United States Patent 9,328,346 (POLYCOMB-ASSOCIATED NON-CODING RNAS) - sequence listing, part 90

SEQ ID NO: 16748 - RNA, 19243 nt, Homo sapiens
accuacaagaguguuugcuuaagaaguuuaugccaaguuauauaaaugaaagacugucauacucucuuugguugacauaagcacagcaucuauaucuuacauugcaaaggacuagucugacuaaucuaugauguuauaugguuuaccuucccucccaaaaguaagcagccauacuggcaaauguccucuuuauccauucacucagcauuuauugugcaccaagagcaccagcacuacauacugcauguuauguguguguaucuauauaguacuauaauacaggaauugucccuguccugaugaagcuuacaauuuagugggaaagucacaauagacaaaggauauacaaaaauauaauuacaaguagugcaaagugcuauaauuuaaaaggggaaaaaaagaauguacugguagagagcagaggaaaaacaagggggcuucuacucacagugaucagagaaaggccucccugguguaguaacaucuagcagugaacggaaagagccagcccuacaaaaauaggagguauaagaauguugcaggcagaagaacagcaaaugcaaaaacccugagggaggagaaaaguugcccuuuuccuggaagugaaagggaaaucaguguuccuggaguguguggugagugaggagaagggcagagguuuggaaaaguauuuuauuuuaaaugcaauagaaagcuguuuugagcaggggagaguaaaaugauauauauaauacgcauuuaaauguauauauaucucauugaggguuuugggggucagguguagagguaaagagaccaguuaggaaauucuagcaguuaaucuaggugggggagagaugguucaauuuuugccuuugugcuaauccacgugaaaauaaaauuaaaugaaaauaaaugucauguuaccccacucccuuuaaacguaaaggaaauaugucuuguugagaugacccuuaagcaaaugaaugauagcucuuccuugucuuaaagcccagucaaauuuucuccuggggauuucuggggaagaggugcuucggccagcacagcaaauccucagacaccuguggaauacccaauggaaacaaguggcauagagcagauggaugugacaaugaguggggaagcaucggcaccacuuccaauacgacagccgaacucugggccauacaaaaaacaagcuuuucccaugaucuccaaacggccagagcaccugcguaugaaucuaugacagagcaaugcuuuuaaugaauuuaaggcaaaaaagguggagagggagaugugugagcauccugcaaggugaaacgacucaaaaugacaguuucagagagucaaugucauuacauagaacacuucagacacaggaaaaauaaacguggauuuuaaaaaaucaaucaauggugcaaaaaaaaacuuaaagcaaaauaguauugcugaacucuuaggcacaucaauuaauugauuccucgcgacaucuucucaaccuuaucaaggauuuucauguugaugacucgaaacugacaguauuaaggguaggauguugcuucugaaucacuguugaguucugauuguguugaagaaggguuauccuuucauuaggcaaaguacaaaauugccuauaauacuugcaacuaaggacaaauuagcaugcaagcuuggucaaacuuuuuccagcaaaauggaagcaaagacaaaagaaacuuaccaauugauguuuuacgugcaaacaaccugaaucuuuuuuuuauauaaauauauauuuuucaaauagauuuuugauucagcucauuaugaaaaacaucccaaacuuuaaaaugcgaaauuauugguuggugugaagaaagccagacaacuucuguuucuucucuuggugaaauaauaaaaugcaaaugaaucauuguuaaccacagcuguggcucguuugagggauugggguggaccugggguuuauuuucaguaacccagcugcaauaccugucuguaauaugagaaaaaaaaaaugaaucuauuuaaucauuucuacuugcaguacugcuaugugcuaagcuuaacuggaagccuuggaaugggcauaaguuguauguccuacauuucaucauugucccgggccugcauugcacuggaaaaaaaaaucgccaccuguucuuacaccaguauuugguucaagacaccaaaugucuucagcccauggcugaagaacaacagaagagagucaggauaaaaaauacauacuguggucggcaaggugagggagauagggauauccaggggaagaggguguugcuguggcccacucucugucuaaucucuuuacagcaaauugguaagauuuucaguuuuacuucuuucuacuguuucugcugucuaccuuccuuauauuuuuuuccucaacaguuuuaaaaagaaaaaaaggucuauuuuuuuuucuccuauacuugggcuacauuuuuugauuguaaaaauauuugauggccuuuugaugaaugucuuccacaguaaagaaaacuuaguggcuuaauuuaggaaacauguuaacaggacacuauguuuuugaaauuguaacaaaaucuacauaaaugauuuacagguuaaaagaauaaaaauaaagguaacuuuaccuuucuuaaauauuuccugccuuaaagagagcauuuccaugacuuuagcuggugaaaggguuuaauaucugcagagcuuuauaaaaauauauuucagugcauacugguauaauagaugaucaugcaguugcaguugaguuguaucaccuuuuuuguuugucuuuuauaaugucuucagucugagugugcaaagucaauuuguaauauuuugcaacccuaggauuuuuuuaaauagaugcugcuugcuauguuuucaaaccuuuuugagccauaggauccaagccauaaaauucuuuaugcauguugaauucagucagaaaagagcaaggcuuugcuuuuugaaauugcaacucaaaugagaugggaugaaauccuaugacaguaagcaaaaacagaaccaugaaaaaugauuggacauacaccuuuucaauuguggcaauaauugaaagaaucgauaaaaguucaucuuuggacagaaagccuuuaaaaaaaaaaucacucccucuucccccuccucccuuauugcagcagccuacugagaacuuugacuguugcugguaaauuagaagcuacaauaauaauuaagggcagaaauuauacuuaaaaagugcagauccuuguucuuugacaauuugugaugucugaaaaaacagaacccgaaaagcuauggugauauguacaggcauuauuucagacuguaaauggcuugugauacucuugauacuuguuuucaaauauguuuacuaacuguaguguugacugccugaccaaauuccagugaaacuuauacaccaaaauauucuuccuagguccuauuugcuaguaacaugagcacugugauuggcuggcuauaaccaccccaguuaaaccauuuucauaauuaguagugccagcaauaguggcaaacacugcaacuuuucugcauaaaaagcauuaauugcacagcuaccauccacacaaauacauaguuuuucugacuucacauuuauuaagugaaauuuauuucccaugcuguggaaaguuuauugagaacuuguuucauaaauggauaucccuacuaugacugugaaaacaugucaagugucacauuagugucacagacagaaagcacacaccuaugcaauauggcuuaucuauauuuauuuguaaaaauccaagcauaguuuaaaauaugaugucgauauuacuagucuugaguuucuaagaggguucuuuauguuauaccagguaaguguauaaaagagauuaagugcuuuuuuuucaucacuugauuauuuucuuuaaaaucagcuauuacaggauauuuuuuuauuuuauacaugcuguuuuuuaauuaaaauauaaucacugaaguuuacuaauuugauuuuauaagguuuguagcauuacagaauaacuaaacugggauuuauaaaccagcugugauuaacaauguaaaguauuaauuauugaacuuugaaccagauuuuuaggaaaauuauguucuuuuucccccuuuauggucuuaacuaauuugaauccuucaagaaggauuuuuccauacuauuuuuuaagauagaagauaauuugugggcagggguggaggaugcauguaugauacuccauaaauucaacauucuuuacuauagguaaugaaugauuauaaacaagaugcaucuuagauaguauuaauauacugagccuuggauuauauauuuaauauaggaccuauuuugaauauucaguuaaucauaugguuccuagcuuacaagggcuagaucuaagauuauucccaugagaaauguugaauuuaugaagaauagauuuuaaggcuuugaaaaugguuaauuucucaaaaacaucaauguccaaacaucuaccuuuuuucauaggaguagacacuagcaagcuggacaaacuaucacaaaaguauuugucacacauaaccuguggucuguugcugauuaauacaguacuuuuucuugugugauucuuaacauuauagcacaaguauuaucucaguggauuauccggaauaacaucugaaagauggguucaucuauguuuguguuugcucuuuaaacuauuguuucuccuaucccaaguucgcuuugcaucuaucaguaaauaaaauucuucagcugccuuauuaggagugcuaugaggguaacaccuguucugcuuuucaucuuguauuuaguugacuguauuauuugauuucggauugaaugaauguaaauagaaauuaaaugcaaauuugaaugaacauaaauagaagugauuuauuuuuuuauuaucuuaaagauaggaaggaauuaguauacguaucagguguauaaaugguuuaaauuuauuuuaacaugucagauguguucaaguugucauauaaauaaacuauguauguaaggaauggguuaaaagcuguucugcugagaaacugaagcuauuuaaguauauaacaaguuuuaguauugauuuuuaaguuagauguuacacaucuuugauuuucaaguuaugucagauaguagauaugaauuguuuacuuaaaaaaauacauguaacaaucuacgugaaagcuagcuucauaaaaaacucuaggaagaccuucuugugcuaacaaucaacaaucuguucagcuacacuuggucagcuacauuugauaauuugauauguaugcacaaaauaacguagugaacaaauguguuuuaacuaaugucucaauauaucuaguguaagcuggguauuuugcauuaaccacuucuuuucugugagguaauuauaccacacuugccaaggggauuucucuacagaagcucucaaacugaucuuaccuugcuauacaacauaguagccuaucaauacugguaaaacaaucuuuuagaagccaugaucugaauucacagaguaaaugaguuucugaaucuacauuaccuguuuuugaggugaaggaauagagggauggaagaaaugcuuccaguucaucagcauuuuuauuggauggcauagcuccauuagauuuucucccuuuucaauuuauagguaaacugcauuccaaaaaaaaaccccaccaugcaccuccuugguuauguaaucacauucauuaagaaacagugcugucugaauaguuacagaguaagcaaauguauuaaauagguauucuaauagggcugaaguaaaaugcuauucuuguauuugaacaggaagucaucuuggcuauccuucacagccgaauuguaaucccacauugcuuuucucacccauccucugccguauaccuaaauaauacaacuauuagcaucaccacaaagccauuuaaauaauauuuguagugggucucaaaguagauaacagaguaaaauauacuguaauugaauauaguuguacuuacaaccugguaguauuuaccuggagagaaaaaaaugguacaggcuuccuaauguuuguuugucaauuuggauggcuguacagucauggaagugccuucuauaaccaguuggucaguuugcuaaacuaaacaauucauuugcuaguuuagcuuuugucuuaucaguacagcaaaucuguuuucuaccucugcuuccuaaguucuuucuaccaccuuuuccucgacuacaaacugauagauguacucuaaacuuggauauaagcacuagcagcccuucagacauguuuuagauuucagauuccuccuuagagguaacaaggggagaaagugcuucauucucuuuucuagcacccugcacaaauaccuagaggcgaacaaaccacacuaucaaaaccucaugaccaccucucagugcgagcuucaaucuuccaauugauggugauucaagcauaaaauuccaaaacuuuuauggagaagacuaauuauaagggcaauuuuuuauaagauuuuagggcaucugucuugaaacuuuuuucuuuuaaauagagaugggauguugcccaggcuggucuugaacuccuggguucaagcaguccuccugccucugccucccaaagugcugggauuacaggugugagccaccaugccuggccauuugucuuguuuucuauacuauucaaaucaucaaguaagccagcuguuuauaauccacaugaauuauuuuaauaguuacuucgagauacuccaugguacuauacaaaaagcaugaucaugaacauuaaagcugauggcaggaagaauuuaugacguccagagacaaaaugaauuuaaaucauuuauuuucacuuauuacuaaucuuacuacagagaauaauacaauacuauaauguaucauccucaguaaauuaaucuucacuuagaaaauguuacugauaaaauacaacauuuagaauuuucauuuaaaaauacaaauuuuaugaaaauauuaagaauuuuuaggaugggaauuauaaaagucaaugcugaacaaaauucuacuuuuagauaguauguaucuuaaaauauuaugaaaaauauucuuuauucugaaaacaaugucaggaaagaauaccugaguucucuaaaaccacuaguucuaauuucaaauugcuguuuugguaacauaaagaaaacacauuuacaauuuaacacugcaguuaccugucaaauaauuagaauagaauaaauguugcauauacauuagguugaacauuauauauauuuuaaaacacagggugguuucauuuaaucuuuuggugaauuggaucauaaguccuacauucuaaaaccaucuggaaacauuuuucugguagcccugaaaauccauucugaugccuuaucaguagucauuaugaccaaaugacauuaguauuuuguggccuugauaguuuauacaacuuaauauauuugaaggugugaugaaguggcuccauccuuccauuuguuuauauggucugaaaucacaguucugcagaguggacauguuuucucucuguuaaaccauaaggucaugcacucuucacaaaauauaugcuguaauggaauuaagaauuagauuugauauuugauaaucauuuuaaauccaucacauuguagggaaugaaagggauucuuuuuuuuuuuuuuuugagauggagacugaagucuugcucugucacccaggccggagugcaauggcaccaucucggcucacugcaaccuccgcccccgacugguucaagugauucuccugccucagccucccaaguugccgggauuacaggugaccaccaccaccaugcccagcuaguuuuuuuauuuuuaguagagacaggguuucaccauguuggucaggcuggucuugaacuccugaccucaggugauccacccaccucagccucccaaaguucugggauuacaggcgugagccacuguguccagccugaaagggauuuugaagagcacuaauccccucauuuuacaauugugaaaauggagaacguaugagacauucaagaagacaaagagcaguaugauugguagagccacuaguguucuggcuguaccauccauuuaaccauaaaagcuauccuuaggugacaccuuuaagauuaaguaugauaacugcuuaaggucuuugaguuacuaguaacugccauaaaguauaggaaagggccacaauccaguaacaaaugucaguauuguucuacauggcuaguauccaauuauaaaauagccuguuuuuuaaucacuuugguauucaaucugccaguugaauuauuuuuuccccuucauacgcuccucugcauaaaaauuaucagaacauaagggacaaaacuuagccaauccacuaguauguacccugaaugcuaccuuccacuaaacacuagauuuuuuuuuuuuugccuuacagcaaacauaaauuugacuuuugcaagucacagagaacuguuguauuuagguuuuuaaauuuaaaaauguaauuaccugacaaaugagaagaauuggcuucugaaauucagcuugacauauugaacaaauaucauccacaucugaacacugucucuugcuggcagccacuccauaacucuaugaagauaguaaguucuguucaucuacaaauuucuuucuuuccuguuccucaaauuacauaaguaaugcuguacuucucaaaucucccuggaaccaggcauuugaaaaacuucccaaaggauacaaacaucucaaagcugagccauauacagaaccaccucuugagugcaccaaaaugaaaucauuaaauaauacauaauaggauuuugaaagauuguuagaucuacuagcuuuacaaaggaugauagugcuucaaauucaacauaacuggcuuaagagacuaagcaaucugaaauguaacuauuauaaaaucuauagccauguauuauuugacccaggacugccaaauugagcuuauuaccugcagcagugguucauaaagucaauccagccagagguuggcugguugaauguaacucauguggaaagcuugcuuuaaaaauagauuucucuguuccacacaauaucaauucacuaggaccagacauauugggaugugacccaguaaucuauuauuugaaaggucuccaagugagugcaauaugaagaagacuuagggaccacugaagaauuuucugccacuaggucuaaaaauuauucgaaauuauaaaaagcauuuagugcuaaacauaaaaaaguuuuacggagaaacugcaacuguaaaugucgcuuugguagaauaacuacugucaaaacuaacugaacaaaaaugcaauuauuugaauuuucuucucuucuaauguccuaauaacaaguuacucgucucuaagauuuuaaccuccucaccagauucagaacuuagucauuaacuagaugugaugucaauaacccucagugaaauuuggagaaaucaaaauguuacaaaugaaaccugcuuucuguagaaaugauggggaagagguaacuaaagagauguaagaacacccaagucagucacggucaugaggguaaagcaugacuuaacauagcugaaguuaucuaaacuucuuguacuaaaacgucucaggcuaacaacaucaaaaucaaaguaaaacucaaaggauaaagauauuaaaaauugagguuuuuugaaacugguaauaaagauuucagaaauaagucaggauacuguuagaugaucuuggugucaauuucccuucaguaaggugucauuuagcaaaguacauuugcagauaauuaugcugacaagcuuuuaagacguuacucaucuggcaucuuggagacucccucuccagauaguaacugccauuucccugguaaaggagacuugaacaaauccaaguauugaugacugauauccucucuguaguuugucucagagaaagaauaucaggguauuuucuugagaguauuucggcacaaaucuuacaagaccaauuauaguaaaaugguugaugcucacauaaucaucaguugaacugacuuggacaaagcugaacucucugaauuuuauuaugucuugucuagagaaacaagcuugcauaggauguagcaaaguuuguuucuacauugcuaacucuaucuuagggaaaaggcccuggccaguuagucucguuuacuuuguagacauaauucuuuuuuuauuuuuacgguauauuauucgguuggcauucuuuuaagucagucuccuugggcccugaugaaaugacugcaaaauugagaaucaaacccugaagucugcugaccacacauagguacuaggaaccuuucaggcuacuaagugguaaauuaggguucucuaugacauccuuucacugcaauuugcaacaucaauagaaucacacaauaauguuauaaaugacaccagagacucaauuaauuguuaaauuucaugccaugaacguauuuaugcacauauaauugagcaauggggaaaucugcuccaguaagaaaacugcaagagacaugauuuuuggcagugagcuuucuaaacaauaaauuacaauggaaggauuuucacaggugaauaaggaguuaauaggaacaaacaaagcccccauuuguggauuaaaaaagaggaacacaauuucauaagauuguuaaggguuuacaagccuuaaaaauguccaguggauugaagaggcaagagacaaguucaaauauauaagcacugcaacaauuagcaggugguugucaaugugugauucaagaaucugaucacagagauaaaacuccuaaauuauuauagccccaagugccaaaguacuagaaaauaaucaaaguaaaagaaaaggaucaucuauuuaugaaauccauucuuguaaaacugcugaacuaaaaaaauuuuugcagugaagaaaggugaagguguuuuucuuaacugauaaaaaguacuuacugguuguguaaaaaauauucguaaaaccugucugaaaguucucagaugcccaaaaaauuccaaaagcugaaaagagaaauaagagaucauuuauuaauucaaacaguccuauuugcuaaacccaaaaaccaaagcugaaaucccauaacaucaaauccucauauuaacuuaauguucauuauaugucacaucuaaucauuuugugcugaguauuuuauucaauuuauagauuugagccaucucagcaagcugaaguacauuuaaacaccuagaguaacaauuugaucaagacaaauacaacuaugucaaagucaaagcaauuuuaucugauucaccuguuuuuaacauuuagauuuuaaaguuucauaaagugauuauuagguugaggggugcaggcauggagagaacaggacaagauacucuacuaguuuaagaauuauguguaugacaauguuacuguugaggauggguauguucuauuccacuuguuuucccuacuuagauaauccacgcuaugugaaggucgacuccccuucccuccagugaaaccugaggaccgcuggauuaagauagucuauuuccguuucuccauuucuaaacaaauauagaaccugcuauuacuucaaacuagugauaugaagauaaacuauaaaacuguuaaaagaggaaaacaguaguauguaucaguaaucauuaaugugaaucaugcagugacaagauuuguaauguuaccuacuuuuaauaugagguagaguaaagccagcaguaucccaagacuccaucuaguuacguuaccaaacuccccauagcuuauaagguagcgaaaccaaacugguaugggaacaaaaguucgguaguauugacacaauucuucuaaaagcauauaccaguaacccuaaaaaauaagaagaaaacaaauagagcuacccaaacuacuuaacuacauagcacaaacaauauuagacugagaacacugaguauauuauacaauaauauaaauaacuauaaaauuaaucuucauaaugauuaugacugaaccucaagcugguucucacauauuacagucacugaguggccugcuuugaaagaauuucuagguuggacgcaguggcucccagcacuuugggaugggcagaucaccugaggucaggaguucgagaccagcuggccaacauggugaaaccccgucucuacuaaaaauacaaaaauuaacugggugugguggugggcaccuguaaucccagcuacucaggaggcugaggcaggagaacugccugaacccaggaggcggagguugcagugagccaagaucacaccacugcacuccagccugggcaacagagcgagagacaaucucaaaacaaaacaaaaccaaaaaaaaagauacaaugagaauguuuuauguauacugcaaguaaaaccuaugugaguauguuuuugcugauuauaagaauuuaaaaguuuuuagugcauaugggaaaccacugaauaauuguacauagucaacugucaauugauaaugcccuggagaacagaaguacacaucuaaauaguuucccacauaugauguggggacugauuuuaaaauuauucugaagcaaauauaauucugauuuuauccaaauagguuaauaaucagguucaagugccugaacaaaugguugcuaagcugaaauaauacagauaauuaagcuaguuagcaaacugaaaaacugcaaaaggaggauucauuuaaacaaagacuaaauagcauuaaugugauucgauaacaucacuccaauaaagcauaagugaguuucuuaccuuagauuuaaaaggcaugaugaaagaaggcaccaauaaaauaaggcauuuuaagcccaugaaaaagaauuucagaaugaagucuguaauuccaacaauccaaaauacuucccagaagcucaaaugguccaaaguaggauuuaaaaaaauuaagcuaccaaaagaaaaacaucaaaauuuaucagagcaacauacaaagauaaaguauuaauaaaggguuuuaauuugcuacaaauauuuuauuuugauauguaaaaaauaugaguuuggcaggaugucagaguucacaauaauggaauggaggaucauuuugcuuaaagagacuuuuuaaaccuguuuggauuuuagaucuucccuucauagaauaaggaaaaagucuucacgguuugucauaguugacaccuuucuagccuguaaaugaaaaaaacucaucaauaccagacaucugcuguguuuuucuuaaccaauuccaaucaggauuccaucucuuccuuucaaugaauugcuugucaagaucaucaacucccucuguauggcuaaauuucaaggucacucucuuuuuccaucuucccucccugaauaauuuucuuucuagacuuuuaacacaacacuuuucuauuucucauauuucacugcugguuucuucuuagucuccuuugcuguuucucuucuaauuguggucauguccaguacugggcucucuaucuacacucucuuuccuggguuaguuuuguccaguccugugguuuuuaaauaucaaccauaugcuccugauaccaaaauuuauugccuuaaccucuacccugaguucaugacauauauuuggaaccacuuucuuaucaauucuacuuagccucucaaacuuaacauguucaaaacaaaauuauugauuuuucuccucaaaaucaguuccuuccucaacccaaugaaaugacaccaccauccagccagcugcuuagacuaaaaacccagaggucauucuugcuucucuccacccaccuauccaauccaguccaucugagggauacuggcuccaccuccaaacuauaucccagauuugcccaucucuccaacuccagugaaaccaggucuucuaauauucuaauaaaagcugaaaauucagaauacucccauuugacauggagacuuaucagcuacugucauuuaguaaguguucuuacuuucagaaacaacgaccaauaauaacaaccuaaugguacuuuaaaaauacgaaauauguaaacaaaaacucagguaucaaaaaauuaaauauuuauugagcaucuguuaugugccaaggcacuggggauacaaaaucugaguaagucacuuaaagcucucacuuaugaggcugggugcaguggcucacaccuguaaucccagcacuuuaggagguggaggcaggcagaucacgaggucaggaggucugaccaacauggugaaacuccgucucuauuaaaaauacaaaaauuugccaggcgugguggcgugugccuguaaucccagcuacucaggaggcuuagacgggagaauugcuugaaccugagaggcaaagguugcagugagccaagaucaagacacugcacuccaggcugggcgagagagugagacuccgucucaaaaagaaaaaaaaaaaaaaagcucucgcuuaugaaaggagaaaguuaaaaacugaacugaacugaauacaauaaguacuaugugaaguaagauacaaagugcuaugaaauauaugauuacauuaaaaauguaauuguguauuuggaccucuaauuaccuguaauaaagugacugagaaugaaagguguaauauaaaagaacagaagauccugcuaagaauaccaguaaccaagcacacugaaucuuugaggaccuuuccugaaagauaaacaauuuuauaauguuacuuugauuuugccagaauuuuaaauaucauuaaacuguuuuacuuuaaugacuauuaacuuagaauauuuuucuaaaucuuaauauagaauauguuaaacuguacauaaucaucacaguuacuguuuuauacuacuuuagugaccaaacagaacucuuauauuaaacaaauguuuaaaauacaaguuucuucacuguaugaaaaacauuaccuauguuucaaagaagccaagucuucucucaaaaaaaaaaaaaaaaaaagaaaauuaaauuaaauuaaaaaaaaaaaaaagaagccaggucuucuacaagcugacauaaaggacccacccaggacgggggcaguggcucacacuuguaaucccagcacuuugggaggccaaggucggcggaucgcuugaggucaggaguuugugaccagccugcccaacauggugaaaccugucucuacuaaaaaaaguacaaaaguuagccaggcgccguggcacgugccuguaaucccagcuacucaggaggcugaggcacgagaaucacuugaacccaggaggcagagguugcagugagccaagaucacgccacugcacuccagcccgggugacagagcaaaacaccgucucagaaaaaaaauggacccacccacaaaagaaaauuucaaaaugcauuuuaaccuugacucacuugucaagguuuauauuuuuuaaauucucagauuauaagaauuuaauaaauuaauguuuuaaucucacuuuuuuaauauauggggucucgacacauugcucagaauuccuaggcucaagcauucuucccaacucagccucccaaguaguuguaaucucccuuuuuuuuuuuuuacuuuuuugagacugggucucacucuuucacccagacuggagugcaguggcaugaucacaacucacugcagccccaaccaccuggggucaggcaauccucccaccucagccucccagauagcagagauuacaggcacgugccaccacgcccagcuaauuuuuuguauuuuuuguagagaugggguuuugccauguugcccaggcucgucuucaauuccugggcucaagcaaucugcccaucucagccucccaaagugcugagauuacaggcaugagccacugugccuugccuguaaucucacuuuuaaagucaaguuuaaugaaguuuuacuaauuuuaaaucauuaagauuuuucuaguuugauagguuuaacuauaaauuuccaggucagaaugcaugauacuuuacacagacauagccauuuaaaguugccuuaaggugaaauuuuagaaacucauccucuuuuucccaaugauuuauaugacgggcucguguaacuuauguuauggaaaaauuccuuggguuucauuuucucucuuuuuuuuuuugagauggagucucacucugucgccaggcuggagugcaguggcacaaucuuggcucacugcaaccucugccucccggguucaagcaauucuccugccucagccucccaaguagcugggacuacaggcaagcgccaccacgcccagcuaauuuuuguguuuuuaguagacaugggguuucaccacauuggccaggcuggucucaaacuucugaccucaggugaucugccugccugggccucccagaguguugggaugacaggcgugagccccugugccuggcccaggucuuuuuuuuuuuuuuuuuuuuugagauggagucucguucuguagcccacgcuggagugcaguggugcgaucucagcucacugcaaccuccaccucccagguucaagugauucuccugccucagccucccgaguagcugggaauacaggcacaugccaccacaccuagcuaauuuuuuguauuuuuaguagagacaggguuucaccguguuagccaggauggucucaaucuccugaccucaugaucugcccgccucggccucccaaagugcugggauuacaggugugagccaccaugcccagccacuaaaaguuuuucaugaugauggucuuacuuacuauggucaaaguaacugauacaacaugaagggacuugccaaaucagaucagauaccguguucuaacucuuuuaauccuuuuuacuacuuuaacaguaaccaauuuuuuuuucuuacaaagaagguaaggugaaggaauucagcauuaggagagauaauuuauuccaggauuuagauaacaaauuuaacauaacguggauguuacaauauauccuauuacuuccuauuucuuucaaguuauuuccuauuucucucaaaauuauuucucuaaaaucuauggagagaaacaguuaauaauuuuuuaguugcuuguuauacuuacucuuagaaaaaccugauuuacaaugcuuuuguuugcauacauaaaaguuguuagcagcccaauuccaagagaaauuccuguuagaaaauaaguuccaguuaauugaaagaaaaaaaaaucaaagaggauuauauaagcuaacaaugacacaaauuaaaaauaaacauauacaauaauaaaagcucacagaaaauaaguaacuggaugcauuaaguagauuaccaauaaugaaagaaaauuaacugaauuuaggaaugaaaacaagucaauguuuuauuauguccuaccuguuauaugcugcauaacaaguuugacgcucagaaucaaaauauauggaagacuuuuuugcagccacuugaagagauagcggaauucugagaaggagcuacuaccaugaucuccagauucugcggcaguaucaucagucagccuugcuucacugugggagugaccccguaagcgacuguguacacauccaugggcacagcuauggacaccugaccuuauauuucuggagcuugcauuuucugcacauucuuuagguauggaguuuaucuggauaugaacaucuccagaaugagggcaagaacccucuccugucaaucuuguguggacacacugagggguugaggcauccucacugcuuccaguuccuggaggacugugcaguuggcuacgauuggcuugcauggcccuuaaauacuuuuucucugacccagaugucuuugcuucaggccucugucuccuaaaaaaucaaauaaaagauauucuaaguaaacaggcaguuaaauaccagcaguauauuccucacuggguauccuuuauucacuaaaggaguagcaaauaaucacaacagaugaauuuucagguuauuuaucacuggacuccucccuucucccuuaaugccaaggcucugcugcccuacacaaaugaucuuuuagggaacauuugcaccaaaaaaaaaaaaguugagcugcaaaugcuuccaguucucuaauggcagaaggcauccgcaaaacagucaugaaguauggguacccagcagauguuaaugagcaccaguccucacuggguacucugguacauuuacuuuucccaaauggugcaguuucaucucugauguagauucuacaucaaagaaguuucauaaggaagagugagccaguauuuuuuaaugguuggaaauguuaggaaaaaaaacaacauuaaaucuuaaugccuuauuaucaucauagguaacuaauaauaaacacugcacuuaggugaccuacaaauuagauuuucugcucaagcagcuuucccaaagcucauaaaguuuccaauaauuaauggugccaccaauaauauuaccuccccgcgcaaaagaauguuaccuaaauacauuuaaagcauagauacuuuggagagucaccacguaauugcuagguaacucuuuagucugaauaagcaguuacacaguccgcccaauaaaaugccaccgucggugguguguguauuacggagggaggggugugaggaaagaggacucuagcagagaaagaucucucuaauaaaugauccaguguggaccuccuagaaacagaagaacagagucggaaucccagcugacaaaacgcagaggcuaucccacacugccgugcuuuucccguuugucuaggaggaggcuagaguuaacgucagggaauguucugugucauucuauuucacucccaggacugaacaguggugcagucaccgugucuggcgguuuggguuucagugcuuuucacuaaaggcuuucaccgaggccccgacgccacggguguuauuucgucaaaacugaagagcgacguuggacagcaggcuuucagugucuuuucuauaaauaacauagaacccucccacuuuccuucaugcacagacaagaaagaggagaaaaaagggaagaaaauucaacacaacucuuccggaaucuccgagggcagaguucuccacccacguccgagccucgagugccuauucuccccagagcccccugcgccgcggccccucgccgccuccuccucugcccgcuucccccaggccuaaccucucaugaccagaagcggacggaggugucgggagcgacagcaagaacagcggcauacaccgccuccagcccuucagucggggccaucaaccgcaaaccccgcaagcucuucucucagcccggcggcaacggcggcggcgcgcgcgcuccccggacguucucacgcgcgcgcgcgcgcccugccccggcuccaccu

SEQ ID NO: 16749 - RNA, 2747 nt, Homo sapiens
cuguuuguaaggauuuaaucaaggucuguauauaguuugguuacuaugucucuuaggucucuuuucauuuauagauuccccuugugauuuauugaagaaacugggucauuuguccuguagaauucucaaauuuugauuuugcugauguuauccccauaguuucauugaccauguucaucuguucucugaauuuccaaaaacugguaguuaaauuuaggugguugaucuaauucagauuaaacucucaguauugcaugcuuugaucaggaggcauaauguguaguuuguguguguguguguguguguguguguguguguguguguguguguuuaagugauguuaguggucacugaucauugccuaugucagcauuucacuaccaggguaauuuggcaaugucuggagauacacugauugucacagguugggggagggaaugcuauagguaccuucaggaguaagagucagcacagcacagcccccuacagcuaagcguuaauaggccuaaaaugucaguagcacugagguugagaaacucuggccuacuuuuauaauuucaucagguguuugugaaauggucuuauucuaacuguuauuucuucuuucuuuguuagcuggaauucuuucauaaagagaaacucuuugaucaguuaguuacccaagguauaguucauacaguaaaggcaggauguauguuugauucuuuccuaguuuucaaaauaaugaauuaguucccuagcaucuuccagaauugaccaaugaacuuuguguguguguguuuuuuucuuuuuuaguauauuaugaacuuauauguuuuaacacauuuguguuucauuucaucgcaguuauuuuuauuuuauuuuuauuuauucauuuauuguuuugaggcagggucuuacucugucacccaagcuguagugcagugguauaaucucugucuacugcagccuugacuucccggccuccagcaauccucccaccucacccucuugaguagcugggaccacagguacaccaccaugcccagcuaauuuuuguguuucugguagagacgggguuuugccguguucaccaggcuggucuucaacuccugagcucaaaagcaauccaccugccucugccucccaaaguguugggaugauaggcaugagccacugcaccuagcaguuauuuuuauugaugcucaauuuuucccuucguugaaugcuggugcagugaaugcugggugcaucuucauguugguuucugaguccuuuugacaugaccacauggucugguguuguacgagagagcaaaauaaggaaacugguguucuaugcuuaucuuguacauuuuccccacacuuggaaucagccauuccuccagggagugcagguucacagucugggcucuaagagaauuauaaggucaauguggucaucuuuuaguauuaagucagauauucuaaauuauuauuuacuuccuacauuuggcccaagagucuaaccagauauuuugggaaagagagaaggaauuaaauaaauaaaucucaugguuagaacugaagugauaacuauacuuucacaaggaaauauaacuuauaaaccaugcagaauagaaaauuauuuuuguuccuuuagauuucuaaaggaaugaaauaagcugugggaagaaacuuuaacuggagcaucuuaccaguguuauucauguuuuaacucugcuucaguaguuuuucagguuuauuacaaaccugcaguagccaacugaacuaauuaucucuaaacagggauuuagccaguggacuaggcacacugaagcuuugugagaggggaaauugauauuaacauuuuuuccagcuuguuuugagcucgauauauucacuuuuuuuuuuuuuuuuuuuuuuuuuuauugagacagacucucgcacugucaucugggcuggugugcaguggcacgaucucugcuugcugcaaccugugccucccggguucaagcaauucuccugccucauccuccugaguagcuaggauuacaggcacacgccaccaugccuggcuaauuuuuuguauuuuuaguagagaugggguuucacuauuuuggccaggcuggucucaaacuccugaccucaugauccgccugccucagccucccaaggugcugggauuacagacgugagccaccaugcccagucgauauauucacauuuuuaauaggaauaacuguauacuaaaaucuauuuuagugcauguuuaagauuugaagauguaauuugacucaguacuuuccaccuacauuuuuuucuucauucugugccugcuaagacuauucuaauacuuuauuauaguuaacccccgugaaaagagcucccagagcuuacagugcauuugauugauguaacauggacuauuuauuauuuucuaaauuauuuuguuuguauaaagcaaucugaagaggauguaagucaguuugauuccaaguuuacacgucagacaccugucgacagcccagaugacucaacucucagugaaagugccaaucaggucuuucugguaagugaaagaauuuccauguagucaugggaaauuuuagugugaggaugggcucuucaaagaaaauucaguuugcuugcuuugcaguucauguagguaaccuggcccacuuuuuuuuuuuuuuuuaaauaagccaugccuuuauaacuuauugaugccuacaaaauuuauuuucauaauccaacauuuuauuuuagcaauuagagugggaauguaca

SEQ ID NO: 16750 - RNA, 75429 nt, Homo sapiens
acuggcgaaagugaugagucuaaaaaaguagucccuccgguuccucuguuuccccccauguggcgucaggaagcgaggcaccgggcgcacugcgccccgaauuccugcgcccgccgcgcgcggcgcuccguggagggguacauaaggcggagggggugaggcgacugggcggaguucugucgccgggauccuuccgcugggcucagccguuuccggagucugcgcugcgcccgguuccgccauugcggcucuccuggccccuggagccuccgcccccgacccgagcucuuucgucugccugccaguuuccugcguccccggagaggauccugcugagcccagccuccccccuccccuucuccuccucucccuuggagagcccgggcagccacugccccgcagccccagugacaggaggagaccauaacccccgacagcgccauggcccagauucugccaauucguuuucaggagcaucuccaggugcggccgggcccgggcuggugagggcuguggagaaggugguaggaaggauggaagacgcuggagucugggcccgagcaguaucggagcuggaggggcggggggguugucggugauugggguagguggaggagggggcacuaucuuggaaagcuuaaaauauuaaaugauguggggcuuggauggaaaggacaggaguuggggugcaaagagcugcaaggaccaggccuggauccaaaggccucucgaucuugcuuccuggauggccagaacugcgcguacaaacucucuccccauuuuauucauuucauucauuuggguaggggagugggagggggauucucccuuguuucuaccagagcaaggauucuuauccccugggccagugcggggcugucaccuuccauugcucuccucuuucccucaucgugucugcacccaggaguuguggggcggguggguuggggaggagcaaccuuuuuuuucccucccucugcggcucucaacugagaaaggcaccuucuccggugguggggguugggggugguggugaggcgguggcuuuucucuugccuucccugaggcaguagggacagaaggucacugaaagaacggaacgaggguagaaugggagaacgcauuucuuagagcuaugucaaucucagagugugugcggucaaacucccuaaggaaacucgccuccccuucccccuuuuuuuauuucucuggggauguuguggcucuuaaccccucuuugguucuggaagguaggaaagagugauacagagguuaucuuuuagucuucucgaguaguagcagguaguuuugaauaucuucuucaggaucgcauggaauugaacagagcccuggggacagcacagcugcucugagaccugcagggcuauuuggucugugacuggcuucccuuuaguaaguucuagaguucuuccccaugguuccuuauccuggaggcaacauauuguuaucuggcaacaugccaguggcgggccuaggcaggugaccauuggaaggcuucacugaauuaaaccucuucagagcuuuugauuuuccugugucaccaauccuguuuuuuacuguagcuuaaauaauuuauuccuauuaauuugcuuucuucccaaauauccccuuaaagaaaccugccucagcucagucgucugaagggcuaauuccauaaugacagggaaugcagugguuugacaugacacugauaucagugaccuauuagacacuuuaccauugaagaccauuuuuauuuacauuuccccauuggcauagcauacauaaaggauucuuguuaauaaaagguuuuaacauucaggcuauaaguaacauaauuucauauuucuuugcaaguauuaccauguuugcacuagcaaggacuuauuuuccuuuaaggcuugaaauguaaagaauaauaaauuuuuacccauaaaaugaguuaaauaaugcacuuuccucagucaucuauaauuuucaaauaacucaucugaaguaauggaauauaccuuggcaauaaaaacacuuuuacagaggguuaaaaauguuaaauaacaaaauggacauuuuuuuuugaucaauccaaguuuaguugcugugguugcuuuuguuaaagugggguggcaaaugaauguggagaguugaggggugcuguucuuaagugugaggggaaaacgcgggcuuauuuucauauuaaacugcaucugaaauaucuuucugcagacaaauguuuauaaaccacacagagaaucaaguacagcugcucuuuauuuuccacggcagauguguagcucacuacuaaaucuuguggugguuggaguaauagcuuuucauuucuuuuaaagaggagacaagaauuguuaaaugaucccaaagauucgaacccaaccuugucacuuauuaaagacaaauuuaauacaugucuguuuuguaacuggaucaaaguuucugcagaugcuugaaugaagccauuuucuucucaaauaauuugaagauuuugaauauaaagcgauuugcaaauugaaaaauucaguccucuguguuuuggauugcuaugucaugccuaaacuuaagcuugcuuagcuaauaugacugugcuccaguugauuaauuguggagcccaaauaacuacagccucuuucaugauaauauaucuccuaacuucauaucauuaucuccucccuuuuuaaaaauuaauaagcauuuuguuuuuuugaggagacaggguuuuugcuggaggucaguggcaccaucacagcucacugcagccuugaccuacugggcucaagccauccucccaccucagcauccugaguagcugggacuacagccaugagccaccacaccuggcuaauuuuuguauuuuuuguagagauggaguuucauguugcccaggcuagucucgaaugccugggcucaagcaauccuuugccuugaccucccaaagugcugggauaauaggugugaaccaccgagcccaacuaauaaggauuauuuuaauuggcaucuuuggucuuugaccucugagcuucuaccaguuugcuaaguagcagaaaacuuucugaaacacguaggauaaaaacuggaaacaagaaauggggaacuuaagugugaguguagaguuaccuugugaaacuguaaaugaacuuauuuuuauacccuuuaacuacauuguccaacugaaggaucucuugucaucaaagcuuggaccuacagcaaaugaaugugaauauaugaagauuucucuuuuccuagacuguuuagacugauagcaguuaauaaaugagugccuauuugagcaagauacuguuggaauugaagauucuauaaaaauccuaggcuacauauauaaaauauugccugugauucuuaauuuuuuggugauuuucaauuuucuggcacauuaaguaucuuuaggccacuugacacauuccauuguauuccuagauucuuugggucuucaauuaaaaaucucccuacccuguucuuuccccuuugauccauagaugcaggcauggaauguguuguugagucaaauguuagggguucuugcuauaguuaguucggauugugaauagaaagcaaugcuaaguacugggauuuacuacaugcuuaguuguacucucuggaagagguagacuuccuggaauuaugcggcagucuccugggaauagcuucuaaguuuaaaauguaucauauucuucagaauuuucuugauggucaguuuacccagcuuaaagugugugguuaauuuuagugaaagugcuuucacucugauuaggaaauaagacacagaaugguguguauguagaacacaaucauuuucauuugaguauuuaggaaaauucacauuucaggaaccaugguaguugcucuugaacaauuguuucugaccauaauuggaauuuguaccuugcuuuuaaaagauuccauuuauaucgaauccucagcuucuuugcaaaauuguuuuuuccauacauauguuuauauguuauucaaauuauauuuaacaagguguuuucccugucauuguuaccguuguggcuuuuucucuuugaguuauuguccaguagaacuuucuucaaugauggaacugucuaccagcuacauagggauauugagcacuugaaauguggcugaugugacugaaaaacuaaauuuuugcuuuaauuucuuuuuaauuuaaauguaaauagccacaugugacaauugacuccuacauuggacugcacaauuauaggccaugcugauguguuuuguaaguuugaagauuuaucucaccacucauguuuauguauuuagaauauuucguuagcuaaaauuaaaacacucauuguucaaaaguuuuaacugaauacugucugucuuggaaagugguggugaugaacaaugacuagcagcagacuucuugagaccuuauuaugugcuguaaauuuggcuagguacuuucagaucuucacucaauccccccagacaccuuucuaaaaagugagacucauaaaguagugggaaugcuguccgaaugggauguguaccugagucuucugacacaaaauauuucaaagaaauuggauaauugaccuuaaaaaaagaaguuauacaguauccuagagugcuuuuugucuguuggacuuaggcccagagaggugaguucucucuacuuguuuauagauuaacaaugugguauaguagacagaacagggagggcuuuagggguuguugaaacaaaugcuguccaauagaaaaauaauaugagccacauacuuuuuuuuuuuuuuuuuuuuuuuuugagacagagucucacucuguccucugucaccuagacuagugugcaguggugcgaucucggcucacagcaaccuccaccugccagguucaagugauucuccugccucagccucccaaguagcugggauuuuaggugucugccaccaugccuggcuaauuuuuccauuuuuaguagagaugggguuuuaccauguuggccaggcuggucuucaacuccugacuucaaaugaucugcccaccucgaccucccaaagugcugggauuauaggcaugagcugcugcuccuggccucauauaaauaauuuuuuaaguuuucuagcagccauauuaaaagugaaaaaacauaaaauuaauuaauuuuggguuuuuuugguagagacagagucuugcuauauugcucaggcuggucucaaauuauugggcucaagugaucugcucgccuuggccucccaaagugcugggauuacaggcgugagucaccaugccaugcccagauaaaauuaaauuuaauauauuuuauuuaacuugggauaugcaaaauauuauuucaauauguaaucaguauaaaauuuacuaaugagauaccuuacauucuuuuucauacuaaauuuucuaaaucuagugugugugguuuuuuuuucuuuuuuuuugagacaaagucucacucugucgccaggcuggagugcaaugguggaucucggcucauugcaaccuccgccuuccagguucaagugauucuucugccucugccucccgagucgcugggacuacaggcgcgugcuaccacgcccagcuauuuuuuuuuuauuuuuauuuuuugguauuuuuaguaaagaugggguuucaccauguuggucaggauggucucaaucucuugaccucgugaaaugccugccucggccucccgaaguguuaggauuacaggugugagccaccgugcccggcuauguauauuuuguacuuagagcauauaucaauucagacccuauuuucuuuggaaauccugguccguauuuagaguucauaaaauuuacaguuagaaaggcagauuuggggcuggggguaguggcucaugccuguaaacucagcacuuugugagccaagguaggagcauuguuugagcccaggaauucaagaccagccuggguaacagaguuaagaccucgucucuauauuaaacaaacaaaaaugaagaaaaaggaaagcagauaugcaauacuucagugaucccaaacauacuuaaguuuuccaguaauugaaucacuuacugguuauuauuuaauuuuaauuacuuuaaaauuacgguaaccacauuucaagugcucauuaugguauguagguugugacuugugguuaccauauuggacaacacagguuaagucuaaccucuugcuuuuuuuucucugggaaaugggcauacuuaucucacaaaguuauuaugaggaucugagaucauguaugugaaaguacuuuacguagcauuuuaggagcauuaauuauuggcuaaauaauuuuuguccaguacauuuuauucagguaucucaaccaaugacacaauauucauuuacagauccaguguuuuaugguguauaaguauuugggguuaacacauuuaccuaagauuugaguacuuacugcagaugaggaacuguguuagacucuagggacaaggugguaaacaagauggacuacaccuugcauucaugcuuccauugaugaguuggcaaaggcuguacacuuguuauuccaaccauugauguugucuacuugauuguggaucuuuuauguguucgaacauuugauauugugcacaguuuaauacaaauauugauaugauacaaaguugauuacacucugaaacugccccccaaaaagaaacuuuuaaauaaaucuuuuauuauguuccacgagucucauugugugccacugguacauuuuaaauuaggguuccuugaacagacauauuugaaaaaaaaacuuaaugaaucauaucggauaaaauacccauauggaaugccggucaggcgauuguuagaguuauuguauguguuguauguguccuuuuuuagggugguaguguugaagugaaucuucucacuuagaugagcaguagguucauggcugauauuuuaguccuguauauuagaaugaggcuguuucucuaaguucaugcacuauaugccaugccaaaacuacuucaugaaauaaaccugucuucugagccacagcaaaguuuacagcucugggugucuugucuuugcuucuugguuaagugccuauggcuaaugcucuuaacucaaaagauggcugaaagcuuggaccuaaauguguuaugcaaaacccaucugucagacuuuugugagucucuucuuuuguauuaucuccuuaaauuaagacauaauuuaagauauuuuuguccuacuuuuuuugggggguggggacagggucucacucuguugcccaggcuggagugcaguggcaugaucaaggcucacugcagccuugaccucccugggcuuagguaauccucccaccucugcucccuaaauagcugggacuacaggcgugcgccaccaaacccggcuaauuuuuguauuuuuuuuguagagucgggguuuugccauguuucccaggauggucucaaaaucccgggcucaagcaguccaccugccacagccucccaaagugcugaaauuacaagugugagacaccaagccuuguccuauuuuugaggcaguaacuauucaaaucuuaauuguccuguaaucuaauccauaaaaucaaaauacaugggccauuauaguuguuugagcaccuauuacgugccaagaacuguauuaaauauuuaauguuuauuaucucauuuaauuagcaagagaacccuugugcuuaggucagauuagccuuauuguagagauugggcaacugaaguucauaguagguaacuuuuagagucacacagcuagugagcagucagacuuuuaauauuuauucuuucauuuggcucauugccucauuugguaaauggucuguaucauuugaauugcaaaauguaccacaauuguuuauaucuaugcugugauguucuuugauucuaguaguacugucguuuguuuaucgugaaauauuuuuuauauuaugagaaaaguaggagacagcaaacuaacaucugacuuuaugccuugaaugauuauuuagcuguaucuuuuuuaaggacuuuauccuguuuccuauuggaaaauugugcaggaugauugggauccgguuaacuuguaaccaggauugucugcaucccucucauaagacugaacuugucacacuuuucuauagacuuuuucuuacugaaaagaaugaguguguuccagucugaagccacuugugaaaggaggaaacuucugcuuucuauuuuacuguaaauucauguuuuuguguuuaugccaagaaauagaagcuugaacucaacgaaggcaguugugcaugaaagggauaggaaaugaaggugacaauggaauauauuugcucauuuugaguagcaucaugguagaaaggaaaaugguuacagacuuguaggguugugcuuuggaggcagacugccaguacuguuaauacuucuuguuccuaauccuuagguaaauaaggauuuucuucaaguucugaaguaagacgguuuuaaagauuauugcugaaagaauaggaaccagauccauuaaagccauauuuugucacauuaaaaaacucugcagugugcuauucuggaaaaugucucagauguuuaaucugggcuuaucuauugauuaugucagguuuucaacuugucucaacuuccucauuuauuaaaacaauauuuccuggcaauuuuaaaguuagacuacaguauguuuuuguauuuguaguauaauauuuagccccuuaaccccuuacaggcacucgaauauuaguucuuccccuccacccuggaagaguuucccuuuguccacuugaguugaauauaugugccguacuaaaggagaaaaacuaccaucuacccaguuauugaagccaagaucuugaaguuacaccagacucucuaauuucucauuuucugcauccgucgauuucuggaguuccucagugaugcacacugggggucucagggaugacaguuuuucaugacccuagguugaaacugggagucauagaagacgaaaaaacgagaauuggauugggaguugacucuguugcccaggcuggaguacgguggugcaaucuugguucacugcaacuuccgccucccagguucaagcaauucuccugccucagccuccugaguagcugggacuacaggggcccgccaccaggccuggcgaauuuuuuuuguauuuuuaguagagaugggguuucaccauguuggccaggcuggucucaaacuccugaccucaaauaaucuacccuccucagcuucccaaagugcugggauuacaggcgugagccaucgugccuggccaacuugcauuuauuucugauuagcugcucaucugagaaagguggcuuaaaaaaaaccaccaaaguggacagacugaagcuaaagacugucaguauauaugcucugcuuggcaaacagcugacuuuggauagaucucauuauuuaaagaugaauaauaagggggaaaaacguguagagagaacaugguuuacaaaaacccaucucuuucuccagucucugcaauauucuauauuuggucauauugaacuaugaaaaucuaaggcagguuucuuuauuuuaccacagauauccucaggaaagagucuccuuauuaaaagccuuacugaaucuccauaguauuguguccucucacaguugcuucuguucugagcaccagaaugcuguuuggcaaaggcugcuguaggcuugaaaucaacuggauuagugagagacaaauuuuacacaucuaaaauucuccuguguauggccucacaguuggaacuguuggauguuauaagcagaugauuuaaauaucccgugaaaagcaguccauucgggcauguuucuagagaucauaauuuuuuuuuuuuuuuuuuuugagauggagucuugcucugucgcccaggcuggaguacaguggcaugaucuuggcucacugcaacuucugccucccggguucaagcgguucuucugccuaagccucccaaguagcugggauuacaggugcccgccaccaugccuggcugauuuuuguaauuuuaguacagaugggauuucaccauguuguccagguugguguugaacuccugaccuugugauccgccugcuuuggccucccaaagugcugggauuacaggcaugagccaccacacccagccuagagaucauaauuuacauagaaagauaagagaaaaacaacucuccugauaacgcaaauagauuugauguuacaaaacugcaccauuaugauugcucuguaauggauuuuugaaaagcauugugaaauggagaugacuuuccagugcugaugucaaaaaugcauaugcagaguuuaaauauaauuuuguguguuuuguuuuuugagacagggucuugcucugucucaaguggaguacaguggcgagaucauggcuuaccacagccucaacuucccaggcuccagccauccucucaccucagccucccaaguagcuaggacuacaggcgugugccaccacacccagccaauuuuuguauuuuuuuguagaaaugggcuuuggccauguugcccaggcuggccucgaacuccugagcccaagcaaucugccugccucggccucccaaagugcugggauuacaggcaggagccacugugccuggccuaauuuuauaauuuuaaaugucuguaaaguaagcaaaaugacuaguugaauuguacauuaaauauaucuaaucccuaagaguuuauaaugaaaagggaucaaaacuuuuucaauugcgauaaaacucacauaacaaaauuaaccauuuuaaagugaacaauuuagugguauuuagugcauucacagugucgugcagccaacaccuguaucuaguuccaagacauuuucaucuccccaaaaggagaccccauacacgugaagcagucccucucccaucccccuccucccauccgcuagcaacugcuaauuugcuuuuugucucuauggauuuaccuguucuggauauuucacauaaauggaauuauacaauaaaggaccguuuguuucuaacuucuuucacuaagcauccauguuauagcauauaucagacuucauuccuuuaugacugaauaauacuuugcugaauggauauaucaguguuuuauuuguccuuucaucaguugguggacauuuggguucuuucuaccuuuuggcuauugugacuagugguguugcaaacauucauguacaaguuuuuguuugaaugccuguugucaguucuucuagauauauacuuagaaguggaauugcugggucauaugguaauuucucuguuucaacuuuuugagagaccacgaaaccguuuuccacagugguggcaccauuugacaugcccacuagaaauauaugagaguuccauuuucuucacaucuucugacagcuuuuugggguguugggaugauucgucuaauugggaaaauaaguaccuuauuugggccuauaugguauuuuuaauucugugugucugcucccaaacucuguagcccugcccucccuuauauuguguauccuguuucagauuguuuccguuucuucugagacacugcauauaccccuacauguaucugugcuaggcauacaucccuguaacuucauggcauuuuuguaauugcuguguaccuguuacguauacugagugggagugucucauuugcuguagaacucucugcauuaguguagugucuggcacacaguagcugcucaggcauuuuuuaaguauaugauuauugggaaaacuacagagcuagggagagaucugaagaaauacuagaaauuuuuuucugcaaagaaaacuuuagaaaauuguugacaucaucuguggcaugcagcaaaaguugauguaaaaggaacagaaagaccuauggagauaaugggauguaauaacagaaaacauacauaaacaauugguucugaaaucaguuaagagcagaacuggaauucauacucuguggaaugaaucagcaauguggaaggaguaacaagauuuuuuaaaaagauuuugaauuuaggcugggugcaguggcucacgccuguaaccccaucacuuugggaggccagaguagguggauugcuucaacccaggcauucgagacuagccuggacagcauggcaaaacccuaucucuacaaaaaauaaaaaauuagccaggugugguggcaugcgccuguagucccaucuacuugggaggcugagguggauggaucaccugagccugggaaguggagguugcaguaggcugaagucaugccacugcacucaaaccuggcggacagagugagacccuaucucaaaaaaaaaaaaaaaagauuuuaguuuagaaguaaaucccagaauuaaguaaaagugguguguguguguuugugugugugacagaauagguuacaaauuuaagaauuuuagaaaccgggcugggugugguggcucacgccuguaaucccagcacuuugggagggugaggcgggcggaucacgaggucaggagaucgagaccauccuggcuaacacggugaaaccccgucucuacuaaaaauacaaaaaauuagcugggcgcgguggcgggugccuguagucccagcuacucgggaggcugaggcagcagaauggcgugaacccaggaggcggagcuugcagugagccaagauagcuccacugcacuccagccugggcgaaagagcaagaauccaucucaaaaaaaaaaaaaaaagauuuuuagaaaccaaaauaauuggaauggaagcucuuuucaaugaaagaaaacuuuuguaauuugaaagaaccaaaauuaaaagggcuuaguguuuggaacaggccugaagaaguuguaauaccaugaauuuaaaaaaacaaaacaaacucgggaggccaaggcacaagaauugcuugaacccaggagccggagguugcagugagccgagauugcgccacugcaugccagccuaugcgacagagcgagacucugucucaaaaacaaacaaaaaaaucccuaaaacuauaagcaucuagggcacauccucuuccugaccaaaaaaaucaaaguaauacuaguuuuuuaacccugaauuuuagauagugaagcagugucuauaguuuuugagauggaaagugucuucacuuguuuuuagaagacaugaaucacaauuugaacccccaaagagccucugagagccuaaaaccuguuuuuucuccuauagguuguuuccucacuaguaaugacaaaguuauaaucuuagcacaaaauaagcaaaggggacaguuucacacaaaaauuguacuuaaaauauugaguuuguguuaaguugcuaaauaauggaugcucaauauguauuaauugaaagcaaaucauggugguugucauuuuaaucauuuuaaugucauuuuaaucauuuuaaugucauuuugaacucccugaauuuguuaauauuaaaucauuuugagauaaucuguaacuccucaugcugauuguuaguuaauucauucacucauuugaaaacaguauuuguggcauuuaagcucacaggaaaacacuccaggcugggugcaguggcucacuccuguaaucccaauacuuugggaggccaagguggguggaucacuugagaucaggaguuugagaccagccuggccaacauggugaaaccccgucucuacugaaaaaauacaaaaauuagcugggcgugguggugcaugccuguagucccagcuacucaggagguugaggcaggagaauggcuugaacccgggaggcagagguuguggugagcugagaucaugccauugcacuccagccugggcgacagagcgagacuccaucucaaaaaaagaaaaaaaaauacucuagugacucaauuguaaaauaaaaugguucuagucuuauaacuuguagcaccugguagacugaguaugccuuaaaugauugaucuaacuagaauaaugugggauagagcauaaugucuaauuuccuggcaggucccucaguauaggguagaaagauaacaugaauauguacaauagugaugggguugacagaauguaacacuaggcucccacuuaaauguacauuuugugaagucgcugggaaguugugucauagaaugaaguuuaucaaggaucuuuauaacuugaauauuaaggagacuguccagauguuuuauucauaucaggaaaccaagccuuuaaugucucccugguuacauucauuuauaacauccuuuaugcuaagucagcaauaaguauuauauauauuuuuugagauggggucuugcucugucacccaggcugaagugcaggggugcagucacagcuuguugcagccucugccuccuggacucaaacaaucuucccaccucagccugccaacuagcuagaacuacaggugcacaccaccacgccuggacaguuuuuuuauuuuuuguagggacagggucucgccauguugcccaggcuggucuugaacaccugggcucgagagguccucccaccuuggccugcaaaagugcugggauuacaggcaugagccacuaugccuggccuugaacccucaaaguaagcccauuugguagguuuggauauauucugcacaacuucucaccccugccauugaauguagcugugguuguuuugugcugcugaauugcauuuauacggggggcauaaucuugguaagucauauccaucuccaagauuuggggcauaaaaacuccuguauuucccugcagcuugguuaacauuggccuaauugaucugauaucaucuaauuauuggcuuauuuuuuaagaaugcauuaaauauaaaguuuuugaaaauuuccaaucagcaguugauuacaaguaggaaaaauucuuugagucuccugguaguuuaccaaagcuaauaauagucugacaaccucucuccaacugugguugcuuccugaauauauugcuuaaauuuggaguuugugaccagaaucaaaaauucuaagagccagugauucucucaaaggcuaacauggaguagaaaaaaacuauauguuuaaauguggggacagcaaggguuaaaggcauuuuuauuuguugcuugaaaucuguggagccuacagaaaacagugguugguauccuguugauggaagaacuaaaggaaugcugcauucucagcauuucuuauuuccuguagaauacagcaacugcaguuuuuauuugacauucugcuaguuuccaggaagggcucaaugaagugacugcugucagcaucuuuuuucaccgcgacugauacuagagaagguagaggauguuuaggagcuuuuaaaggaaauuauguuuagugaaauacuuggguuaggaaguuaaccaaaucuuuaaguacugacuuaaaaaugcuuguauugagagaugaaugguaucagaaugacauacaaguaucagcaggucucucagauuguugaccuauuaacucuacagugguaacacuucuaaaguccuugguaagauacaagauucauuugcagaaaauagcuccaucugaaaaacaguagcucauacauacuuccuuuacauuuucccuauucagaugaaacaaggaggaucuggaaaaugugaagccaagcaauaauugugaaacauaaguccuuaguaaugcugucauaaaccaguuuucauguaguuugauuuucagcugauaaagcugguaaaugaguuauacuacaaaucuaugauucauuaggaagcaaacuccuuagguauacuuacagagaagccaauuuccaaugaguuuauucuuaacuaaucagaugugagaacugcugguugaaauuaguaggcucaaagcaaaccuauuacuccuuuaauuauguggcgucuguaggcacaaacagauagauuaugaaugauugcugagagugugccuuggugcuaauggagaguugucuuuagauaguuuaagaauugggccuugaaaaaauuaugguuuuauuugguuguaugucuuaagcuagcauuuucugcccuucuuaagguauauaguauugaauuaaauauauuaauaggaccauggccucuuugguccucuuaacaauauuuucauaguuugaucacuaauauauucuguuaagaugcucauacaacaccauuaaguuuccugauuccuugauguaucaggguuuccccauucugucuuuaggagcaugugaacaaagcgaauuggcccagguaagguuugaguauauaacaguagcaugaugcuaaaaccagucuguuuaagaacaaucuauaucggccaggcgugguggcucaugccuguaaucccagcacuuugggaggccgaggcaggcagacaccugaggucgggaguucgagaccagccugagcuacuccggaggcugaggcaggagaauggcuugaacccgggagguggagguugcugugagccgagaucgugccauugcacuccagccugggcaacaagagcgaaacuacgucucaaaaaaaaaaaaaacagucuauaucauaauaccauagucccagaacuagaaguucaucaaauaauggagugcucugugcucccacacuaagugcuugauguguguuaaaucaccuuaaccuuucauggagcaccuaggcaugcugcuuugcucccucucaaguaaggauggauacuuuuuuucccuuuccauuuuccauauuuacaaucaaauggaguauauuuuuaaaaccaagacaggaaaaacaaaguuuaaaccauuaaaaacugaugagcauucaacguagauuucugagucucauugcugauguguuuuuuauuuuuauuuuuuauuuuuuuggagacagagucuugcucugucgcccaggcuggagugcgguggcgcgaucucagcucacugcaaccucugcuucccuuguugcccaggcuggucuugaaccgaacuccuggccucaagcuauccucccaucucaaccuccaaagcacugggauuacaggugugaaccaccauacccagucuuguauuugcuuguauuuguuucuuuugcuuaaacauuuuaaauaaagucaggcuaucauauuuuaccuguaaacacuucagcuugcaucuuuagaaaauaaggacauuuucuuucuuuuucuuuuugagauggaguuucacucuuguugcccaggcuggagugcaauggcacgaucuuggcucacugcagccucugccucccggguucaagcgauucuccugccucagucucccgaguagcugggauuacaggugcccaccaccaugcccggcuaauucuuuuuuuuuuuuuuuuuuuuuguauuuuuaguagagaugggguuuugccauguuggccaggcuggucuugaacucuugaccucagguaauccacccaccuuagccucccaaagugcuggaauuacaggaaugagccaccguaccuggccaggacauuuucuuauaaucauaauauuauuuauagcucccugauauuuaagaacaauaucagaaaaccaguccauauucauauuuuccucauugucccuaaauguuguuugguuuaaaucagaauccaagaaagcucauacugcuuucaguuaugucucugaaguuucuuuucuuuuuuuugagacggagucuugcucugucgcccaggcuggagugcaguggcacaaucucggcucacugcaagcuccgccuccuggguucacgccauucuccugccucagccucccgaguagcugggacuacaggugcccgucaccacaccuggcuaauuuuuuguauuuuuaguagagacgggguuucacuguguuagccaggauagucucaaucuccugaccucaugauccgcccgccucggccucccaaagugcugggauuacaggcaugagccaccgugcccagccugaaguuucuuaaaaaaaaaaaaaaaauuuuuuuuuuagccggguacagugacucaugccuguaaucccagcacuuugggaggcugaggugggaggaucccuuaagcccaggaguuggagaccagacugggaaacaaagugcugccuaucucuacaaaaaaaaaaaaaaaaaauuagcugggcaugguggcguaugggugguaccaucuauuuggaaggcuaaucuauuaucaguaguuaaaagaaauucacacccagaguuucagccaaccuauggacagcugaauuaagcagcccaggagguugaagcugcagugacccaugauugugccacugaauuccacccugggccacagagcaagacccuguaugagaaaaaaaagaauuggaaguccuaaaguguaauuuccuuuucuccucacuuccccaacaaaaacaaacuuuaaaaaaaaaaaggcauuucauagugucugaggcaguuaagcacccagagaccacuaaucuaguaucaguaguugaaagaaauucacacccagaguuucagccaaccuauggacagcugaauuaagcagauaauaaaaugcaaaugcaaaaaagcuaaccuugagcuggcuuaaaguacugauauguuguauguauuaauaguuaauaucagugagcucuggguugcuugaucccaggaguuuaaggauacagugagcugugaucacaucacugcacuccagcuugggugacagagcaagacccuaucucuugcacuccagcuugggugacagagcaagacccugucucuuaaaaaaaaacagaaggcaauaucuguugagcuguuagaugucaggcauuguucuuugcauucacauuaaaucuucacaccucugagauagauacugucaucucaaauguuucauaugagaaaacauaaacacagccuguguucucuagaucagugguccacaaccuuuuuggcggcaccagggaccaguuuuguggaagaaaauuuuuccaccgguugggggugggagugggggugggauggucucagaugaaauuguuucaccucagaucacaaggcauucguuagauucucauaaggagugagcaaccuagaucccucgcuugcacaguucacaauaggguucgcgugccuaugagaaucuaaugccguggcugaaaugacaggagguagagcucaggcggugaugacugcucauuggcugcucaccuucuucuguguggcccaguugcuaacggaauacuggucugcggccugugguucgggaucccugcucuagauuauggggaagccgaaguacuauuuucucauuauaaaaacagaauccuaccuuuuacuccccaccucccccuguuaauagaaguuggaauggagaaggaaggagaugcauuuuaaaaucauuuguaacauguaacuccaggguacuucagaguuuuaaagaauaaauagggaauaaauuuguuuaauugccuuuuuagauccagguuuaggugucaaguccuaaaguagugccacuugcagaccaaaaucgaaucuggaaaccaaaugaguuacaaaguuugggugcuuuucuguaaaaacaaggaagcaguuuauuuguauacuuuugugucuugugccauucuguuggaaaagggcggaggaaauacauacuuucauaugcuacaggauaacucugaaaugcaaaaguaucucuaauugcuuaggggagaaggguauuacuggaaagacggggugggugacuuuucauaguauaaccuuuuguaagauuuuagugcuuuacuguaugcacgugauaacuauucaaaaaaacaagccccuuuuuuuggacccaguuuauugacuccauauucuuauaacagcaaaauaaaaauucuuuuaaguuaaaaaaaacuuuaucauaggaauuuccaagcauauguuaaaauaggauaucuccagcuucaacacuaauggcauuuugcagauugagaggauaauaaaauguagcuguaguuuggauacauguauccagauauauuacauguauuucagauauguccucugaaaauaccugcaaguuuauagagaauguuguauauguccuuugacuuuauccaugcuuaguuccauaguguauaauucaguuuauggcuggguacagugguucauaccuguaaucccaacacugggaggucgagcugggaggauuacuugagcccaggaguucgagaccagccuggguaacauagggagaaccugucucuuaaaaaaaaaaaaaaauuagccaggcaugguggcgccuguagucucagguacugaggaggcugagguaggaagaucacuugagccugggaggucgaggcugcagugguaccacugcacuccagccugggcaacagggcaagacccugucucaauaaauaaagaauaaaaauacaauucaguuucugugguauagcuuauaugccaucacaccuuuauaacugacugagaauacuuuaugguuacuaugugcuguuuugaaaauaaaaccuguuuaaaaauauguugcauuuuaaaaguuuuaaucuauauugauauuacuagacauaguuauauaguuuggccacccuguuacaugcuccuacuguaaggguauaccuaaaccagacuugcaguuaauaagagugacuuguccuauuauugugugcuuuggcauauuucucuuuugaguauauaacaggaaaauaugggaagaauugcugaguguucuagacauucucacucaaaaggaacaucaguaaggaaaacaaucuuaccuaccuuauuugaagagguggaagcaaauuuaaccuucucuuagccaauacggucacuugaaguucuuuuuuuuuuuuuugccaaagucuugcucugucacucaggcuggagugcaguagggcggucuuggcucacugcaaccuccgccucccggguacaagcgauucuccugccucagccucuggaguagcugggacuacaggcgugugccaccaugggcccggcuaauauuuuguauuuuuaguagaaacgggguuucacuguguuagccaggaugaucucgaucuccugaccucgugauccacgcccccuuggccucccaaagugcugggauuacaggcaugagccaccacgcccagccgaaguuccugucuuuuuuuccucacaauuaggaaggcuauauaggaaggagcaggguccuguucaguuguguaaaugaccaccacuuaagugugcuuuuuuaauauguuuaaacaugugccauuauuaagaauuugacacggcuggacgccguggcucaugccuguauucccagcacuuugggaggccaaggcggacggaacaugaggucaagagaucgagaccauucuggccaacguggucaaaccccaucuguacuaaaaauacaaaaauuagcuggacgugguggugcacgccuguagucccagcuacuugggaggcugaggcaggagaauugcuugaacuggggagguagagguugcaguaagccgagaucaugccacugcauuccagccuggugacagagcgagacucgguuucaaaaaaaaaaacaaaaaacuugcaacuucagaauuauguucauguuugcugguguuuuaacucaaacugggacauaaauccuagggaaguaacccauaucacuguuguucuaauaacugcauucguaguagaauaacacuacauucacuaguagaggcugagggagagaggaaaagaaggaauuacagguuacaggcuacuuuucuguucuugucuagacugaggcugacugacuugucuagacugaggcugaggcagguggaccaugaggucaggagaucgagaccauccuggccaacauggugaaacuccauuucuacuaaaauacaaaaaauuagccgggcauguuggcgcacuccuguagucccagcuacucgggaggcugaggcaggagaaucacuugaaccuaggaggcagagguuguagugagcugagaucgagccacuguacuccagccuggcuggcgacagagcaagacuccaucucaaaaaaaaaaaaaaaaaaaaaaaagaguuugucacuugccuccuguuuaauuuugcauuuuuuaaauaaaguauaucuauuccacauggacuauuuugauuaguaccaauacauuccugaaggagaucaaagauauauaugcauagcucucuugguagcauauguuuaaugagaaaguaauauaaggauuacauagauuaggguugcaggcaguucugucacuuuaaagccagaucuuuuauuuaccuuauuuuuuaaaguuuuugcagagauggggucucauuauguugcccaggcugguaucaaacuccugggcucaagugauccucucaucucagccucccaaagugcugggauuauaggugugaaccaaggugccaggccaaaucuuuguuguuuuuuuuuuuuuuuuuuuuuuuuacaaguaaaauacccugaggcugaaggucauugcuaacugaugcagcguguuuuucuuacugcuuuuuuucuggggaucuaacaaggaauuggaaacacagguuuuugacuuuccuuuuuccuccucauuguuuucugauaguguuuucuuaaagucaucuuccaccugccucugaaguugagaaguaggaaggaaucuguuagaaucacuugggguucaguuaguagugucugugguuugcuuccuuuugugguuuugaauuuaauuucacuauuugacuaacacuauuuuuacuccgacuuccucaaacacugugggacuuaagcugugacaggugaaacucagugccuuagaugaaggcuugguagagacuuagaaacauagaauucuuacaggguagcuuaggauucuuacagcauaacuuacugcuuuuagguauauagcucuaugaacuuuaugagcccacuggaauguuuucuccaauuaucggaaaggauaauuaucaauuaaacuuaaggagucuaaggacccucuacucagaaaaauagaugugagauccugucucaaaagaaaaguuaaagucaggaagaaguuaaaauuaaugguuuauaaggcuuuacuauaacuaaauacauuauaaguuacauacuuuaaagcuaguguauuugccuugcauuacagcauauacuugagcuuguaaagcagguuaaucuacuuuauuacgauguuuguauuaaugguuagagaguuguuugacuucuugccccuauauucagugacugaguuacuguaacuacacuuuauaacugaguuauaacauuaauaacuuaauaccaguaguaauugagauagaagagugaagagaaaguaaaauguagccuuguagucuuauguuauaucuuauucagagccuggccugguuauguuuaagcacuauuagcagaagaguuucagaagagaauuuaaauaaaauacaguuaacuuggcugguuuaguccauaagauaauagugacaguggugguguuuguggaggaaaacuguauugcuagaggacaagggugacagaaagacuugauuuuuuuuuuuccaugcuuuuucuuuucugggguguguguguguguguguguguguguguguguguguauuuuguaccaugcgaauuuauuauauuaccuuuggaggaaagggggauaaaacuagucuggccaaggcuaauaaaauaaagccuccauguagcuucuuuuaguaggacuuaaucuguuacaacauaguuagucacccagaguauuaauaacccacuaugguagagauuucuuccuaguaacaagugacuuuuguucuuacauacuuaauugguuugcaaagaccuaccaucuuuagauccacuauauuuguuuagcagauacuuuaguauuuucugaguacacaaagcaaaucuaauuccauuauuuuccuuguuaaaauccuuaaguagcucccuucgccuguagaauaaacucaggauucuuacugagguauguuuagcuuguuggucuggcccuugcucauuucucuaaccuuaauuguguacucccucaauccuauaguguuacaaaaguacuuguaguucccuuagccaaccacacuuuuacgucucugugcuuuaccacaugcucuuucuguugagaauucucucgccugccuccuuugaacacauugcuuuagcuguguagccuuugacaagaucccucuuacauaucuuuguuuuggcacuuuuugcacagaauuagaacuuguuugcucuugcuauucaaguuccuuuauuuagaucaagaauucugugacauuuuagaucuuuuuaugcuuguaacuuaauuuuucagcuucuugaagcgugaacaaauaacugcuacauguuaaggggggugagagaggacugguccaauaguuccaaggucuuaaaauaaaucaagaaacucaauuaccucaaaucccuugaaccaugcaugcuaccuugcagauguugcucuuuccuuuaacuucaucuguauuuguucugccucuuauuugaaacaguugaauggcauguuuguuugaagaagagaagguccaauacuuggcuauuaauagucucucuuuaauuaacauaauguagauguuauugugaccuugaagcauuaauguuaagugaggauuuguguugaugagcauauaugaaugucaagucuuuggaauccacuugguaacaugguuucuuauuauuuuuucuagcuccagaaccuggguaucaacccagcaaacauuggcuucaguacccugacuauggagucugacaaauucaucugcauuagagaaaaaguaggagagcaggcccaggugguaaucauugauaugaaugacccaaguaauccaauucgaagaccaauuucagcagacagcgccaucaugaauccagcuagcaaaguaauugcacugaaagguauaaaagaauguggguuuuccuuaaaacucuuccuauguuuuuguuuuuuuuuguuuuuuuuuuguuuguuuguuuguuuuugagacggaguuuuacucuugucacccaggcuggagugcaauggcacgaucuuggcucacugcaaucuccaccccccagguucaagcgauucucuugccucagccucccgaguugcuggaauuacaggugccugccaccacaaccagcuaguuuuuuuguauuuuuaguagagaugggguuucacuauguuggccaggcuggucucgaacuccuaaccucaugauccgccugccucggccucccagagugcugagauuacaggcgugagccaccacgcccagccagcucuuccuauguauuuaugcaaguacaauaacuaggguuuaccuuuuuaaguauauugauuaaguuugguuaaagaaaauagaucugcuaauaccgaacuugauuuaaaccacuuuaauuacuuuuacuuggaauguaucuguggaaugucuuaacauauaucuacuuagaauaauuuuaaguuuuagaauaaaugcauuuaaauuuuguaucugguauaaaacugugcuaaacauaucucucuacagaggaaagaaauuagugauucauauucuggaauagaacauacuuuacuaauauuagcaccuaaacauugcagaauuuuguuaugaugauaaacuugccuuugauucugugcuuuuuuuuuuauacuucgggcuuguguuucacuuagauuauuggguucuagaaauggcuugaauuuacaguaauuguuuaaaguguguuuguauuuagguggauauuaaagcucuugagugaaggguauuugaguuuauucagacuaacuuuuuaauugucccaacaagggaacugugcagcuuaagucuaaacagaguucaaagacucuuagacugucacggaagcuguauuccuuugaacuuuagaaugagacuaauugacccuuuaaaacagauguuuuuaagagggcucggugacaaacugacucuuaaaaaggcauucgauugccugcuuuguuuuucauuuugauagaagaaagaagaguucaaguucgcaguaauuuguugauaaauuugugacuaaguuauuagaggugcugaacuuugacuuuucuuuacaugauuuaaacuuuguauauaguaauaauacuaguuggagagugaauaggguuggguaggacuaggauauucaaacaaauaagucacuaucacauaucuaagauagaaacucaucucaucucgaggaaaaaugguccagcuuucacauaggaccagauguuuugugacaguaaguguuuuacuucuauuacuucuauuuaggguauuaagcuuccuucagacucuuuaaagaauuuaaauucagguccuuagcaauucccaugccucucuauuaaaaggccaucauuuuaauuuugccaaaauucuuuucuauuuuuaauguuauuguuaucuuaucacauuucuuaaugcuuucuuaugugugcagauggugaguuaucuuaaauuagauuguauuaguuauuguccuguucuauaaaaagaauaaauugaaaagauuuucggagcauuguacaauaacaucauagauuugucccuauaugucugcacuauggagucaagcugucaucccuugucccccuccccaagaccaccccacuuauguauauauuccaaccccuaauaaucugggaguugaggaaggcagcaaaggaaaguaagucauuccaaaauacugcuucccucugaagccaguuuugaaccccuuggcuucuuuuuauaaacaggacuguaacucucacaauuuuucaagucugguugugguuuacauacugugugggaugggaauaacauucuucauuuuaugaaagaaauuuuugcacauguguuacggaggguuguaguacaaagcuguauguuuugccccccuucuuuguccccccagcacccgaaucuuaaaauuuugguccuucaggagccagauucucugugucucaggaaugguguuuuucuuagucuuuaaagacuaaucuugauagccuagugauaguuguaggcuuuggccucuauuaauuuauaccaaaucacauuuugaacugauggauuucaaacuacaaguacaagccuuugcaucugacucaguggacucuuaacacucaaggcaaauuucauccuuuuuuaacuaaaugcuugcuuucuuaauuggaugaagcuugcacuuuguucuuaucuccaguauauuaacagcaucugaaacuauccucuuccuuugucucccucuccuuuccuccagcaccucuaccuucccuuuguuaucuuaagccgguuaaauguagcaggcacuucucuuacgugcuaguggcaacaagacagaauugaagcagauccucuuuuuaaaaagcaguuuccacaagauuuauuuagaugagagaugacugccuuuaaaaaaauacauuuucuuucccccauguguuuguuaucagaguugcuuugucuuguguacaugcaacuaaguuuauguguaaaguaaacauacuuaauuacaaguaugaaggugacagcuuuguuuucaauuauuguuaagaaaacuauucauuaggcuuauuuucaguugggauuuagaauuccauggaagucauacuaucuguuuaaaguguguuuauuagagguaauguaguuuuugcuuaaaacguagauguagauuguuugcuuagucuuagcuguuaccucuuuaaugguugcugcuguaucgaugcaacucgucucguaauagaacuauuuuuguuuggaagugacagagcuagucuagguagguauucauucuaaacuuuacucuuuuaaugauuuauaauucuugauuuuguuuuuagcugggaaaacucuucagauuuuuaacauugaaaugaaaaguaaaaugaaggcucauaccaugacugaugaugucaccuuuuggaaauggaucucuuugaauacgguugcucuuguuacggauaaugcaguuuaucacuggaguauggaaggagagucucagccagugaaaauguuugaucgccauucuagccuugcagggugccagauuaucaauuaccguacagaugcaaaacaaaagugguuacuucugacugguauaucugcacagguaacauuuuaacuauuuuuuuaugaagaagagguuuagaacacgguugugcccagaaugcaguuugauuuugaaauuaggucuuucuauacucaauccuguugaauuucacuuauuuuggaagacuuuuuuuuuccuuccucccaucccuucucuucuccuuccucccucccuucucuucuuccucgcucccuugcuauacugacauauaauuucagaaugcucuuaccaagcguuuuuagcucuucuguggagauugaguagaaauugaguuucuguaagaaugauuugggauuuauuauggaguauuuacugcagaaugaaugcuucuauaccuuuuuguuuaagacguauaugaggcauauuuuaaacauuuauguuaggcuuuaacaagauaauguuuggggcugauuuuaaguuaagaaguaucaaaucuacagugagagaugaagugacaaauaauuauaaauccugcuaaagaugacaaagcauucuaauuauuucauuacuugaugaaucugagaguuuuugauuuaugggucuucaaacguuauucucuuugauccuuuauagcaaaaucguguggugggagcuaugcagcuauauucuguagauaggaaagugucucagcccauugaaggacaugcagcuagcuuugcacaguuuaagauggaaggaaaugcagaagaaucaacguuauuuuguuuugcaguucggggccaagcuggagggaagguaaguuuuggcuuugguaauuauuuuaaugagaacuuguauuuggcuuucugcuaugaauuagucaucuaauuucaaaauagccuucucccuuccuaaguaauuuuaguauucacauuuguggugacuuaauuuguucaaauuuugcaucuagugauacuugucuaaaaugaauaauguucuuucacaacucguucuguuggcuguuuauauucuuugauugcuaaagugcacauuuauaugcuguacaucuagagaguuugauuuaguagguguugccuauaauuuuuuuuguuuauuuguugcuuuuugagacagggugucacucuguugcccaggcuggagugcaguggcgcagucaugggcucacugcagccucgaccuucugggcucaagugaucccucugucucagccucccgaguagcugggacuacaggcaugugccaccaugccuggcuaaauuuuguauuuuuguagagacagggucucacuauacugcccaggcuggucucaaaccucuggguccaagugauccucccgccuuggucucccaauauaaucugcauuuuaaauaccuuauauggcuugauauagaggcaauguagacuacaggugaauaacacugacuuaaguuagagguuuucaaccaugacuacacauuggaaucgccuggacagauuguaguacuuuguauauuagacuuaguugcagguaauagaaacaaggucugguugauuagagcaauggucuguuuagugaaggauauuggauaguuuacaacagcuggggaggcuguaaaaccaagacugggaaaugaggagaaauaauggaaaaugagcaguggucagggucccagccaacaacuauuccacagaacucugaggacacuucuggauccaugauugcauuucuggaugcuuggaaauucgauuugacuacuauuuccacuaccagaguagcaucucugaaauccuaauacuuuuguguuccuagcucccuguucaaagucuaguuuuaggcaagaucagaugcccacaucuuaugucugagagguuuggaaauaauuauuugguguuuggugcuccuaaaacagaaggcugguucuaccaccaacaaaacuuguaaagaguaucuucccucuuguugucccaucaggaagaggguuuagauucuaggcagaccaaaaaauuugaacuucacuuuuguuaggacaugugucucucucuuuguaaguaagcaguuuuuaaaaauugagauagagauugcuuaagauaucaucuguagccugucaggagagaggaaacaguaaguaaugacauacaauucugcuuaaaauuucacgauagccccugaauugaggauaaugcuaccaacaccucaaugugacagugguagaaagcacugauauuuagaucugaauagaugaaauuuaaacagaaaaaaacacauaguuuuagaaauuagauauuauccuuaaaacauaaggcaggacauuuauugaaaaguucuacuagaaaaaaguuucaaugucauuuugaacaguaucuggaaaccuguuuauagguuauugagccuauuauuucauacauggugcuauccugucugccauggcuuuugaaggaagauaccaaguuuuucaguauggcuagucauccuaaugaaggaugaugagacccuauaacauucauaugguaugugucuuggaaacugaauuuuuuuuugucugaguucauuucuggcaugacuaaggaaaauauauaguacuuuuucauugagauuauuuacuuuucucuugccuggcuuaugugcagcauuggauauuuuaaaccaaaauguucucauuuaguuuaugggauguuugugauuagagagacaacucaaauuagguauauacauucauucuguuuuaguguauauguauagguagagaagaauuuaacaacuuagguuucuauuuggaaauacuaaauuaaaauuuaaagcuaggagaaaaguaccauuguagguaauguauuacccuucuauaccauuuauuucagguagauuauuugagguaugauuauuucagauauucagaugacuuuuuuuuuuuuuuuuuuuuuugagauggagucuugcucuguugcccaggcuggaaugcaguggcacgaucccgguucccugcaaccuccaccuccuggguucaagcgauucuccugccucagccucccgaguaucagcugacuuuuaaaaaugcauuuaucuuaaaauaauacagauuuauaggaagcuguaaagacaguacagaacaguccccuguguucuuuacccaguuucucccaauggcuacaucuuacacagcuguaguacaguagaaaaaccaggaaauugacauugguacaauuguauaauucugugucauuuuaucaugaguagauaacuauuuuaucaccacagugauuucccuuaugacuguagcgucacacccacucccccucucucacaccaucccuagcuccuggcaaccacuaauuuauucuccaucucuauaauuuugucacuuuagaaauguuacauaaauggaaucauacaguaugugaccuuuuaagauuggcuucuuuuuuuucacucaccauaauguucaugaaaguuuguuccuuuuuauuaccaaguauuccaugguauggauguaaccaaaaccauuuaacauugaucuucuguagaacauguugguuguuuccauuugggggcuacaaauaaagcugcugugaucaacugcuaauguauagguuuauauacauuuugauuuucuuuugaacaguuacauauuauugaaguuggcacaccaccuacagggaaccagcccuuuccaaagaaggcaguggaugucuucuuuccuccagaagcacaaaaugauuuuccuguugcaaugcagguauuuuaagcaaaauaaaugacuuuuuaaaaaucucuccucuuaaaagaaauuaacccaaagacuauucaugguagauauaauuuaagugaugcuuaaaagaauacuuuuuuaaaguuuauuagugaagcuuuguaaaauaauaccuuggcuuuucauguacaggacuaccuuaggccuauuaugagguuuggcuccagaccaccacaauaaaguaaauaccacaacaaagugagucauaagaauucuuugguuucccagugcagaucaaaguuacacuuaacacuaugcuguagucuacuguaaagugugaaauagcauugucuagaaaaacaguauacauacuguaauuuaaaaauacuuuauugcuaaaaaauguuaaugauuauuugagccuuuagugaguuguaaucuuuuugcuuguggaaagucuuuucucaaugucgauggcugcugaauaaucagaguggugguugcugaagguugagguggcuguggcaguuucguaaaauaagacagcaaagaaguuugcugcaucaauugacucuuucacaaaagauuucucugugcauugcuguuugauagcauuuuacccacaguagaucuuucagaauuggagucaguucuuucaaacccugccacugcuuuauuagcuaaguuucuguaauaaucuaaauccuuuguugucauucagcaauguucacagcaccuuuaccagcaguagauuuuaucucaagaaaccucuuuucuuugcccauccuuaagaagcagcuccuuuacuaggagauuacaguaauucagucacauuuuuaggcucuauuucuaauucugguuuucuugcuauuucuaccacaucuccacuuacuugcuccacucaagucuugaacuccucagucauccaugaagguuggaaucagccucuuccaaacuccuuuuaauguugauauuuugacuuccucccaugaaucaucaguguucuuaguggcaucuagaaugaugaauccuuuccagauugaccguuacuuaaauuuacuguggugaauccuuuccagauucacuuaaauuuacuuugcccagauccaucagaugaaucacuguucagggcagcuguggucuuaugaaauaauauuucuuaaauaagaagacuuguaagucaaaauuacuucuuugguccauaggcuucagaguggaugcugucuucgcagacaugaaagcaauauuaaucuccuuguauaucuccauuagagcucuugggugacuaugugcauugucgaugagcaguaacauuuugaaaggaaucuuuuuuuuucugagcaguaggucucaacaguaggcauaaaaagauuuaguaaaccaugcuguaaacagaugugcugucaucagggcuuugcuguuccauuucuauagcauaggcaaaguagauuuagcauaauucuugaagguccuaggauuuuuggaauagcagaugagcauuggcuucaccuuaaagucaccagcaucauuaguuccuaauaagagagucagccuguccauuaaagccaggcauugacuucucuguagagaaaaucuguuguuuaguguagccaccuucaaugaucuuagcuagaucuuccauauaacuugcugcaguuucuacaucaguacuugguuuuucaccuugcacuuuuauguuauagagaugguuuauuugcuuaaaccucaugaaucaacuuaugcuaccuucaaauuuuucuucuguugcuuucucaccucucugagccuucacagaauugaggagaguuagggccuuaaacuagauuaggcuuuggcuuaagagaauguuguagcugguuggaucuuuuauuuuauuuauuuguuuauuuauuuauuuauuuauuuuauuuauuuuuuuuuuugagacagagucucucucugucgcccaggcuggagugcaguggugcgaucucggcucacugcaagcuccgccuccuggguucacgccauucuccugccucagccucccgaguagcugggacuacaggcacccaccaccacccucggcuaauuuuuuguauuuuuaguagagaugggguuucacgguguuagccaggauggucucgaucuccugaccucgugauccacccaccucggccucccaaaguggugggauuacaggcaugagccaccacgcccggccuccucucccucuccuucugccucucccucuccuccucucucccccucuuucuuucccuuucccucucccucuuuaaagagauagguucucccucuguugcccaggcuggaaggcagugcugugaucauagcucacugcagccuuggaacuccugggcucaacugauccucuugccucagccuccagaguagcuaagaguagguaggacuacagguacaugccaguacgccuggcuacuuaaaaaauauuuuagagacaaugucucacuguguugcccuggcuggucuuuuuuuuuuuuuugacacugagucucucuauugcccagacugaagugcaguggcgcaaucucagcucacugcaaucucugccuccuggauucaagcgauucucaugccucagccucccgaguagcugggauuacaggcacccgccaccacaccuggcuaauuuuuguauuuuuaguagaguugggguuucgccauguuggucaggcuggucuugaacuccugaccucaaaugaucugcccaccuuggccucccaaagugcugggaucacaggcgugagccaccaugcccagcccaggcuggucuuaaacuccuggccuuaagugauccuucugccucagccuccucuguggcugggauacagacacauaccacugcaccuggcuaguguauaacauuuuuauuuguauuuuuauuugagacggucucgcucugucacccaggcuggagugcaguggcgcaaucucagcucacugcacccuccacgucucggguucaagugauuauugugccucagccucccauguagcugggauuacaggcgcgcaccaccccaccuggguaauuuuuuuguauuuuuaguagagacagggcuucaccguguuggucaggcuggucucgaacuccugaccucaagugauccaccugccucagccucccaaagugcugagauuacaggcaugagccacugcacccagcuguguauaacauuuuucuuuuagagacggaaucucacucugucgcccaggcuggagugcaguggcaccaucucggcucacugcaaccuccgccuccggggucaagcaauucuccugccucagccuccccaguagcugggacuacaggugcacacugccaugccuggcuaauuucuuccguauuuaguagagacaggguuucacuguuuugcccaggguggucucgaacuccugagcucaggcaauccacccaccucggccuccuaaagugcuaggauuacaggcauuagccacugcacuuggccuauaacauuuuaaaagagaaaaaaacugcucauuuagauaguuacauaaauucaaaaguagaaucguuuuauuucucuuuggccugcaaaacauuaucucaauauggcaaguaccuagaguuugacuuugucugugguagguuucuuagaugugagaaaaugagacugggauuacauuuguaagccacugcaccagugcacuuucugcauaucagcaagaaagcuguuagguuuucuuaucauucauguguucacuggaguagcacuuuaauuuccuucaagaauuuuccuuuguauucacaacuuggcuaggucaaaaggcccaccauucagccuaucuuggccuuggacaugucuuuuucacuaaacuuaaaauuacuucuagcuuucgauuuaaaaagagagguagaacacauagaggcaauuguaguuauuauauuggccuaauauuguugugucucagguaauagggaggccugaggaaagggaaagaaacgggagaacagcugguugguggagcagucagaacacacacaauauuuaucaguucaguuugcugucuuaugugggugcaauucaucacaccccaaaauaauaguuacaucaaagaugacuggccacagaucaacaugacagauacaauaaugaaaagguuugaaauauugugagaauuaaugaaaacgugacacagagacacugaagagagcacaugcuguuggaaaauagugccaauaggcuugcucgaugcaggguugccauaaaccuuccauucguaaagauucaucugcacugcaaagugcaguaaaaugagguaucccuguaauacguaaacugugcuaucuaaguuuugaauugucuuuccucuuaucaguuucauguuauauaagagcuugggauauccauauuuaaaugugcuguagaaaugaaggaaacuuuaaauauuagcuuauaauuuuucaaauaacccucuuguucuggaauuuuaccaucucuaaaauggaauuagacugaauguuuuuauuuucuguuuguagauucauuauuuuacuaaaguguugauuuucuuucuguagaucagugaaaagcaugaugugguguucuugauaaccaaguaugguuauauccaccucuaugaucuugagacugguaccugcaucuacaugaauagaaucaguggagaaacaauuuuuguuacugcaccucaugaagccacagcuggaauaauuggaguaaacagaaagggacaaguaaggaaaccuugaaacuuaagcaauaaaauaagauaaccugaugaguugggaacaauccuguccuuuugagaaauuacuccccaagauuaaaaaauagaaaauaaacauauuacuguuaguuuuuuuccaaaaaguaaauaguaacuuuggauauuagaaaauaauauauaucaaagcacgauguaagcugauaaaaaagaaaauaauauauaccuaaaaauagagauguguaugaauacaaagucucucuuuaauccugucucagagaaacugguuuauagccaucuaggacuguauagaugcauuacugucaaaagaagugauuccccaugcaaagaaacaauuuagggucauauuugacagacuauuuuuuuaaggaauuuucuguuaucuccaaggcagagcaauuaucaacuacagggaaaagaauucuaccuacaucccuuuuccuagcuccuuaauuaagcauuacuauuacauguuagaaggugauauguuucaguaccucuugugggaugccuggaaagcuaaucaguuugguaggaaaaauauuauccguucuaaauuugucauuuuugaaaaaccucuucauaccaucuagcaagugauucuuuaucugucaucuuauuauuuuaauuuuuuuuuuuuuuuuuuuuuucuugagauggagucuugcucugucacccagguuagagugcaguggcaugaucucagcucacuacaaccuccacuucccggguuuaagcaauucucuugccucauccucccaaguagcugcaauuacagaugugagucacugcacccggcuaauuucuguauuuuuaguagaggcgggcuuucaccauuuuggccaggcuggucucaaacuccugaccuugugauccacccgccccagccucccaaagugcugggauuacaggcgugagucacggcgcacagccuauuuuaauauuaauaagaauauuuuaccaggagcuauguuaauuuucugaaaaauggcuaaacauuuuaaaaauacuguuacuggucuugccuuuuacucauuuucuuccaaauuaguauuuuucccagauaauaagcaaaggaaguagauagauuuuguuucuccuucauucaguuaauuuuugaaaaauguuauguauaugaagagacaauuccucuagggaaagggagugcaucccuaccuacccaugccccaccuuaacuccagaccugguuaggugcuuuugcucuguacuccuagaacuuagggcuuucuccucauaacauuuaccauacuuauuaaaauugcucgcuaagcuguugcagucacuauucaucauuagaaaaagggauugucuuuaguaaauuauauuucuagcaccagucagugucugggacaaaagcaguuuuaaaaauucaguagcuuucagauauucaguuaugagugucuugcuuagaaaaaucaagaauaaggcuaggcucaguggcucauaccuguaaucccagcacuuugggaggccgaugcgggcagauugccugagcucaggaguucaagaccagccuggccaacauggugaaacccugucucuacuaaaaauacaaaaaguuagccggcugugguggugcaugccuguaaugcuagcuacucgggaggcugaggcaaaagaaucacuugaaccugggaggcggagguuucuaugagcugagaucgcgccacuguacucuagccuggaugacagagcaagacucugucucaaaaaaaaaaaaaaaaagaaggaaaaucaagaauauauuggucuuuuggugaacuagauuagugauaauuuaauaaucaugaaguugugaagccaggggcuuuuuuuuuuaaacucuuaauuaauuaaaaaaauaaaaaaaaagacaggggcugggcacagugucucacgccuguaaucccaguacuuugagaggcugagguggguggaucaccuggggucaggaguuugagaccagccugaccaauauggugaaaccucgucucuacuaaaaauacgaaaaaaaauuagcugggugugguggcaggugccugucguccuagcuacuugggaggcugagacaggagaauugcuugaacccaugaggcagagguugcugugagccaauauugugccauugcacuccagccuggguaacagagcgagacuccgucucaaaaaaaaaaagagagagagcgccagggucuugcuauguugccuaggcuggucuugaacuccugggcucaagcgauccuccugccuuggccucccaaagugcuaggauuacaggcaugagccaccacgccucgccacuuuuuguuucugcuguugugcuguuuuaagauagcgcuuaaccuuaaauaauuucaugacacauucuugguguucauaacucuaauucugggaacuuguugauuguuacuuucccuuccucccaaauuuuaugugccagcuacuuugaguaaagagaugaguauuuacaguaaccuuagggcuuucuucuacucuuugcuaaagucuaccaacuuggcauauucccugaaggaaugaguaaguggcuucuauggguugaaaaagcaaaaucaauuaaagugauauuauagucaacaucugacuuaaauucuuaauuugauagaacugaguacuuuagaagacacuggagccuuuucuguuuccuguagcagaucuuacuaaggacugguugcuagaaaucugcuagaacagucuuuaaguaugauaacgauaaaacuguggauucaguauguggggaaaccuaagguaagauuugaguuaagguuggggcucaggaaugcaaauaacuauaaagaaaguaauuauuacuuccuuuaaauaagccuugaggauggaggucggaccuauagaaguaaaaucuuggagguugaaauuucuucauuuucccugaaaggaguaguagaauuggcagggcagacuguuaccuaucuaucuauuugguucacugaguucucaaguauuuuucaauucuuacugauuuggggacagaaauuuccuauauucauuuauucaacaaauuaaauacguuuuaugcuauacuaauugcauauugcuaguaauacaguuaaacaaagacaaacccccuuuccucaugugaacaguaacugagaaaaaauuauacaauuauauuagguugagaagugcuguugggguaauaugaguaguuuauaagcuagggcauaugacuaguucugcacuggggaaugggauggauggguagagaaggacucccuuucucuauggcaguugacaguaguucagcuuuuggggcaagccagaaaauauucuguggcauugagagguuugaggguagguaauuuuccaaacaagcaauuagaaauuggccuuuacugauauuauuauuauuuuauuuuuauuuuuuauuuuuaauuaauuuuuuuuuuuuuuugagacagagucucccucuguugcccaggcuggagugcagucgugccaucuuggcuuacugaaaccucugccuccuggguucaagcgauucuccugcuucauccucccuagugacuacaggcgcgugccaccaugcccggcuaauuuuuauauuuuuuuuuuaguagaggugggguuucaccauguuggucaggcuggucuugaacuccugaccucaugauccaccugccuuggccucccaaagugcugggauuacaggcgugagccacugcacccggccuauuuuuucaagcaccuaccauguuccuuguauuauguuagcugcuugaggauucaguggucccucccuucauugaguauauaaucugcucucuaggaaugaaaauguaauuaacgaaaauuaccaaaaaauucuuguaaagaaaaauccuaaaauuaaaaggaguauaccuuaaacaacuugcaagugaacccuaaaugucauuuagauaucauagcuucuucagugucauuuucuguagguuaucaagauugaaguccucaagaaguuuuaaauuauguggaguugucuuucagagcucaauuaagugggaauguuaauuuuugauacugacuguguuaagaaugaauagaugguaucaaagcaguuaguuuggacaaugaaguaaguuauuuagauuauagaauagccauauuuuaggaaccacauaauggccuaacacccuaugacauuuguuuucaaaucuccuuaauuuuuuuucuccuugucuuccuuccuuucauuauuuuuuaauggcagcaagaaaacagcugucacaauuucauuaccuuugugacucaguauuaaccuguucuaaacagauuugguaucauuuguauccaaaugaacacauugcagcuacauuuuauucuuuaaauugcagguucugucaguguguguggaagaagaaaacauaauuccuuacaucaccaauguucuacaaaauccugauuuggcucugagaauggcuguacguaauaacuuagccggugcugaagaacucuuugcccggaaauuuaaugcucuuuuugcccagggaaauuacucggaggcagcaaagguggcugcuaaugcaccaaagguaaagaguuaugaaaaugaaguugucaugacauuaauccauuguuaauauucuguuucuuauauuacuagaaaaggaaccagcuuccuacagauaaacuguuuuuagauuacauuuggguuacauuuuccuuuaguagaauuccuugucaaugccucuagauuugguuaauuuucucuggauuugauuaguuuuuuaaaacccagauuguuagaaggauaugugggucuagcaagcuuuugauuuacauagauguaguaauguuuagucauuuagguguuauacuguuugaccucauaaaugauaguuacugauuuuauuuccauaacuuggacaugaaauacauacuguccaauuuuauaguggguagagcugucaaaauuaggcugaauuuauucuuaucacuuuugauguuaguuuaugguggacugaauuaacaccuuacauuccugaccaauauucauuaugaaauuuguacuuaauuuaauaugaacuugggauaauacuuagcuauaacuguuuuaugauuauaacuauucucuuacacacugacauuguaauuuaaguugauguauuuuugauucuggauaauuuuuuuuuuuuuccaaauucuggauaaucuuauaacauugaaccagggguaugaaagacagugacuaaauauuuacuccagaugguaaagauuugaaacuuccuaacuugauguuaauagauggauucauuccuuuaagauugaccuaagagauugaucucuacaggguguuuagugugauguuuggaucacuuucgaagagcguuuaacauuucuccuucuuacacuuucgaagagcguuuaacauuucuccuucuuaaagggaauucuucguacuccagacacuauccgucgguuccagagugucccagcccagccaggucaaacuucuccucuacuucaguacuuugguauccuuuuggaccagggacagcucaacaaauacgaauccuuagagcuuuguaggccuguacuucagcaagggcgaaaacagcuuuuggagaaaugguuaaaagaagauaagguacguuaaauuauguugacauaaucuugcuuugguugcauuaaauaugauauuggcaaguuaaaaucauuuaggcugcaccacaaugucuccauuacugcugguagaaacagaacaaaaacacacauugcauaagauggauucacuuauuuccuuuugaaaaaauauauauuuuuucgccgggcaugguggcucaggccuguaaucccagcacuuugggaggccaugguggguggaucaccugaggucaggaguuugagaccagccugaccaacauggagaaaccccgucucuacuaaaaauacaaaaaucagcugggcgugguggcaggugccuguaaucccagcuacuugggaggcugaggcaggagaaucacuugaacccgggagguagagguugcagugaguugagauugcaucacugcacuccagccugggugauagaacgagacucggucuuaaaaaaaaaaaaaaaguuggaucuuaguaagacaggauggcuaucuaauuagcaaugagauacuguuucccagagauuucacagaauguuaguugguguuacauggaaaaauauuuaacuugguuucuugaaauuuauuuaaauaugaaccuuuucuaaauguuaacuagcuuucuuuacuguaggucuucuccaugccuuuuauauucacucaguacuuauuucucuuuacagagagcauauaaugguaguauguuuuccugagcacauuauuccuuauguggaauagugacugagaaacagccaaaggauguuguuuguuucuaggauaacaaacaaguuuuagcuguccauuaguguuaauuccuuucacaccaccacauaaaaaagccuuucuccucaaaguuguaguauggaauugccauugucaagaacugaaguaguauuguuuaaagcacucugaauagugaauaacauuuaauguuauuauucuuucagcguuaguauauguuaggacuguuuuuauauuauuaauucuaaguccuuguuucuugacccaguuucuggcaaucuuguaagauaccagagaauacuacaucagauuugggauacuuggacaggagucucugaugaagaauagccacacuagcgaguauuugagguccauccuaauugauuaagauaaggcagggcugaguuugguggcuuacgccuguaaucccacuacuuugggaggcugaggcaaaaggaucacuugaugcaaagaguuugagaccagccuaggcaacacagcgagaccuuauuaaauaaauacacaauauuuuuuaaaaagauaagggagggugagaacagccaagguaacugaguugaccuacguaacagggugaaagcuuuuuagguaucauuauccuuuucugugaacagucauaugggaccauuugugguauuaauaaaagagacauuaaucaacuauucauuagcauguucaguuaagauuaucgacucugauacaacuuuuuauuuuuggcacuaaauaucauuuauaagagcuaguccccaaaguagaaaaucuacuauaguauguaaaccagaacucuuaggaaaugaauuuccagauugggcagcugaaugaguaaggcagacugaauaacacagaagacaguaucugccuguauacuaccuaaaaauucuuaagaguguccuuccugcccuauaagcuuaaauccaagucaagaagauaguggugcuuagaucccucagacauauauagguuacacugugaguuuaauaacuguccuuaugguaaaccucaucuggcuccuucauuaucaaauuuucaguugauaacauuacauuaaaaguugcuuuuuguuuuugaaaaauuggggccaugugaugugagucugauaucugaauauucuuaguagcuagaaguacaagagguacaagauuguacuuugaaguacuuaaauccuuaacaagguaguugauaguaucuauaagauugcagucuuggugagcuuuuuaucguuaaacaggauuuguggagaauucuacugagacauugcugugaacacaagauuaagagucuaccaaccacaaccccugcauauuuauaauauauucugugaaacuaaguaccuuucauacuaguuauuacuuauaguggacauagugucaacugcucauuucuaaaacaguucauggaucacuaaacaaucucuuuuuccuuuggacagcuggaauguucugaagaacugggugaucuugugaaaucuguggacccuacauuggcacuuaguguguaccuaagggcuaacgucccaaauaaagucauucagugcuuugcagaaacaggucaaguccaaaagauuguuuuauaugcuaaaaaagugaguucaaugaaacacauucucagcaugaauucauugaagcauugacagagaaauuagccuguauuaacucuugauuacuuuaauagugaauuuccuuucauuuugauuuacuuugaaauguauaaaaauucucuuaccccucauaucaaauucauacuuguuaaauugagaaaauuacuuuugcauggcuuaucagaauuucagauagcaggcacguuuaacauguuagaacaaacuuuugaaauauucauuuauugaaaauggauaagccaggccaggugugguggcuugcgccuguaaucccagcacuuugggaggccaaggcaggcagaucacuugaacucaggaauuugagaccagccuggguaacauggugaaaccuugucuuuacuaaaaauacaaaaaaguagccaggcgugguggugugucuguggucuuagcuacucaggaggccaagguaggaggaucacuugagcccagggggcagagguuucagugaaucgagauugcaccucugcacuccagcuuggaugacaaagcaagacccugucucaaaaaaaaaaaaaaaaagaaaagaaaagaaaagaaaauggauaagccaguuauaaaaauugacagauguuuguucaaauaugucaucaccaaggucuaacugggcaccuuaaauugaaaaugaauuugugcuuucaccaguaguucuauauuagugagauuuuauaguagaaaaagucuuuaaaugcuauaaaauugaaacuuaggagcagcguuuaagucuuuguuuguuuauagguuggauacacuccagauuggauauuucugcugagaaauguaaugcgaaucaguccagaucagggacagcaguuugcccaaauguuaguucaagaugaagagccucuugcugacaucacacagguaaugugauuaaaauauauuuuguagaagcugauugaaauggagagugggggccagccauggugguugacuugggaguccaaggugggaguauugcuugaggccaagaauucaagaccagucugggcaacauugugagacccuguaacuacaaaaaauuuaaaaaucagcugcaugugguggcacaugccugucgccccagcuacucggguggcugaaguggagggauagcuugagccugggaggucgaggcugcagugagcuaugaucgugccauuggacuccaaccugggcaacagagugagacucucaaaaagaaaaaaaaaaaaggaaaacuuacaguuuguagaaauuaaagcuuugucacucuauauggauaaaccucaaaugccuugcaaaaaaagcaaguugcaaaagaauggacaguaugaaaccaucugcauguaguuuuaauacaugcaaaacaaacaucuuauuuagagauguauguguauuaaaaauaugaaaaauacauggggaugauaaaacaggauagugguugccacuggguguggggagagggaagagaugcauuuguaagugugagucagaguccuucauauuuaugcuauugguuuucuaaaguucauaaaaauaaaggucugucaggcugggugcgguggcucaggccuguaaucccagcacuuugggaggcugaggugggcagaucaccugaggucaggaguuugagaccagccuagccaauauagcgaaacccugucucuacuaaaaauaacaaaaaauuagcuaggugugguggcagacgccuguaaucccagcuacucaggagcugaggcaggagaaucgcuugaacccgggagguggagguugcagugagcugagaucgugccauugcacuccagccugggcaauaagagcgaaacucugccucaaaaaaauaaaauaaauaaauaaaauaaaauaaaggucugucgguucaguuguauucugcuguuauguaauaucuugaaauauuuuguaguuguuuuuaucagaacucaaaauaacuaugaucccuagaggacaaaaauuuguucuuaaguguuuauauuguccaaauaaaauucucagguaaagaaagaguucaugcauaauuuugucuacauacucuccauaguaucuuaaaacaauuucuuuuaaaucuuuuuuuguagauuguagaugucuuuauggaauacaaucuaauucagcaguguacugcauucuugcuugaugcucugaagaauaaucgcccaucugaagguccuuuacagacgcgguuacuugagaugaaccuuaugcaugcgccucaaguauguguuuuaaugcuuuuuaggcauguuuccaacauuguuuuaguaauugugcagcgccucucagauuguuaugcaaagcuacugaggggccuacuccuuauuaaagaaaauguagcuauuauaauauucuuuuguacuuuaacaguucacuauuaaaccuuaaucuguaauacggauauugaauuacucauguaaguggaguggacaauaaacuugccuuguuugugguuuuacagguugcagaugcuauucuaggcaaucagauguucacacauuaugaccgggcucauauugcucaacugugugaaaaggcuggccuacugcagcgugcauuagaacauuucacugauuuauaugauauaaaacgugcagugguucacacccaucuucuuaacccugagguauuucaguuucuuaccuaauagaugguguuaguugugauuaauagguacacugaaaauguguuugugguacuaaauauuaauaauuucauaccaccaugagguucaacauuauuucauuuauucauucauucauuuauuuugucuuguagugguuagucaacuacuuugguuccuuaucaguagaagacucccuagaaugucucagagccaugcugucugccaacauccgucagaaucugcagauuuguguucagguggcuucuaaauaucaugaacaacugucaacucagucucugauugaacuuuuugaaucuuucaagaguuuugaagguaauuaggaguuuuugaguuuuuaaaaaaaguacuuaagguagccaagaagagguaugcuuaugaucaggcuguuggaaauuuuguuuuucuaaaaauuugguucuaugggacauuuuaauuuuuuaaguuuuauucaauauaugucaaggcccuuuuauguuggauucuaaggauaugcagugaaccagaccaucuguuuggauauuuuauagaugaauuaaagguagaauuuuaagagaaaaauauguagugguguugaaauuguauaaaaugaaaauacagguugagugucccuaaucugaaaauccaaaaugcaccaaaguccaaaacuucuugagcaccaacauaacgcucaaaggaaaugcuuguuggagcauuucagaaaucggauuuucagauuagggaugcugaucagguaauuauaaugcgaauauuccaaaguucaaaaucugaaacacgucuggucucaaguauuuuggauaagggauacucagucuguacuaaugaucagguauaauaaaauuuuaugcuuauaugucugacucuuauaauagcaggugauucucacuaagggcauuuugugauuuguugcuauuuagcaggauuucuuaaccuuaguacuauagacauuuagggcuggauaaucauuguagagggguguuccuguacauguagaauauuuaguagaauauucagcagcauuccugguuucuacccacuagauuccaguagcgucagcuccaccaguugugacaaccaaaaaugucuucagacauugccagugucaccugugaggaaaaucaccucaguugagaaccacugcuauacaggguacuaacguaaucacuguugggugucuaacuucugguccccaacugccuuucucuccucucuguacuaguaguacucuauugagaagggguaagagagucuaguaguuuucuuaauuuuuucuuaauuuucccaguuucaaaauguuaacugugcacuaaauuuacacuguuuaguacagucacuagccacauauaguagcuauuuacauugaaaguuauuaaagugaaauaaaauuuaauauuuaguuauucagucacucuagccacauuucaagugcuuaauagccacauguguuuaguggcuauuauauuggaaggcaaagauaagauuuucaucauugcagaaaguucuucuggacaauacugcacuaaauucuucccaaauuauuuuguauguuuccuauaaauugcauauugaaaaacaccagguauuggggucuucauuuaaaauuucccauauaggggcacaaugguguaugccuuuaauaaucccagugcuuugggaggccaagugcuuggggccacaaauucaagaccagccuggcuagcauagcaagacaccaucucuacaaaaauuuucuuaaaaauuagccuggcaugguggcaugcaucuguaguucuagcuacuuaggagguugaggugggaggauugcuugagcccaggaguuugaggcugcagugagcuaugaucgugccacugcacuccagccugggugacagagaccugccucaauaaaaaagaaaaaaaggaaacauuggguugaauugucuauucuucaggauuaaagugcaauccauuuuacugaucugauuaauggaauaguuaguauuuuuaucgcgcuuuuuaagcaaccaacuuauauuugggaguauucaauauaacaguuuuuuaauuacauaaauguuuuucagucauucucaaaagugugccuaugcuuaauuguaauuacuuguuucuuuaaggucucuuuuauuuucugggauccauuguuaacuuuagccaggacccagaugugcacuuuaaauauauucaggcagcuugcaagacugggcaaaucaaagaaguagaaagaaucuguagagaaagcaacugcuacgauccugagcgagucaagaauuuucuuaagguaagugguuuugaguaauguguuuucugguuggauuccagguuagcaguucuacaaggguuuggucauaguucaaaaauauuuuuucccuaaaugugaaguuguuagcauucuuaaguugugugcuggauuauuucuuccaaacauaauauucugugguuuccuuugaaauacggaaggaaauuggugaguaagaaugaccaucuguuuaaaagaagaaaaaaaaaauagcacuauuucaaaggaauuuccuuuauuuuaauuuuggauggaaaaauuuagaaaagugguuguauacuuucaaugucauuuuagaaucauuuaggcuuuugaauauuaacaucagcuugcucuucauaccauuuugaggagccucuauuguaggcaaagggaucuguugucuaaggaauguauagguuuaccucuuucaucaaguuugcucaacucuagaaacuaaaauauuguuauucauauauaauucauaaagguaagaucaaacaaaacgcucagcuuugugacacauuaaaucaguuagagaggaguaaggaccaccuguguugcagggaggaguaaugguugagagauucugaacucuagaacaucccuaagggcaguuaauuuuguuuaauguuuaacuuagcuuuagcuuuauucuuguaacugccaguuacuuugugauggaaauaaagcuuuaaaauugauagcuaucuauaaaaggcuaggaaaacuacagaacacuuagauuacugcucucucacugccuauuauguguguguguguacacuauauauauauauaaugauuccugagacuuuauagaaaguucugaaguauuuuuugucuuggaagaauuuuacauuacaaguaaaaccaaaauguuuuuguagaacacaguauagaaaguaggcuuuuccuacucccagauuaucaucauuugugugugugguugcauuggcagauuguucuuuugaagaauuuacuaccugggcucuagauuaaauagcaaaacccuuagggguuuuaguguaaugaaguagucaaaauguugaaacugcucuacauuuuagauuaaaagauacacuuuucaaaaaaguauagcuuuaaaaugucuuggccaucaugaauauucuggguaaccuagcugugcuauguuuggaccaaaacuuucuggugucaaaaaaccccuccaaaugagaaagauuugauacucugugcuugacuaguguacccauacuacugauucacuuccuucuuugaguaucauuacuauuuccuuuaaaaaaaacaacaacaaaaaaaacuacuacuagauucuuuugggggcaggggguguuggguuuuuuuuuuuguuuuucuuuuuaagcuuuuaaguucaggggugcgugggcagguuuguuauauagguaaacugugucauggggguuuguuguacagauuguuucgucauccagguauuaagccuacaacccauuaguuauuuuuucugauccucucccuccucccauccuccacccuucaguaggccccagugucuguuguuccucucuguguccauguguucucaucauuuaucucccacuugcuagugagaacaugcaguauuugguuuucuguuccuguguuaauacuaccagauucuuaaaugauuucuuuuuguuuuuauugagcccucagcuucuaugcuuaaauuguaacuucuuuagcuuuggauuuuaauauuugaguuauauauauauggaaagcaaaaugaaauuagcuauuauuuaauuaucacauuuuugagcuuuaaaaaaaauccucuaguaaagaaaugaaaaacaauccucuggguacuaggaugguacugccuuagguuugcauagcccaugggaucuaaucagaugaagauuuccccuccacacuugugaacuggguacaagccugauauaguagggguguggauguggauuaugagcuuuugagucagucagaccuguuucaaauucuacuuagccauuguuuguucauucaguauaugucuagcuguuaccucaggcaaguuaaugaauaugccucagccucaguuucuucaaccauaagcuauguuuauuuaucaaguaccuuguauacuauagauguuuaggcaguaacuauuacugauaagugauaagccuuggaaaaagguggagucagccuaaaugggauuucugucaggcaaguauuuauuucucuuugauaucaauuuguacuugacucuuugaaggaauuuacuuccagccaggauuagaggugaauuuagggucuuacgucuacauaauuugacaugggagcucaauacuaagaugcaacuaucacauucauccucugaugccaguguugagagugaacuuauuagauuccuuguuaaccuccaguacaggguuaugaugccucuuaucacuguuauuaaacuuaauuuuagagguacuagcuacaugauaauuuacugguguuguaaguaaacccugugucauaagaaaaauacccugacucugaucuugaauauucaagugccaauuguguguuagccaccaggaauaaagagauugguagaacauaacuucuccuuuaagguacccugugagcaggauaaaauugugucauuagcaucauuugacucaugcccuaaguuuguagaacuguaagcucucuguagaaagcauauaacuguucaucagacccaugaucugcuccuugcuaccuuugaucuuauuuucuaccuuucuuuuuuucuuucuuuccugguuuagcuucaaccacacuggccugcuagcuauuccuggaacuccccuaaccuuguccugccgaagggccuuugcuugugcccuguacuacuauucucucaugaccuucuuucuccuuuaccuucuuuggguuucugauugaaugucagaagagaggaugucucagguugccuuguguaaaauagaacccauuccuaccccauuuugcuuguuuuucuuuauaacaccacuaugaaacgucuccucccacuagaauguaaguuccuugagagaauggacucugcuuccuuuguucccugcuguaucuccaguaccuaagaacagagucugauacuuggguacucauaaauauuuguuaaaugaacaaauuuauguugaagaaaaccucugacuaugcuaauauaauuucaaguuugaucuuaaaaucuuuaaccauuauaacuggagguuaauuaaacauuuaguaaguaauuuaauauuauuaaaauguuaacauuucuaccauguauaaaaucaugugcaaauuuuagcaaucaagaaaauaaccuagauuuugucuacuuuuuaaaucugaaauuuucuuuuggaauacaguuaguauuccacaaaaguggaauuauuugccacagaaauuuuaacaccuaugcaugaaaacagaauaaguaauccuagauuaucuguaagugauaaagauaacaaaaauauuuuauauguguauagguaagaugacuaguguguugauccauacuuuuuugauguucauuuaguaggaaaaacaugacauacuaaaauuuuuacauagauagaugcagacagauucuagaaaugaucguaacagcuauuagugcagaguuuccaugguguuaaacaauacuuauuuuagaaaaccuuccuuaauguggaaaaucugcagcuuuacagacauuuuuauuuuuuaauuuaggauggcuauauuaaaauuaagauuuaccuugguguucuugggacacuucauagacuagucuucguauuauuuauaaucgaguaacuaauauccccuagucucaggagccauuuaauucuaaccuugaaaauaauguucuuaguggccaucacuggggaaaguucuacccuacuuaguucugcuucccuaguagacuguguuagaggaaucauuuauugaggaauguuucacuguguauaaaugaauuccugauggaaacuguuguuuuuugugcucuaccuuaugucuguggaauguaacaggacauguaucagguaaaugcccaguacagguuuuacuuaccugucuauaacaucuucuaugucagucuauaaguaggauuguaguuugguaucuguaauggaaugauaaaagcaguuggcaauuuaaagauaucuuuucuuuaaaugcuggguuuuuuuuuuuguaggggguggguuuucuuauggccacauguggucaccaucaugcugcuccuuguaggcuuuguuauaauagaguauuagaggcugguuguauagauuggauguggggagggauagaaaaucauuaguuugaaacaaauguaagccauuuaugccauauguuugacaaugugacuauaguuauuaaguugauuuuaaauacgguagaaguguuauuaccagugaaagucccaguauggugaauuuaucaucugagagccacuggcucagguaucuuaauuuguuacucuuguuuuuugguaaaggguguguaugggaaagacuugguaucuugcugugugaaucuaaguauugcuuaguaaaaauuuacugaaacugggauguacacacucaacuauugggacauucuuucuuuaacagaagagcuauguuugugugagccucucuuguuagcguagaacaaauucucauauguuacacagauuugauaccucauagaagaaauuuaaaguuuccuuuuguuugucuuuuuuucaggaagcaaaacuaacagaucagcuaccacuuaucauugugugugaucgauuugacuuuguccaugauuuggugcucuauuuauauagaaauaaucuucaaaaguauauagagauauauguacagaagguaaguaauauguagguaauguaaagguauaaucuuacuauagauuuuauuucucauauucuggaaauccuuuugaaacucugugcucaauaagaguggucugcagcuuuuaacgugggauuuuuuguuuuuguuuuuguuuuggagacagggucuugcucugucacccaugcuggaauacaguggcacaaucacagcucacucuaaccuuaaacuccugggcucaagcaguccuccugccuuagccuccaaguaucugggacugcaggugcauacuaccaugcccagccugcuuuuaauacuuuuuccccagcagaauccuuucuuggaauaaaauucuacgugcuucccuagcaagccgacucagggaagggggaaaaaaaaaacaugcaugccaaguguguaaaauauaagaauagaacugcuauuauugaaaaaguuggguggccuagggccuuacuaacuugauagacccugagguauccauguagacuccaaagcagaguuuucaaaccaucuuaaauacagauauuagauaauucaccuucuaacuguagaaacaggcaguauugcuauaaugggagccuuuuuauuagacagucuugcauagucaucuuugacuguaucuucuuuggacuuauuuaucauauggaacaauguuucgguaacuaaccaaaccgguagagacagaauauaguauaugugcuuucaauacuuauuaaaccaugaagucuuguuuuuagcuggacuuccugcuaaauuccucuaucuaguugcaaauuuagacccucaguuuauuacugaauuuaaaaacugaacuuaaagaaaaaaaaacugagcuuaaaagcgauagagauaaaugcuuuuuuaaaauuccucuuugcuuuuaauaacauaauaacauucuucuacuucuuuuuaaccacaggugaauccaagucgacuuccuguaguuauuggaggauuacuugauguugacuguucugaagaugucauaaaaaacuugauucuuguuguaagaggucaauucucuacugaugagcuuguugcugagguugaaaaaagaaacagguguaguaccauuuuaacagggauaaguuacucuuucuuaacauggcaauagauaaaaauauagguagucauuuguuccaaagcuacuaaauaacacauggagaauaauuuccugaagacaccuaacauagaggugauaagcuagcuaauagcacugggaaaaaaucuguuuucugaaacauuauagcugucauaggagaucuguuaacuugguugaucauuuuuuuggcauguuuauaauuacagcuaugugguuugacuuuauauguuuuuauauaaacuauguacuaagucuccuguuuaggugugauaccuguguauuuaacaacuaauucuguacugaucaaucaugugguguuuccaaccugagaaagcugauuaaaaaaaacagugugguguuuaagugugaggcaaaagaguucccugugcaacucuugaguucaauugauauuuaauuuacaguaccuuaacaugauaauauggauuuccaauagaauauaguauaagugcuucuaaaacuuacagacugugaagucuuuuuuuagcuggaacguucugaggaacuaguguuuaggaaguacugauguaaaugaguuuggugaggugguaugcuagugggaaguucugcuguuuaugagaagaaauuaagaaagucuguggguuucauuuuaaccugaguugauauaggugaucuacuaauuauauucuuagaauuuauauuagaauguuucaaacauggaaaaauuuugcauuuaaggguaauagagauaugcaguuaauacugaccuaaagguuugagccuaguuucaagugauuuuaugucauaacaauuuaacauuuaauaagagguucaguugagucugaaccuauugaaucuauuaccugaaaauaaucuuacugcauauuccaagcaaauggcaguuacaguuagauaauuuagucuuuaagugacaaauuauauugugaaaagcuagauucacaucuaagucacuagucuagacaugccucagcuaauuuuuauuccuuaaguugacauggcguaucuuggauugcacauguuuauaggagcuggauuuuugccucuauuuauuaaaauugucuucucccuaaugggaggguucauaauaaccaugugaauuugauauagccaaaauaacgaauaaugcuuuuucucuggcugcuuuuaauguuuaaaucauugguaaaagaggcuugggccaggcguaguggcuugugccuguagucccagcuucuggggaagcuaaggugagaggauugcuugagcccaggaggucagggccgcagugagcccuccacugcacuccagcuugggcaacagaagacccuggcuuuaaaauaaaaauaaaaggaggcauggucaucaggacuaucgaaacaagcuauaguauagcaaaacugugcuccuugauggaguguuuauaugacagcugcaacuauuaaacccagagcuucuaaagcuaucagauuuuauucccaauauguauuuaggguuuggcuguagguaaugcuguauguuaauuguguuaaagcugaaagaacucucagauaaucuggccuauguaauaucacauccccauccuauccacaaacaaaauuuucugaagucuagauauuuuguguguuauaaagaaaggacacuguaugaaucucuaaucuuuuauucagauauaaggagguaaguauaucauauagcagauaaaccugggagagugaaaaauagccuuauauaccuucuuuuuauucuuggacaacucaaucauauuuugagucuuaauuucccaauuuauaauaggaucacugauaauuaaaauuaauguaaagccagguacaguggcuugcaccuauaguaccagcuacucgggaggcugagguacuaggaucacuugagcccaaggcuguagugcacaaugauuguggcugugaauagccacugcacuucagccuggacaauguagcaauacucggggggcggggaaaaaguaugugaaagcacauuauagaccauaagguauuuacauaguuagcaugucaagaguguguuauuuauaauacaguaugugugugugagguuuuuuuccuuuuuuccuagauugaaacugcuucugccuuggcuagaggccagaauucaugagggcugugaggagccugcuacucacaaugccuuagccaaaaucuacauagacaguaauaacaacccggagagauuucuucgugaaaaucccuacuaugacagucgcguuguuggaaaguauugugagaagagagauccacaucuggccuguguugcuuaugaacguggccaaugugaucuggaacuuauuaaugugaguacugcuagcugaauauguagagaagcugcauuuuuaaaaaccuguuacaugagaguuucaggguaauuuuagguaauaugggacauuuggggacggugggugcuuuuuuaaaacuuuauuuggaaauaauugugaaucugaaaguggccaaauaguggauaaagucuauauacccuuuauucugauugacuugcuaauguuuuaaccccacuagccuuaccauuuguguucucacacucuuacacucaggcacaccauucauacauauguguauacacacacauacuauuuuuuaaccacgugggaauaacuugaaugcaucauggccuuauaccccuuccgaguguauggccuaagaauaaggauguucucuuucauuaaccacaugaaagauaccagcuucagucaguuugacauugauaggauaccuuuaaaaaucuguucuauucuaguuuugucaguuacccaaugauguccuuuguagcaguuuuuuccccucuagucuaaggucauauauggcauguaguuuucaugucuuuagucuccuguacuuuggaaugguucuucagucuuuuguuuucuaugacgcugauaucuuuguaaacaauaguugcuuuuucuauuuguaacuauuuuauauaggugaaauuucaagcaacaucaaauuaaccauuuuaaagugaacaauucaguggcauucaguauauucacaauguuauauaaucaccuuuaucuaguuacaaguuuucaucacuucaaaaggaaacccuguauuaauuaaacaguuccuccacauacccccuccucccagccccugacaaccaccagacuguacugucucuauggauuugccuauucucuauauuucaucuaaauguaaagucucuuuuuaaaaaacagaaugugucucacuuugaguuccucugaugguucccgaugauuagauuuagauuauacauuuccacccagaguacugcuucaguggugguuuguuuuucucuugguauuauauccggaagcacgcaguguucauuuguccccuuugucaguuuuuaucaaguuguaacaugucuuuauuacauaauuauuacccucuuggagauauuaaacagucuauaaguagucuguaguagacuaugcaaauauccucuuacccucucccuuaauuuagcaucuguugauucuugcuuaaaccauucuuaauguguugguugcaaaaugaaaauuuuucaaacuccagcaguuucuccacauuugucaguuagcacucaugcauucaugaacucuuggauuuuauucgaugggcuacaauucacuacuauuuauuuugaugcucaaauugucccaguuuugacuggugagaaccucuucagucugugucuuugugucaugggcucauuuuucuuugagcacuaacuuauuuucuggcacacaauacaccaagcucauuuuguaccuucagcagcccugaagucagucauuucccuagggaaccuuuuacuggggcauuagaaaccaagaucugggccaggugaguggcucacuccuagaaucccagcacuuugggaggccgaggcaggaggaucacuugagcccaggaguuugaaaccagccugggcaacauagcgagccccccgucucuacaaaaaauuacaugauuagcuggggggaggugccaugcacuugguuucaagcuacccagaaagcugaggcaggaggaucacuugagcccaggaggucaauguugcagugagcuaugaucgcaacacugcacucuccaaccuugacaacagagcaagacuccuacuuucugaaaauauuagaagucaagaucugagcuuuaguguauuugcuucuaagaucuuucaguggucagggcuuaguuacauuuauguacauacauaugcucauuuauguacauacaugugcauauacgcauggaaaaauaaacacacaagaacagcuaguaaaacacugaaaacuguaaaaguggacuaguccuaccagauguugaacuguguauuacaaagucuauauaauuaaaacaguauauuacugguacaugaaucaaaguccaaaacuagauccaauaucaguaagauuaucaauaaacauaguuuaaaagauaggaaauacccucuaaaaugcuauaaaaaguccuuuacuuuuuaccuugaaauuaaucuaucauaucuucuuuagguuugcaaugagaauucccucuucaaaagucuuucucgcuaccugguacgucgaaaggauccagaauuguggggcagcgugcugcuggaaagcaauccuuacaggagaccccuaauugaccagguaacauuggcaaauguguuuauggcugucaguaaaaauuauacauuuuuaacuaugaauacaauccuuucccucaucauguacucaaauggaucauauauaacuaugagagaaagcaauacaaaguagaagaaaauuaaaauuuauauauauucaauuuacauucauuuguauauaaugaauguaaauugauuauauacauuauauacaaaugaauguacauuuauauaaguauaaauauguauauaacauacauuaagaaaaauaagccaugugcgguggcucacgccuguaauuccagcacuuugggaggccgagguggguggaucaccugaagucaggaguucgagaccagccuggccaacguaguaaaaccccaucucuacuaaaaauacaaaaauuagccaggugcauguaaucccagcuacucggcaggaaaaucgcuugaacccgggagguggagguugcaguaagccgagaucacgccauugcacuccagccugggugauaagagcaagacugucucaaaaaaacaaaaagaaaaaagaaaaagaaaauacaucccaaaagaccugacuuaauuauauaaaacucucuugguucaucauaguuuaaaaggaaaauaacaaacuaaacauuaaagauugcuauuauuaacacuuaaguggcuaaauugauuggaaacuucaagauaauaagucagaaaaauauaaggauaagagaaaauacaaaagaccaagugcaucaguguuauaucuuacuaauaagaaguauagaacugcaaaugagaugggguuuuauaccuaaauaaaauagacaacauauuuuaaaaguucuaaaaauagaagaguuguuauaaugagucuuaaauucuccugagauaaguauaaauaaaauauuuuggaaacgaauagguugaaggcuauuaauauuucauuccuuuccuaggaagcacuucuaagcaacauucccaaguaguuacaaagcuuccuaggggaagguugugggggugggggcgaugguuggaaaucauugcagcaucuagaaaaccaagcaaauagccaaaaccagacgaauuaccgauauuuuaauuccacaucuguguagcugaauuuugaauuauguguagccauuaaagugauaaugaugauugcuagccuggauaauguuuuaaucagggaaaagauagaaauuauauaauuagaguaauuuuucaacacaauuauacauauuguauagauuuguguagaaagaccucucuauguaaauuuaaaggucuuuuuccuacuucauucuuuucugccuauuucaaguuuucuaaugagaggccaacuuacgcuuuuuuaaaaccaacuugauucucaguacuuaugucccauauauccucuguagguuguacaaacagcuuugucugagacucaggacccugaagaagugucaguaacuguaaaggcuuucaugacugcagaccuuccuaaugaacucauugaacugcuggagaaaauuguccuugauaacucuguauucagugaacacagguaugcuuucagagggauccauuggcuauuuauagucagucuuuaauaaauuauggcccaucaguuuugggaaggaacaaaaagaucagagaaaguugccugaauucucacucuucuaauauccuccccccuacccuaccucuugagacaaaaaccucuccguuagucacagugguuauuuuuuaugucggauaaacuuaaaauauugcauuuaaaauauucuuuuuuuucuuaaaggaaucugcaaaaccuccuuauccucacugcaauuaaggcugaccguacacguguuauggaguauauuaaccgccuggauaauuaugaugccccagauauugccaauaucgccaucagcaaugagcuguuugaagaagcauuugccauuuuccggaaauuugaugucaauacuucagcaguucagguaaaucuucagauuaccuaaguugaauuacuaaacacugugcuaugagggugggccuaauugguugcuacggcaauagagcagcaauaaaauacuaacagcuuaaauguaauugcuuuggguaggauugauuuuacucuaacccuaauuucaaacuuggauacuuaggucuuaauugagcauauuggaaacuuggaucgggcauaugaguuugcugaacguugcaaugaaccugcggucuggagucaacuugcaaaagcccaguugcagaaaggaauggugaaagaagccauugauucuuauaucaaagcagaugauccuuccuccuacauggaaguuguucaggcugccaauacuagugguaugacuucuuaccuuauguauugaaaccucauaaaaugauuaagcuaagcauuaagauaucugucuauucugaauuuuagaagaguuggauacugcaugguuucuuuuagugcuccaucuuaguccagauaaaaagaggcuguauuuugugaauuuguaaguucacaaaacuuacaaguggggaagaugaaucuucuguuuuugaagucucauaaaauccugauagugcucuaaucuuaaaacuuuaaggaaaaagaauucaucuauucauuugguccgugauaauacagaagugaaauauugcacgguuuacauuugucauuauccauguuuccuugaaaaggaaaugaaugcaauuuucauuuacuugggugaaagauaaacuaggauguuaguguuuggauauauuuuuucuuuuucuauacuuaggaaacugggaagaacuggugaaguacuugcagauggcccguaagaaggcucgagaguccuauguggagacagaacugauauucgcacuggcuaaaacaaaccgccuugcagaguuagaagaauuuaucaauggaccaaauaaugcucauauccaacaaguggguuuccuuuucagauuuaagaaaaacuaguugggcuacuugauuagcuugguaggaucaaaacaucauaacugaagaauuccaaggaaaaaucuauaggaaaacaaauucuuucucauugugaagauaucaauuugaaaagaggauuaagcucacacuaauaucuugcugaauguggguuaccuuuuuuuuuccagguuggugaccguuguuaugaugaaaaaauguaugaugcugcuaaguuguuguacaauaauguuuccaauuuuggacguuuggcaucuacccugguucaccugggugaauaucaggcagcuguugauggggcuaggaaagcuaacaguacucgaacauggaaagagguaaucuaaacccaaguuugagugaagaauuaaagaaacgcuauuuaaacauuaguuuaaauaacuagccauguuuuacauuugaguucacagaaaggaaauguuuauucuaggucugcuucgccuguguagaugggaaagaauuccgucuugcucagauguguggacuucauauuguuguacaugcagaugaauuagaagaacuuaucaacuacuaucagguauuaacgagacuuuuauaugaccugagaucuuuuaccauagauauucuuaucuuuaacugcacauuucucuuguucaggaucguggcuauuuugaagagcugaucaccauguuggaagcagcacugggacuugagcgagcucacaugggaauguuuacugaauuagcuauucuauacucuaaauuuaagccucagaaaaugagggagcaccuggagcuguucuggucuagagugaauauucccaagguaaccagucauuguaacacagugaagcaacuguguaguuaaaacuaaugcuucaaaauaucuuauucuuuuuaaggcuguuagcuagacucauaucuaaagcaauuaagucuuucuuaugcaggugcuaagagcugcagaacaagcucaucuuugggcagaacugguguuuuuguaugacaaguaugaagaauaugauaaugccauaauuaccaugaugaaucauccaacugaugccuggaaagaagggcaauucaaagauaucauuaccaagguguguacuuucuucagaagauaaaggauucagaaggagaaagcucauuaggaaguaacugacuuauguauggauuuucccauuguagguugccaauguggaacuauacuacagagcaauacaguucuacuuagaauucaagccucuguuguuaaaugauuugcugauggugcugucuccacgguuggaucacacucgugcagucaauuauuucagcaagguaaaguaauaauuuuaaaccaaagcuucauagcaaggaauuaggacauacuucgauaacuuuugucccugggacuucaauaaugugcuauauuuguaacaaacucuuuauuuuaaagguuaaacagcuaccacuggugaaaccguauuugcguucaguucagaaccauaacaacaaaucugugaaugaaucauugaacaaucuuuuuauuacagaagaagauuaucagguaaaaccuuuugauucuugcacauaaucucaagacucauaaaguuauguuuucccauuuuuuaaaaaagccauuauccuuuaggauuguaaacaguaggugcuugcauaccuaggaucuaaauuuaguaagauuucaggauugauaaaucuucuaauuaagugccaaguuuucagaauuuugcucagaucuuguauaagauacugcuuuugaaaaaaaugauaugauuacuuuaucucuaacaucuagauuguagguagagucaaaaaugucuuugaccacuuaacuaauucauaaaauuuauuugguauuaacuauauuuauucaccauuuuucuugccuacuguuuuauuaguguuuguauaaacuuucucuuaugaaggauuucacaagcaaaagugaaguagaguuaagcuuaagcuacuugccuuuuuuucucucucuucauuuucuuugaggcucagcgcaugcagaucuguacugcugccaugcugaguuuuaucagaaguuucucuagagcacagaaucuugcccuccaugccaggcguggugacucacgccuguaaucccagcacuuugggaggccaaggcaggcggaucacgaggucaggagaucgagaccauccuggcuaacacaaugaaaccccgucucuacuaaaauaccaaaaaaauuagccgguugugguggcacgugccuguaguagcagcuacucgggaggcugaggccggagaaucgcuugaacccuagaggcagguugcagugagcccagauugcaucaccacugcacuccagccugggcaacagagggagacuccaucucaaaaaaaaagaaaaaaaucuugcccuccaaauuagaaauauuguccauuucauagccauauguuaguccuugauagugaaaaucuuggagaaaaugguaucuuuagguaaaaugaaaaaucauaccuuuugaugcuugaaucuaggugucauauuacauguuaccaucuaaggggcucauugauugagaacggaauauaauguuaaacaaaauacugaucuggcauuuggauggcuuuuuuuuuuuaaggcucugcgaacaucaauagaugcuuaugacaacuuugacaauaucucgcuugcucagcguuuggaaaaacaugaacucauugaguucaggagaauugcugcuuaucucuucaaaggcaacaaucgcuggaaacagaguguagagcugugcaagaaagacagccuuuacaagguugauaaaguugcggggcaggggcuguuuuaaaccaggccuaaaaugguguuacaagugauuauaaucuauaaauaaaaguauugguuuugugaauaugagagcugacuuuaaggcaauuuaaguuaauggauuucuugauucuaggggcucucuuauguuaaggucaaacuugucuggggaaaaaaaagcuuuuagcuuaucucuucuuugaaaauuuuaauuuaaaugauacaacuaggaggcuuuuuuccccuugcaaaaccagauuuauauuggaaaguuuccauuguuuuucuugguuuacuaguucaguauguggggucuaauguuuuugacuuucacuauuucuuugaauaggaugcaaugcaguaugcuucugaaucuaaagauacugaauuggcugaagaacuccugcagugguuuuugcaggaagaaaaaagagagugcuuuggagcuugucuguuuaccuguuacgaucuuuuaaggccagaugucguccuagaaacugcauggaggcacaauaucauggauuuugccaugcccuauuucauccaggucaugaaggaguacuugacaaagguaaugacucuucuaaguguauucagaacuaguuuccuugcauguaaaauucuacaugcacauuaauuuuuuuaaaugcuuuuuucuuuaguagaaguaagucauuuagucgaucauaaaauauuccuguucuuuugaaauuuuuuuuuaauagcugacaaaugacacugauuggaaggggaacucaaauguagcuguuuacccucaguguauuuaugagggugaaaauaaucuauguauuuuuuuauuuaaaaaacuuugauaaauuuuauuucaaaauaguauuuuucucaaaaucaguucuugugacucaaauauucaugacuaguauuguagauucccuuuuauuugguugguuccugacuuuaaugaugucuaugccuguuuccccuggggaagcugcauguauauucuuaacauccuuuuaaucuucacaauuuuuuugauaguuuaaccccugauuuaaaaauaccauaggaggugaacaugggaaaaaaaaaacaagcugggggucuaauugccuuauaacauucacuauucgucuuaguguccuuuuuugauguaugaauuuacucacccuaucuucagcaguuacuagcugucucucuguagaacauuuuuaaaugguuuuagaggauccuuuucgucaaagcaaaaaacaugauuaaaaucagagucucacaucugauuccuucagccugccugaguuggggggaugggagggugaagaagcgcuaccaacaaccccucccauacugaauuuuuccucaggauaccauuuaauuagauaccauugugucuguuuaaaguuuuuaaagaauuaacauuuucuguauucaauguaagagaaaaaacauguugccuuaucuuagccauagaugagaauagcuucuuaaacauaaugccaacuugugagaccugucuuuaagcugcuguuaaccuaagugcuguaaauuuuucuagugauuaagcugcuuucuuucauacuguagcauaaauucuucugcauuaagcuuugaaguuacacaaaauucuaaauuuugcuuccaguaugcccuuuauuuucacuucucucauaccuuuuuagugguuagauguuucuucccuaaaccuuuguugcugauucuaccuuuuuaugcucaauauggaauugauuuuuuuucuaagcugcaccuucugaauuccuuugcagguugaugcaauaaaggaaaaggugaaaguugauucuuuaacaucuuuaagucuggaggacuaagucuaaggaauuugcaugauguuuuuccuuccucuucuacacugcugcugcugcuuuuuccccccaauaaauuuucacuaaagccucugcaagucccuugaaacauaacuuuaauagagcuguaggacauuaguagacguuugcuacuaaucggcuaauaggcuuuaggaagggcaggaggcuaaucaguaguugguucacagucucucuuaaauauauuaugaaaaacugaguauggugaguuuccauauuaauuucaaaguaacaggaaauuucucuucccugucaggguaucuggaccauaauaggacugucauaauccuugaaguaaauuaaaacagccucugguuuuacuuugugagcuugccugacaguugucgaauuuauauauguauauauacaugcccuaaaaggcuuuuugggguuuuuuuuuuuuuguauugaaggacugugauccaguuucugaucucuugauucuuacuaauuuuuugcugaaaguagauacgagagauacuagcugcuuccgaagagacuuuccucauguuucuccagguguccaguucuuauggugcuaguccauuuuuaagaggaaucaaaaccuuuuuaaucaugagagccaagcuugcuauaauuguugcuaagcaacaugaauuauuuuuaacaaaguauuaacuucuacuuucuguaauaaggcauaccucugaagcuaccuaaaauuugcucuccuauuuaucaguuggcuuguccaaggaugucaaauucaggcaccuuuugguugcugcuuccuucauuggcuugucuccaucccaauauaaaugaaacaaacuuacgucuguuaucaaauugugguuagaaaagggugggaagguaaaggagaguugaaacaaauuuaaaagaauuugggugggggacaaugccuugggauuauguugaaccaaacuggaaucaccacuggaacuuagggcaaaccugaguaaaaugcauugugugugagacccuucagcagcuaguaagcaaggcaguuagaaagcgugugugugaaaaacagguaauugaacugcaguguuaugcauuguuuuaaaugaagcauguacaacagucauugcaauuacaucauacuauuuuugaaacucuuauagcauugcugugggcuguguguguuucuugagagccuguauagcaagucaucuucagaccucacuucuugcuucaguacuuuugccuuuuuuucaugcacacauacaccaaaauaacugacugcauguuacuuuuccucugcagcacauugcagucuuuguggaaaagccuuuuacauuuuagugaauuuucaguaguacagauggaacugaauucauugacaugcuuaccuguaauuuuucuuuuuaaauccaaggaucagaaacuuuaguuacagcucuuaacaaaagcuuguguucuuaaaagacuucucugcuuuuuuuuugagcaaucuaaauuggaucaguggaaacaaaaauugaaagucccugugccagaggcugucccauuauauagaagaaucaaacuuuuugcuuagcuugaugcuauuccuucagaauucuucccccuacgcccaaacuuccuauguguaugccagggcauugugauauugccagcucuucuaagucuuccauguguuucucuaauaggacuucuguguucaacaucugauucagaccuuaacuuuuaaacacauguucacuucagauucuuuucccuggaaguccggaaauguauuaugcagugguggcuuuuugguuguuucauuuuucuucuuuuuucuuagaaguuacuaauauacaggcauccauguauuuuucuuuauaacuucuguagcucuuucuugaauacugguuaguuagcaaaaccccaucugauccuugauggcacagagcugugcuuuaaguucuauaacuaauaauuuuuguucuaaguguggaugccaaaaaauggacauuucauaugguacuuauacuacauaauagucuuuaauuugauauuaggguaauuuguaacacaucauuuagacuauaaaguaggauaauaguguauaaaaguaaacuaauccaucuuccuaggcuagaaauuaaaccacauuucaucugaaggagccuacuuaggcuuacuuuucucaaacuuucaguucccuaacaaauuaagauggauuagacucauauuuaugguauuuaauaugaaacaauuaaauauaaaacagugcccuaaccuuaauggccuaugugaagacugaaagauacuuuuuuaauaguuucaaacagaaaugaggugcugccuuaaucuuuuuaggaccugguuuuuagaaacuuuuccacugaagucuacaauuuuuuuuuuugagugauuuuucauaauuugccuuuuugaagaacaugcagugagcauucauaaaguguuucccccugcaccuuggccccccgucucaugcagcacauuuaugacauugaaaaccaccaguaauagauaacauugagauuugaaauuuaguuuuacuuagguauaaugacagaccaaguauaaggcuuugguugagagaccagcuuuuaaauauugaaagacaaauauaguguaaaaggcgcaauggaauuuguauagugaaggagauucucuagucccaggguuguaaugucacuucugucuaauucauuacagaauuacagaaucaaaucauguuagcccuagaagaaacugcagaucauuuuguucaaucuucucauuauauaggaaaggaaauuugagggccagugcaaugguuugccaaggucacacaacuaguuaguggaaggauccaggcauucuaauuccuuucuuucacuaauacauuuggccugcucuacagaauuacuucugucugauacuauccacuuugaagaguagcuagcauauaguagccauuuacuuuuggcucaauuaaaagcaaacauuuuugggacaaaaucaggcuuuccugauuacuucuuagauaacagagcccacacaguauuaaaacaugcagccuuucuuuaugcaaaaagauugaauauggagccacuugaaucuuaaacuucagucugcagcuauaaccaauaucaucagaaguuauacacaauuggcaaaagaauagcuuauucugcccaaauacuuguccagucacuaggaucauuucacuuuuuugaauaccauuugcuuuggggagggaaguauugccagaccaugaauucauuauuaccucugaucaguuuuaaacuucauuugaaaagugguuccuucucguuuucucccucccucaggcugcauccuagcaugcccaguuuuagucuggcaugagcuuuuauggcauuuugaaucccuccuuccugaggguuuauaaugacagugcugaaaaccaccuggacugaaguaugaacauugccauugaauuugagggggacugagaauguucuuucuagucuguuuuauuuugacagaauuuaacauacuaaggcuuuuccacuuucugccauaaaccuagguuuauaauacuuuuggggugcuaauuaacaugauguguuuuucuccagguggauaaauuagaugcuucagaaucacugagaaaagaagaagaacaagcuacagagacacaacccauuguuuaugguaaucucucucuguaaccucaaaaaauucauuagacaaauauuuaauuacuuagagacugugccucaaaauagaauacaacaagcuucuaaagugcaaaaggcuuucuaagaaauacugcucucuacugucugauuuuuuuucugagaagucauaaagcagguguugauauuauucacuaaaauaaucuuaaauacaagaaaacucaaaaauagucauuuaaaaucauaacaugaaucuuuccuaucaucuggucccucacgcauuaccugcucauaaauuacugaaaaagaaauauugaugaauuccauuuucaaaagagcaaaaggugagagaacaugccaaggcugucuuuaguaugcuuuacauaaagaauacauccucauuuuaaauucuaacuggggcagagaacuggguagaguuuccauuugagaacuuuccagagagauaggaucuucaaacucucaagugaauauuuaagacaauuucaugucuucuuaaaccuacaugucugaauuacugcuccuuuccauuucauaguuggugaacagauucauuugaacaaucacuuugaagaguauagguagaagcacaauaaccaggugagggaacauaaaaauaugaccauuauggcugggugcgguggcucaugccuguaaucccagcacuuuggaaggcugaggcgggcggaucacaaggucaggagcuugagaccauccuggcuaacacagugaaucgccgugucuacuaaaaaugcaaaagauuagccgggcgugguggcacaugccuguagucccagcuacuugggaggcugaggcaggagaaucgcuugaacccgggaggcagagguugcagugagccgaggucgugccacugcaguccagccugggugacagagcaagacuccgccuuaaaaaaaaaauauauauauauauauacauauauauauauauaaccauuauauaucaggcuacugacacaaauaauaauauauacacuuauuaugguuuugucuccuuuuuacuguagauaaaaaguacuuuaggaauuuagaggacaggauaguuuugauaaaguggguucuuagagaugggagcaagauguuugacauguuugagauaggaaacacaucaaguccuuaaaggugaaaaagacauaggaaacacaguaggaacaaaaaaaagauggguguaauacuuugggguuaccuacugaauuuggcuugccuucaggguguuuucauggguaguugaaaauuggguuggaauuucaaguagaugucauuaucaagauuagggaugacuuuuuaaaaacugguuucuguuggcugggugcaguggcucacgccuguaaucccagcacuuugggaggccaaggugggcggaucaugaggucaggagaucaagaccauccuggccaacauggugaaaccccaucucuacuaaaaguacaaaaauuggcugggcaugguggcaugcaacuguagucccagcuacuugggaggcugaggcaggagaauugcuugaaccugggaggcaaaggcugcagugagccaaaauugcaccacugcauucccugggcgacagagcgagacuccgucucaaaaaauaauaauaaacugguuuccaauaauaauuuguuugcugaagacagcuuugguuguuaaccacaaaaagcaaagacaugaaguccuuuguguaggagaaaucuugaucuagguuuacacuguagugggauguuaaaaauacuuuuguagggguagagagagguguuacuuguuuucgcucucuaagccaaguucucuacaggucauguuuucuguauauggccaacaacuauuuaaacuuuauaagaaagagugucaacauaguauuugauagaggguguauguucuaauguauuucauaccuaaagaaugucugaauaugucuuuuuuuuucccccaagauggggucucgucugucacccaggcuggagugcaguggcgugaucucggcucacugcaaccuuugccuccuggguucaagugauucuccugccucaaccugcugaguagcugggauuauaagcaugcaccaccacgcccggcuaauuuuuuuuguauuuuuaguagagacgggguuucaccauaucggccacgcugguguccaacuccugaccuaaugauccacccuccucggccucccacggugcugggauuacaggcgugagccaccgcgcccggcccaaaugugucuuauuuuuaauuuaacugcugucucuaaauuaguacuggaucuucuauaaaugaauuugguuucauugccauuuagacauguuuaaaucagaaauuuaaauguaacucuaaaaguuauguuaaaaacaugucauuuagaccaagcaugguggcucacaccuauaaucccagcacuuugggagggcaagaugggcugaucacuuguggccaggaguucaauaccagccuggccaacguggcaaaacccugucucuacuaaaaauacaaaaauuagcuggacaugguggcgcacacccauaaucccagcuacucgggaggcugaggcacgagaaucacuugaacccaggaggcagagguuucagugagccgagauuacacaacugcacuccagccuaggcaacagagccagauucuuuuuuuuuuuuuuuuuuuuaaaaagucuuuuaaaaaauucuuuuauugugcugauuuuauugugucaugaaguguaauaugcauguagguaugugucaaguauacagagugucaggcauacgguguucagucauaagcaguucuggccuuuggcccugcacuguuuguuggcuuuuuagguaggaaccuucuuagaguaagacugucaugcuaaaauuguagcaaucaaaugugccccccauacaacucauuugagguugagauuauguugcuagaguggaggagauuggaguguucuaaaugcuaacaguuuguccugccuccuugccccugcccccugcuccuuuuuguuuucuucuacuguaggucagccccaguugaugcugacagcaggacccaguguugccgucccuccccaggcaccuuuugguuaugguuauaccgcaccaccguauggacagccacagccuggcuuuggguacagcaugugagaugaagcgcugauccuguagucaccuauuuucguacugaaacaucgucuuuacccacuucucaguuuauaaugggggaaaacaggcaacguguucuuguaaccuuuauuucaugaaggacuucuuuuuguuucuaacuauaaacuuggaucaccuauguuaaaaccuuauuucacauuccacaucauuuuagaauuuauuuucgaaggggaauaguuucaauguuuuauucacuugggcuuuuuuucuucccccucuuucuuuaaagaacugcucaauauucaaucuguugugaagaaccugauuugcacucuguaguguuuaaagaaacaaagaaacucuaauauugaaucucuuaaauuuaguguauguaaacagcuuacaaauacguauugucuaaaugcauuuaaaucuguuuuauucaaagaaaagcuaaagcaaaaacacuggcauaugaccaugcaagacugucagugccaacaaagacaacacuaaucagcacaucguacacuggauugcagugcuucccagauuauugaaaaauguuacagacaacuugccugauuuuuaaaugagcguaaaaggcccucuaaccuaugcagguuuccccauuaugcauauagaaaaugcuaguauguuuugcucacuucauauguaacaggugcccuuauguugugcuguauccugugcuuuuucugugggaccauuccauucaggagcaaagagcaccaugauuccaaucuuguguguguuuacuaacccuucccugagguuuguguauguuggauauugugguguuuuagaucacugaguguacagaagagagaaauucaaacaaaauauugcuguucuucaguuuuguuuguggaauuugaaauuacucaaauuuaaaauaaauuacuggacuguggaaauaacauagaauugaaguuuuaauuaaauaccacucaaacgaaaagaacaguaguuuuuguaguuuuauauuggauacugaggcauuagggaggcaugaaaggaagaggaaugaggauugagacaugugaagacauugugcauuauaucaaugugcauuccuguaguucauuaacaagguacaugcaauagucuaaagaaccagagucacuacuauaguggcuuaacauuuaaucugucuccaauauuuuaaccaagugacaccgagguuuuuaucgaagcauuucacuuaaaugaacaaaucauggcuguuauauuaacuugaaauaaaauauauuuaaacauguaguuaaca

SEQ ID NO: 16751 - RNA, 1011 nt, Homo sapiens
ugacuuuuccacuuuaaugaauuauggcucuuucacccgaaggcuugcuugcaaaauuuugcuuacccuucccucucaauuccuucccacuucccucaauuauggaaugucaaaugucuaaacuaagagacuaggcuucccugugugaaaacaucuaaaaagcccuucacuuucaacacugagcaccugacggaaaaucuacuccauucucucaucuggauacggggccgguauaaccaucauuguugcaguuacgcaggaggcaccucgcagcucagucuagaaaggagucgcgucucugccgccaaacaacaaggcacucagcccgggaaaagacagacuggggugggaggaaaccucccggagaaagaagggaucugggaagaagagggagcucaagccugggaggaaggaccuuuccaggcaggaaagggaaagguugcgugaaguggagcuagaagcugggggccgaggugaaaggggaugaggggcccgggcccggcgggagggcgccggggcucaggagagcggcuucaaggccggguaggaggcgugggggccgaggcgggcgugggggccgaggcgggcgugggcagcucucagccgaccgcccggguccgagcagcgggggcgcuuucagcggcggcaggcgcgggugcgggggagaggagcagaaaagagagcaguuugaggggccgagggagccgcguccgaggccggcgcgguggggaccgcgggcccaccaccagccaagcccagcuacuuaacuauuuguagagcugcugcaggcacagguccaggcuuucgcccuccaccuccucgcgggugaugcgcucugacagcggucgcgggagcgggggcaaaggcggcagcuggggcggcggcggcggcacggccgagugccccggggcugccgccgccgucgccgcgcccuccuccuccuccucacccucaaccgccgccuccuccucgggcuccgggucuugcuccuggucccccuccuccgucgcg

SEQ ID NO: 16752 - RNA, 13831 nt, Homo sapiens
cgcuuuccggcgcagucgcggcgcgucgcagcugucauggcggagaccgucuggagcacugacaccggggaggcaguguaucgcucccgggaccccgugcgcaacuugcgccuccgguagucgcaccgccccagccccgaggccccaugcuuuuguguccuuagaucauuccaaccugagcucgguguucugagguccccacuuucugcuuacaaucccgaccacuucuccgggcuccccacuucuuucacuauccguacccccauccacucacagccucuaagaaccccuuacagaccuacccaaguccauucacgucuuuguugcucccaguuucucaaagcccugugcccccaguacacccucuccccuucauucuuccccauaggacggcgcacccacccaccuccucuccguugucugcacccagcacaccuuggcaacccuaccuccucuguuuuguuucccccauccuugcuuuguguucaucuccugguugcgugucugguaacgaauauuuugggcuuuucuugacagaguccaccugcaaagaaucacaucaagcaacuuucuucauuaucagccugcugccgagcucgggaaggaccucauagacuuggccacuuuuaggccucagccaacugccaguggguguuacgguggugaugugccaucuaauacuaauuaugauacuaaucagaauuguggccaaauguagugagauaacaaauacuauacuucugauauguuauagaguugcccggcaaccuacauucuauuuguggcuuuuuuuuuuuuuuuuuuuuuuuuuuuuuuuuugagacggagucuugcucuuucccccaggcugaagugcagugucgcuaucuccgcucacugcaagcuccgccucccggguucacgcgauucuccugccucagccucccgaguagcugggacuacaggcgcccgccaccacgcccggcuaauuuuuuguauuuucaguagaggcgggguuucaccguguuagccaggauugucucgaucuccugaccucgugauccgcccgccuuggccucccaaagugcugggauuacaggcgugagccaccgcgcccguccuauuuguggcauuuuuaaaagagaaaacgugccccaaacccuaaauacacauauaaacacuuuuaaaaacaauuuuuaaacuggagacugcuugcaaaaucugcauaugaugugcauguauagaucaacuguguucuugugguuuuccuuaucugggaaaccaaaagaaugaggaggagaggacagagugguuguugucaggucacuagucuguuugcuuuuauuguuucucuuucuguucagagcuguuccugggcaagagugugggcucacagguugugaaacgugucucugaaaaaggcauacccaagaguguauuagauuagauuuguuuucuuuguuuuuguuuucguuuuguuuugagacagaaucucauucuucugcucaggcuggagugcagugguaugaucauagcucacuguaaaccuuggucucccaggcucaagccauccuccugccucagccucccaacuagcugggacuacagacucacacucaguuuauuuuuuuuuaaaguuuuaguagagaaaaggucuugcuauguuguccaggcugguuucaaauuccugggcccaagugauccucccaccuuagccucccaaaauguugggauuacaggcgugagucacugcauucagccagauuugguucuguuaaaaaaucauuuauuugccuucacuguccucuccuuacacuuggucuccuaaauuucaguguuugugauucuacauauauggcuuuagaaauaguaaagauaaaaaugccaggguuauuuucuagcaaaugcagacaguugggacugaggaagggcuggcuauucagcuuauaucuaaauuucaguuucuuauauccaguuagauuagauauuuccuggagcgggcugagcgccguggcccacgccuguaaucccagcacuuugggagaccaaggcagguggaucaccugaggucgggaauucaagaucagccuggcuaacauggcaaaacuccaucucuacugauaauacaaaaauuagcuggguugguggugugugccuguaaucccagcuacuugggaggcugaggcaggagaaucgcuugaacccaggaagaggagguugcagugagcugaaacagugccacugcacuccagcuugggugacagagugagacuccaucccccccagaaaaaaauuccugggggguauuuucuuuuauucaaauuagagucaugacuaagacuuccuggguucuaaucuuggcuucuacucauacuaacucucauauacagccucucuagcauuucucuagguugagugcuuacuaaauugcugaauuccagcuaguuuuuguggcaaauauaagaauagggacuuugguuauaauaaaccacagaacaagaaguggugcugguuuggcucaagcauuugauucacucuguugucuuuggagguggacaccgcccagaggaagacgaagaggaggagauugugauuggguggcaggagaagcucuuuagccaggugagccagugucucuugucuucucugucuauuccaucuggucuaccuccacauggcuggugauacauauugccaaagugauuuccagacagguuguaacaguuuauacuuuccccuguuguguuuaaagggcauuguaacauagggauugccacuacucaguuuugugauucugggugaggaacuuuucaucucugggcuauaugccaucuguaauagcagacuuggauuagacuaucagucugguuccuuuuagcucuaauguucuugguuccccugccauucauuaguuuaguguugguuaugaaaacaugucagauagcaucaguucuguagaacugauuugauuaaacaguuacagaagcaaaaguuugauguauuauaaugauguacacaucucuguuuccuuaugguaaccucaguuugaaguagaucuguaccaaaaugaaacagccugucagaguccuuuggauuaucaguaccgucaggagauccugaagcuggagaauucggguggcaagaaaaaccgacgaaucuuuaccuacacugacucugauagauacaccaauuuggaggagguauuguucuuucuagggucucauagcuuccaucuuugcuuccucuagcuuuuuugccucacugaguucuguguguuaugucagagccuaguaaggggagacaaguagccugucuaggaacugcugugagcugcugcugcuggcagccagccuggaauagaaugggcacagucuacagguggugaggcugcugcucccuucucugccugcuagagggccugggggagcugccaguaucucugauuauaugcuugcagagugcauacugggagaaguaaccacugggcuugacuuccuccaugcaucaugaaaaaagacagguaguggagucuggaacaauauagauaaaauucaucaggggauucagcccaaacucugaguauauggguuugaagaggaauucaguauagcuauggaaaauggcuuauguccucaauuugccuaugacaaaaauacccuugugaccuuguuuuacauuuucuucagucacugcauuucaguugcuucugucuucucaguaagauuuuaagcuccucgaggguagagccuauuuuuuuuauuuuugucuaugacucuguaggucucugcaaggaacagguauucaauaaauguuuuugaaagauugacgugcuuucauuauuagagcuguggauugauaacauuagcugggcaugguggcauguaccuguagucccggcuacgugggaagcugaggcgggaggaucacuugagccaaggaguucaagguugcagugagcuaugauagcaccacugcacugcagccugggugagacccugucucuuaaaaaaauauauaaauuaaauaaaauuuggguugucuguuuuggaaaagcaaaugaaaaugcaguuagugcucaguuaccaugugaggauuucccacaaaaugcuuguaucccauuuggcauuuucuaaccaccuuguuaacuucaacaucuaccaagcacacuaacccaacuuuuuguugguuugugcucagagaaugcagacugauuuuaauauuaacauaaauaacuccuuuuuaaaauccaaaggcaaaccaugaugugguagaaaucuucuuuggguuguuuggcuacugcucccuccguuagcauguauaauugugagguggcggaaccugugggguucagguccuggaugagguuucaggaggaagacuucccuucagguacuuggcuccauguggcccugaccagauggcguacacagggcugcuugcuuuucccagcacugucagagaaugaccacugcagccagcgaggugccuucauucuuggucgagcgaauggcaaaugucaggcgucgccggcaggacaggcgagggaugugagugcgggcaugggaugggggacaagcuuuuacuuuuuauuuccuaaaguuggguaguuuugcauuuuuaucagugguuauauauaguauucaaguauuacuuuguaauuaauuuaaaaaauaaauauaaaaauauaaaauaucuuccucacucuucauguggacauuuuuccaaagugccucagagagagggaagggaugucauuucuguuugucaaauauuuuggcucuuaaaaaacaaaacaaaacaguauguccacuagcucaaacuucccauucugaaguggcucuccacuggggugcuccauuggggugugccagggaagugaccuuucuguggugucucccagggagggcggcauccucaagucacgcaucgucaccugggagcccucagaagaguuugucaggaacaaccacgucauuaacaccccucuucagacaaugcacaucauggcagaccuggggcccuauaaaaagugaguggcgcuucucacugccagcuuagagccucauccuuuucuccucucaccagcucuccccuuccuguuauuaucauccuagguuauaggggagggagggacuuuuucuuccuucucuucuuaguuaugagugaagcuucucacugccaacucagauccucaucuucuucuccucucaccagcuauccccuuccuguuaucauccuggguuauaggagaggaagggacuuuuucuuccuuuuuuuucuuaguuguacuuggaagaaaguuuuaccaugacagcucucccuauagccucuguucucuccccugcagugggcucaguaucucuucuuguuucccugaaggaccauugaccucaaccuugguguuuuccugauuucuaggcuuggcuauaagaaguaugaacauguccuguguacucugaagguggauagcaauggugugaucacaguaaagccugacuucacgggccucaaaggacccuacaggugaggagaggaagaaagggguaguggagacuggcauuccuucccuugguugcacuuuuugucccuagucaacuagacugucagaaaguccuucaucuguucuaacuuuuacauucccaggcaaugguucguauucuguuccaagucauagggccuuagaaaaccagggacuccuuucucagaaaaugugcaacugcaccaauuugaaagggaucacuucagugguacaguuaaaugacagugauucucugugcugcugaauguaggaccugaccagaacagaguggggugaacucagccaggcuuuuccugugggcugacuguuccucaucucuguaucuuggaaaugacagaaauguaaauuagaaauuaucuggcccaaccuguccauuuuucaggugagagaacuggguggcaggaauguugugccuuacaguuugacuguaacuucaagccagaaaugggcccagaaccuauacuuucugagucuagucuggugcccucucugcuuuacccuuuuguuucucucuccuggucgucaauacagccacuuuuaucaucauauacuuuagugagguguauggccccugaucgcucaucccugggcugggagcuaucccagggcccaucucucauuauuagaguugcuccuuucugugguuuugaccuuacaggauugagacggagggggagaagcaggagcuguggaaauauacgaucgacaauguuuccccccacgcacagccggaggaggaggagcgggaacggcgaguguucaaggauguaagcgcaaguucauuccaaguauccaagggaugagccucagugccuggagcugagaccauuucugaacuugaugucagcaguugcucgggaaaagccuugcccuucauggccccuucugacuuaggcagcauugcugacauaucagacagaaguuuuugaucauauuauaauaauaacaauaaccauuuauuugagcauuuaccauguucugugcuagguacuuuacauaccuuauuuccuuuagucuuuacaacaacccuuugaggugaacacuuauuaccaccuuauaaguggggaaaccgagauugaggagcuaaguagucugcccaagguggcauagcuuguaagggcgagagucaggauucugccccagaccagcugacuccagggccucugcuucacgguaaaauggcggugagucaggugcuuacgccuccagcucuugcugacccuucccacuauugcuuuucuucuucccauucagaacugaacuuuggucuagcuuggguugcaucuugaguuuugguuugguuuguuuccucagcuuuauggccggcacaaggaguaucucagcagccucguaggcaccgacuuugagauggugaguagcuuggcuuccugcagcacugugagcuguguuuagccggagcauucugacuguggaugaguuacacuaccucucuuaaaggcccaaagguauacucuacagugugaaaaggaagucaaagaauagcacauauaguccuuguuauguguuuugcaacauugcauguugauagagaacuguuaaugcuaagaaaaaggucugaaaggcuaugcacaugcuguggguggcuuucucuggggagggugggauuagaugugguagaaggguaguggguggugagagggauauauuagggauuuuugcuuuuuauucccuaaacuuagguagcuuugaauuuuuaucaguuguaauguauuuagguauuacuuuauaauuaauuuaaaaaauaaauauaaggaugaaaaaugucuucuucaccuuucauguggauauuuuuucaaaauaccccauagagaggcaggggugccauuucuguuugucacauauuuuggcucuuaaaaaauauaggccugaugcgguggcgcaugacuauaaucccagcacuuugugaggccaaggugggaggaucacuugaagccaggaguuugagagcagccugggcaacauagugagaccacaucccuacaaaaaaaaaaaaaaaaauuagcaaggcauggugauacauaccuguagucccagcuacucaugaugcugaggcagcaggauugcuugagccuagaaguuugaguuugcauugagcuaugaucacaccacugcauuccagccuggacaacagaucaagacccugucugaaaaaaaaagaaagugguuuaguucagcuauucuguugugcuguucuuugucuuuucucauucuaagaguucuaucucuagaccuggaaacaaggauagaauuacuuccuggucucccucucuuucucugaaaaauuaaccuucacuauuuccauauugcauaagcaacagauauucaguauuuaaaaguuagauaagacaugcacaaauaauuaaaaaagaaaacucccugguuucuugaccucagccaucuaaagggaagagggcguucuggcuucccauugcacaccacaggacaguugcuguugcuugaauaauuucccauagugcauuguccucacugccauuuaaauuauguacuuucccccuacauugugaaucuuaggaaugaaggaaacagaucuguggagaagugucaggguggggagaaagugcaguagugacacccagggccugaccccuaguggcaggucgucugcagauuuguagauggggcuggaggagaagugccaauucccuccaggccugcugauccuuucccacuucucuucaccuuagacugucccaggugcccuccggcucuuuguaaauggagaggucgguaagugucuugcuagcauagaucucuugaugcuuaggcacgugccuagauggagcugugaauagucuccuccacucugguagaggccuugucugcuguacuugggaaacucaguggugagucuuuccuggaaacgcagaggguuccuggcccucaaaagacuugcucucaggguguguaggccccucaggauuggguugggugcuaagggugguaggagaaaaagcuaaaauagcuuccuguuuucucucguaguuucagcccaaggcuaugaguaugacaaucucuacguccacuucuuuguagaauugccaacugcucguaaguaauauucuuaagucucuccuuuuauacccauucagacagaucuagaggcauuuggucaggcuuccuuucccacuccucugcugaaacuguuacuguucuuuucaaggucauagaucacauccacuuuaccaaacccaguggagacuucccugcuuucaccucgcuugaccuuccugaagcauuuuccagagcccacugugcugcaugacacacuucucuggcuucuggcuccacacuucucucuccuaucucgcugguggccccucauccuucuugggugaugccuucccuucuguugaucuuaaaccgugagaguacccacagcuaagccaaggccuucuguuacucucugucugcagucuuccugggcaacgucauccauccuauggcuuaaauaccaucaauacgucucagacucccagguuucugccucuagccuuaaccuuuucccuggacuccagacucauauccaguuaccucuuuugucauuucugucuaacaugaccaaaaagaacucuugauuccuccucuucccucaaaccucuccucccuggucuuccccauccuaacagaauggcagugucaucuacugaguuguugaugccaaaaaccuagggaacauccuugaucccucacuuucccuagcucccuauagccagccaaucugucaacaguuccuguccguucugucuucaaaagcuguugugaaccuauuuguucucuccagcacccuacaccaagccaccaccaucucuugucuaggccagugcauucaacuucugauguaucccccugcuuccugccuugcucccauuugccguugauuugccacagacaccaaagccaaguugagcuuuaaaaaauguaaacaaguuaugucccuuuugagcugaaaaccccaacagcuuccccucccacuuagaguaaaauguaaacuugauacccugaaugagcuggccccugccuaucucuuccauacaaccuuccagucauucuucccagccagguucauucccaccuuguagccuuuuaagggccguuuccuuugucugaaacccuuucugccauaucuuagcauggcugguucuuucugaguuuaggucucagccugugucgccucugagaggccuucucuuaccacccagucuaaaugagccucccaaucacucagucccuuccccguuuuguuuuuaguauagcacucaucacuacccaauagucucuuguugguuugguuuuugucugucucccugcuucccccagaaugucagcuccaugagagauggggaucuuuucuaucuaguuaccaagauaccccuaagauauacuagcacauagcaggcacucaguaaaugguaaaugaaugauugauugugugaauaaaugaauaaagaaacuguccgccccgucugggaagugaggagcgccucugcccggccgccccaucugggagguguacccaacagcuccgaagagacagcgaccauugagaaugggccaugaugacgauggcgguuuugucaaaaagaaaagggggaaauguggggaaaagaaagagagaucagauuguuacugugucuguguagaaagaaguagacauaggagacuccauuuuguucuguacuaagaaaaauucuucugccuugggaugcuguuaaucuauaaccuuacccccaaccccgugcucucugaaacaugugcugugucaacucaagguuaaauggauuaagggcggugcaagaugugcuuuguuaaacaggugcuugaaggcagcaugcuccuuaagagucaucaccacucccuaaucucaaguacccagggacacaaacacuguggaaggccgcagggaccucugccuaggagaaccagagaccuuuguucacguguuuaucugcugaccuucucuccacuauuauccuaugacccugccacaucccccucuccgagaaacacccaagaaugaucaauaaauacaaaaaaaaaaaagaaaagaaaaaagaaacugucuuuuucugaaugacuugcuuuccucccaggcgagcuuacuauauuuggucuuuggcuuucagacuggucaagcccagcauuccagcagcucucaggaguaacacagaccugcaccaccaagucccuggcaaugguauggagaaugagagcggguaucuggaagggaaugagaucugcuccugggauggcauuugagguuuuaucaggccaagugcugugcgcccuggggaggauuccagaguugggugacuuguguguggguucuacagggccaccugguccggagauccugucugucuuuuugagcauggcagcagcuuguauuuggguguccuuuugcaucucagacuccuauuucccaccugggugauaauuuuucuuuuucccuugugaagauaaccuugucauuggccacaaggagaacagauuccaagggaggccuugcccacccuaugacacuccuuuuuauaggacaagguggcucacuucuccuacccauucacguuugaagccuucuuccuccaugaggaugaaucuucuggugaguagcucagcaguugauccugggccuugguuccccucaagcagugcugucucuuggugaaggccgccugugaccuggccgcuucucuccuugcucccagaugcacucccggaguggccugugcucuacugugagguccucucgcuggacuucuggcagagguaccguguggaaggcuauggggcuguggugcugccugccacuccagguaaccgcucgucucugcccuucuguggcccacaugcccuaggcccuaagaacaagacuaacacucgaaugcuucuggugagggguggagauaauugggaauuggaaauguuuggcuugaaagaguuccuguuccucugaggacuuucugccccccuccauuagcgacaaugacguggccuuggcacugacuuccugacagucucuccaugugcuucaugcuccucugauuggacucagggugagaagcuguauggcaaaauuggcucauagcauauguguauugaaugaaucagcauucaguuuggaauaaaagcaucugucuuuuacugugugccaggcauugugccauacuucucacuuaauucucccagucacucugugaggugcaggugguauuauuuccauuuuacuagaugaggagaaugagcuucagagagguuaagaaaccuguccuggguaugcagguaauaacuggcagagcggaaauuugaauuucucccugauugauuuccauacaggugcuauggguaaccaugauaaccugcaccagaggccaggucaucaccagaccagguguuuuagcugagucuaggccugugucauugcuggggagucagugaggggccacaugcccuuucuggaccuggccccagucuucucuucccuugcgcaggcucacacacccugacagucuccacguggagaccuguggagcuuggcacgguggcugagcugaggagguuuuucauuggcgguucucuggaacuggaggaccucuccuauguacggauaccaggauccuucaaggugacuuuugucuuuggagugacuucacgcugagaacuuaugguccuguccuucuguaggaggugggaucugggucaagaccccuuaguugugcauugcuucaguauuaaccccuuccuuccuguggcuuaagcuggaagucaugaccacauuuugaaucagguuccaauaucuacacugcuaucguaggaggucucuggaaaauaguauaauuagagauuuccccugguucccaucagaauaacuggcucuuucccccaucacugaaggccucaguaaucagauguggggaggauucacaguaagcauauaagaccgccgcuucucaaaugagguuggaauguucccugguuuaguugggggagcccaauagcccaguauuagccuugagguaauagagucugggugauggaauaagguuuccccaacagaacugcgcuucccaagaaugggaauaagaaugggggugaggccagcauggugcgggggugucuagagagagcagaaaccugaggcugucccaauggcaugccacagggggaacgccugagccgcuuuggacuccgcacagagaccacaggcacugucaccuuccgcuugcacugucugcagcaguccaggugagugacuuggcccucugccucagggcaccuuagcccugagggguggagacagccguaaccauguggcuggccucccugcagggccuucauggaaucgagcucccuucagaaaaggaugcggaguguguuggaccgucuggaaggguucagccagcagaguuccauucacaaugugcuagguauguccccucccccagcuggccaccccaggucagcaugggccuguuucucucugcagugcagagagaaauaccauauggcagccaaauagcauaucuccuuuccuuacagaggccuuccgucgagcccggcgccgcaugcaggaggcccgggaaagccucccgcaggaccuagugagccccucuggaacccuggucuccuagcucacagcagcccuggcccacagugcaagaggacaagaugggggauaucugaggccagugcucuccugccucuucgucuuucugauuagagaccacguuggucugcugagaaccagaaaagcugggaaauucccggcuggccccucugccuagccuucugcagggucuucucccuacccuguggaaauaaagccagagacccuguggcccccccuuuauauuugcagccacugucaaugggcaucacagcaaggcaggcuuuuugaucugaagcuguuuggggugaccccauagugagucuggccuugacucacuuuucuggcuugucucacaguagcaggggaucugcuguucuccacccuuuaaaaauggagccuuucaucuuccaagaccaaagaaggaaggaagguggacggugagagggucuuaaauccccagccugugagucucagccucuuuccagggaagccucauucuacugcuuggggcuugcugagguugagauaugaguuauuucugaguaagugaaggcugaaggcagugcugaguccuuucugcuagcugggugguaucuuuuacuguguuuuuuuguuuguuuguuuuuuuguuuuuuguuacauaaaccccuuuuauuuugacugau

SEQ ID NO: 16753 - RNA, 8698 nt, Homo sapiens
gcucagucgagaguuuguuuguuuauuuugaucguauucauucaguuccaguggccccaucaugucccacccaaaccuaaauucaguuugacagaagccucccccgacaggugagggaagugguuuggauauucaggguauuuuaguuuggggugacauuauggguggguccguguaucaaucuuagagcuucugagccccugguaccaccccgucccaccucuccccacccacccggccccagccaggaccccuuacuguacuuuauacuugccagcuuuauuccaaucuaguaacaugagcuccugauggugguggugagugugagcagucauauuucuguugucuuuucucuugcuugguuggggcugcggugagagugucucugaggcauacuuucccgccucucuuacgcuaggaucugcacaccuccucucaaacacucuucugagcacgcucagcgggaagguuuguccacaccuauuaauccucucucaguguccagcuuccuguuaguaccagcugguuugcauguuuuugcuuguucagaugaaacaguucaagaaacaaacucauauccaacucucaagaaaugucuuuuuuuguacacuuucguuuuugauuuuuuuuauuaguuacaacuccaaaacaccuguuguccaguaaaacauuucacaccuccccugccuguucuuagauuguauguaucugugggacugaacuaaaugcaugcaccguaguagauguacugguagccguagcuguaguuguaguacaugcauuguugaguugauauuacagggucuuugacggcucggcacagcacggccgucugaaggauagugcggggaccaggaagagaaggggcuccauauuuucaauguuuccaaggggcuuggauccauguucucaccaucagccaccaccaccuccccucacacuccccguucccccaguccagaacugggucaccacccucagcucuagccuuccucacugaggucucuguugauaucguccaauuauagugcaaaaauggagccaggauuggaaggagucuuaaaggucuuccuuguucuugucuuucucauacuauucuugaacagagcagaucuuuuuuuauuucuuaaggccuaccagcaagacuccuucaagcccuucuacuccuugaguccuuuggcaggucacagccagcccuucagggauacgggucuauguggcaguccugucuauauggauuacuucuugggguggaggggaaaugagacaugguaaggaagggauugagaucuugagauccuuggucugcagacagggaaugcacuuggcccuagugaaucauugcuauuuguucuuaggguuggugaagguuaaguagggugagaguggugacauucuuagcauggaggugacuggcacaguuucguggagacagaaagggaggucggcuuggaacauccaagaggaaccaccccuaguuuccuccaguuccccaggaaggcucccuagaggggaaaggagcaguccugcagccugugcccuuagaacaggagcacgugcugccagucaucuuuggacaugccaucuucccuacauuuguggugacaagccauaagggagugccagaggucucucagagcuucuggaggugucccuacucuuuacguguugaugcugagugaguagugccugccuccuggaaccugcucuuuaagucaggaugugguggcucugcccagugcugcaagaacauugauggaacacaggugggaucugaaccuucagggugcaaguuaucuacugugggagacagaagcccaggaaaacgucggaguccauaaaguccccugagagaaugcguagagauagagcaaaaugguagcgcuguggaaagaauguaccaugcuguggaaauugguggcagaaucggaaugaacaaggauugaaugugaguaaggccagucugccaccaaacaggaugagggugccaaggcccaggaagauaaaucuggaaggagcuguucuucuagcuuggccugcaugggggugcgggugagggagguacacagggagauggcuggaacugucaggcuucagggcugcugaagcugcaaauuggcccgaggcuggggaguaagagaagaggguagggacagaaggcagagagagcagaaaauccccucccacuggccuaaaucccaggucugguucugcuaggaaaauggcuuugcugcccuguggcuggaaauucuaagagcuccaguuccaguugguaaaaugagcaaaaguaaaaugcaagucaggggauggaauaaauaguuuaacuugaaccagaagagaaaaugcuuuagggaggagaauagaucucaagaaguagauaugcccaucccaaucccccuucaagauguuuucuguguccccacugcuagccucugccuuauauauguuaggggcugggggacaugaaagauagugucccacauacacucuuccacuugcuggagggauccuggagcuauuugggucaguuguaccauaagcuuuaggguucccagguauugcuuucaacauguauuuauuaaggauuuguuuuguaccaagcaccaaggaauauaaaggcagauggcauuucuagccuucaguggccugagacucugguccuguccucugaaaguccguguuucccacaaugcacuguuucuggccucagaaugaccacugucagcuucauuuaaaaaaggaaaauggaucaaugugugccuucauuucugaagauggcuuuccugugcuucaugagcaagaucugauggggggcggagcgggggaugcagugccuccaucucugcuuccucacccagccuccugugcuagcagcaagcauccucugggggcuguggacccaagaugguccauuuguggguaaggucauggggacacccuugugcuaagacaaagccacaucuguggccauagaauacagccaguaguggcccagggggagaacaaaucucugacccacuagggccagccaccacaaccagacuuaccaaaggaucuuaccugaacacacaucucucagucuacugccauguguucuggggauggauaccucguuucccaguuugucauuaaaauguucauuucugggagagccaggacuuucaccauaaagaguccagcauuggauuucaguaaccccagugaauuuauaauaaugcugacagcugcccgcugcugaccucagcuucauucauuuuccaagggcuuucagaccaaaccuguugaggauaaaauacaucagcucuaaucaauaauuuuguaauagaaauacugugcacuugauaaaucaacucuagugcaauuagugacuagccuugaagcccagaccuaaguauaaguuaauccuaaagugaauggagugggggaauguuaauggucuuucaaaucaguggaauuauuuucagugguugacacaucucugccugcccccugagcugguuggucguugcucuugugugggcucaggagcucaggcccagcugucuggagcagggguggaaaguguggugguguccuucauagcuccauaagggcgcgcagagcacaacagagaggggucuagagacccgcuccuugcacccugggcugggugggggcacugcagggucuaggaggccccuaaagcugaucaaccugcagguuggugagaaccauccaaggagcaugugcccggguguaucauucaugguugcuuguguuuugcagagguuuuuuuuuuauuugguugguugguugguugguugguuuguuguuguuguuuugagacagacucucacauguugcccaggcuggaaugaagugcagucuugaacuccugagcucaagugaaccucuuuccucagccucccaaguaguuggaaauguagguucauacuaccaugcccggcuuugguuuuuuuguguguuuuuuguuuuuucuuuuuuuguuuguuuguuuuugguagagacagggucucacuauauugcucaagcuggucucaaacuccuggccugaaaugauccuccuaccuugaccucccaaaacacuggaauuacaggugugagccacugugccuggccucugcagaguuuugacuuucagauauacaccgugauguauauuaccauagccacccugggagacggucaggaaggcagaaguuuguggccugguuuacaagcauguuuuuguuuuguuuuugugagaaagcugggcuacagaauggccaugugacuuauuuaaaaucacacaccugguuaccggagagcaaggcuuugguuaaaggugaagaacccuggacuugaacccaggucucuggccuccuuaaguagcccucuggagaagccguguuuuuuaugagggacacaccugccccccaggacaccgggcacaagcaggaauaaagaccauguaggaaaaauaauaaaauaaaauaaaagcccauguagggacagcccaaguagccucagcuucuagcucuauauaggccaagcgcucagucucuggccuaaaaccucauagucugaucuuucagauguagauuucagaacuggaccuacgggacaucugccauggaguugaauguggcagauauuuauuaaguauauaacaauaguaauuauuguuauaugugguagguacuguccuaagccugauucaagggugcuuuugacuguaucagaaaccucccaacucugauuaaacacuauagguuaauguuacagggaauuaaauauuaugggggauuuauuggcugacauccuggaagcuccauagaagagugggcuucgugccuggcuuguucagggauccuuuuucugcaauucucuuagcuucgcccuccuucucauuucaauacugucuuuauauugguuuuccucaugguggcaaaaugauugcagcaguuucuggcaucauaccguccuguccagaagaggggagucagauggucuggaaugcuaggaagaguccagagcuuugugcugcuuggcuaaggcugggguuacaaaaccagucacugagggugggauccacccccucuaaaccgaauggcucuuuacacggugguguaaggauggguucccaaaggaaaaccugcaugcugauaagaggggaaaaggaagaaugaugccagagagacaaccaguggaugcccaccacagcccuggaaguuccuggaaguucauggauaaauacuaagcagucuccacgccauugaagaucucccaaccuaguguggaaacuaauggguaauuacaauaggaugccauaagcccgguaacauaagccuauccaaugaacagaaguagcacagaggaggaagugaucagcuuugucugggaagucagggaauguuucacaggggagugaauauuuccacuuuuaaaggacaaauaggagcuccccagggggccggggaacaucaugggcaaagccaccagaccucgggacaauggagugagguggaggcccugcuuuauucuggcuggagaauaaaaugcaacaggggaguaacuguagguaaagccagagagcugggcagaaucagagcaggggacccuugguacuacgcuaaggagacuggauuuacaugggcagggccugugagaucaugggaggccugaaacuaggaacugacaucagauuuguauguuagacaagcuuugacaacauuguccaggauggauucaagacgcaggacugaggugggaggacaaguuacagauaauucguguacauuguaaacacuccauagauguuaguauauagcugcucaagaagcaguaggccuuuugcucuuauccauaagacgauuaacucuggacucaacaucaugcuaggggcuggggugggcugcagaauaaguccauggcaugguccuugccuuuagccgacuuccaguccucuggggaggacaaaaguacacaaccgaugugagagcuagccuuuaauaaggauagauuccuacaaggucagagaguacccagaaggcaggaagcuuaguggaggaggcaagacaugacacagggccuggagaauuuggagugggaagcugucugcuaggcagggaauaugggcuugaagagauagagacagucaagguucugggagaucuugaaagccauguugauauagucacaggagagggagguucguauucuucaugcaaguggcgcucaguaaggacagaaccaucuaaagaagauaagccuggcuguagcuccacaaagaacagccugaccccuaauccuggggucuggggcuggggcugggcucgugaccuggagcaagggguguggagugagaggcauugagaaagcagacacaggagggcauuccauggcaaaucucugccuuaguucccuuaacuuuccuuugcuucugccaacaaguuguuauuuauucccugcuuggggcuauuguuucccauuccuuugcccuugagguggccacuguccccuuucuuucugccacuccauuucccucuguccuugucuuugcccucucugucaaaauuuggcucaaagugccagaaagccauaccugauucacccuaccuggggcacccccuccuuugcccauguccucaguccucuuccucaugggugagcucuccugaaugaaaggugagauuauggguccuuggaagauauuuugcaugugucugcggguggcaccugcuuuccccaacaauacaaaccaucaggccucccggcggcaaagucagccuaguccucauucuucauauggauaaguaauuacuaugcaauuagaaaacacagaaaaugaaggggcccuuuguuccugguugcuuauuaauauuaauuuuuuuaaaaaggucucccuucccagcuugggauccuacagaacaggaagcagacaaauaaugccuuugaacagcugugaugggcuguugaaauuagaucugucaggggaugagaacaccacgauggcagccacuccgugguauaggcuaagaggguuccaggggaagguaucuuguaaguggucaauagaaugcuagagacacauccuagucaauuugaauacaauaaugauaauagauguuaauaauaauagcucacauguauuaugagugagccaaguaccaugucaagcccaccugccuuaucccauuaaauucucauaacccuaugaagugagcacugucauucucauucccauuuuaaagauuuaaaaacuguaguuuggaaaggauaguagcuuaucugaaguggcagagacaggauuugagccuaagccugucgucauucuguccucuaagccacugucagcggacgcuccaucguaccagcccugggauggcugagccaggcucugcaaccuuaaaacagacacucaagaaaaaaccacagcugcucuuaacuaaauucuccauuauccuugggggaggagauaaccccaaaucauuuacgaguggccucaggaggcgguauaaguauuuuuugcaccugcuccugcuguugcagacacugccuggcuuuggcugacagguuucuggucccugaaugcacucagaccaaugucagacaaaggaggccgggaggaggcguggucguguaagaggaagccagccugaagagaauuauuggaagggaaccuuuagcugaaacaaggcugagggaaguuagccaaugcccagaagaaacuaggcgauggagcacgggcgggcuucucugggaagacagacguccucuguagggaugagucaacauuuuuuccugugggcugcgaggaccgcuucuggaaggucgcugggaagccccgcccggccuuagggcugggaggggauuggcugcccaguugcuggggcuuugcucugagccaguggcgggguggaggggcggggccaaggcgggagcagcgggcuucuuggccaaucauccugcagggaggcugggcacccgguaccauggcaaccgcgagcagggccucauuuguuuuguagaugaguaauuacuacacaauuagagaaagcuaaaaauaaaggggcccuuuguuccugguuacuuauuaauauuaauaaaauggucugcccaggucugugguaaacauuugaugccugcgugccuguggcagaggcuuguguagccgggaaaggcaccccagccccgcucgccccucuuucgggaaguuauuucugacuauauccuggagagggugggcuucugaccuuggggagaagaggagaggcucagugugacagacauaggauccaggauguccuggaguccggguccgucacugacucagguggaaagguggcggcagcgucaccauccuucagagaaaagacagacacacagcagcaaagcagacacuauggaccggugucagaggaaaccccuaguccaguuuugcuguguccuucuguguuuucuggcuuuugauugaucagcuccagguguguaaaauagucguuaagucuucaauggagguagcccccaagacuccagugacuccccucccaucuggcuuaaagggcacauuccguucaggcuuggaaaugaucugcuggagguuuacacuguguucaggguuguccccguggcuccccaugcccuggccuucgaaguuaaagcagcugagaggcuugcuuucuauuccuucucccuccuagggggagagguugccuug

SEQ ID NO: 16754 - RNA, 2991 nt, Homo sapiens
aauugaaguaagaauaacaugccaagacaaauuaaaaauuaucaaaguggaaaaauugaggaagaagaagaucucacaaauaaacugguccuuauuaagaagagaagcauggccaggcacaguggcucacgcuuguaaucccagcacuuuggggagccgagguaggagaaucacuggagcccaggaguucaagaccagucuaggcaacauagugagacccccaucucuacuauauauauauauuuuuuaauuagcuggucaugacggcacaugccuauaguccuagcuacuuggaggcugaggugggaggauugcaugaguccaggaguuugaggcugcagugagcucugaucacgccacugcacucuggcuuggugacacagagacacccugucuccacaaaaacaaaacaaaauaggccgggcguagugucucaugccuguaaucccagcacuuugggaggccgaggcaggcagaucaccugagguuaggaguucaagaccagccugaccaacauggagaaacccugucucaacuaaaaauauaaaaaauuagccaggugugguggcacaugccgguaauccuagcuacucgggaggcugagguaggagaaucgcuugaacccaggaggcggagguugcagugagucgagaucuugccauugcacuccagccucggcaacaagagcgaaacuccaucucaaaauaaauaaauaaauaaauauaaaauaaaauuuaaaaagaagaauuaaaauaagccccuaugcuaugacacaggacaagguaugauuuucaguuucugaacgaccaggggauacugaaaagucauaugagacacagugcaauuauucuuugggcaggacugcccuaggcacuguaggagucuagcaucuuuggcuccccacuaaaugcugauaauggcucccauccauaaugacaaucuaaacaacuccuucagauuuucaaaacuccccagaagggcagugccaccccccccuugagaaccacagauacaugugaaaaccauuugaaaaguuaaaagagcuuugcaaauacgcacuaugauuaauccauuaacguuacaguggauuuucaguggacacuguacauugguacuauuuaaaugaagacuguugaauuauaaaacaugagucuuuuuuuaauaaaauugauuuccauuucuggaaacauggcaagugaaucaauauacuuauugaaaauaacuaaaaauucuggauuaaaaauaauuuaagagcaucagugaauaagcagaaaaauuaacaauucuuaguccagggauuuagcggaguaguugagagauguggguagagcaauguguuccaaaggcauuugcuaaaccugcugaauuugagcuuugguauucauggccucacaagacugugaaaaaggagacaaagcccaccgucugaccaagaugaggaguuuaauaaguagucuuccaccauaaagcugggaugcuuccaaaggcuauccccuuuguguaaggggaaauucagaaacauuucccacauucgggccaggcgcgguggcucacgccuguaaucccagcacuuugggaggccaagguggguggaucagcugaggucaggaguuugagaccagccuggucaacauggugaaaccccaucucuacuaaaacuacaaaaauuagcuggaugugauggcaggugccuguaaucccagcuacuugggaaggcugaggcaggagaaucacuuguacccgggagguggagguugcagugagccaagaucgcgccauugcacuccagccugggcaacaagagcaaaacucugucucaaaaaaaaaaaaaaaaaaaaaaaggaauauuucccacauucucuugaagacugcaggggaaaucugccucacacuugcacugaagaggguaagacaggugcguauguuuaugugugugucuuuguguguguuugugugcguguguagacacacgugccaagaaucaucacuaaacauucaaaccacaagcuguccaugacacaguuuauagcaaaaaauccacacucuggguggucuggauagaccaaguggagaauguaacuggagugaucccagaaauaguaaugccuccagaaccuggcagaagcaaaagugaauccuuuauagaggaagccaaauuuaucccagacuucaaaguauucccacacauaaaaugucaaggaaaacgaucaguuuaaaguuaaaugacagagagagagagagaaagaaacuaacuacacaauaaaauagggcacuuaagaacuaagugcaagaagcagcagauagcuagaacaauccugcaaaaacuucagaucuugaaauaagacaaagacuuuuaaacaaccacguuucauacauuuaauaaaaauaaaaaucaugcaugaaaauguaugcaagaaaaagaaaacaagaaaacaagugauuuugaaaaagaaucuaaagaacuucuagaaaaaaagaacucaggggacagauuuacuggaauaauaacaugggaaauauauaaauagcuaacuauuuagcuagcuagcauuuaucucuaucauaaugaaguugcagagcaccaaagacaaaaagaauaucuuaauaacagugaaagagaaaagacagauuauuuuuaaaagaguuucagacaacuggcugggcgcgguggcucacgccuguaaucccagcacuuugggaggcugaggcgcgcgagucacgaggucaggagaucgagaccauccuggcuaacacggugaaaccccaucucuacuaaaaauacaaaaaauuagccaggcgugguggcgggcgccuguagucccagcuacuugggaggcugaggcaggagaauggcgugaacccgggaggcagagcuugcagugagccgagaucguaucacugcacuccagccugggcgacagcgagacucugucucaaaaaaaaaaaaaaaaaaaaagaguuucagacaauuuacuacucauuagcagcaac

SEQ ID NO: 16755 - RNA, 37383 nt, Homo sapiens
cgaggggcggggccugcgucgcgcugcgggcacgucgccgcgcgucuucaguauuuaaugucucuguguuccacccgccugggcuagcacgugggggagcugcggaagcgcggcgcugcgggccgggccgcggggcacagccgggggccggcggcggcgcgcggacuccgcaucccgcaccccgaugguagccgaggagcugguaggucgggggcagcugcgccggggacccccugccggagacccgaaggcggcggggucggggcgauggggagccugaggugcaggugcagggugcgacgcgcccuccagguaccccgggggcgggacgcuccggacgcagagguguccugggggcucucggccgccgcgcgcugucaggcaggcccaucuuucccucccucgucugcgcccccucucguccuuccccgccgguugucugcccgcgggcuccugacagaucgcgugugcgcggcucugggcggcgcucugcggccgcgccguccuccccacgcgcgucacuguccucgggggcggggggcgagggcgcgacgcccgggucgccucucugcaccucaacuuaaccggagcgugcacacccgccugcgaggcugacccgagcgcgucccacccaaggucgcccagccccgcgggcguuuacuuuucaaaggucguguguacacagucugagccggagcugccccuucacuucuggagccucgcccaacuucucacccucggcucgcccgccggcgcagccccugggaguuccgugcggcgagccaggggaacugggaagaugggccgggacaucggccgguugugauccaaccguguuucgggcugagggaccguucgaaccgaauuggggucuggaggucggaggcucaggggcgucucggggggaauuugcauucguagccccugcaggcguguccggagggguggaggccguccagccuggggugucugccgaccucacgcccgggggccccgacggucacguguccggccccgccugcggcccagggcccggggucugcgaucuggagggaccgcgccaguuuugggguuacgaugugcuaggagaggcaguggcuggaugccucgaacgcgggcuuucuggcguucaacucuuuugugcccuagcugaaggucuuccuguuucccuuccagggagggauaggagaagaaaggugcugaucgugguaggcggugcuguggcgacucggaacggcaugggagcccugggcguuucgggaucuuccucuccugggggauguccuggguggcggcgccuuccugccgccguuaacacaaacccgguggacuucgcuccaggugcgagucgaggccucucaagcuggguaggguguaugcgcagggcaauuagugagguuaaccuggguaucuuuccccuacuguagugcgcguuacuucguguuuagauuugucuccagugaaaucuaggcugcuggaccuggugcaacaguaucuguuaguuacugaucaaggaacaccguucacaaaaagcuauuaauucuggcaacuaguagccuuacaagcucuuguaacugcuaaguccuucccaaauuaguaccuuuuuuuuuuuuaacucuuuauuuagaaagcaaagcuuggacucuuagcaccacccauccacuuugcucuuaaagguacagaacaucuuugaaaugaagaaggcugccugacuugaucauuuauauaauuccucugaucuuggcauugaagugguucaccugcugauuauuuaagacccugagcacuggaagcaagugaaguuauguuuugggaaccuuuugacuuguguugaacuuuucuuuaaccucuaacuaguuuuguagguucugcauaauucuuggguguauucucuuugaaauauggcccuagguuagaggagguccucuggauccuacaggcaugcaaaucacuaaagcuugaguccauuacuggauuaauaggcucugucuucaugcauguugucagaugauggcucagaacuugcagguaacagauccuagccaaugagugagacaggucuaauggauuugugucuaggucuaguuccuuguaggaauaucucucccaucucccaguuguuucuaggaaaugcauucucacuuggccacugcagggugacaguggaggugucuguuguaaguggccugcucaggugcugaagucgauaugucuccaguguaagguugcugaacaucaauauuuaaaagcaauuuaucuugcugccugguaacccaaauuauucuugagcuuuggacauaggcuggguugcagccauauuuuaggggaaggcugguguuagccucuacaguauucccuuuuccuguccuaaagacaaauggagaucauauuugugauacuggggacugugauaggugcuuaagcauugcucuuccccucuccucccugaacaaucccugagacugacuuuguuucucuugaauuacuugagugacuugaauucuauuaaaagcaccccucuccuuagccucugacccagaagcuuguuugggaggaaaaacgaauugguuucccuaagcuuugcuggcuagccuccugcucccagccugcaacaugacuugauugugugugcauuucagggcuuugaagagcaggcagcuuguagccaauguacccagagagcuggccguagaguuccccuaggucacuccuuccuaaucuucccugugagucugaaugauugggccuuucuguagcuuggucuguuuuccuauuguggggaagucaguuguuucagguaugaguuaauaccuucagcuugucauucucaggcguuuucuuccacuauggggagguaguagauccugugggcaucuugucccauugaaaucaucucauauacuguuugagaguugcucaucuuuauggugggggguguauuuuaguccuaaaucuugcuucuuagggcaaguucuguuucuuccauguuccuuccugguguaauaccucaggcaguuuucacuuuuaugaucauuuaacauuaaguucccaucacauguggcaucccacugaaggaaccuccuggccuugguaccuaauuugaagcuugggcuguggaaaacaucaucagugagcauguuugaaguaggacagagucuggcuggagaaacagguagugggggagcugggagcuaaacuugagaggaugccucuuucuugauaguuacugugcuaggugaguuaugagcacacuaauccuuuaauccucacaccucugagaacagugagggugaagcuggaggucauucuggauuguuucaguggcugucacacaaauucaaauugagggguagaggaacuaggaagcguggguguggaguuaaaacuagguccucuggauggcuuuugugagaagaaccaaggaauauucuuaaaucccugggcuuuucuccuaaucuuucugcugcuuucuaaguagauuguuaacauuguguguguuaucauucagcauucugagaacuagcuuuccagcaauaaauagcuuucaagguguccuuugccuuaacuuuuucauuuuacuaaauggugcagccuuguccacauucuguccgggucuucaccaucugguuguuuuuccggcuugguuugauaguuugcagcagucagugguaaacauuguguucccuguucuguaaugguggcugguuguguucaccgagccaggugucacuaaggcccaguugcacuugggagcaaagaagggcccugaggugaguccuggaaguaaaaauauguauaaccuagggcugaugaggcuuguuucacugcugggcuuagcugacaagagccugggacuugcugcagcucucagagcugaaaccuggcggugauucuaggcaggcugguuggccuuccagaucuugguuuauucaguggcuaaaagagguuuggucaaaauuaucaguauucagauuaugguccugggagccuuggaguuagaccaaacgugcccaggggccacuggagugauguguuugggcuggggagcacagcucaauggguaguacaugucaaagacuuaaggggaaaaaaaacaacucacuguucaucucaaguucuuagcucuaaggugugcuacuguucuaaauauuuuuuauuuuuaaagauagcuuuauuugccuaaauuuguccuggguguggggaguuuagagcugccuugucuguaggguagcugcuagcugugugacuaauuaaacuuuucaaaguauuuuuaaaaaaauuucuuagugacauuagccacauuucagguucucaguggccucguguagcuaguggcugccguccuggucaguacaggucaagaacauuuuccauaaucgaagaaaguuuuguuggacagcgccggccuagaaaguuuuuuuuucuccaacucuaaaagcuuaauugucucaacuuguaaaucucuaaagcauaacauguuugagcuuagucuuccagaguccauaaacccaacagcuuuggugacaaauuaucuacugguugucuccauggcauacuacaagugaguucuagucugccaguugggaguggacgaacaguuuugaaacaguuugagugaggaccuucagaaaggaccuggggacaggagcgugaagcaaagguccagaugcuaagcccuuagaaagcccuuuugguuugaagccguuuauuaucauaaagaucccugcugguuuguccuuggucuccaaaugucagaugucaacauauuguuacuugguccuucacccaccugaugacuuccuacagaucucagugcggcccuucucuuaaacgagguuguguuuucauucugcuguuuccaguccaccuaaauguuaggggccauucuucacagaagguguugggggagaguggggccacagcguggaugcuaacguguucuguuguggcagggguggggaguucuuuguuuccagaugcccccucuucuaguccugggugugcuuuguuugaacccugcuagauugaccuuugguauauauaaugugagaucucuuuucuuggagccaggcagcauaaaggacacuuacugaugagcaccuacuggcauauuaguggcuuuuuuuuuucugugucauuuuuauucucugucagcccuaugagguuaguacagugauuaguuugugggugaagaaacaagauccgaguagaguaaacuggucccuggacacagcaagggcuggacuggcuuggaccugggcuggggcgugcuccccaccuccuccucugccccugccgccccccaugcucauugguuguugcuuauuuacugccccuuuaucaccacauccucauucaggaaacuaaacuggguuuuacaaagauuaaaaucauugaucccacauauggagucugacuuaaguguguucagccucguuacaacucugugagggagauauucccuauuacagaacaucuucauuuuaugggaaacugaaguacaggauccuacucuuaacucucuugucuuuccaaagccauauuuuaucaucagaauuaugcaaccaucgggugcuuuugaaaugcacaaguaaugacuaugaauaaaaaaagcugugccugagggcucagggaaacugcucugaagacugagcugauugaaaaagacaauccugaagucacuaauuucccgacaccugucagaccucacuuggaggucacagaccaucuccuggcccuccaaaggcugucacccagcaguagcuggccuccugauuagaggaggcaguaagaucuuuucaagcacagccccagcccccaucccuucucuggccugggccuggaugugccuuugugagguugggucgaugacagaucugaaggacaguucagucuucuguacacuccuucuugccccuccuuucugccacucccaagaaaaaggagcaggagugauucucacuuuccugaacugccuuggagggagacccacacucagcugugccuuuagcugucucugggagaaaaggccgugcugcaaauaaccucccugcuuuguccuuuggcuuugguguggcucaccuggccaagcaugugcuggugcuauuuuuagcagguggcauccuuuaggagggccaagugcauguggcugcaguguacgggacagguccuggugccaaagcugcugcugucucugcugccaccgccucgucaggagagagaggagaauaaagccacccuggaagcugccaagggguguguggaggggguggcugcuuaagaggucuccagggcugccuuuucuauucuggaucuguggcaggggcccagccugccuccuggugcaggcaggcaugugacugaggcagcccggggagcuggggagcuggggagcuaggugucagacugcugccuggggagugaggaccccuuguugccccagcaggcaauuuuucaggaaaccacauaaccccauuaaaaacauuauuuauuuauuuauuuauuuauuuagagaugaggucuugcuuugucacccaggcuagaguacaguggcucgaucauagcucacugcugccuugaauuccuggguucaagggauccuccugccucagccucccaaguacccgggacuauaggugcacaucaugaugccuggcuaguuaaaaaaauuuuuuuuguagugauggggucucaucaccuugcccagacccauuucaagacuccuaggcucaagugaucauuccauguuggucucccaaagugcugagauuacaggugugagccaccgugccuggccccauaacuucauuuuugugugaaguugcccagccuaaaggcuggccacuaaauggacacuuaaaaacucucuaauaguguggauuggugggcagucugauuccucuggcuuaaaccaaaaugcaaacaugaaaggaggcauggccauagacccccggugagaauucuuuacugugaugacacagaagcugaagagggaugaaaaagcaguuugaccagcaagcuugcugguucccuaggccacccuuucuucucuccuuuucaguuccuccuucccucuaacuuggagcugcuaacuccagcccaucuaacuguuucugauuaagaaagcuucaagccuuauaaggcccucuguugccuaugguuuauguuggcuggagagcaagguuguuuuuugcaaagucugauucaaagaaguggcaagggcuuacguaggcuguguguguccgccuccuggggcuggacugccuuauuggaacagguuccuuugagggagccugagaguaaggggggcuuauuaucccuuacccuuagugguggcucuguaaggcuaaugugugguguggccacagggcuuccuggcaaguguauucgcugagaacuuaaagguaaaagcaagccccuguuuaccuacacaguguaccugucaugcuaccagccacagaggcauccuguuucaggaaucaagucuggaagcagcuucugcuuauuaauuaagaacuaaagccccuuggcucuucaggcacaucgcuuuccccucuggagaaaguuugguggaccgugucccuugggguucuugcgaguccgacuggccuuccgcgcagugauguuggagagcccuuuuucugagagccaugcucugccucaucuucaccuccccucuugcuaccucuugagucagccaagccuguuccugccuuaggacuuuggcacauguucuuccugccuggaacuuucuccccgcucuccuccugcuuccccccagaucuuggcacaguucucaaguguuccaguucugaugccaccucuuccaagaggcauucccgccucauucugucugcagcuuccccuuccaagugcuccauccagccuuucucauuucaaccacagcacacagaaaaggacuaggugaccguuccucaacucucccagcuggugcccugcuacacgcacagggauauagguaauucaucacaugcaagggcagccuuagggcucaguucucucaaucaguugagagaggcugcaggucuuuauauuuaagucgcggaaucuuugcaguaucuuaccuguaauuugacucucuacccuuccuuccaccuuugcuuccugagggaucucuuugccuuaugugcccagcgaacuuggcucacagugcguguuaaacucuuuguuaaaugacuggcccugagagguccagccaucugaugcuggcuagcccucaaugccuugcuuccagagggaucuaaccugucaauaagcaugcucucuuuuugauauuacuauuaugucagcugggcagcugggggucucugaagcaaaauuggcaucaauuauuauaggaaaauaaggccuuacaaguuuguacacagaugaguugacauuaaugcaaauuuaggaugguuaauaagaaacauaaagcugugugguaauagagcaugcauugcuacuuguauguaucuuaauaacguguuuucuaucaaaacauuacuuguagaaaggauuuggcuuuugacuguguacaaggcuugaaaggacaguccuuugcccacugccccccacccccauuacuuucaauucuuccagcuguccccaccauugucaguaguauuauuuucuuucuuuuuaaggauuauuaucugauuuguuuuucugcugugggagauaggauuuagcucguuccuaugcuuuuuucuucccucaucaucccaguguagagauagcccaaguuuuggucaaguugaucuucagaauauacauuauuauaauaugaaccuuguuuauggcugcaagguuuuuaguuucccauauuucuucuuuuccuucauuuucuucuucuccucuccuaguuaauuuccuuaguuucuuuugcuuaauuuucugucucucucaccaguucccugaccaccucgcagccuccaccauugcuguggaaugccugucauugggggaaaguggcucucacuguggcuccacauaccagguacucgcaacgguuccacguuucuccugggcgcaucccuuuucccuggcucugcuuccccuucagccuuggaauucccucuccccuucucuugucucguuucuggauccagugccccuccuuucuugguugauuuccuugucuugggggagcccaucguucaguagcuugcugagaaggugugcgugguuuguggcccacaagaagccagccgauccaugcagggacaggcaccuuugaaggcauggauugggccuucaguuggguggcugaagucagcagacaacuaggccuguggagcccuuccgccaggccaggccagcagaaggucuggcuucacuuuuuagagaaguuauaaauguggcgaucuggauuuggguaccagggaguggugaaaaugggucccccccaacuuuuuuuuuuuuuuuuuuuuuuuaaagacaggucucacugucccccaggcuggagugcaguaaugccaucauagcucacugcagccuugauuuccugggcucaagugauccucccaccucagccugcucaguagcugggacaagaggcauguacuacuaugcccgacuaauucuuuuaaauuuuuuuuuguagagaugaggucucaccacauugcccaggcuagucucgaacuccugggcucaaguaaucuuccaacuucccaaaguguugggauuacaggugugagccaucgugccuggcugaagaugggucuugaaugaaagucuauauauugaauggggcaucccaacucuccuuggcucccauaaugcuggcauucaggcuuauauucucucauuccuaccccaagauacuagaacauucuagucugaggacacuggcaccccauuuucuguuccuccuucaccccuaacagggcacuuccauguccuauggacaaaacuuucaguuggucaguagcagagaguggcaguaacaggcccacuggagaaaaggucauugcuuguuuuuugagacaaggugucacucuguugcccagguuggagugcaguggugcgaucucggcucacugcaaccucugccuccuggguucaagcaauucucccaccucagccucucgaguaguugggacuacaggugugcgccacuaugccuggguaauuaaaaaaaaauuuuuuuuuuguagauacaaggucucacuauauugcccaggcuggucuugagcuccuggccucaagcaauccucccgaaguguuggggauuguaggcgugagcuaccgugguggccuguuugggcuuuuuuuuuuuuuuuuuuuuucuucugcccuccacuacuccccgccaagacugaaagugccucgagggcagugccuugccugauuaauuugugucccaccaugcuuuucucugugagugccaguaauuauuuguugaauagaaauuaccuucuaugcuuuuaugugauuucugggguggucguaguucacugucugccauuaggaagaucagggucuuaccucuuugguuuugcccaugugaggugcugcgaaggguuucuugcugcacaccaacaucuuuucugaugucuuuacuggcuuuuaagucagguuguugucagauugccauuucauacuuuuugggcaguuuuguguaaugucuucuguggucgugggcgggaacuccauguacccaggaaggcauuccuggcaccuguguugugaccaucuuuagaaaccuggcggaauucacuuguaaagcaagaugguugucaaggccagaggugaggggcaaggugagugugacauagucuucaaaguuuuaaaauccacaccccuacccccaaaaugaagugauuaggaagaccuuuguaggaggugcugaugauuuuuccuucacgaaaagaggcaugugacuuggaccugccauggauuuggccagcagagcaggaaagagacugggcaguucaaccucggguacuaaguuuuccagagcaggaguugguuuaacuuuuaguugggcuggcggagcucuuacuuugaggccauguccagagaugguauuucuggcuuuuggcuugucuugucuuaccuagagcaccugguaguggauucaggguuuucauuuuggccguagaaggcuuugccaagcagguacucagacacuacuggguuaagcuucuggccuuccuucugugaauugggcugggaaagugucccgaguuccugacagcugcucuacguggaagggcagaagcacccacaaagugugcuggucugguggugcuggccccccuggcuucucugugggccaucacaauggagggugggggacaguccuagacaggaccucacaaccccacugugagcuaauuugggaucucuaggguacccacaugaagucauagcuuacugugacuuacacaggccccugaggaugaagguaacaguccugugagcacugaggcugggcugggaccaacaccugagccauggcuccagcacucugauuccuggcccagccaugcugcugagggugcacagcccaggccuaccaucgcccccacccuugguggcagaaccgagcacuacccagcaagguagguguuggcggcugcagcauguauccagcccuccuguucauuggggccuucugggaacacccuuuagagcugcauuguccaguagguagcugccagcugcagguggagaguucaaguuaaccuaaaguagaauucagugcccuagucacacuggucacauuucaagugcucaguaaccucccaugacuaaguggcugccaguauuggauagcagucacucuugagggucaccgagaccuuuaccucuugugaccuacucuacuuuaccauguugcaacugcugcgacuauggcuccuguggcaaaggucaaacucuuugucucgccugaccagcacuucagcuccuaggauuucuuccuguuuuacuuugggacucacuguucccucccaugcccaaagauauuagaaccucaauuuauguccugucccccucccuacccacccacugcagccuaaggaaauccuggcccucuuugagaaagccuuccugggcucccuuugcccacuucucagcugcuuguggcgcaggggugugugugugagugagugagagagauugauucuuccaucagaaucgugugcuucuggugaucagaaucuucugcuuauagcaacuuaaacauauuugaaugaaugagcaaggugaaugacugugaccugaugaggaaauagguaaaugcaucugauacaagccaagaggcgcuuuuggaaucuugcggagaacuccgaguuugugauuuuccucgaccaaacucccauggaagggaguaugccucugccuggccacagacugcugucauucucugaaugcaguggcugaagugcugggcuuuagguucugauucccugcccuuggaagacccccuucaaggggaagagucccucagcaggaacuuaaugagcugggcacucuggagguggagugucuugggcaggcuccuuccuauugguagaacaccuggggacagccuuugucagugugaacacuggaauaauggaagaaauguucaaauuccaguguaaauguucauucagaacgcaaaguggauguggcuucacugaccaggcccaagcccacauugggcuuguugggcacuuggcuccuaagcuguuguuuuuaugguggacuuucccaucaguuacaugcggcucuuuuugcagucacugcagccaaauuggcuuagucacugggaccaacacucucuguaccauugccagggauuuguuuucuuguuuagcagaaggcuguagccugcaguuaccagguuugucagcugaguugagagugaggccauuacuuuucugagggcuguucugagaagcugcagguaccucccuggagaaagaagagauccuuuggaaccuggagugagcagaugaaugcugaggccuguggcuguagcacgugccuaacuucagcucugugugaccacuuggcaacuagccaguaugcaucuauucccaggcaaauggaccugcuaaaaauaagcaggcagcuauuuaauuccaacagauucaaaaugacagaguguccuccccaccaacccuagggcagggcucugcagcauccuucugggaggcuuuucucugacugcagacaggucugcccuuaguccugggccugggggaggagccagccuuugauuagcuugugaguaggaaggcuuuggggacuacugugauaccacuuaaauguugagaaguucagguuuacaaaaaaaaacaccucagggcaaagagagcaacuccgaagagucuggcccagugcaggaaggaagaugucagaagagccuuguaaggcuaaagggguauguguauguaugaaaagagguggcacuaccugggcacucaggaaagccugaugcauuuuauaccaccucuuguagcccugucggaccacguaaauugggcaaaauggcaucuuaccaauuccaagaagucuguuugacugaggugagaguggcucaggggugagggagugaggggcuagcugauuuuuuuuuuuuuuuuuuugagacggagucucacucuguugcccaggcuggacugcaguggugcgaucucagcucacugcaagcuccgccucccagguucaugccauucuccugccucagccucccaaguagcugggacuacaggugcccgccaccaagccccgcuauuuuuuuuuuuuuuguauuuuuaguagaggcgggguuucacuguauuagccaggauggucuugaucugaucucgugaucugcccgccucggccucccaaagugcugggauuacaggcgugagccaccgcaccuagccuagcugauuucuugacuagugggaagugggggcugguagaggggcaucugugaggugucuccuggcaaugggugcccuuagugagacccagccaaggccugcugaucccagggucucuuggcucuguucuuguuggaggaugguucacaucucuaggcacaauucccugguaacaaggaaaaaaacacaucuuccacucugcucuucggggaucugguaaucucuguucucaagugcugguggagcgcuucaagccaggcaguuucuguuccuggaagcaauggugugagaagggcuuuaucuugagccacucacugcauagaagcagugacaccugguuccugauugcucagccuugggucucuggcucuaguccagagugcggggugaaggcuggggagagaugggcacugggaauuuaggugggacauccuggauucuguggguugggugaaauggguagcaguauucagugccuucuaggaggccaucccuggcuuggaaauguuguagaaaccauguuuuccaggcaguaauucuucaguagcuccagugacuauaggggugacucuagaggugguggucugagggcuuagagccucagucucuggggaacaagcugggcagggagggcuaguggugguguccugguaaacuacagagcagcaggcagagauggguguuguggccugcaguggugauucugugcauucugucugaggacugagaacagggcaggugaagugcagggagccuagugacagaaggugcuggggacuggguauggguggcccaggguacaggaccaaagccagggcagaggugcgugcuuugaguguugggucucuaccucacuguaguauagcccccuuaugggaucuugggaggcuggguguggugguguggugugggaccagcaacuaacugcuggagacaggcaggaccccuugggaucaacuuuuaguucuaaagggguggggcuucucccagccaucuugagaggugguuuguguuuugagcagacagccaauuagagucugcggccuugggcccuugauauguaaaauaaggagaacuagcccccggugggguagcuguuaggauuguuuuucuucucuaccccaucccauuuaaucuuuuuccugcgaucagauaauugcuaugggagucacagcuauaaaucugggugaaaugggauugccuaguuaauaaggaaucacaaucuaaauuuacugaccuggccaggcgcgguggcucacgccuauaaucccagcaguuuuugaggccaagguggguggaucacuugaggucaggaguucgagcccagccuggccaacauggugugaaacuccaucucugcuaaaacacacacacacacacacgcacacacacacacacaaacauuagccaggcauggugccgugugccuguaaucccagcuacuugggaggcugaggugggagaaucacuugaaccuaggaggcagagguugcuguaagccgagaucgugcccacugcacuccagcuugggcgacagagcaagacucugucuuaaauaaauaaauaaguaaacaaacaaacaaacugaccggaugaaaaccuggguuuagacuccacuccucuuccugcuggcaugugcccuguuagguaggauuugaaucuuuugacagcaggccacgggcacacuccccuauccauugcagccuuuccucauagccacuuucccgucucaaacuguccuuacucuuuuuuuuuaaauuauuuuuuccagccagaccaacauggagaaacccugucucuacuaaaaauacaaaauuagcugggugugguggcgcaugccuguaaugucagguacucaggaggcugaggcauaagaaucacuugaacccgggaggcggagguugcggugagccaagaucacaccauugcccuccagccuggacaacgagagcaaaacucccgucucaaaaaauuaaauaaaauuauuuuuauugggcagcccccaaacuagaauagguguagggagacuucccugucuuuacucuuuuauuugaaagacaauugaacacaaagcaaauacaaggcaaaucucccaucauuaccacuuuuuugggugugggcggguuauuacagaacagugauucucucuuucuuccccccaggauggggucucacucuguugcaagugcaguggcacgaucucagcucacugcaaccuccgccucccuggcucaagugauccuccugccucagccucuggagcagcuggaauuauaccaccuggcuaauguuuuuuagagacaggguuucacauguugcccaggcuggucucaaacuccuggccucaagcgauuugccgcccccuccaccacccccaacccccgccucccaaagugcugggauuuuggguaugagccaccacaccuggccucagaacagugauucucaaacuugacugcacauuguaaucaccuugguuuuaaaaaaacccugcugcuggggucucacucuaagauucugauuuaauagggcuggugcugccuuggccuugggcuuuuaaaagcuuaccagaugaugcuaaugugaagccaaguuggagaaccgguugugaaagaaauuaaaaaucucuccucccaaaaggaggaaguaagacucuuuaucuguagguaagaaaucccaaggaaaucuacuaaaugguuagaauuagugaguucagcaaguuugcaggauacaagaucaguguguagaaacuuccccucuccuacaacugaauggcuuguuguguguccuucccaguuuuuccaugggauuaugugaacauagacauuccauacacaugguggucuguaccuuuuuguuuuacguauccaggugauuuuuuccaugucggcacaugagaucaacuucuuucgguaacaucgguaugucaguggauuccauaaucuaccuagcagugauuccccugaaauguuuguuaaucccaauuuuguuucaaaugaugccucagccugugcagagguacguggguuaaaaacauuuugaaaaaaaauuuuuuaagggacuagucucacuguguugcccaggcugguggcaacuccuggacuucagcgauccuccugucucugccucuuuaaguagcugggaucacaggugcuuggcuuuguggauuuuucuuuguugugguuuuguuuuuguuuuuuuaauuuaaagaugccaagugugggauuucagaguuguaggaugugguuaugagcuuuuaagagcuaucauaaggcucuccggaaagguaguacagacuuccccuuuucuuggcucauauagcgccucuuccccacaguucuagaauaauggguuccagauuuaaugugggagagaauuuagguacccaucccuuggcuguaugccuugagcuuuuuuuuuuuuuugagucucgcucugucacccagacuggagugcaguggcacuaucuuggcucacugcaaccucugccucccggguucaagugauucucccgcucagccucccgaguagcugggaguacaggcucccgccacaacucccggcucucucucuuuuuuuuuuguauuuuuaguagaaacaggguuuaacauguuaaccaggauggucucaaucuccugaccucgugauccacccgccucagccucugaaagugcuaggauuauaggugugagccaccgcacccagccuccuugagcuauuuuaaccuucaagauaguaauucauuuggcugggcaccguggccugucaucccagcacuuugggaggccggcuggcggaucaccugaggucucgaguuccagucuagccaacauggcgaaaccccgucucuaccaaaaauacaaaaauuagccaagugugguggugggcgccuguagacccagcuacucuggaggcugagacaggagaacugcaugaaccuggaggcagagguuguaaugagccgagaucacaccacugcacuccagccuggacgacagcgagauaaaaggaaaacaaucuagcaagguucuguguuugaaugugaagcaaaacgguagcacuaaauuucuucccugaggaauugauguaaagccuuagcccuggccacugccuagcccugcauugugcuucaaaugcuaucauugcugcugcuucaaauaucagcaagaaaguuuaucuuuaaagauauagggacuuucaaauggaggugaccuucucacuaccacugcccccacuucaucacuucaggggcagaacacaccucuuagcauuccuucacaaacuguaagguccuucucaauccccuagggaucuuguuaaaaugcaagucugaggugagacugggauacugcauuucuagcaagguccuaggcaauauucaggacuucugguacauggaucgcacuuucagaagcagaguccuagaguagugguucccagccuuggcuggaaaguagaaccucucagggaacuuuuaaaaguacugauguucugguucugccagaaaacaauauaagucaaaccaauaugaguuguuaaaacaugugcauuuguuaucucuaaaagaaaacaaacccaaauaagguguaauucagcuugucaguugaaggauuuuugguuuuaaaaagacauuacuuuggcagagagauuuaaaguuugcuggcauaggaagcauugaauguaaguguucuagaauaagcccaucauauaccuuuagugaguguuaacugcuuugcaaagaacuuucuauaucucagcuaauccuuauaccaaccauccauuaagagauguguccccaucuuacagaugaggaaaaauugaguuuucuauccccuuuacaugucuguugccuucuucuaggcccuuacuauuccuccuugcuuagaccuaacugacuuagguuucuagguuccuucugcucgauauacuucacuuuucuuuuuugagauggagucuugaucucggcucacugcaaccuccaccccccuggauucaagcaauucuccugccucagccuccugaguagcugggauuacaggcgccugccaccaugcccagcuaauuuuuguauuuuuaguagagacaggguuucaccguguugcccaggcuagucucaaacuucugaccuuaggugaucugccgagcucugcuucccaaagugcugggauuucaggcuucaggcaugagccacugcgcccagccucgauucacuuuucauccuguucccagaauugccuucuagaaacaauuugaugugugugccuugcagaccuaugcugguucucuguugucugcaggauaaaguccagacuacgcaguggggcccuaggacacccucacugaccccacgaugguacagaugcuccucagcuuacaauggaguuacauccugguagacccauuguaagcugaaaauagcauaaaucgaaaauaaauacaucuaaugcaccuaaccuacugaacaccauaguuuagccuaggcuacuuuacaugagcugagaagacucacagucgucuacaguggggcaaaaucaccuagcaacacgauccacucuggagugcccguuguucacccuugugauagaguggaugacugggagcuagcauugcgagagaguagcgcaucaccuauugguaguccagggaaagaucagaauccaaaauuggaaguauaguuuccacugaauggguauuguuucccaccauuguaaaguugaaaaauucucaguugagccuuggaagaucagggagcgccuguauuugaaucuuccaagucugaccuggaccuucaugcugcaguuugcuguguuggucccucacccuggagcaucuccuuagccauugggaauuuuauuccuccuucauucucacugucucuaauugcugaguaacaaaguuccauuucauugacucaugauuuuauggguagaugugagggaaccaugcacauguggauuccauggggguuugaaaugcucugaugccacuugauagaaaaaaauguucugugaguuuagagaacugagccacacugagcagagcuagccccuuuuuggggaacauagagagaauuuggcaucaugaagugaugaagggagggauuuggguuaaagaauagaaugcucgguuuguuucaagagggugcgugaguuggggagcauggaggggaagaugccucuuccuggccacugacccccaguggaucacacagaggguggacugguacgagcugagaggugugcuccucuuggagggcagggaaggcggaggagauggcuccagcucuacccuguugacugucuugcaugugcgguugccaguauccuccuaccuggcucuguaacaucccuccuccccgcucuccugcucuccccagguguaauuacuucaagccuccaggauggcaauccaguuccguucgcucuuccccuuggcauugccugggaugcuggcgcuccucggcugguggugguuuuucucucguaaaaaaggccaugucagcagccaugaugagcagcagguggaggcuggugcugugcagcugagggcugacccugccaucaaggaaccucuccccguggaagacgucugucccaaaguaguguccacaccccccagugucacagagccuccagaaaaggaacuguccaccgugagcaagcugccugcagagcccccagcauugcuccagacacacccaccuugccgaagaucagaguccucgggcauucuuccuaacaccacagacaugagauugcgaccaggaacacgcagagaugacaguacaaagcuggagcuagcccugacagguggugaagccaaaucgauuccucuagagugcccccuuucauccccaaaggguguacuauucuccagcaaaucagcugagguguguaagcaagauucccccuucagcagggugccaaggaagguccagccaggcuaccccguaguccccgcagagaagcguagcucuggggagagggcaagagagacagguggggccgaagggacuggugaugccguguugggggaaaaggugcuugaagaagcucuguugucucgggagcaugucuuggaauuggagaacagcaagggccccagccuggccucuuuagagggggaagaagauaaggggaagagcagcucaucccaggugguggggccagugcaggaggaagaguauguagcagagaaguugccaaguagguucaucgagucggcucacacagagcuggcaaaggacgaugcggcgccagcacccccagucgcagacgccaaagcccaggauagaggugucgagggagaacugggcaaugaggagagcuuggauagaaaugaggagggcuuggauagaaaugaggagggcuuggauagaaaugaggagagcuuggauagaaaugaggagggcuuggauagaaaugaggagauuaagcgggcugccuuccagauaaucucccaagugaucucagaagcaaccgaacaggugcuggccaccacgguuggcaagguugcaggucgugugugucaggccagucagcuccaagggcagaaggaagagagcugugucccaguucaccagaaaacugucuugggcccagacacugcggagccugccacagcagaggcagcuguugccccgccggaugcuggccuccccuugccaggccuaccagcagagggcucaccaccaccaaagaccuacgugagcugccugaagagccuucuguccagccccaccaaggacaguaagccaaauaucucugcacaccacaucucccuggccuccugccuggcacugaccacccccagugaagaguugccggaccgggcaggcauccugguggaagaugccaccugugucaccugcaugucagacagcagccaaagugucccuuugguggcuucuccaggacacugcucagauucuuucagcacuucagggcuugaagacucuugcacagagaccagcucgagccccagggacaaggccaucaccccgccacugccagaaaguacugugcccuucagcaauggggugcugaagggggaguugucagacuugggggcugaggauggauggaccauggaugcggaagcagaucauucaggagguaggagggucucggguucguuuagaggauggggcgcucccaguauuucuuggagaaaggcugccagucugccucucccuucugcuacuugugcagcaaagucauagugcucuucagcucuuuaucgcaaccugcagaggucuggacacggcguagagcugguggguaacugaggaguuagauugcccugaaaccccaagucaugggagcuguaacuugguuccucaaccggugaccuuccccagugagcccuucccaaggaacuagcgccaaguugggcucgcugauuaacauuagugugccucuuuuucuuuguuuaaaaaaauuauuauuauuuuggugcagauggagucuuccuuuguugcccaggcuggucucgcacuccugggcucaagugauccuuccgcccucggccucccagagugcuggguuuauaggugugagucacuaugcccagcccauuuuuuuuucuuuuuuaaacacuaaccucuuugugugugcguguguguguguguuuuaauggagaggccuccuuagcuuuacuucccuugagugccagguaugggugugaguguuuugaaugguuuuuauuuccuuuuaaucaugugcuuguucccaugucuucaccugcuuuccuucuccagaagcucuuacaggguaagugcccaaagaacggccacagcuuugaauacuugugggaggcuugagcuuccugaguugucgcugucaccuuugcagaaagccucagccauuuucuuucugugcaguugcagcuccacccccgggaaagcggggcacuuugauaacgagguguccuggguuuuucgagugcugaccccagcguagacaguucagaccgcuaacuuacaggucagcagcuccugacccugcuucugcaggcacccugggguguuuucauuuaucucauggagagaggccacgaauaucccgaguggcucucugacuuguuuguccuggagccauucccucccauuucagcuccggguagguugggaaucuuuauugggaauuuuaccacuuucagcagcaucuaguuuguaccacacgcuacauuuugucaccuccaagaugcuguuaagacacuacuguuuuuauguaccuuggaaagaaaaaagugcugccagucaugauuauagaaggcaagauacuauaugaugcauccuaaucucgggauguuuaaauguuucuuaaaauacugcaucugaaaaugggugauuuuuauuuuauuuauuuuuuaagaauaaaggaguuucccuuugcuuacugccccucagcugaauuaacaagccccgcagccuugucugccaacucuagauggauaguaguagcuacucagaccuguugaagucuucugaguuuaggcuugaaccuaagccguggugaugggcagggagguuuagggauggcacguggaaaugagguaauacuguccacgagcaugcggugggugccaagcacgagguuagugccucgcauguaccuucaugucagcccugcuuuguuugugaggaaguugaagcugagaaggggaccagggaccaccccacugagggagcuggaagcuggccuuugagugcagccugcuagaguccgggugugguucugagccacugcugggagccaucgggauggcagguguuagccagucccauucuguggggcagaggcuggauacugugagugagcagagcuccccgcccccucgcccagccccugucagccuguuaugcuucccgcaggcuagccaagcagucuucccccagaagggguacuuuucccugcaugaauccuguucgaagcgccuaguguuaaggggggaagucauuuugaaggugauucuuccuuagcugggagcaggaucucuugggccuuaguucucugcauccaguguauggguuacuuggcaaaggauuauacucaggguuuggagaaaccauguggaagguaaccuaauugguagacucucaggagugaucuauuucuggugauugagucauccauauuuaagccagggccacuucucuugagcugaucuggacccgcuuuuuugugacggucccuuuggcacgcucuugagugagaguggaacagcccaggucgggagcagagucuguucccauuggguuuucuugggcaugagcuuuggcucagucuuuugaccaagggaguauuugagccagaagaguguucagaguugcaugaaucaggccuaagcaaagggaaaggagacucuccuuuuuuaguccacauauggcagaggaacgagcggguccccgcuagguauaagaauggggcccucaggcaggccagugaggacuuugucuagcucugcugggcugaaggccaguaccuaugacccugggacugggcccuggggacaggagacugacccuuggucugaggggguaggauaguuggaagggugucaagguguuugugguccaucggucuggcucucaggaccauguggaccucaagcgugucuccucccccgcccucugggcuccccuucccugggcgcagucugucucuuccaaguucaccacuugugucucugcuccagcagcuguggcugggugcggcugccaauuaagcaagugggacuguaagugacaggcuaaaauuagguguaucgacacccccaguucuccuuucauugggguuguucugagccuucuagacuguaaguugacagucaccugccaagcuugaggagcggguguggggcagggccuccugggaaugugaguuugggaaguucuugguuacuggcugcucugaguggggucugugugugugcgugccugcugcuucuuccccugcagguucugacaggaacagcauggauuccguggauagcuguugcagucucaagaagacugagagcuuccaaaaugcccaggcaggcuccaacccuaagaaggucgaccucaucaucugggagaucgaggugccaaagguaggggcggagucccccaggcugguucugugguaagcccaaagcucccuggggccagggccauuagaccucagggagggagggggcugggagagggacaguaaaccagaaggagcccugggucagccaaaggccgcagggaaaggacacgcuacacuuugccaaggcucagagagcuuccugcaacauggaauuccuccagcugccuccaggagcaucuuauucuuguacuucucaaacucgcaggccugugugucucccuugggggugguucuugcauauucuggggcucagaucuauuuggaaaaaaaacaccaaggccgugggggccagccagaaucccuucacugagcucugcucaagugcuccaaguguauuuuauaauugagcaaagcauaaauccauauuuuagagaacuugaaaaguauagaaauacaugcagaaaauaaaaaucagcucuaauccuacccuugagagugacugugaaagacuuuuauuuccuucucaucuugcacccugugguuuuuaaacaaaacugagauuaugucgcuuuaauuaauacuuuaaauauuuaacaauuuaauuuucguguguuauucuuugaaaauguaacuguaacugcauuauucacuguguggaugucaguuuacuucaucagucccccauuccugagugcuuaagugguuucgagcuucuugcuauuagaacuuacaacauauuagcuugaucuugauguuuaucucuggggcucagaaauaauuugucagaccgcauucucccagggcccugggcucugugcucagguggagacuuggcuuggucugaacucugggucagaguggcuguuuugacccuggguugcgaggucucuuggugguuuccucccuggggggcccuguuauccguccugccugcuuuuccuucagugguuacaaagggcaugaagagaaaggcugugccugaggauggaccauguccccaguagcuccuccgggagggggucguuggcgguugugugggagcccaucuuacguaagggcuaaguuuggcugcuucuaucugccuugaacucuggcgcacugggcacuucugcaugccuccugcucugcaggcuucagccugcugucacuuggcagcgggagcccaggguucuuagaccuucauuuucaaaucgagccccuuuaucuuuggaucugaguagacuugagggagaggggcacgagaaaucgagaaacugugugcuggugaaacuucucagcauggcuuuuagaggagaagaugcugcugccuuugcagcuuuccgggucugggccacauuguugggaugaaaugggaacugcuugguccuggagccagacugccugguucgacuuccugguuagcagcugugugaccuuaagguaguuacuuagccucucugggcuuguuuccccauauacagaauggugauaaaguuaucuguguuucacagguacuaugaguaaauguaagugcuuagaauaguccuggaaaauaaaugcugacaugguaacagcuaauauguuugagcaugaucuuguguaaaacagaaguaggucuuuggguguccagggaauugguuucccuuuaacccucucaucucuuuuugucuuucuggaagcacuuagucggucggcuaauuggcaagcaggggcgcuaugugaguuuucugaagcaaacaucuggugccaagaucuacauuucaacccugccuuacacccagagcguccagaucugccacauagaaggucaguaacaucugcugcuuguauugccucuuaccugaaauauuaaauagaagugaauagcaucugaguuucaauugcuaucuuuuuggaauaggaaacccugcuucucaucccagggaagggagcauuagguaucuucccugcagccuuuuccccauuucaggugccugcgggagacucaggucccucccuacucugaucuuuggccaggagaagugugggugcuugguugggcggggccuggguccuggguucauagugcccaccaccccauaaaggcuucucucaaagcagaagugcccugugugcaauucccccuuggcauuuucacagcugccugccucuucuguugcauugaaagcauggaucauaauggcagagguaucauuugaaaggcuuagaugccuuucuuccuaaagcagagcuuaaguguuuuguuaccucaaagaugcacuugaacucuaugcaaaguccaguggaguggggucuguggcuguguuuuugugagugugggugugaguuuccucuuacagugauuguauguccugcccccauccgcuauuuaggcucucaacaucauguagacaaagcgcugaacuugauugggaagaaguucaaagagcugaaccucaccaauaucuacgcucccccauugccuucacuggcacugccuucucugccgaugacauccugggugagcgugcuacugggugauccggacuucuugccacuuucccccaaaccuaccccaaacaagaaacuccccagaccucaggcuaagaaggccaagugcacaugagugccugcgcccucucuucucuggccucugcuggucgguucugcuaugggacuguguucuggggacagggcuuagguggugauagcgcuggcaggaaaccagaggccucuugguccccacaugggaggacuacuuuuccuggcucucccccugggcaccuuuuaaguuuucuaggcguuugcuuagaaaggaugguguaguucggacaggagauuggguguguccagggucgccguucaccaccugagaccugggugggacuagaaucauggguuuggauggcgcuuguucuuucuucugguugagucaggccuuaacaguggcccuggugaaggaucuccuuccccuuccccuccccaggaggugccuaaauuacaaagaagaaugaauacuccccaccaggcccggaaguccagugacucuugggagguugccccaggaguuuggcagagggaagagcugcuaucuccagggccccugugugcugcugacugcagggucucucagggccguggcccauauccugccgugugccucuggcccugguugggucuuaucucacugggaguagaauugcagaauucugugggccaacgacuguugacuacguuuuacacagauggacagaugggcugacuauagcuccaaggaaauuguccuccuucguguuuuuuuuuuguuuuuuuguuuuuuuauggaugguaggcauuucaguuuugugucuuccccuuugcaaaggcccuugggcuggagggaaaggauugggauaucuuuuuccuguggauaugugagaguaggcugaauaccacuuuaugcuuuacuccugaaucaagaguuuuuucccaggaggcucggucguagacucacucucuuuuuuuuuuuuuuuuuuuuuuuuuugagacagagucucacucuguugcccagucuggaguguaguggcaugaucuuggcucacugcaaccucugcccaccagguucaaacgauuauccugccccagccuccugaguagcugggauuacaggugugcuccaccaugcccagcuaauuuguauguuuuuaguagagaugggauuucaccauguuugccaggcuggucuugaacuccugaccucaggaggguaagcaguaggagggagagcaaauaggaagcagacucugcuagaccuugaccauggaccugaccugaggccacugcuugcucuugggagggcagcguagaugcugucagaccauaggcuccugggguugucugccaguccacaggaguuggcuaaagggccuggggccugccuacugcuuauuuucaggagucuuguucucagcggccaccucauuccuguguugcccucccugggucuuauagauucaucaacagaagugggagggagggcacugcugguagguggacccugcccaggccugugcaaggcccagcacuaccuccgcaguugcuucuugguugcccagugucugugggacccucccugccuggcccugaggugagacugccccuaauggcugcucgugguauugcaggacaacagccacaggggugucgaacacuuucuguuguuaaaguaguccuucaaccucuaccuucugggugccauguugucuugaguugcccuuuucaaagauaugcuagcccagagacuugcccuugggucucgggacuuauucaaagaugagauaagaaggauuguuucagugaccgcucccccuuccccucuacagcucaugcugccugauggcaucaccguggaggucauuguggucaaccaggucaaugccgggcaccuguucgugcagcagcacacacacccuaccuuccacgcgcugcgcagccucgaccagcagauguaccucuguuacucucagccuggaauccccaccuugcccaccccaguggaaaguaagcagugcccugaggggucgggaagggggaccccugggguugccuguucugcccuggauccugaucaggaggaggcuguucugcgauccuucauggaagcagcauccuucaauucuugccauuguuauggagcugggguggguuuccuggcaaggcagagcugggguuuccacuggcuggcagagugauggguguuggaguagaguuuugacacagggauucagaucccagcucugccacuaauuuuuuuuuuuaauuuuuucuuuuuuuuuucccucaaagccagugucauaguaucugccaccuauuuauuaucuguuaaagggggugauacccacuuguuccaggaauuaguguugaauacuguauguauuacauauaaagcacuuaugcauauaaugguuaccacaaaaaaauccccaaguccaacaagccugugcagcguguugggucaucuccauuuaacagaugagaaaacugggccucaggugacuugcccaagugagcaggaucuggggucugagcccagccuuugucauuauuaucuuuguuguccuuaucacagaggauggaaugucagaacaucacccauuccucaccaggggauggcagggucacucagugcaguagaaaaccuucugaagugaucucuguagccuuuuguguggauuuuuuccuuuuggaaggauaaggacuuaguuuucauuggcuucucuaaaguugccuuaacccagcaguaaagacugaacuggagccugagggguaacugccagggguucucuccaagggucaggacccagcacagucagccucaugucacagguccucauccuggccagcgugggcagcuguuggggugcugcugggaacguuuaccuccuggucucgucugccucugacccacaguggguuagugacuccuugauccuggguggcugcccaggugcugucagcaccuuccagaggcaaaggcuagaagaaggggguuuaggcccaggaggccccuucuggucaagcucuccagcugaguugugggcuggagcacacccuagguaugaggaugcugagaucugcugcacuugauuucuucagggacuuucuuuuaaauguaaggcuggcccuggcccccauuccccgagugcuauauuuacuugguuuauuccuauucaucugugucccucuugggucccagaaguuuuggaguaauggaucuagacugaaugcuucucagucuggauggccucgggggcggcacacuugcuaggcugaacuucucacauccagguuuuucccucggcuggucuugggcuugggggaggcuuugcuuggggccgguugcuguuccuguccccugcacuguggagguugcaggccucugagagguaacgcagggagguggguaguggccagguggcccuuggugcccugcccuggcccaggcguuccacgcacucugcucccuacccugcaguaacggucaucugugccgccccuggugcggacggggccugguggcgagcccaagugguugccuccuacgaggagaccaacgaaguggagauucgauacguggacuacggcggauauaagagggugaaaguagacgugcuccggcaaaucaggugagcggagaugccucaggcaggccuacgcccugcuuguucugggaugcgugaucucugcguggcuggcucaguugugccagggcuugggugaggguuacuucuucccuccugcugccuacuguguuuuagcagagucugauagaaacaaacucgauuacucgcuuagccaaacugagcuagaaggccuguauuguggaagaauccccagcaucauccuucaaaagugaagcugggccaggcgugguggccugcugcaaaucccagcgcuuugggagggucacuugagugcaggaguucaagaccagaccgggcaguauagcgagaccucaucucuacaacaucaacaaaaaaggaaaaaagugaagcaggcuccuuuuuaggaauuugucauaggaagucccucugaggucaggcuugcagcagggucggcuggcuguguuugggugugcugugagccguggccuccugcaaaguacgaacccucugcuuugcugcaucccagguuaugggcgucacuguacaaagaugaauacuggcuuggaguggagucagccuucauguccacauuaaacuuguuccuuucuugccuucccaggucugacuuugucacccugccguuucagggagcagaaguccuucuggacagugugaugccccugucagguaacagcugaggccuuuggcuugggggauuguuggggacaguuguugagaguaggucuuucucagagccuccguucucaccuggaggauuuaugcuaacauaaguugcuaccacucaagaguuucugacugaauaggucugggcuuaggcccaggaacuuacauugcuaucaaguucccaggugagaccagugcugcugauccuuugagauccacugcucuagacuguacucagaccucaggcaucaaggggcuuccaacaaaggcacuuuccagauuauaguccagacccagagucuuagccccggugguugagggcgugcuggucacugauacugcucagccaggccauagcuccauagggcacaguggggacacccuaucuggugucuuagacuaugaaagcauugucagagggaagaggacuggcaaaaucuuggguaaaugacuuagccucaauuuucaccccagaacaugggaaugguaccugucuuugaugcuggcugugagaauuacauaaaccuaagaucugguguguagaggguggcgaaauggcagcuguuuauggcuaggaauuuuauauuuguaggugauaguucaucccaucccacucccuccccagguuugccccuucugaucuccuucuugcuugucuuaagcgauuugcaugcguuagaaauacuacagucuagcuggagucggcuuagagggagcacuggggcaagaucuuuguuuugcuucuuuuauugcuguugccccuccuuccucucugcuucuguccaucuaagcgaucuguccagacccagcugaaacuuucuccuucguaagauuuucccggaucuuccuugguaaaccccugucucucccauccuugccacugcuugccuuggguaugguguucuauguaacuuuuguaauccagcaaagcugaaugcugccgcagcgccuugcccacucugaguggcuggccuuauugggcuguguggccaacugccuggguuugauucccaccuucaccacuugggagcugguugaccuucaggaauccaccuuugccucaguguucucuccuguaaaguggggauagcacuugguguuacuaauuuuguggaagaacacauaugcucugcacugccagcauccgaguugguggggguggggguggugcugcugcuggugguauugguggugguguuaguggugaaguuucuguccaucuguugucugugcugcaccagugggcaacaugcaguagcggcccuuaguuuauccacugggagucauauggaggccuaggcucugucucugaccuggguggaucuccccagugcaguucucaaguuccacagcaucugaagcauucuacuuggaaugcaccugaaacuuguguacaugacaagggugccuugccucagugagagccuaaaugccgcuuuuccuuuuccuccugaagacgaugaccaguuuucaccggaagcagaugccgccaugagcgagaugacggggaauacagcacugcuugcucaggugugugguuggcaggggugggggaggcaggcuggcuggguucuugggaacugaccuuucaaugccuucuuuccuguggcuuggcccuggauugaccagcaguauuuaaggaaaggugcaugaaguagcuaauacuugauauuagucuguucucacauugcuguaaagaaauaccugggacugaauaaucuauaaaggaaagagguguaauugacucacaauucugcgggccuggggagaccucaggaaacuuacaaucauggcagaaagggaagaggcacgucuuacaugaugggcaggcaagagacaguaugugaaggaggaacugucagauacuuauaaaaccaucagaucucaugagaacucacuaugacgagaacagcaugggcacaccgccucaugauccaaucaccucccaccaggucucucccucgacacauggggauuauggagaugacaauucaagaugauauuugaguggggacacaaaaccuaaccauauuauucuuuccaccccccuucuucaggugacaaguuacaguccaacuggucuuccucugauucagcuguggagugugguuggagaugaaguaaguucugcccuucuuuuccuucuguguugcuggcccgaaguaauggauugauuaggagcugguccugggauuuguuuccucuugaguuaaucagaggauauaacuguagacaagcaccuccuagggaacacuuuggauguccugauuggcaguggugaugucaguguccucuaguggguagaggccaaggaugccacuaaacaucccauaguauucaggacagccccccacagcaaauaauuauccaaccgcaaaugucaauagcgccaagguggagaaacccugugcgagacuuucugggaccuucugucuguugaguuuuucuguccucuaucuuaugguaugaaagcuuagauuucuucagcauauuaaaaagccuauccuggccagguacaguggcucaccccuguaaucccagcacuuugggaggccgagacgggcagaucacuugaggucaggaguuugagaccagccuggccaacauggcgaaacccccaucucuacuaaaaaugcaaaaaucugcuggguguggugaugcacaccugugaucccagcugcuugggaggcugaggcaggagaaucacuugaaccugggagacggagguugcagugaaccaacauugugccacugcacuccagccugggugacagagcaagacucugucucaaaaaacaaaaacaaaaacaaaaaaacccuauccuuaugccacagcagccaacagaauacuuaaauaaauguuccuguuggcuagagcauaagccaugucccccacccuguuacucuuuuuuuuuuuuuuuuuuuugagacagucuugcucuuguuauccaggcuggagugcaguggcgugaucuuggcucacuguaaccuccgccuccgggguucaagcgauucugcuucagccucaguaacugggauuacaggugccugccaccacaccuggcuaauuuuuguauguuuaauagagacgggguuucaccauguuggccaggcuggucucgaacuccugaccucaggugauccaccugccucagccucccaaaaugcuaggauuacaggcaugagccacugcgucuggccuacacuguuacucucauacaucuguugccugcaguggcaaccggggaggggagaacucauguuggcuagggagauggccccaggaugccauggacaaaagcuuuaagggaacuuucuuuucuaggugguguugauaaaccggucccugguggagcgaggccuugcccaguggguagacagcuacuacacaagccuuugacccccaugcugcuuccugagagucuuuuuuugcacuguugaaauugggcuuggcacucaagucaaagaugaacaucggaauaacaaacauuguccucuccagaaaguccuuucuuucuccauacuguaguccuauugagaagacauuucgucucugagaaaaaaggauggaacuauggguucucuucgcaaagccaaaggauaguguuuaacaagccagcuggcuuaugcugguucucagcuguuuaaaaaaaaaaaaaaaaaggaauagaaacaguuucaaccagauuguccuauucccccuguuccauuccccucuucuuccuucuaucuccuuccccggcaaaaaccaaacaaacuggcagacaggccagggauguauguugcuugcuugagaggguuucuuuuacuucaaaaucuuucuucagggagcaagacaugaacugacuaauugguauccacuacuuguacagcuuacauaaaugaguugaugauauuuaaccaguuuuuauaaacuucauuuaggucucuaaacacagacuuuuuaaauugcaacuguaaauaugaaauggucaucacaucugaccuuggucaguggggaggggaacugguauccugccaagccugguuguaauuuguaaccauuuucuauuugugcaaacucuguaaauauguguuuaaacaaauguaauauuuuguacaagauacacuggagaacaaagggaacucaagauucuuccagccacaugucaccuguagguagaaguaaacucugcagugcagcuucugcucuuggccccucuggccagggccccuguggcuuccugcacacuggacaggugacuguaugguagagacugugaucugggaacuuuuugcuguacaaaucuguuuaaaaaaaaaaaaaaguaacucauugaauuaacuugcagugguguguuugauucuuuuuuagacuggcuucagcauugugcaguuuaaaaauaaguaaguaacuuacauaaaucuucaauuguaugaacugcagcuuugaguccauuuuuuuccaguggugaagaauuggcgggggggggguggugaguguggcgagcuggaucacaggccccacacaacugccucugcaggagacccaugguuuuuugaagacaauuuggccagaaauuucuaucuggccuuuuccucucucuccuugucccaccagguggcagccaagcguccuccgacuucuucacugcauguuaacuggccagacucaguuuaaagcacuggcuuccaaaacggguugugccuucuuugguugucauucuuaauagauucgugaaguuauuuaauuuacuguagugauaagaaugauguaaaaaauacauguaaguuaugggaugagauacugccucaauuuaauagccccugcucuuaaagaaggcuggccacugcagcccaggccuaccccagugccccgccccugcccccuacguuugaggccucuggcugcagggcuguugagcuugagcucuaguuuuuagagagcugacguagccugagggucauucugauuggagauauccucccaccgcacacccacuccugggagcuccucccaguuccaacccagcuggcuuguucuuuccgucucuguccuggccaagccugagcuguggccauugucaggugcccaucuuccccuccauccagguucucgccugugugguuaacagccucuguuucccucaucuguaagaugagauaaccucauaaggcaauuuaaucauggaaaugcccucugcuucuacagugcuuggucccagggagcuccccugcaguuccuuagccacuauuggcuuuaaguccuggcaggaauugggugugacuuuggccaggucaccauacacccaggucuaagcuuuuccucuauaauccagcauugcuggagcaugaaaaggucuacggaagccuuccgacuaacuuagggaaugcucacagagccuggugugcagauuuagcuuuuaucuccagggaaccauugagggguuucaaacauuaaaacaugcuucuggugcagggagaagggugggugagguggagguguagacaugagaaaaaagggauuccccugggauggagccugggacagacaagacgugaugaagucaggauccucagauaaagccccuugggcuuugaugagugggaugggcugcuacccgggacucccacgccuuagaguccuacccugcaagggugccuccauuaaacucg

SEQ ID NO: 16756 - RNA, 26167 nt, Homo sapiens
ucagggacugcuccucucgagcuagguuucguuuccucggcggccucggagcgcgggugcagcaguugugucccgaccccugggagcgccauggcagagcugugcccccuggccgaggagcugucgugcuccaucugccuggagcccuucaaggagccggucaccacuccgugcggccacaacuucugcgggucgugccugaaugagacgugggcaguccagggcucgccauaccugugcccgcagugccgcgccgucuaccaggcgcgaccgcagcugcacaagaacacggugcugugcaacgugguggagcaguuccugcaggccgaccuggcccgggagccacccgccgacgucuggacgccgcccgcccgcgccucugcacccagcccgaaugcccagguggccugcgaccacugccugaaggaggccgccgugaagacgugcuuggugugcauggccuccuucugucaggagcaccugcagccgcacuucgacagccccgccuuccaggaccacccgcugcagccgcccguucgcgaccuguugcgccgcaaauguucccagcacaaucggcugcgggaauuuuucugccccgagcacagcgagugcaucugccacaucugccugguggagcauaagaccugcucucccgcgucccugagccaggccagcgccgaccuggagguagggaacggccugcugggugcagagggcagccuggccugauggguggugcagaggggccaccgggggccucucugccacacucuggacgcccuggggagaugggccugaauucgaggccggggcaucuccaaugucagaguagaaaggggaugggagauuauauagucccuucccaucauccaugaagacagguuagguugcuugccauaauccugucauugucugaugguguuuauuuuuauuuuuuugagacagggucucgucccucucacccaagcuggagugcaguggcggaaucacagcucacugcagccucgacuucccgggcuuaagggauccuccuaccucagccucaagaguagcugggaccacagccucccaaguagcugggaccacaggcucgcuaauuuuuuguagagaugagguuucgccauguugcccaggcuggucucgaauuccugagcucaagcgaucugcccaccucgaccuccuaaagugcuaggaggucuuuaaaggcgugcaccacugcgccccaccaucugaugguguuuaguagaggguuuugaaugucaacuaugaacguuggagguuaccucuguucccucacgaaguccugguggcacccaggagguggauaugauuuaguuucauuuuacuguugaggauacugagguccagagaaaugaacuuagccugaccuaaugcaguaaauagccacgcaggcauugugacccggguugguucgauuucauaguuugcauuucuucccauggaccagccucguauccagguccguagaguccggagcaccaaacaguccaggaagcuugaggucauguaagcaaaagccuuuggugggccggagaguuccugugaucaggaaggguuguuauuagaggccuaagagggagggugggcagcgucccaguaaucacuggaucagagccacagggagagccaacacucuugcaccauaguguccuccguccuggccgugugacuuugagcaugggguuuggccccuggaccuggguccucaccaguauagugaggcugugggacuagguggauuccuaagggccuuucaggucugcaauguuuuuaggugguuuggggaucauaccuuccccuuguggccucaaagcagaggcugaaaucaaaccaccuuuuguuacaucagccuaagauccaaagcauggccugauuucauuucauucucacagcaccuucagggagaacaagacccgucuucguguugucagaggagacaguagccugagcaaggucagaguugggggucugcauccagcuuuguguagcauauaaacuuggcuuuuuuuuucuuuucuuuuagagacagggucuugcuauguugccuaggauguucuugaacuuccggccucaagggauccucccaucucagccuccugaguagcugggacuacaggugugccaccgugccuggcucuaaacuuggcuuuuuuuuuucuucuuuuagagacaggaucuuacucugucacccaggcuggaguacaguggggugaucauagcucacuguaaucucaaacuccugggcucaggugauccacuugccucagccuccugaguagguaguacuacaaaugugagccaccacaccuggcuaaguuuuaaaaaauucuuuuguaaagaugggaucucacuauguugcucaggcuggucuugaacuccuggccucaauccuucucccaucuuagccuccugaguagcuggaacuacaggugugcuaccauggggccuggcuauaaaaucagaauuuuuuuuuuuuuuugaguuggagucuuguucugucgccaggcuggagugcaguggugcggucucggcucacugcaaccuccaccucccgaguucaagcgauucuccugccucaaccucccgagcagcugggacuacaggccugcgccaccaugcccagcuaauuuuuguauuuuuaguagagacugaguuucaccauguuggccaggcuggucucgaauuccugcccuugugauccacccgccucggccucccaaagugcugggauuacaagcgugagccaccacgcccggcccauauauauauauuuuuuaaucuuuucuuuuagagacagguuuucacucagucacccaggcuggacuacaguagcaugaucauagcucacuauaaccuuaaacccuggacucaggugauccuccugccucagccuccugaguagcuaggacuacaagcacgcaccaccacacccagcuaauauuuuaaaacauuuuuuguagagacgggaucucacuauguuguccaggcuggucuugaacucccaaccucaagggauccucccacuucagccuccugaagugcugggauuacaggcgugagccaggagccuggccuaaacucugcuguuuaauccuaacaacaggccuuccucugccaacaccuaccccccuguccugacuugcugaguccuauaacaggucugcuuuuugagcccugcuacugcugcucaucacuguuggcagagccagucucagcugggcaaugcccuuagccucgggggcuggguugccuuggccacugguggggucggacuugagacucuggugccucccauguggaagacccaagucucuagucugugaagggauccucaggauuucaaaaaguccuuugccuuugauuaggggauuauugcugcuaccaaaguuuuugggucacuuuccuuuggucuggagucgugugggcaccauucaugaugaggguacugccgcauguguuugauuaaugguguaucaaaucuuucaaaauauagggcucaggguguagugcuaugagcagcucuugaaagugaagcaguuggcagccuugggguguucugaggucucuucuugcucugaggccagcaaggccggauguauguaggccuggucuuuggcccacaccuuaucuuggccacuguuagaggccaggucgaagggcagugucacagaggucaaguuugaaacaucaugagcagcuugggcuuuucggauugaguuaguguggccuuggucccugccuccaaccccuacaugugacugucacuggguuguucaaaucuagauucaagaucagguuccgcccagaauaucuuggguggaguugaagagucugggaaguggaagagagagccagaguauguugagccugcuaguuacgggaaggaaauuuuuuuuuucuagaaaucuccagcaugcucaguuugggcaugugucuaugauuuuaauaucgggaucuuagcugugccaguuacuaguaguguagcuggggcaagucacuuaauuguucugugccucaguguccuugucuguaaaggcuggguaauuccuaccucauaguguuguucuuagcuuuaaguaaguuaauacagguaaagcacuagaacagugccuggcauacaguaagugcauaauaaauacuggcugcugcuguuauggugguggugauuuuccuucccauuucugugcaguauucaucugagcagggagguaggagacucagauauugauuaugaaaauuaauugaaaucagaugaggauauuagcuuccuucauauacaguuugccuuuguuucuggagguggcuaggacugagcagauuugcaccugggcuucagccccugugagcuacuucaucuuuuuuuuuuuuuuuuugagacagggucucacuuugucacccaggcuggagugcagugaugccaucucagcucacugcaggcucaaccucccggaaucaagcgauccuccugccucagcccccuaaguagcugggacuacaggugugcaccaccacaccuggcuaauuuuuguauuuuuaguagagacaggguuuugccauguugcccaagcuggucucgaacuccugagagcaaaugauccaccugccugggccuccuaaagugcuaggauuacaggcaugagccacugcgccuggcuggcugauucaucuuauucccagcccuugguggucccagucugcagugagccuuggacucugauuucugucucccugcccugugaggcugacaaaggcucccagccuuguucugggauuggcagaugccucuggagagaacauccuagauaucaggcuuaucucucugggcccccuucccccuucuccuggaccuugacuucuuaauccucugcuugauuggcucuccagcaucuuuuagcagaucuccccgcugccccauuauuuggacugcuuuccuggcuguuugcagugggaggauuggucugaguggccccaccugccauuaccgaagcagcugucccagcucguucuguuccugugugagcuuggccaccuuucuguccuccuugcuugaguuucauuggcuguaaaauggguaauuagagaaaaacucauaauaauauaagcuggcauuuaguauguuuuuccuaagauccaggcauugggcugaguacuuacauuguuucaauuaauccucccaauagcccugugagcuggggacaguuguaucuauuuuguguccaagaaaacugaggugaaggacacaguugcacagcugggaguugggacuggaacccuggucuguacuguccucugaaaaggaugaagggaaguaguaaguauuagaaugcuucaaaaagcuccaagcaggcaagacucgggugacaggacuugggguggcaagacuuggguggaguggaagaggaaggaaucuauccugugggauaguuccagggauggcuucugguggggcugggcugaagaggugcauucucaaccucauuuguuuucccugcaggccacccugaggcacaaacuaacugucauguacagucagaucaacggggcgucgagagcacuggaugaugugagaaacaggcagcaggaugugcgggugaguggcagggcucuccaaggccagcccugcccuguggcuucgcucagcuuccacgcgggaugggcguggcucugaccaugacaaggcugguguugggugcacucacagugucaggaugaaacaucaaccuugcaaagcaugcagacagcugugugucugagagagauccuuugcaaacccaaaccaaaaauuaccuauaagcccaacugugggggaaaucauuauaaauuaggauuaaaaaguaguaauucagaaaaaugguuaugauauaaagugggagaaaaagaggaagcaaaaguauauagcucauaggguugcaucuauuuacaaaaaggaaguauauuaguuucauagggcuacugugacaaauugccagaaacuugguggcuuacaacaacagaaauguauucuggcagaguucuggaggccagaaguccaaaaucaagauguuggcguggccacacucccgaagucucuaggggagaacccuucuuugcuucuuacaguuucugguggcucaggcauuccuuggcuuuugacugcaucacucugaucucugccucugucuucacauaccugucucuucuucccuuagugucuuccaucuccaauaagaacccuugucauuggauuuagggagcaccuagguaaucuaugaugaucgaaucucaagaucuuuaauugcaucugcaaagaccucuuuccuaaguaagauuacagucacagguucugguauauggacaugucuuuugggggcccagcauucaacccauuacagagagcauggaaagaaacugaaagggaauauuauagaaggaucauaguggaaguguuggagugguaaauuaggaaugguuuuguucccccuguuuuucagauuuucgauacguuuaaauugcuuuuaaauggaaagaucagauuuuuacccuuuuucagagcugcagcaccaguuuuauugcagcaguuaugguuucauuagaugagaucuagguuagaauaccagcucugucacauacuaguuuauguugcuuuggucauguugacagaucuuugaaccuucguuucccaauuugcacaauggaaucacaaguucuuucugaagaugacugugagacaaaugaaagaaugcacgugaaaguaccuguauuuguuagagggcaggcuauacugcuguaacaaagauacaccagaauucagaggcuuaaauaugauugaaguuuauuuuaccaacugacaguccaaacccacacaugaguaacccagacuaaggguucaugugaucauucagggauuaaggguucucccuucuuauuacccuacuauuccacaagguauugucccagccucuuugguugaagcuggguuaccauuacaucuuuguucuagccugugacaaagggacaaaaaggagguggaggacaacaagcaauuuuccuuuacacaagugacacaguguugcacauaucacuccugggcaugggucacuggaaggaguuuugucacaucgccuagucuagcugcaggggaggcugggaaauguagucugaguagccacacgcccagaugaaacuccagggauguucucuuaccaaaaggaaaaaagggaaaaugaacacugggggacacuuguagucacauuagaaguugcacagugaaagauuggcaaagaaggcugggcgcaauggcucacgccuguaaucccagcacuuugggaggccgagacgcauggaucaccugaggucagcaguucaagaccagccuggccaacauggcgaaaccccaucucuacuaaaaauacaaaaaauuagccgggcgugguggugcaugccuauaguuccagcuacucaggaggcugagguaggauaauuacuugaacccgggaggcagagguugcagugagccgaggucaugucauugcacuucagccugggugacaagagugaaacuucaucucaaaaaaaaaaaauauuggcgaagaaauacuugaauuccucuuuuccagucuacuguccuucuuguguguuuuucucuuuguuauguuugauucugagcuauugucuuagucuguuuucugcugcuauaacggaauaccacagacuggguauuugcaaagaagagaaguuuauuuggcucaaaguucuggagccugagagguccaagagcaugcuuccagcaucuggugaggaucauccauagcggaaggauggaaggcaggagagcgggacaggaagaaggaggucaaacccugugauaagaauaugaauccauucaugagggcagagcccucgugaucuaaucaccucaguggcaauuaaaucucagcaugagcuuuggaggagacauucaaaccauagcagcuauugaggcuacccaagaugugaaacaaaauugcagcuacuaaagcagugcuguccagcagaaauacaguaggagugcagaugucauuuuaaguuaauuugaauaguacaugagauuuauuguauuuuauuuaucuaucuuuuuuaggacaggucucacucuaucacccaggcuggagugcaguggaacaaucauagcucacugcagcuuugaacuccugggcucaaguaaucuuccugacugagccuacuccccuucaccacccccacucuccaggaauacaguccaucuaauuuuuuuauuuuuauuuuuguagagaaacagucugucuauguugcccaggcuggucuugaacuccuggccucaagcgauccuccugccucggucucccaaggugcugggauuaugagcaugaaucacugcacuugacugagauuaauuuuaauauuauaguuuauuuaauuugguauaucuuaaauauuauucuuucaacauaucaucaauuuaaaaguuuuaagauauuuuacauuccuuuuuuuggugugaaacccuugaaagccaguauguauuuuacacucauggcaagucucaguuuggacuaaccacauuucaagugcucaguagccacauguagcaaguggcuauguuauuggaaaguacaauccuagagcaugauauucucuagaaauuuuccagagcugcauccugacuuuuuguuuuguuuuauuuuauuuuauuuuuuugagauagcgucucgcugugucucccaggcuggagugcaguggcacgaucucggcucacuguaaccucugccuccuggguucaagcgauucuccucccucagccuccugaguagcugggacuacaggugcgcgcugccacaaccagcuaauuuuuguauuuuuaguagagaugggguuucaccauguuggccagaauggucuugaucucuugcugacuuuuauuuuuaaaaauugcccaugaaccaccuuuagcuuaagaaauaaaauaucaucgaugcagccccucccaucuguuucucccuuauucuaucccucuuccucucuuccagaaguaaccacucuccugaauuuauuuauucauucccaugcguuucuuugugcauauagccauucuguuuguuucuaagcuuuauugaaagagcaucauaugguggaucuucuucugcaaguuguuuuucucucauggagauuuauccaggcauagcuccaguuuauuaauuuucauaacuguuuaauauuccauccuaugaauagcucccagucuuugcuucaagucuucuucugauggauguucagguugauuccagguuuuugcuacuucagacaaugcugccugugaacauucuuaugcaugucucaggggcagguggcugcaauuuuuuguagcacauauuccuaggacuggaguugccgagucauagccuaugagcaccuccaaauuuauuagauauugccaaguugcuccccacagugguuuguucucccacaaaguacagguaagaguuccuggaacuccacaucucacccaugcuuggggcugcagccuuagcacuuuugccccuuugacgggcauccucuuaccuuggcccucucagaugacugcaaacagaaagguggagcagcuacaacaagaauacacggaaaugaaggcucucuuggacgccucagagaccaccucgacaaggaagauaaaggaagaggagaagagggucaacagcaaguuugacaccauuuaucagauucuccucaagaagaagagugagauccagaccuugaaggaggagauugaacagagccugaccaagagggaugaguucgaguuucuggagguaggucgccacaaggcauuguugaauguuuuuuuuuuuuuuuugccugaugucaugcuguugaugauagggcccucaaggagcgggagacuggaagaggucacuggaagcaucccugagacacacgcuguauuaguuuucugagcugggcaacaacuuaccacaaauguaggggcuucaaaaaacacauauuuauucucucagaguuucucuggcucaggaaucuggacauggcuuuauggguggccugcauagggucucaccaggcuacagucugcgagggauggccaggcuguuuccuuuggagcucaggguugucuuccaggcucaugugguuguuggcagaauuuaguuccuuaugguuguaggacugaggccccccgcaauuuccugcuggcugucucucagauugauagcugacuucuucaaggccagcaugagaauuucuccucuagaaagaugcaaucccucuuuuaaggucuuuuaccugauuaagucaggcccaccccagauaauugcccuuugaugaacucaaaaucaauugauuugagaugcuaauuacaccagcaauauuccacccccuuugccacaugacauaaccuaaucacaggagugauauccuauuucauucaccguccugccgauacugaaggggagggcauacuauaggguauguacaucagucggggucgggggcuugagggccaucuuagaacguugccugccacucacacuccaccucuuccucccauccuuccuccagcagcuccuggaaguguguguuaguagucccuuuugcauugcuauaaaggaguaccuaagacugaguuauuuauuuauuuuauguauuuauuuugagauggaguuucacucuuguugcucaggcuggaguguaguggugugaucuugcucacugaaaccucugcccccaggcucaagugauccuccugccucagccuccugaguagcugggauuacaggcgcacgccaccaugcccagcuaauuuuguauuuuuaguagagacgagauuucaccauguuggccaggcuggucucgaacuccugaccucaggugauccacccaccucggccucccaaagugcugagauuacaggugugagccacugcgcccaaccagacugaguaauuuauaaagaaaagagguuuauuuggcucacaguucuacagguuguacaagcauggcaccagcaucuguuuggcuuuuaguuaggccuuuggugaggaaggaagcuuuuacucauggcagaaggugaagcugggagcaggcaugucacaggguuagagagggaacaagagacagaggaggaagugccagccuccguuaaacaaccaguuugugcaagaacucaccuguuaccauggggagggcaccaagcggugcauggggaauccacccccacgacacgaacaccucccacccugccccaccuccaacacugggaaucacauuccaacaugagauuuggaggggacaaacauccagacuguaucaaaguaucugucuaaagcaugggcccccugcuguuucuggccucaugucccuuaacauggccugcaggguccuaggugacugggccccgccugugccagcagucucaucucauaucauccaucccuggcucaugcccuaugcacucacuguuccccagacacagugggugugggugggaugccaugcugggcauucuugccuagugagucguauccuuccagggccuuggaucccauugccaugccguaucgguguucccaagcaugccacacuguuucuacaguaacauugggugauguuguuucagaugugcauuuuuucauggcuguuuugacuguaagcccaucucuuauuacccccauucauccuccugccaaucugaccagcacauagcagagugcuuggcauauaguggugugccccauugauugagugaccugcagcuauaccugaaagacccagauuccuuguucagaucaggggguggggagacagugcaggagugaaugggaaccuugucucugugcacugaggccugaugcgugccuagucuggauggcguuaaguuucaucccaaguguucauuccugucuguuggagcagcugccccgagcucucgaaggaucugagugcacaucuaggcuucuugauacuguacaacccuauuuuucucaaaguuugggacuuccaggaagacccucccuucccauaagauauucccuggcugcaauccacaucccuugagaugucccugucuguuaccagaaugugugauuagagcuguuccccuaggauuggggugguccugaguuuccugugcuuuuccaccuuuagcuggaaaaguggaaagaacauuguccugggggaucggaagaucucagucccagcugugucugugccccuagcugguggaguuccugccaugucuagaccucaguuuccccaucuguaagaugagugaccucugggguccccuccagcuccagauuacugugucuucaagugucauuuaaacuccuggugaccucuggccuguaauuugagaaggccaauuggacuuagcacucuugggcauaggggagagccuccugggguuggugaggacugagcccagguccccguuucaccagagcugccugcacuaacccccuggcauguuccagaaagcaucaaaacugcgaggaaucucaacaaagccagucuacauccccgagguggaacugaaccacaagcugauaaaaggcauccaccagagcaccauagaccucaaaaacgagcugaagcagugcaucgggcggcuccaggagcccacccccaguucaggugaccuuagcagcccccuaugcugcccccuguggaacccugcaacccgauggguccccuaaauguuuugggaugggagauuggggcgugaucccgagcacuggggccugaguuucagggcuccugaaacauccgcccucugucuggaggcugguggggagucugcuucauccugacauuuuaggaucuuuccuaaagcauuuuuggggacuugauguuaaugcuuggacuuucuggacagauaggcucuuuuggccugugaucuugaggccaacuuggauggguuuugaauaagcuagggcuuguuauuguguuuggugggggaauggcccguuugggggagaaaucuagaauuccucuuugacacccccuuuucaucaccccauauccaauccauugccaaauuucacuucuuucaaucuccugacucagucugcugauccuagcacugcuugccuguucuccauugccaucaccugucgccccaugacuguagcagcuuccuaaacccucugcaucugccgcugcagccagagagggauuuucaugaugcagagcucauguccugggaccuauucugcuuugcccucucacuaggcuuccuauuacucccugaugcagaccaaacccuugacccuggucuagaugccaggucaagcccuguuggucucucuccagccccaaggcgccccccacucuccucuggugcaucucucugcauucaguuccucaaauaugcaaaacuuccugcuacagggccuuuguguuugcucuuccccacucuccagaaggcuugaacuccaccgucuucacuaauuaacuccucucacccuucaaagaucagcaaaacauuacauuuauagccagccuccccugccacugcucccacuccucagacugggcccaggguccuugucauccucuugggacucuugcauggguaguaucgcauucuuccuugggauccccguauaucucccucauuagguugugaucucugugaggucaggggcugcggcuuauuuauuuauuuauucaggaucuugcucugucgcccaggccggaaugcaauggcgugauuauaguucacuguaaccucaaacuccugggauuaagugaucccucugccucagccucccgacuagcuaggacuauagauacacaccaucaugcccggcuaauuaaaaaaaaauuuuuuuuuuuuugagacggagucucgcucugucacccaggcuggagugcaauggcccaaucucugcucacugcaaccucugccacccagguucaagcauuucuccugccucagccuccugaguagcugggauuacaggcaugugccaccacaccuggcuaauuuuuguauuuuuaauagagacaugguuucacuacuuuggucaggcuagucuugaacucucgaccucaaguaaucugccugccucagccucccaaaaugcugggauuacaggcgugagccaccgggcccagccuaaaaaauuuuuuuuguagagccagggucucgcuaaguuguccagacugaucuugagcuccuggcuucaagugaugcuccugccuuggccucccaaaucauugggauuacaggcuugagccacugugccuggccugucugauuuuucuucaacgcuauuucccuagugccuagcacagagccuggcccauaguaaaucucuguuguguaguccaagauugggcuugaaucucagcuuggccugccgaguguccuugcagaagggcuucugaaaucgguggcggugcagccccauuguggaagugcugcgugggggcaaagcuauagguggcugguaugugggaggaggggagagaaagaauagugggaaaggaacaaguguugacccagccuccgcuacaugaccuugaucucauucaggagucacaucaaccaugagcaaggugaagucauccccauugugugcucgaagaaaccaaagcucagagaagucucagaggccacagagcugggugcugguggaaaaaagacuuggcccuugcuacauuuuaaaaagucagagaaaaaagggaauacaccaaacugguucuuagaucaccuuguuuguagcucuuguaagcgaugggauggggaaggucggaggaaauggcugucuguguaaacccucugccugcccaccgacccauggcaaagcuggcugcuagggucagugagaggagccgcacacacugagcccuucuucucugacacaggugacccuggagagcaugacccagcguccacacacaaauccacacgcccugugaagaaggucuccaguaaguagccccaccccugucuccauggcaacagcauggcuguggccuccccaggcucuggccaagucacuuccggcccaucccgagucacuguggggccuggaccucagugggaaagaaguugguggcaguccccacugcggggggcuguagggcuguggcagaagcuccgcuguccaucagcauugcacguuugggcugccuggaacagcaagaugccugaggcuggcuuguuuugagaaauauuuacuauacccaaguccuugggcagagccuugggcaaggagacugauggcgguccaggaaggguggaggcuaaaccuccuuggcaucucagcaguguuaagucucuggguuguaaugggcuucugcuauuaccauguuucucaacuguuuuuuuuuuuuugguuucucacuguuacccuccuccugcucauccccagaaccauuugagaaaauuuuuuuccuaauuacaacccaugaaauuuuaauaccacccaucuacugcauaacuguuuauguuugugcuuuuacacauaaaaagaguaaucuuuuuuacucccccucccccaaggauccauuuuugcccuccuagggguacuaucccccucauugggcaggcaccugccauugacauggggguugaggagaagagugguccuguucugcaaauguggacaauagugauaucgaggccacaggaugauucugagugaugaggggacacugauugugagagcucuuuaugagccauauaccacugagauguccauauaccacugagauguccauauaccacugagauguccauauaccgcugacauguccauauaccgcugagauguucauauacugcugacauguccauauaccgcugagauguccauauacugcugacauguccauauaccgcugacauguucauauaucgcugagauguccauauaccgcugacaugcccauauaccgcugacauguucauauaccacugacauguccauauaccacugaaauguuagcugucauugcuucccugaaaaguuggugugaacccaggagggcuggcugcacacugcugguguuggggggaugagagagccagggcuugcucuuuguuguuguugcuugugcuuaguguucaggucaccuguagcaggcagagugugguaucgguccccgaauggaacagagucagggcugggaugccuggugcagauggaggagggagcccuuagcugggccggaaaaccucgaaggguacuuugugugaaaagaggagugaaagaggaaguggaaagguacuguugaccuguguccuuccccagucaccuuccucugaaagcuccucccuuaguaugaaugagguagggaugccggccagcaggcagguguguuccccagugaggugagguccucaugucacagcagaaugacacccuggagaauaaaguucgggaaugaaucaaggcuccucuaggcugaaauggggaaauaggggaggggguauggaguagucccagugcagagagaugucuaaggguaggugaugagggaggugccugugcccuagauugaugucacagccugggccucccaagaugcugguccacagggagugggugggaaaguggcagaaggggaggaaaugggagagugagcgacugugagugaugugacuucgaaguaggagaagcgguagcaagggggcuuuguggugugaugggggucugggggagggagaggguaauaggagagagcagggcuuaucuguaaugucagguguccugcaggugggcagggauaugauuucaaaaacgccccuuuuuguuccaguguuguggaagguggcaaagaaggaagcugggaucuucuagcccacuugaguggacuuuggacucaccuggagggcuuguacaucacagauugcugggucucacccccagccuuuaugauucaguggcucuggcuuggggcccaagaauuugcauuuacuauuuuuuaagagacagagucucgcucuuuugccuaggcuggagugcaguggugcgaacagaacucauugcagccucgaacuccugggcucaagugauccuccuaccuuagccucuugaggaguuaggacuguaggcaugugccacuaagccaggcuaauuaaaacaauuuuuuuuuuuuuguagagacaggauauugauauguuguccaggcugaucuugaacuccuggccucaagcaauccuccuaccucagccucccaaauugcugggauuacaggaguaagcuacagugccugaccaauaauuugcauuucuuagggguucucuggugaugucacugcagcuggcuugggcaccagacuuugagaacgacuauuuuagccaaacucaguuccuguagguagacacuccagauauuuuuaaaagacuuggcaagcauuuuuuuuuuuuuuugagacagggucucauuuuguugcugaggcuggagugcaguggcaagaacacagcucacugcagccucauccuccugggcucaagcaauucuucugccucaccucccaaguagcugggacuacaggugugugccacuaggccuggcuaguuuuuucuuuuuuuuuuuuuuuguaauuuuguagagaugggguuuccccauguugcccaugcuaguuucuaacgcuugagaucaagugguuccugcaccuuggccucccaaauugcugggauuccaggcaugagccaccaugcgcccagcccuuggcaagcauuuuuuuuuuucugauucccuauuugguuuuuguguuuuuuccuuuauggaaauauaauuuaccugcaguaaaucucuuuuuucccugcaguaaaucuuaaaugugcaguuagaucuauuuugacaaaugcauacauguguuaccauuguucaaaucaagauaaagaauuucccuuucuccagaaaauuccuucaugcuccuuauuagucaguccccgcccccacgaccgcucaugcugguuucuaucacuauagauucauuuugccugcugacuccuucuguuuuucaaauuaaaacauccuuuuauuugucugggucaaauucaugcacaugaauguuauuauuuugaaaaugucauuguguugugccuuaaaagaaauuaaaucugaaaacuuucuuuugcagaagaggaaaagaaauccaagaaaccucguaaguuaugcauuucugcaacuguucguuucuugagacugcccgagcacagaacuaaaugcugguagugagagucgaccucucucaucaggguucugugauggguucuauaugauuccauucuguaauggcagcaggccugaggcuggaggggaggacaagcauaagugagaugaauaaggugacuuuagccuugucuguuuuccccuguguuguccugcuguucaggcguguguuuguagaaguggcucuuaaucaguguggaagggaguagaggccaucccguugcucuguaucauauuucccuuuccuuacccccagccccugucccugccuuacccagcaagcuucccacguuuggagccccggaacaguuaguggauuuaaaacaagcuggcuuggaggguaaguuaucaugggcaaggagcuuugggguguccacucugaguuuguucugcaaaucacucucuguuuccucucccagcugcagccaaagccaccagcucacauccgaacucaacaucucucaaggccaaggugcuggagaccuuccuggccaaguccagaccugagcuccuggagugugaguagcuucggggcuggugcgcgguuccacugguucugucucuccugcgccgcucugugcagcucucugugaggccagcuggccggcuauaucagccacuccccuucacuuguccucuacuuuguugcucccuuauuuucucccagucaucagugccuuucuuuacuuuuccuaacuagcucagauuucacaaucgguccuuugacucucccucuugccgucuagucuggcccaauugagcucaccuuucucugugggucggcgccugcauguccucugcagagaaggcagggcgauugcggucaccggccuucaccgggcgucccguugccggcaugccugcccugcaucuccugucuccuccccaccacucuccagagccaccauucccaagacuucccacuggccauagcuccauccuucucccugucccgcccaccuucugcuucacgaaaaagacagacacuguagaaggggcucccccugcucuguuauugacaucgcaucugcaucuacugugcccccuuccucgccuccuggccccuuucccaagacccccuggcccugggcucuggagucugcuccccacacgcucucuggaaucuucugcucucucuuaggccuuuccauucccaucucuucacccucagcaucucuaccuaggcuugccuaucuguagcacguuuacaucucuccaaaucacaaaaacaaaccuagcaaaacugucucagcugcagcucuguuuccugccucccuuucacccgaaugcuuguuaaaaauacaaauuacuagcugggugcgguggcucaugccuguaaucccagcacuuugggagcccgaggcagguggaucaccugaggucaggaguucaagaccagccuggccaacauggcaaaaccccaucucuacuaaaaauacaaaaaauuagccgggcgugguggcacaugccuauaaucccagcuacuugggaggcugaggcacgagaaucacuugaacuugggagguggagguugcagugagccgagauugugccacugcacuccagucugggcaacagagcgagacucugucuuaaaaaacaaacaaacaaacaaaaaaccccaaaaaccaaauuccugggcccuguucuagcccuacaagaucagacucaggcaagcacggaaagcuguauguuuagcucauuuccuccaugauccuuuugaggacaguuggggaaaagcagcucugcagauuuucuacauugguggcucucaacuguggcugcguguuggaauccuggggagcuuuuuaaaauccccgaugcccaggcugucccccagacugguucauucagaauguugguguuuggcugcccaggguugcaauguggggccgaggugggagccugaagucuaauccucgugccacugcauucugaccucuguccugcccuugacccaggcagcucugaggucaucaggguacuccgugucacaaaauccagggacgccuuucagcuuuuauuuagcuucaccugucaguggcauuccuccuccuucugacacucucuccccuugccgcuugagcugcuauaccccccuggguuuccauccaccccuccuuugcaagcucguccaaccuggaaguggguggaguuccguugucaaggccaggccuagggcccucccacuuuccgucuucuuguuucuucugcacccacgugcaacacuccaggcagcaccugccagugguacccacuuccauguggaggccaaagccaaucacugaaaaauauagcccuuccuuuaucauaagcagcugcagcaggcuugguggggaucugugggucccuugcuuuuucagggcuggccuucuuguagcccuccgcugucccugccccccaagagaggcccagaccagcccugggcugcagcuaacucuugcccaagcugcuagcggcggugcugagccacgucuuucaggagcugcugugcacucuguggcagccgcauaaacagggaaaguaaaauucuaucaacuuagggccuuuuccacccccagcuuauucauuuugccuugggggaaacucgggcuccagugaaaagugucaugcccugagccaccuagcaaaugagugccucgcuuggcucccugcugcccaccaguuaaagucuagccuccuaagcccuucccuuucuagccccaacauguuucccuucuccugcugcaucuguguucccagccacccagcuuccccgaucccagcacaugcgaauccccuuggcacuccguggcuucacucucacuguucccucugucuggaacagcuuuucucucucuguucuccucugucuaguucucaucuucuguuacuuggcuccaauuccagccugccagugaaauguuccccaacuguagcaucaguugccuugucucugugucccuacagugugugcuuacccuuuuggcagagugugagucucaugguguuguuacugauggacuugccuugcuuguuggagugugaacuccaugaggcccggcaccuugucucucugguucaugguugugcaucuugugccagaaucuggugucagucaggugccugguaaaugguuuuggauggaugaauggacagacauacggaugacugauagaugauagauggcuggcuggcuggacagaauggauggaugaauggauggauagaugagcugaugaauaauggauggguggauagauggguggauggauaaauggacagauggauagauaaguggauagauuaaugaaugaaugaauggauaaauggaaaggcagaaggauggauagauaaguggauagauggaugaauggaagaauggauagauagguagauagauggguauauggauacauggguagauggauagauggauggauggauacauggauggauugauggauacauggauagacagauagauggaugaauagacagacagauggauagaugaguggauggauggaccaauggguagaugggugcauggauggauaaaacuagugaauaaauaguaccacuuuggcaaaggucuaaaagagcacuuugggccccuuguaauuaauuccuuggggugauguuuucucagauuacauuaaagucauccuggacuacaacaccgcccacaacaaaguggcucugucagagugcuauacaguagcuucuguggcugagaugccucagaacuaccggccgcauccccagagguucacauacugcucucaggugcugggccugcacugcuacaagaaggggauccacuacugggagguggagcugcagaagaacaacuucugugggguaggcaucugcuacggaagcaugaaccggcagggcccagaaagcaggcucggccgcaacagcgccuccuggugcguggagugguucaacaccaagaucucugccuggcacaauaacguggagaaaacccugcccuccaccaaggccacgcgggugggcgugcuucucaacugugaccacggcuuugucaucuucuucgcuguugccgacaagguccaccugauguauaaguucaggguggacuuuacugaggcuuuguacccggcuuucuggguauuuucugcuggugccacacucuccaucugcucccccaaguaggcaggcuguaggcacuugggcugacugccugcagaagucccaagacccuagugaaaauacagcaggcagaacucuccuuggauaauuccccaagaggucccaaggauugggagcaugggaggggagcuggcgggagggugggaggugggauuuagccaggaaaggggugagagugauuguguugugggcgaggaggcguuuccacccccuggugccuaucagggcagggugaccuacuccccauuguucuggaaaucuccaggcugcugggcagcugggcagagcucugggaagugaagucaugagugcccgauuccucuuagagaaaauccauagcuacuguagguucugucuugggccacuuggaucugaaggcugccccuuugcucucugggguagccuucagaucuugguguuuugaauucuuacuauagauguuuuuaaaguuccaaagucauugaguuucaauguuacauaaacuccauuacccgcauguuggggcuugaucuccugguuauuaucugugcuugaggaaacacccacagcagucucuacccagaacaguuuccuaaagaggcauacccucuuccuccacuggaaaauagugcguucccuuccuacccugcacacccaucgcccccacauugaugguuuucaaacagcaaacuuuucagcuaaagcuucaaaccaugauuggaaucagccuguguuggauuugugauucagggucauggugacccugauccaguuuggguggaaauccuuccuaaguaucauaagaagcaucuuggcagagaugcuuugguggcagccaugagcuuugcuggaggccuugcuucccauagccuuggcuguggggcaaggaacucugccaggcgagggggaugcugcccuggaucaacagaagccugguggguuugcucguguuagaguguccugccuucuuacugacaacucuucucggugauagccucucuucccuggauugugacauauggaaugacagugcagguaccaccgaggcuagcacagucaagccuccagcuaagcuggaucccugaagccugcuaucaugcagacaggcuaugcggcugccucggaccaugcuaggccacuugcuggggugucaaccuaccaccaaaggggucuuuuagcaaaccucauggggaacaggaacauuccuguucaucccuggccacaggcugcagacccagcacuggcccuugcgugagucagagccuggggcuggcccuagccccuucuacugacuuccucauuuaagccaauuauauaagcucacauugaucagggagggagggaaagagcuaaagagggucacacaaguggcuauuuucccugcaguguuucuguguggugaaaauaacccaguccacuaaggggcgggagugaauggauggcuggauuuuccccaagcuccuuauagccuaauguugucaggaugugaguaugaggaauuuagccucuuauagugaaaugaguccaacucugggcuuugcuuagaggagagcuccugucaggcuuccuauaauaugaaaagaagucaccauuggggaacuagagaccccagaccuuuucauauggauauuugagaauguaaugcaucucaggccucgugcuggaacucuagggcacucuaggcaggcucagaacacuugauauuccugacagcuacacaccugacaugcagguacauaccugaucggugucaucuccuaacaaggauuuucaguuccucgggagagcaauaaucuuuguaggaaagacaucccugcaauaggugauaugugguccuuagaaguuuuauuccuuuacuacuuggaagaaaaguucuuuggugauucuucucugcuuuugaagaugaucaaaagcaucuucauugauuuucugaaacgaaagccuugucugaaaccaauuaauacuugggaaacagcugggcuuggaggaguagaaugccagagauaaauccauggcuccugcucuggcucucuucugcagaaaugagggcaacagugaggccacuucccuggcaaaugugcagcucaggauagggaagcauaagacccucuguuuaaaagagagucaaguagguaaccaaagccaagcucugugcaaggugcuuuggaguuguaaauugaggagugcauccuugcugucuugaaccauucuguuugcaauggugagaccuuacauaaccuagccuugcagggccgccacacaacccuggaguccuagaguuggaggaaccuuuguauccaucugacuucucauuuugcagaauaugaugagaaaguagaggaucgcucuguucaccacucuugcuauuccauuaguggggagaugccugcuagcaugugugaggggaacacucugauacacugggaaguaucggaaauucccagaaacacaaacauaaaauaacucuccuagacccagguacuggggacugucucaguccguguggcaugauaaauaaaagguuaggaucaagucuuuguauuuuucaagaugugguagcugauuauuccuguuuuaaguacucugaaauugaucugugaucaauaauacuaauauguuaucuuuuaccguauucugccucucacuauugauuuuaauuaguuaggaguauuugagcuguuauuucuugagcuuaauauuuuuuuagaguuaacucuuuaaggagauaaucauggcuguagacaaggccagggcuggcugacgugccuuagaagguuugaaugcaauaaagcgguguuuggcguucuccugcauuguagugcggguacaaaaugcuauuuguucgucauacuguugucagcagaugagccgcccacuacagacggcuacugcccagggaccugcccaggccccacccaagggcucccaaggguugagauuucugcagaccuauagccagcacacuuaguccugcccuauauagaguuccucuucgggaagcuuuugauaaggaauucucagaccgauaggaugucugucugggcuuugcugcgggacagucuaacugugggggcuaggggaaagcaggagaguaucgaucaaagaguaagccacacacggauaaucaguuacuagggauggaggugugaggguucauuauauuauucauuuuacuguuguauauguuugaaaaugucuauaauaaaaagcuuuaaaaaaaaaaaagaaacaaaaauaguucaggccagcaaugggcccuccauguucaguggauuuuauccuuguuucaauugggguaggaguuccaggagguguggauuggagguugucuaaagaauugaacuggccuuugucccugcuuccugggagggagacuuucaguccuugacauuuccaggguaauaggagugucuuuguuauuugugaggccaugggaucacaccugagcuuaugcuaaaaggugggaugacucagagcuggggcuggucaccagacagacugaccaugugauuagagguuugaggcuuugagucagccugaccuauggggcgggggacuggaggcugaguuuaaucaucuggccagugcuuuaaucaguacaucaugaaacccuaauaaaaacucuggacacuaaagcucagcauagcuuccuggguggugaagcuguggcuaugccggcagggcagugugcccuaauuccacgaagagggggcaugggagcacugugcucaagacccuuccagaccuuucccugugucuuccuuggcuuguggagcugauuuguauccuuuauaauaaaacuaaucauaagu

SEQ ID NO: 16757 - RNA, 6058 nt, Homo sapiens
auaacuauagcagaaacaaccauuuaagaaguuuuagcagcaauaaguauuuauuauucugaaugaaauguacaguugacuuuuauauaaaaaucaucaaaagugcuauauuggauuauuuuacuauuaauuuaacccccaacagcaucuauuagcuauaacuuuaauggguuuuucuuuacuucugauacaucauuacaacuggcuaacacuguccaauguuaaaauauaaaaaauauuacuuuucaagauaaaguaccaccagugaugaguuauuaaaaguauaaaaugaaaacagacgccagugaaucaauguauugaaaaaaauuaucacagaauuucauagacauaugcgaaacccaagguaauuuagauccuuggcagaacauuuuuaugauacaucuuaagacuguagguuauuucuuuuggaggcaaaugucuagugugccaggccuaucuugauuuuucucaucuuuucuuggcuacuuuacagggugaaccaaauacugucuaaugcugugcacucccaugacccccaaaguguuucauguaaauagaaagcugauuuuucagucucagaaguagcccuuaggguuaaguuugucguuaaagaagacaugagucauuccucacaaaggagaagccccuccacccucccacccccauucuuccagucugcuccaacgccaagucuguucucucccaccaugguucugggugaauugggugacaaagucagagcacguuuuccaggcccaauggcccauuuggucguauucagucucaagcaaacaagcuucucugauuugccacgagagcuguuugacucucccgucucuuggcuuucuugcuccuuugucucacuuuccagcacaaggcacuggaggcuaguaaaaaaaguccagaugacagaacaaccaggccaaagauggagauaauagacccaugggaauugaagcuguaagccaccgcggugaccacgaugccggcgaugaagacaaccacagcaaaggggaugaugcagcgguagcaggagagcucgguacccccuguagcagccaucaacugaaucucacugaccagagggacuguggugaucacaacuucacucuuggggcucuucuccaucgucgcugccaugugagccuuuggggcucccaggaucuccuugaugggcucuucagucauuuuuacaacagugcuucuaagcuggguuuacagacuagaucuggacagucucaccagggugaaagcugugaagauaacaggagaugucagcuacauguaucagaauguacacccuguaagcagaaaugaaaagcuggggaggcaccuccuuucuaggaggcacagauccaugugaaaagcaacuuuacucuuuuuuugaauugguugcauucucuuugcauuuaggcaaaaaauaagaugaagcagaugcauaugaagggaagacagaaaaagcaggaagcacuuacaguguuuaauauacccuggcggucuacaaaaguuuuacaagcuuuucugcuuugucuauugcuucuccuuccucugaauacacagaaaugccugaauccuaauccaaagauggucucauucaagaggagaauacauuacaaacaauauuucguaccauuaaucccagaacuuacagcaacucagacuccgccaaucuugcugggcauaacaugcauucuuugcaaacuaucacccauuggcugcccacaaaaucaaugucaaggcaaguggccagcaacaaaugauguucuucuccauugaaugacagccaacaaaucuuuauuguguuacuauuaaacacagugcaaccugcucccugggaucuuuuuauuacccacuuuagguggacaguucagcaaaaaauucauugaaaaugagguggggauuuguggucugaaguguaacaauaucuuccaaucugcuauaaaagagaaaaaauaagaaaaaaaaauucaaccccuucauaggauauaauuuugugcuuucucuuggcaaaauaaaaucaauuauuugaguaauuagcugucaauucacaaauuuucuauuaagcucaacacaaaauuucgauauuauguauacuacaacaugcagaaacaaauaagcaugcuagguuuucaggaaacuuucacaaccuucauuuuccuccaugccuuuguguauaaaacuugcugcaaugacccuuucuaaguauuucguaccugaacauuucaggacaaagcuugagacuuuugaucaaaaguaucugguugaaaugcugucuaugagaaaucagugaaaacuugucugcugcucagacaugguugagucacugucuuccauucucaaaaagcugucuagcugcuacacaguugagcaguuguaguuaccgaacaaguuuaaagaaagauacuugagaccauuucaaugagauucauacuuuaaauauauuaagcauccacugaaaacaaauucaacuccaaaucaaaccucacugguucuucccugcucuggaaagucaaaauaucacucccugagcaaugaaacuaaaucuuagagcugccuacucacaugucauuuuuaaucaccaaacuaauuaaucacuguuguccaaugacacccuaacuucuggugaggccaguuaaaagauauuugagauuaugucugaaaaaaauaacuucaccccaaagcugagauugagcuaaccugaaaaucaagaucuguccccaaauuacuuacacucaccucggagagaggcaauccauuaccagaguaaccacuugacuuggaagacaagaaacagcaacgccugagccucuucguccaacuucugggaaagagccucuaacagcaaggcugucaauaaaacaauagguuagggaucucuucuggggaaaggaaaagauguaaaaauacuuuacuauagggucugcucugguuugggauccuggaguuccugcuucuuucaggcuaccucuguuccuaaaugacgcuugucuuucccucccucucucuuuuuauucccucccccucggguuugccccucccuaacauuuuuuuuuuuccuucguucuuuuccuugccagcagauucugaguuuuggcuucccccagcuuugcucagugacaugaugaguccgaaucauuucuacagauuccccagagacaggagccagcuuuuacuuuuucucuugcagcauuuacuaagcggacugcuuugugaauuugaaugacucauuuuuucccccgccgaccuccagaucuuccucccguccaucaggcauuuuuauaagaaaaucccagagucagcguugcagacccggcugaggggacagagccgaggggacagauacucuaggguggcagaaacagcugugaagucaucaggcagcugaauucagucucuaagccagcaaaaauccauguuccuagguuuuccauuauucuuuauaugugcgugauagucaucugaagcuuaaaaccccacuuguugaguguuaauucauuuaggaaugagggugggaggcacaaauguuugugguuaagggggaaagccaguuauauugauuuaaacaugauuguuuacugcuuuugcaaggagguaacuuuagcagcaccaagauuaucaucaucaugauaauugcuaccauuuauagagcaccuacuguggacauggcacaauauuaagaaaugucacauauuaauguuaauucucacuaguucauaaaugaggaaacaggcucagagagguuaaguaauuuaacaaagaucacccaguaacagagacacccuugguuugaacccuaaucuuuaauggauauauauaucauuuggggagauuguuaaauuuagauucugauucaguaagucuguaacaagcucccuaccuauguugagaccucuguuccuuggcccacuuuaaggaucaagguauuuuaaacauucaaacauauacaacuugacacaucauacuuaaacaauaaaguuaaacaucuauuucccaccccauaaaccuguaagugacuuuauagguuuaugcuuucuuacagacaaacugugaaauuuuuaaaaccuugaaacauauaaagcccaagauugucuuuuugaggagaaaagauaauacugggagcucauccuacacucuguaguuaaaaguuuacauccuccauuuuuucaucugcacaaguguuaauaaccucuucuaauuaauacugugaaccacaaauccaaauuaacucuuggaagagauuuguuuuccaucuuucucucaaauuguuagauuucucuaauagcuggcaaagggcuuggauguucucaaacaucucgccucuccucuaccacagcacacucucuccagccuugccuuguagcaauacccugaugacuugucacaaaaagagagggaccagaaguuguuuauucuggaaugaaagccagagagaggguuauguccuuauaaaaaauaaaguugaaaagucccugagguugggggagucauggcaaguaccuggaggccuuggucaccaugauccucacacuuuaaaaaugucagaccuaaagagacagcuuucauaucugaggaguaccgucacuugguguugagggucaggaauacuuagaaccagggcauuucagaacuugccaaaguugcccccggaagaugguaagaugggggccgcuggcuacguacaauggagguucuugagaagcuccuuaacagagcugucuucucaccugcaaacucuggcccuugagggcaauuccccucuauuuucuaguaccacuuugccugcaagauagcccaauaacugcacugaagcucugaauaucaccuuauucuguugaaaagcaugcuuuccuguuaccaaagcuaaaggugcaaacauugaacgucuagagagaggacaauggcagcuuuuuucauaguaagcccuugacugagucuauaaugaggcgcagugagugugucuguguccuaggagcacaaaucugucaucacuuccaauaccaaagcuuucuucaaccuugucaggcucaggugccucauucacaccaaugcuccuccacagggugugugcaccugccuugauacacagguacacaucucuagacucugaguagacaaccaaugauuuguauuuuaaauucaaagagguagaaaguuuugguauaaagcagacauuguaucagaagaauagaagccugucauccuaaccacugacacaugcagcuuuaacugacuuuaccucuucaaauugaaauucaaagagaauuccuagugaucuaugccuguuguuucugaauguuuauuccuccuuccacucugugucuacaaaguauuaaacaccccugggcauccuuuggggacaccugcccccaaaugcaaaauuucauccacaaugcaaccagccuuauuucugcgagcccucuauuuucacaaagaagaggaaaucucucuaguucuuucuaaagcacauggcuuuaggagacuccuuuaaguuuggagaacuuuucucaaagccuccaaugcaugaauuauaucuaugccccuaacccccauagacauucaacauuuccuucccagaucuuucaaaaagcaaagcaaagauccuuaccuuucccagccagaguuagacugagacagcugccugcccugccaagagcaacccagacagggggaugcaaaucaccacauuagggaccguaaacaaaguacucagcaaggcuuaaacacaauuaagggaccggagacaauuuggcaagaggaaaucccuuaaaugcugcuggauuuuacucuguuguccuccaugaaaauguaacccauauauauguguguguguguguguguguguguguguguguguguguguguguguguauacagacagagacagagagaaagggcaucaaguuugagaagaauaucuuccuucacuuuucucuuuuuauaucuuuauucaggcacuaauuugcaagguuuuuccuauccaaagcccccauucugaugcucucccucugugaaucagaaccugcagaaaagaauucguaaucuuugcucuacauuucua

SEQ ID NO: 16758 - RNA, 3332 nt, Homo sapiens
cauguccgaugccucgcugccuuggaggucuccccgcucgcgugucucuucucuucgcaccagcggcggaaaccgcacuagcagcggcggcggcggcggcggcggcagcagccaccugaagccaccaacacugggcucuuccagcaaaaacgagaccccgauucgucuggcgccccaagaagacauagacgauagccccccgccgggcugcgccgugcaauuccgggcucccgggagcgcguagcucgcuggcuaagcccaggcaguccgcggcaaguugcccucgaaguccgccccccucaccggggcauggucggaggguggcugcugcgcuccggggcaguucuucuccugcuuccggggggcggggaaggagcagacacagcagacacacagagaaagagaggcagggauuauugcccgaaaccgccagccgccggcagccuccgccgacccucccugcuccccagguccgcgcgcagccugcagccucucagccggguuccggcagugcguccagggcgccgaggggaagggcugggccccggggacuggggcgcggugggggcacacagacucuccaggucgcgcgcgcccuuccugcuccucugcuauuuuccugaacuccccagaacccccaguugccuggcuuccaucgcccgcaacuagcgccgcugucgagauuuuccgcaauacaacugcaggggucguuauuuccucgccuacggaucccuacgcuucccaacucagagaggaggaggacaggugggggcgggagggggaggaggagaaggaggcuuggccaggugagcguccucgccgccgccgggcgucccagcgucagcuccgcagcccggcacccgggggcggaggcaggaggcccgggcggggaggugaggcugagcgcggccaugaggaggaggaggaggaggcugggugucacagcuucaggccaccuuggccgccgccucggccccagucccuggcagccgccuccgcacuccgccccgcccuggcugccucuguuacccuccaggauuuucgaguuucucuucuuaaaaagaacuucgugcugcggguucggcgcgggagacccaggcaggacucauccugggagugcugugcugugcucucccuccgcugcgaaauauuggagauuuuuuugcauaauucauucccugcccucuccauuucgucccucucaugccccccacccuuuaccccuuuccgugccagugccagaacacuacuuaccccagaguucuuuucucugcagguuccuagaccaggugcaacucuugccugcaagucccugccucccuccucccgaaaagggggaacaccgccuuuccaaguccgggugccagcagcggcugcugccaacugcgccuucgcccaacuccaggaggauccgggacuauuggaaacccgggcuuuagaggaacgggcuucccuucuugucuuucuuuuauucugcuuuucuuuagggaagcucuagugcuuuggaggcuuuugcugggcuccaggauacuuuccgccaacgacacucagcagcuuccacugaaggagauuuccccaccaaacccgcgcgcgcacacacacacacacccagcgcgcggcucuccagggccccaggggaaaguaggggcggcgcgagcaccacccacccacccaggccgaggccaggggcagccaguccgcagaaggucucguggggaggcgggcugucuauaaccuaggaaagacuugcacccgguugcaguguggaugcaggggaauugaagaaaacccugugcucagaacugcuugccuaagagggcugggaacgaaaggggaaagacaaaaucucaacagauuugucugcuuccaucgcugcaguggugguuugcgaaagcucaaaccuaccucuuugggguuauugaagaagaggagggagcguagagggaaucccugggaagauccaggauuucucggcgcgcuugucccgauugggaacugugacguuaggagauuuugcacaagcgcggaugaacacacacauaacaaacacaaacacacacauaccccgcggggauuuuuuauccacuuuuaauauuugauguuuagaagcuauuucaguauaaaccucggucuaagaacugcacaaaggguagauaaguggagauggaggaggggaaggaaagggugcccguucauccgcacagagucaaucuagugaaucuucccguguugaucccagcacccaggcugugcgacaucugagggugcggagugggagcuaaaggaguuacauuacagugcucccaggguucuugaagggacuccaacugcccaggagucuggcgggucuuuuugcugaguggcggggagaagagggaggaaaaagagagaacgcagagcagaucagcagcucucugagcugucugggcugggcggcugcgggagccagagcuacguagucccaccgacucuagggauucgaaaaaggaaccgccgacagaccugccuacucuuaaagaaggagauguggccgugagaucuguucugugaaacaaaggccaaggacucuagguggucaacacauuaaaaaucuaggcccagaugaaauaaauccagcauucuuauguagagagcuuccaggcucagcagggaaaagcaugaaacuucagaacauuaaaagaauuccggauagugagaauuagcccauuugggaaauauaugggggcauuugucuccgugccuugaaaguagacugcaugaagaauuauuauuauuuuuucuuucuuucuuucuuucuuucuuucuuucuuucuuucuuucuuucuuucucucuuuuuucuuuuuucuuuuucuuuuuuugaggagagagggagaaagaaaaaaaaaaaagcagucugacaaagaugagcagauuccagccuggugagaguucagaaccguggacagcgaccuaccaucccugcuuggguggggagauaggcuggcagaagaggucucuccucuggaagcagaagcauggugccugaauuuuuaugucacuacccacucauuuacuaaugaauucugcaauuauuaagugucuuauaugugucaaacacuguggcaagaugcuugggcuuuguaauugaaaaugcauuauccuugcuuucaaaaaaaucugcagaccauauaucccucuauauucugcuuuaagagccaaugccaguaaaauaauacuuuauuuccacccuuucagucugcauacucaccuccagcauucccaaagaauauuuaaucugugaucugccacuaagugcuuucaguuuuuaaaaaaggcaacucacaugacagua

SEQ ID NO: 16759 - RNA, 495 nt, Homo sapiens
uuuccuuuuuuuuuucuguuuaauuuuuaaugaccaaaacgaagcaucuaaaaccgcagcuucuggaagaaccgcuuguucuugccugucuuguaucucucuucaaacuugaccuuggccucucaucgggccuuguguuuaagaguagggucucugaagacauccuuauugaugacaguuuuguccaaggggauauccacagaguaccuugugggcauuagcugauugugguuauaaacuuucacaaaagacuugaucuuugaccucuuagagaucuucuucuugcccauggcagcugucacuuuguggggacagcggucaauuccagccaccagagcauggcuguaggggcgaucuaagguaccaucaucaauguucuucacgaugauggcuuugcauccagaauagcauccagccagaacaagcaccaccgucccagguuucaugaacuugcccauuucagcagcaaccccucgggccuauagcaaaaaggaa

SEQ ID NO: 16760 - RNA, 5208 nt, Homo sapiens
gcuuacacacauccucuugcuguuuugauuuauauuaaaguuaguuccagugcccaagugccugggguggcagguggccagguggccagcuggccagggauuaggaaauacugaauugucuuuauuuuaaaaccuuggccaaugccagggaauauaaagggaagugaaugaagugggaagcaaaucauauugaugauuuucuuacaucucuauaaaaugaucuaucguguuuccuugauuauaugacacauaauugauguacaaagacaggguuuuuuuugguggaaagaaaaugcauacauuugcaggcacauuguguguauacaucaacuaugagacacauuuguacucagugcaguggcucaugcugguaaucccagcaauuugggaggccuggguuagaggaucgcuugaauccaggaguuagagaccagcugggcaacacagugagacccccaucucuccccagcaaaaaaaguuuuuuuaaaugccagacaugguggugcgugcuuguagucccagcuacuugggaggcugagugggaggaucgcuucaacucagaaggcugaggcuacagugagccaugauggugucauugcacuccugccugggcaacagagugagacccuaucucaaaacaaacaaaugcaccuuuacaguuuagaaauuugaaacuguguaucucagaggcaaggaaaaggauuuucuaugaacgaugauuggaggguagaaugugaaaauacaauauaaugauguucauggguuauggauuaucuuuuggucuuugaggguucuuguaauagauauuaacaugaaguuugcauaaugauuaaaaaauacaguuuacaaagagaaagaaauuucauuagccacaagagccacaaagucugcugggguagaauaucauaagauaccuguggccuuuaggagaucugcuauaaaaugguccuaauucuuagggcuugaacuuagucccugugcaaccucggguaagucacuugcugagccucaguuucuucauuugcaaaauggaaaucaugaucaucuaccuggccugguuccuguuuaguuagagaaucaaaugcagggauuauugaagggaagaacagguggaaaccuuaaucugcuuagccuggggagaggauguuucugggacuccaccugccccagaaucccaaacccacagccuuguagcagaugaucucugcaaacacagggcauagcugacgcccucugcuuccagagaggccucuaccuuauuuucuggcaaaaccucaaugcccuggacuguugccaaaaucucagauccacuggugccugaagauggauucuggggagcacagcuggucagucagcacaggacacacagaugccuagugcgaccuggacacagccaaagggccugagcuucccaccacuggggucucucucuuuggaggaaaucauuccacagaaaggcccugauaaaaaugcaaagguguuauuuuaguaagaucaaugcuaaaauuuagaacagagaucgcagcccacagauggacuucuuuuggccuucacaguuuuuaaauuuuuuauucuuuuuaauguuugaguuucccacaaagcuaucauccuuuugguuucuguggcugcagcuugggcucugguaggacuggacguggcacuuccaacaggggcugccugggccccagggcacagagagaccuucgggagccagauaucaagagugguucuggcugccucagccauggacauccugcugcagccugugugggggaauucaggagcagagagugcuucccacccagaucguaaaggagaggauacuuuacaacucugcaguguggagaggauuuccaaccccauaagggagcacggccagcuugugcauuuauccacaugcccaacaauguuuacugaguguuuccuccucuguggccugugggccagucaucacauuuaauucccccaacagccugugcaagaggcauuauuguuccacauuggggucccucuccuugagacaaccagcacccccaucucuucuccucugcuucccagccuggcugggccggggaggagguuauaaggcccaugguggauguuacccauucauugccuucugguccugugguuguuauggacucuggcuggggucagagucuccaggggcccccugggcccaggcucuccacccaggcagccucacccagccugcacagguggggccaggcaauuuaucgacugaucugggugugccccuguagggaggagaaggcauggaccagcugaccucugccccauccuccagacccagaggcuguagacaacgagcuuuccuuaagaggcucucaacaaauacucaggcuugccagggcuccucugcuuauaaaaauuccaucuuacagcauagaaaguuuggaaagcgcagcaaauguauauaaaagucaccuaaaaggccaccagcuagcgaugaccauugucagcauucaggaguaugccuccucuucaucccaaagucaaacaugaacuacgacuagguugugacuagguuguacucuucuacaauggggacacaggggucacaguuauuccauuguuugucuuuuauuaauucuccuccauccuuggcuuguuuggggacuuuaaaaaaaaaaccgcuuccuauuacauagcacagacuucaggaaauacuuguucaaugaagggacaggcagggccuggucauguugggacuggaacccuggcuggcuuuaggugugcccagcacaagcugaaccccaacaccauucaccauccaaccauuccuggcaucccuggcaugagguuaguucucaccagcucucaguggaggucacuaguguuuguugaccuuaguaagggagauucacagcugggcauggugccuguaaccccaacacuuugggagaccaaggcaggaggaucacucaagccuaaggguuggagacgagccugggaaacauaggaagacccucucucuacaaaaaaauuuacagauuagcugggccugguggugggcacuuguggucccagcugcuugggaggcugagguaggaggaucgcuugagcccgggaggcugaggcugcagugagcugugauggugccacagcacuccagcccaagugacugagcgggacccugucucaaaaaaaaucaaucaauaaauaaaugagaaauaaaggagaugcagguggagagggaggggccuggauccuggggcuguggcaucaggcagagucucagcuucagagucagcgggcaaaauagggccccggggcugaaggguaggguuccuuccccuugagcccucagagagguuguuaagaaagagagaggccaagcgcaguggcucacaccuguaaucccagcacuuugggaggcugaggcaggcagaucaccugaggucaggaauuugagacgagccuggccaacauggugaaacccugucugaacuaaaaauacaaaaacuaucuaucugagugugguugugcacaccugcaaccccaacuacuagggaggccgaggcaggagaaucacuugaaccugggaggcagagguugcagugagcagagauugugccacugggcuucaggcugggcaacagagcaagacucaaaaaaaagaaaagaaaagaaagaaagaaagagagagacaguucuuaaggaaucaggcuucagagaaagcagaaguguggaggacggacacaggaaggcugucgguuguaagaggaggcucugcaacaucgccagcaaaggcgaccgaauuucucuucccggaaacuuccaagaagggggcaucuccguggacugggucagagaccaccuaucccugggcgaggggaggaagcagaggcuucaggagcucuuucagggagcacggaggccagggcagccugcaggacagaggaggguguggcuggagggccgagguggcuggaggacaggagagacuuuggccagggcauugguuuuccuuacuaggcugggcaggcuuucuaagccucugcaggcagccaguuuggggaggggccugggcuuggagauucucgcuuggcucaauccccucuuagauccgggagcucgugggaggcuucggacagagcuggcccacucugcaaagguacuuuaggauucuuccuggaaaaccagcaagaggaggaagcgaacacugccaggccacaggcccagcuuggauggcgaggaggcuacagcguuagaaucuggacucagccacaucuaugccgagugaccgugggcaagcagagauuuaaccucucugaguuucagcgucuuccucugggaaaugaggauuuuuuuaaaaaaccacacaaaaaauuuucuucuguccccuucucccacucaagguugcugugaggauuauaaugcaagagcaaauaagcagaagggggcugggugcaguggcucacgccuguaaucccagcacuuugggaggcugaggcaggcggaucauuugaggucaggaguuagagaccagccuggccaacauggugaaacccugucucuacuaaaaauacaaaaauuagccaggcaugguggcacacaccuguagucccagcuacucgggaggcugaggcaggagaauugcuugaacccgggaggcagagguugcagugagcugagaucgcgcuucugcacuccagccuggggaacagagugagacucugucggaaaaaaaaagaaagaaagaaagaaagaaaauaggcagaagggccugccuggcauagcuaggugcucaauaaauguuauucuucccugaagguguccucggaauugguggcauacgcgaauugccuuggggguuuguuuaaacugcugacuccucuccaccccggcccagcaggucugccuuuuucacaacacccaggcccaggugauucuuaggcagcaggaccccaaaauagcaccaaagacgccaaaaggcuguugccagauggggguccuaagcagguguguggguaacccccugcccaccgacucucacgccuuaggccaccagccugcagccccucccucccacaagcaccgugggcccuguugugagcugccaguugcaguguggguuuuugucugccuuccccaccccaugccaacccgcccagcaggccccacugccuuggcaacgcauugcaaaguccacacaaagggaaacugcgcuggggaggcuggucc

SEQ ID NO: 16761 - RNA, 4144 nt, Homo sapiens
cggcagaaggagcgaagcucuggcccggcguguagcgggcgcacuacggggacgcugggccgggcaccgggcuguguggagaagugagcgcgcucgucugacccccgugcccgccaccccgagccacuaacggcgaucucccaaggccugcccgaggccucuguccucuguccucagccccgcagcggcaacgucuugcacucggcgagcucgccgcucccgacccucccgcgcccccgcccugccgcgcugcuccccgcccagccgcgggucugugguccaagccgccccgaagcagcccguaaguaucucggggcgccgggcggggucggcgaggagacgggagccccgggcccaggcggcggaggaggggcugcagcggcgucgagcccugggcccucgggagcucggggacggcggggucgcggcccugggcgccgagggggcagcgccaggacccgaggggagcggcuccgaggggccgccggcgcgucgggcucguccugggcaguuggccggggacgggcggcccggggcgagcugacgggaauugggggguuggggugcccggaggagcgacgagcucgcgguggaacgcugggguucgaggggccgguggccgcgaggcugaaaauggugccgaggaaccggugcucccccaggcucuggccggcucccaggagcccggggcgggggccacggggcggggagcagcgggucggguuacggcgggggaggggagcggcugacccggcgccccgaccugcucggugcugggugcccagccgggagagguugcucuuccauuucccgggccuuccuccuccuucuccgaggaggcucguacucucuuccuccuccaccuccaccuccucuugcuguugcugcugcuguagcgcuugggcuccgagggcugugagcagaaaucuaaugagaucuaacuggcuguuuauguaauucuucacacuccugccugucuuaaggcguugcuuuguaacuaccuuccaccgagccugaauuucgcucggcugcaccuucaagcaauugggcuuaaucagcugccucugccggcacucaggcuuuugacuuggaaaguguuuguaguuugggggcagccagagauucuuuuucccuuugucaccacgaauauggaaaauagaacagacgaauuaagaccaacuugauuuuuaaacguacuuuuaaaucaacuucagugugcaaauagaucccuuucgcaaauaucuucuguuugcccuugaucuuuucuuauccccacccagugcugauccagcaaacguuuaaaggucgaccuuaccauacuugccucuccggcuguuaccgugagagggagggagggagagagggacagacggagguuuuuuaaaaucagacuaaaacucagaaacccuggccuuaaacagaauaaucaauaguuuuaauuugugucuuugcuuuuguuauacuugcugccgaauagguauuuucagauuuagaaaaauacacauugaaaacaaaaggcccagagaagcuggauuuuauuauauuguaugcucuuaguauacuuaaggccgaaacuauauagaauaauuugguucauaauuauuuacuaggaugaaguucauuuaguacucagugucuuuaauuuuagcaucauguacuauggaaauuaaaaugaucuuccuaacguaaccaaauuuuuaaaugucagugacagagcagauuuaaacaguauauauccaaaguaaacuaaaacauggauucacuucuaaguuggugaauaacaauaaaaauuacuaccuaaaaguggcaucuauauauauggggguggggggaggaugcugaguacaauaaauauucuugugagaacugaggagagaagaaugcauguucuagagauuuuucuucuuagaacucuauucagaaacagguuuuuaaaagcauuauuucauuuguaaaucuacauuuuccugugucauuuuaaacuuuaauaaacgauuuucuauuuuauguuuauuuugugcuaguaacaguuuucaggcuuucuguccuaguagacauuuucuuuuucuuuuuauccuuagcagacuaacacaggaucuuagacauuuugaaaggugaaauuacuuuggaggggggaaggucaugggacuuauauuacauuuaucuuauuuggauauguuugcuuuuguuuuaaggaacaagaucacucaaggugaaggauaaucuacuaauaccagcacuuugaaugaaaauuuguuucucugccacaaacugaacaucuuuuuuuuuuuuuuuuuuuuuuggugggggaguugaaaccuaauuuuguggcguagcagcuaugcagcuugaaauccaaguagcacuaaauuuuauuauuucguauuuguacaauaagcuucccaggagacgugucaacauuuuuggugaagaacuugaaagacuucuuaagaagaaauaugaagggcacugguauccugaaaagccauacaaaggaucgggguuuagauguauacacauaggggagaaaguggacccagugauugaacaagcauccaaagagagugguuuggacauugaugauguucguggcaaucugccacaggaucuuaguguuuggaucgacccauuugagguuucuuaccaaauuggugaaaagggaccagugaaggugcuuuacguggaugauaauaaugaaaauggaugugaguuggauaaggagaucaaaaacagcuuuaacccagaggcccagguuuuuaugcccauaagugacccagccucaucaguguccagcucuccaucgccuccuuuuggucacucugcugcuguaagcccuaccuucaugccccgguccacucagccuuuaaccuuuaccacugccacuuuugcugccaccaaguucggcucuaccaaaaugaagaauaguggccguagcaacaagguugcacguacuucucccaucaaccucggcuugaaugugaaugaccucuugaagcagaaagccaucucuuccucaaugcacucucuguaugggcuuggcuuggguagccagcagcagccacagcaacagcagcagccagcccagccgccaccgccaccaccaccaccacagcagcaacaacagcagaaaaccucugcucuuucuccuaaugccaaggaauuuauuuuuccuaauaugcagggucaagguaguaguaccaauggaauguucccaggugacagcccccuuaaccucaguccucuccaguacaguaaugccuuugauguguuugcagccuauggaggccucaaugagaaaucuuuuguagauggcuugaauuuuagcuuaaauaacaugcaguauucuaaccagcaauuccagccuguuauggcuaacuaaaaaaaagaaaauguaucguacaaguuaaaaugcacgggcccaagggggauuuuuuuuuucaccuccuugagaauuuuuuuuuuuaagcuuauaguaaggauacauucaagcuugguuaaaaaaauaauaauaaaacaugcaucauuuuucauuugccaaccaagcacaaaguuauuuuauacugacuguauauuuuaaaguauacucucagauauggccucuuacaguauuuaagauauagcaaggacauggcugauuuuuuuuuauaaaaauuggcacuaauaaguggguuuauuggucuuuucuaauuguauaauuuaauuuaguacaaaguuuguaaaauaucagaggauauauauauauuguuucuacgacaugguauugcauuuauaucuuuuuacuacagugaucugugacagcagcagcuucauguuguauuuuuuuuacugaaauuguaaaauauccaucuuaaagacaucaacuauucuaaaaauuguguacaggauauuccuuuagugguggaauuaaaauguacgaauacuugcuuuuucaaaaaaauguauuuucuguuaaaaguuuaaagauuuuugcuauauauuauggaagaaaaauguaaucguaaauauuaauuuuguaccuauauugugcaauacuugaaaaaaacgguauaaaaguauuuugagucagugucuuacauguuaagagggacugaaauaguuuauauuaaguuuguauuaaaauucuuuaaaauuaaaaaugccuauu

SEQ ID NO: 16762 - RNA, 3483 nt, Homo sapiens
uacagaacaaacugcauuagaaugcaaggcaauaaagcaaaaaacuagaaacauccuugacaaagaaauacuagcaguuuaauuaaaacaaaguaguccaacaugugccuccgaaauauuuaaguuuuuaaagcauaugucucugccaauguaccaacacaagauggacuuaauaccaaaaagaaaaaaaaaaacaguucaaccuuuuuauuaaaaaaaaaaaagaaaugacaucaaaaucccuaaaaaaaggauaauuaacuuuucaauggcgacuauauuacaaaugugggcgauaauuuccaaagaggcacacuaaugggggcacgagucugcuacaaaauagcugagacaaaacaauguaccucaaaauguuuugcaggacuacacugucuuuuccuucagaagaggcuuuuguaugucuucuuacucggcuuaguuccaucuucaucugugcauacuuacgcugcacugucaaacaguaacaaaaagcccuaaucaaagugagaaacaauacacuuaccucugucugaucugaggucuuaucagaucaguuuuaauuggacugagugucaccuucagauuuaaugucuucacuggucccauugaccucauucuuaguaucacuuuccuucgauucaguguuugugucuucacucugcuuuucucgacuaccggacuucacacuacuuuuuuuaucaucagauccccucuuuucugccauaaaagaagacauugaccauggauuuuaaaguaaaauacaauaaagacaugauuuugaaaaaaagugaaacaacugagagaugagagacaaucauuucccacagacugcaagcaacgguuuggugaauuuaccaaagggauaaaauuuguaauauaugagagagaaggcaggaaggggaauucaaggaagcaaaagguaaaauaguggguaaauucucucaauuggugagaagcuauuaagcacauugcagaauauaauauuuaaguaaauuucauuguggguaaaaaacaucaaaaagcacugggaaagguauaaaagacagcauacaaaacuauguucacaugagguucaauuauuaaguuagaaggguaaaaauggagaccccaaaaggugaaaaaaaguugaauguuuauaacaggcauguuuuaaaaacuacaacuacauauuuuucaaugcaaaacauuauuuuuauauauauuugaauauccaagaaggauaagccuaaucaaagaaaauggaucuuaaaucccaaucuaagcaacugaacuuuugugcuuugcuaagaaaaguaauauauaugccaucugagaguuguuuuuccaaaaagagaaauuaaaauucaacucagcugcaaaugaagaaugaaaaagguaaacaacuuuuuccucuacuauucuuuggauggguaagaccucagacuagagguaaaaguaguacaccagagcaagcauagucuagccuuuucaguuccaaguauucccccaacaaaaaauuucuacagaaaauguuaaagccaacuagaaacuuucuggaaaaauuacuuuuccccuuacuaagaauagcuggucuggcagaguaguuaauuagacaaaaagacauuuuaagagaaacagaacccucuacauaguuucugcacaguuaugaagacguaacaccaaauaucuaggaaagagaugguaaugaaaaacaaaacaugguaugggaggggcacccacucagagaacugaagaucuuauguaaaagagcauauuuaguccguaacacuugcauaauacacaaagcaauguccaaguaguuaagcgcaagacuugcuucaugucugucuguccacuugugagaacugugccaggacagugggcucuaacugaccuugugggaaaguccucccuuugugccuuaugggcuucuccggugcacagguagcuucaaugaggaagagucgucuuguugucccguagaggacuaguagucaguccaauaaucuuaucuucugcccuauguaaauaugguagaucuuaauaguccuaaggacauccacaauuugugguggauuuuagggcuauggaugaaaaaaggaaacucucuugacaaagagagcaccuuacacugguugcugacagcuuugugugagaaaccacuuuucauuuguggaguaagauaaacugcuucuaucauagcaccuggaguaauaaacuugcuuuuucucauuugccauuaauaaaugcccacuguggcucacaccuggucccaaaguccagaucuucagucauuuauaagagugccuagauggcuacaugguaguuucuuuucuguauuuuuuuuuuuacauuuuuuaaauucacucaucugcacacugauuuuaauuaauuuauuuuuacauagcauuuucaaaaugccaauaaauuauaucacuucuaaaagagauuccaauguuuaacucuaucauagcauacccaaucaugggagacaagccugauacaguuuucuuaguaacuucucucuuugcaccaagucucacauggaaaaucccugucuguugcuaaucuaaacguaacucagcuuauuccgcuuaacgaaaaguuuuacuaggggccaggcaugguggcuuacaccuauaaccccagcacuuuaggagacugaggcaggaggauugcuugaacccaggagaucgagaucacacuggacaacauggcaaaaccccaucucuacccccccaaaaaaaaaaaaaaaauuagccaagcaugguaguaugcaccuacagucccagccacccaggaggcugaggugggaggaucaccugggccggggagguagaggcugcagugagcugugaucgugccacugcacucagccugggugacacugagacccugucuggaaaaaaaaaaaaguuucacuaaauuucaugucaucaucauuacaauuuuaggauuaaagguaagcaacucuggacaucuuuuugcucuauccagaaauuacacaaauaugccuguuuuuagucaggccagugucauuuacuacucaacuuugacuucaaguaguuaugaaggcuagcuagcuuuuaucccuaagaaccaacccaacaauuuuaaguggcacaaaugauaacacagaauagagcaacuaaagcuaacaauaggaaauguaaaacuaaaaacuuucucaaaacaaauauuauuaauuugaccugacagucauaccuggcucuuaagaguugaccucucaacccaaaaagacauuacacagaaagucuugcaaaaagauuagguaaaacauucuuaaaucuaauguuaaaucaguuaacccuuuguagcaacugccuuuugaaucagaagcaaguucucaacuugaauggcaaacacuagcacaucuggcaggaagacaaaaguuuucaacacuuucucacauuacaguaaaagccaauagauguuaaauauuucagaaaaagagugugugcuuauuuuaagaaaauaaaagca

SEQ ID NO: 16763 - RNA, 1995 nt, Homo sapiens
gggcccaggcccagcuuguguggcaaggcugcuucauggauaaauaguuuggcaaguaugcaagugcuuagcaaagccgcuuauuuaucaaccaaaauuuauuggacaaucacuauauacaggcacuguuccagacacuaagcuauagcagugagcaaacaaaaaaauuauaguccucauggagcuuguugacgucucugggcucacaacaugccccuggcuccuuguugcccagacccagcuccccagcccccaauucuggauuggcucacagaccuuuuccugggcuuucuugccuauggcuauacauacagccaacgugccuugagcauuuaccaagugcugugccccucgcucacacacuggacacauuuucuuuuaagccuacagucaugcagauuuuuuuuuuuuuuuuuuggggacaguuucucacucuguugcccaggcuggagugcaacggugcgaucuuggcucacugcaaccuuugccuccuggguucaagcgauucuccugccucagccucccgaguagccaggauuauaggugcccgccaccacgcccggcuaauuuuuguauuuuuaguagagacgggguuucaccauguuggccaggcuggucucgaucuccugaccucgugagcugccugccucagccucccaaagugcugggauuacaggcgugagccaccaugcccgaccaaggacgugaguuuuaagcucagccagucuaacuccagagcccaaguuccuaacccuuguauuugaguccguuucuccauaauuugugaagagaguuuuucuuguugcuuaacccaagucuuucuuguugcccuuucaaucccccucauuuuauuuucaugcuuguccauugaaccccuuucauuagaguggggaaugggagauaccaggggcuugcagggagaacuagcugaacccuaucuccuuccucccacccuacugcagcguuggaaggugcagaggauaaggaggcacugcugauugaagacacacucagcaaccacacggaucugacagacaaugauccagucaccuaugugguccagaagcaguuuaugaggugaguuccugagagcucccagcccucccggaggcuguaucaggccuccccaggcccugccagauggggugcagguuucucccugacacucccagccucuguccuggggggugcuugaggcccccucccugggccugaccagcugccuccacagacagcugagugcccuguccucagauggggagggacagggucggccuguaccccggaggcaccuggguccaucagagaaggugcaggugacagaggcgaaggcagauggggcacugacccaggaggagaaagcagccauuggcacugugagucgguggggcaagaggggcuggaggggauggacaggcaggccccagcagccccaggguuuauggaguccccugucccugacugccauggcugcucccuacagguggagcucaguguguucugggauuaugccaaggccguggggcucuguaccacgcuggccaucugucuccuguaugugggucaaagugcggcugccauuggagccaauguguggcucagugccuggacaaaugaugccauggcagacaguagacagaacaacacuucccugaggcugggcgucuaugcugcuuuaggaauucugcaaggugagcuuguggggguguccagaaggggcuccaauaucccuucuucucugggcugccaggccccccaaaccgugcccuugcauccaagccucccuaacccacucuggucaacccgugucucugauucugccccuuugugcccgcucacuaguccaggugagccagcgcccucugccuucuccaacaggguucuuggugaugcuggcagccauggccauggcagcggguggcauccaggcugcccguguguugcaccaggcacugcugcacaacaagauacgcucgccacaguccuucuuugaca

SEQ ID NO: 16764 - RNA, 714 nt, Homo sapiens
agcccaccagaugugcccccgccggggcccccggguugcgugaggacaccuccucugaggggcgccgcuugccccucuccggaucgcccggggccccggcuggccagaggauggacgaggaggaggauggagcgggcgccgaggagucgggacagccccggagcuucaugcggcucaacgaccugucgggggccgggggccggccggggccggggucagcagaaaaggacccgggcagcgcggacuccgaggcggaggggcugccguacccggcgcuggccccggugguuuucuucuacuugagccaggacagccgcccgcggagcuggugucuccgcacggucuguaacccauauccuucggggcacgacggccaggcgcggggucagaagggggacgggccgcaccgccgggggucgggggggaagaagacccaccgccaggugagucgaagugagcccggaggguaggcggauggggggggggcugccagggaggggagggggcaccagagugggagcggagacgcgagcaggucucgucgguaacccgggcuuaccccaccugcguacacacaccucagucuuccuggguuggggggguggggauccaggccaggagaagagagcugugccccgcuggcucgcagcuggacgcccuccagauguggucaggggagggucgucauccuccagaugugggaagcuucgggag

SEQ ID NO: 16765 - RNA, 4715 nt, Homo sapiens
guaaauauaauacauacauacauuuauauuuauagaaaucucaggaagaaauugcagcaugggaagauggacagcaaagcaccgauguccugcuagaacguccuggcaggugggggcuggcagaguuggggcaugggcuuuaaaacccuuucuggaagcaagggguggggcaaggaucugaugauuguuuccacguggcagggaaagaggaacagaggaaggaugauccugggaggguggccauccugaugaccaaccuguugugguucugauugacuuggggggggggucucagcaacagcuucuccaagaggagcuggaggguggggaaggcaugaaggcuggggagaggcucagccuuccuucuccccaggacacugcuggguggagcuggguugguaguggagugcccgaggcccccugccaggacgugucuagguguaggcagcucugugcaucagcagaggcuguggggagaagguauggguggaggugagaaggucaguagucucuccgguggaaggcagaggccagucaccaggacuggcugggucagaaccugcaaagaggcaaagaucgaugucaguacuccaacaacacagaugaugcuugaagaaaaugguggaaguccugggcaggaccuuuuccucccuucaacaggggacccagucguccccuccucucucuguaaaaauggagggucugccugacccuccagggccaggggguauccuggaagauaccagcucacuugcuggaaucaccaaagagggacauaggggaccuguuuaccuggcccccaccuguuuaauggcggccagcuuucuuggaccucuugguggggaacuugcagcugcggaaggcguccgugucacggaugugcuggcccuugaacuuggcaggugaggcacagguggcaucugggcgggaggccuuggcuuccagccaccuggagagacagaaacuugcuggggcuggggaagaaggugggagugcuggggggaagggcagugaacuauggggccaggauugacuuggccacaggauagucugaagcugucaucuucauuuuacaaauggggaaacugaggcucccagggucccaugcuuauuagguagcagaucuaggaugcauguccaacaugucuuagugcagggcuaaugugccucuaucacaugagggugggcucugggagugacauggaaguguucuuaccgccgaaggccccggagcuggcagguacacuuccagggguuauugguaagggcgagggucuccaggcugucgaaggggaaguuggaggguagcugguucaagcgguuguucuccaaauggacguguuucagcgugguuacacccaggaaggcaccaucugagaacuggggagcaaggugggagcaaggugggagcaagguggucaugagugaaugaguaagcacccgagugccagaggggcaggauccuucccugaaccugagccauagcacuuugaggaguuucccaguuuucaaagcaguaugaccaagugaucucagauaauccaaucuacacaacccccuuugagacagaugguguuauuuucuuuuuuuuuuuuuuuuccuuuuuuuuuuuuugagauggagucucacuguguugcccaggcuggagcacaguggcacgaucucagcucacugcaagcuccgccucccggguucacgccauucuccggccucagccuccugaguagcugggacuacaagugcccgccaccaugcccggcuaauuuuuuuguauuuuuuuaguagagacgcaguuucaccauguuagccaggauggucucgaucuccugaccucgugaucuacccgccucagccucccaaagugcugggauuacaggcgugagccaccacgcccagccaggugguguuauuuucaauaugcaaauggggaaacggaaaaagcgcaguccuuugcccugggucacagcaguggguaaacaguagccacaggaccacacccagcuccucuuccccuggcaccacaaucccugcacaaacacugggacuguggggcugccagaguuuggccccagcaauccaaacugguacacggugaacuuggucugugcuugguggagugggcagugggcccaggcuccccacagucccagggucccaggacuucccucagcucuguccucacugcucccccacugccagccagacgcuauuugugaagccaccuugguggagccuuuggccagguuggacggcuccagaggaaauguucuauuggugcccacaccuuugcccaggcgccacaauuccugucuggccuccccugccccaaaccagccccuaauucgcugcucugcugcccacugaaagaccacucuggcacuggugggccacaggggacuccaacuucagcuggggagaggcagggcugaagaagggcaggcuugagcaggcuccuuccacccagacaaagguuggcugcugcccaagugagauucugcccacaucuccacacccgcacccuuuccuguggcccacauugagguaugaaggucuccaguaaccagacucuccucuaccuuguugguuccccacccaaaccuccuggcugaagccccuguaccagggugauuuuuccagucccagagaagggauucugcucugauccaagguagccccaccuggccagacacugggcaccccaggggagaaaggaaugagugaggaugcagacaggagaugggucuagugacggaggagggcaaagggcaguuagcagucuggagacagugagucacgccagucuucucuguggagagacaccuggggucuugggccaaggauugacaauaguggucuugccuuugccccuucacggagcccaugggcacgaugcuugcauccugggggagcccuuggucccacgccuacugagcugcaauggacuugagaaugcagugaauugugucuguguggauugggcagggccauccaccagggccucuauggggcauggagaaugucuuccucaggcauuugcuuccccucacuccccagucccccacucccccuuagcacacaugcacagcccccaccaggaacagggucucuuugugggccugaucugcccagcuccucuggaaggcuccucaauaaacaaaccuuccuuuauggggugguagguuuacuggagacgggaaaaacagcagaggagggguggaaggcccaacaggaagagguggcugcugcucacaguuggggguuuggaagcacuggagauggcccuagggggccuuuuguggggccagggcagucccacuccuuuuauauguaagaauccuaggagggcaguggucgagacuggcagcagacagggauuaggguagggaugugacaaggcgaggaagggagguggcagagcugcucaccuuggagauagccagagggacagggaaccuggggacgggggauggugccagcuguggcccuggcuccuggggccuccaggaagggaagaaggaaccagggcagagcccacagccaggagcucaccuucuccagguugguguuguccagccagagggucuccagguaucugccaaaggacuggaaggcauuguccgggaugcuuuucaggggguugugggacagcuucagcuccuccaccacccguagcuugcucagggcagcugagggguagcuggacagcugguuccuguccacguggaauuuggcgagguucuccacgucguccagggccccgggcugcagggagcucaacgcguuuuccgacagguagagccagcgcagguccuuggcucccuggaaggcgccugcgcgcagcucacggaucuuguuguuguugagcugcaagaugaagagguugaccagcggggagagcaacccccggggcagcucagugaccuuguugugguccagguagagguaggucagcucggucaggucgucgaaggcaccugcgcgcagcacgcggaugucguuaugggacagguacaaguagauaaguugcuugaggccgcggaaggcaccggcggccaccucgcggaucuggcagugcugcaggugcaaugacacgagguucggcauggcccggaacgaauuggcagccagcaccgggaaguuguugcgcuguagguugagcagcuuggucuucucugacaccuuggggaucuucugcagccccaccuugucgcagaugacgugcugcaggucgcuguggcaguggcaguucugggggcaggcggccagcgccggcagcagaccagccaggaggccgaggcugagcaagagcauugggcggaccauggcugggacgccuggggccggggcugggggcagcagcggcggcggggcgcgggcagcggcgaguccuaggcgcucgggucugccgcccucuuuauacgguggcccugaccgcagccggcagccgagccagcuccuacguggagcaucgaggccacugggcuuaacucgcucgcgcccagagaugcgcccccgcccuccacggggaagggggcggggccguucccccagccggcuaccgugcaugagggggugggaccguggcccccgagccccgagcccugagccccggcuguagccccccgcucuccuauggugcuccucugccuaccgccuuucccggggcuuuucugggaagggggaauaguuaugucuggagccccgaguuuacaucg

SEQ ID NO: 16766 - RNA, 9972 nt, Homo sapiens
cgccagagcugcuggagcgcucgggguccccgggcggcggcggcggcgcagaggaggaggcaggcggcggccccgguggcucccccccggacggugcgcggcccggcccgucucgcgaacucgcgguggucgcgcggccccgcgcugcuccgaccccgggccccuccgccgccgccauggcucggccgcuagugcccagcucgcagaaggcgcugcugcuggagcucaaggggcugcaggaagagccggucgagggauuccgcgugacacugguggacgagggcgaucuauacaacugggagguggccaucuucgggccccccaacaccuacuacgagggcggcuacuucaaggugagcgcggcgacccccgcccgggucccggagcccacgagcgaccucgggcgccgggaaccagcucccugccccgcgguccuagcgcuguugcugggcgggccccgaagccuccuggcuugggcucguuucccuucuauggccacguucccccacccagcucugcccggcccccuccucggaccgucucggggaccuucagccucugcugcaguccucgaaaauccccaguucccuucaaggcaucguccgguccccuguuaggcucuuggcccccggagggguggccgggggcccucccuguagcaucugggcguggggcucuugcccaccuccuccuuggcgggggcuggaccccggcugccucccccuccgccccugcgagaaagagggagcggagcccaggccgcgccggccuuucagcugcccuccccgcccuccccggaggagacaaagaggcccccccagaccccguagcugcuauuguuggggagcugggcccgugagcgggggagcgaggccagccuggggguggcuggcgcggccacucgcucagucuccaacaaaggcccggaugagccuuggcagccaggacccgccuggaaagcggccacccuugccaguagcagccggccaggcgcccugggcuccauccccugcuuuauguaaccugcgcccucgggaaggccgaaguaggggcgugccucccaccugcucccugcagcucucuccaggccucccggcucgggcccgcgucccggaccccgaccucagaagcuccgggcucgcucaucccagcuggucuuggccuuucucagaguccacugaacagguggcuucuugggacccaaaccccgaguucugggccguuucuucugcccucuggcgguuuaauuccaagcaguuucuggauguuuuuguuguuguugggagcggggaggcuguuucugucucaugugaaaaggacucaggccaaaaccagggcaguuuucuugaucucacgauccagacgugaccuuugacuucuuuuagcguucagggaccucguucuuggggccagagggacaaagcgaggggcccugugugagcgguggggaacgagcacccuguccaggaaucucccccucccaccgucacuuccugccaagagccuggacacgacacgacacugcagggcccggcccgcucugccccggccagcugcgggcguggggccgagggaccgaugccucccgcacgauaugugucugcucuccgagcuaauuagugucugaaccgcacccgcucagcggcugugagggcagcagccuggucugcugggggcgauuccugagcagagagugggacgcccguggguucugcaucuggaauccugcguccccacacagggaacagaguuugggucucgagguugccaaaugguuuuagcagcuccuccgccagccccuucugucugcuugggggagcagcuggcugaggagccgcagccccaccucgaagccaggccugugaggcggcugcuguucuggaaggaggggauggggguuucuggcugcugugcccaccagaccgguugccagggauugugggcagagcuuccugggccagcauuaggggauaauccgguuuuccggauuucccagggagggggccucuagacaucugccacagggucaguccucagaagccaguguugagacgggggugcugccacccacgaggacucucccuucccgcugugccugggagggaguugggggagcguggaaauacagaaccugcugagugcccagggccgcugcugcccagccacugccugcagcugcuguuccuucaggagccaaagugagcccuggggcaggggccgccagagagagcccuccacagccgacuugcugucugcccuuggcagggcgcuuuccuuuucugagccuggguuugcuccggggaaaagacauucuuagaggugcccaaaauaagaggcucauugggacuuggugggguuugguacagaugaggccuuggcuguugucaaggauugccgccugaaacccagcaccaggcuuggggggccugaagucuuggggaaccgcaggacaguucugagacugaaguuccagccuugcucuguggccgcggccaagucacuugccuuacggggcaccagugaguucccugucaaacagaggacaccccccaagacaccccgcgugcccucccuguccaggaggggcccguccacgauccaagacccccaaagugcccugccuguccgggaggggccucgcccacaauccaagacccccgaguacccucccuguccagaccucgcccacgauccaagacccccugagugcccucccuguccagaccucacccacgauccaagacccccugagugcccucccuguccagaccucgcccacaauccaagacccccgaguacccucccugucaaggccucgcccacgauccaagacccccgagugcccgcccuguccagaccucgcccacgauccaagacccccgagugcccucccuguccagaccucgcccacgauccaagacccccgagugcccucccuguccagaccucgcccacgauccaagacccccgagugcccucccuguccagaccucgcccacgauccaagacccccgagugcccucccuguccagaccucgcccaugauccaagacccccgagugcccucccuguccagaccucgcccacgauccaagacccccugagugcccucccuguccagaccucgcccacgauccaagacccccugagugcccucccuguccaggcuuccaccacgaucgcucugggggugcugcucucgugccuuggagugcugagugccaccaggaccccugacccagacaaccucugugucuggcacuggggcccagcaggaaaacagugaggcuuccuuguuuaccugcuguggcccaggagggccguggguggcaucacgccccaggcugcaggccagacagcucugucaccuggcacguggcuucaggccucccucuguggccguccuugccagcagaucuggaccuccagggccugggugaccacagggggcgaugcugacagggaaggaguccugccagguuucugugaccuaugggucugccugccugaccccccaagaccggacaccugagggcagacggccauacugacucauccccucccacggccugggccagggcaggugucacaaguguuugcuaacugagcaaucaucugugcuaacccuccccacacccuggcugccaaggcccuggaggugcagcccugguccugggcuucagcuccauccaaggggagccuggagccccugccaguccauucugucugcuggugggugccccuggccugggucccauaugccugaccugggcugccacgggccuggagccacgcgggcagccagugcccacguuccccagcaguugugcugggccgggucccggccaccuggacuguguaggagcugggaucagcucgggugacucagaaaaggcuucaggcagccuucuggggacuugaccccaggccugugagagucccugccuugggcaggauacggugucccucacacacacccucaggcaccagcacugggagugggauggccuugggcaccuugugagcuggggcaggucuuggggcugggcuggacugagccaccugccuucugccccugcaggcgcgccucaaguuccccaucgacuacccauacucuccaccagccuuucgguuccugaccaagauguggcacccuaacaucuacgaggugagcgcggcccccacgggccucaaguccucauccuccgggacccagggugcugggagccucacguccucauccuuccgggacccggggcgcugggagccucacguccucguccuccgggacccggggcgcugggagccucacguccucguccuuccgggacccgaggcgcugggagccucauguccucguccuuccgggacccggggcgcugggagccucacguccucguccuccacguccucauccuccgggaccuggggcacugggagcccgugcugaccucugaccuguucugaccugucuucuucuugugcagacgggggacguguguaucuccauccuccacccgccgguggacgacccccagagcggggagcugcccucagagagguggaaccccacgcagaacgucagguaagccggcccaacccccuguguccacccagaacaucagguaggccgggcuccgucccguauccacccagaccaucagguaggccgggcucccccacaggcuguggcgccaaggccugauucgggaccugccagcuggcgguccugggccucgcuguaccugcacgguaggugcuuucacggggccugcggcaccgugugucggugcagacucccaccaggaccccaggccggccccaccgucuggaaccaccuagaggugucccgccauccucaguccuggggccuucuccuuacccagccgucucuggguuggucaccucgugccacgugugccgccugggccucguccccagguacaagcacugggccguguugcccguguguccuggaguguagucuaggcaggacgugcgggugugagggcagccccgggucugacggaggggucugcaccuugcugcccucccuggucuuggcgugggagggaggagacugaugcagguccagccccugcuguucugggggccugagacagaagcagaggccaugaggccaggugaaggucaccugcuggguggguccaggcguccccgugacccucagggccagagaagagccggaaggcuggggugccccgggccgccccacuccgacccacucuccccacaggaccauucuccugagugugaucucccuccugaacgagcccaacaccuucucgcccgcaaacguggacgccuccgugauguacaggaaguggaaagagagcaaggggaaggaucgggaguacacagacaucauccggugagggcgggcgggggcgucacgggaggagagacucagauccggccugcaccccggccccuggucccacggccgcccagccccaccuuccuggugaggguggcggagcuuccuggugcccauuuacagggugccagucacagauggaggccgggccgaguggcggaggguccagccagguucaagcccagcuucuugccccuuuuccucuuuuuuuuuguuugagacagagucucucucugucacccaggcuggagugcaguggcgcgaucucggcucacugcaagcuccgccucccggguucacgccauucuccugccucagccucccaaguagcugggacuacaggcgcccgucaccacgcccggcuaauuuuuuguauuuuuaguagagacgggguuucagcguguuagccaggauggucucgaucuccugaccucgugauccaucugccucggccucccaaagugcagggauuacaggcgugagccaccgcggccggccuuuuuuuuuuuuuuuuuuuuuggagacagaguuauacucucuugccuaggcugcagugcaguggugcgaucucggcucacugcagccuccacuacucggguuggagcaguucucccccuucauccugccaagcagcugggauuacaggugcccacuaccacgccgagcuaauuuuuguaauuuuuaguagaggugggauuucaccaucuuagccaggcuggucucaaacuccugaccucaggugauccacccgccucggccucccaaagugcugggaugacaggcgugagccacugcaccuggccuggugguuaguguuuucauagauucuuccaggcuuuucaguuuaacgcaugucugugcuuuaaugaagaaauggggucgugcugugugugcccagugacugacuguuagggaacaugugucugugccuuaaugaagaaauggggucgugcugugugugcccagugacugacuguuagggaacaugugucugugcuuuaaugaaaaaauggggucgugcugugugugcccagugacugacuguuagucagggguguuggccuuacucaugucuggagugcgucccugcaggcucuuggccuggugagcucuggguacagcugugcagucgccuaccggcgccuucuguaccugcaguccacuuagcuugcguggcuguguguggugacccacggcucucccucuccucccaucgcccucaugccccagagcugagccccacagccccuucucuugggugccuguguucacaugaauguguaaacacgugcgugucuguguacaaagacaaggcuuucuuuacggguugacggccuuaaugguuccugcucuuccuguuacauagaggcccuuccuauccauuuuuuuuuuuucucagagugauauugcauagauuuccucacagaggccucaccuauuuuuguugguauuuuguauaaacagaaucuuaaaaacaacuuuuaaaauauugcacacauaaugcaugugucuuccucgccccaggacccaggagcauccagggcaccuuccauccugcacucgcugguaccuggugucguggggucaucucggggcagcauccuggugcugggcggucucggcucugagcagccauggugggcgggccccgugcggccuccugggaaguggccugcaagcaccugcuggccucuggaggucacaggguagcugcccuggccgucccucuggugcagauguccucgguggccccgguccggucgugucaccuggcccagguggcuggcuccuuggcccgguucuucccggccaccucccugaggcaccaccuccuugagaucccagcacagaaauaaaagccacacuauuuuuaucccucaaaacucccugugggccaacacacaugugccauguggacucugcuguggucgccguuucugccuguuuuuucaucugugugcguguuggccucguggcagcccaagucccgcugagcugugucgggcaggcugccguggagcccggcuuggucagggauguuggucuugcugaacaggaccuccagaccguccuccagcucaugcuggcggugugccggcggcaccuccacggugcaggucaguucccacccuggcccuccccugcgucuccccacagccgccaccucugcggugccguccccggggcaccgucacccccccagcccguccacccuggcccuccccugcgucuccccacugcugccacccgugcagugccguccccggggcacugucagucacccccccagcccaucggagagcuuggaaagcaaagcuuggcguccgcugggucccgccacccagggacgucccugaggccagacgccugcccuccacgcgucaugcauccccauaaaaagcacugggcuugugggcugggcuuggggcugucugucugcucccuggugcccucccaugcgggcacugugggacccgcacacccugguagcagccagccccagagcccagagccgugccuggucggugauaggggcucgagcccauugccugcggcugcagccucguuccuguuuucugucaaauggggucagcgugccgccuggcccugcugugccacccccggaagccccuuugcuuccaguccuggggggacauucuugacgcguguccuggagguggagccgggggcagguuccucguagguccuggugugcgcggugcagccccucauagggccggguguacacggugcccuccaggaaguuugagcuaacuuguccucccuuccugccagaggcugggauggccaggccccccagguuuagaauccggaggccgggguggccaggcccccagguuuagaauccggaggccgggguggccaggccccccacguuuagaauccggaggccgggguggccaggccccccagguuuagaauccggaggccgggguggccaggccccccacguuuagaauccggaggccgggguggccaggccccccggguuuagaauccggaggccgggguggccaggccccccggguuuagaauccggaggccgggguggccaggccccccggguuuagaauccggaggccgggguggccaggccccccgguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccggguuuagaauccggaggccgggguggccaggccccccacguuuagaauccggaggccgggguggccaggcccccggguuuagaauccggaggcugggauggccaggcccccggguuuagaauccagaggcugggauggccaggccccccgguuuagaauccggaggccgggguggccaggcccccggguuuagaauccugcugaggccacggagaggcucaggccguuuuugcguuucccaucucaccugugcugguucccgucuccagggaugguccugccuccuguccuugggcccucccagcugcuuccuuugcuccugcgcugaggaaggcuuuugccccccaguggggcagcaugggcccucccuguugccggcaucguuauuuucucccagcuccugaugggucccuuggguugugcuucggggcggggcaggcgggugugacugcacugcgcccguccagccucccacccgcaccuccugcccuucccgagcccccuccucugucauuucucccccuggaguuccucacgcacagggcuuuguccuaaguggucgccacacgccguuuuaagagaaaccugagcguuggggugagcgucggaccugggggaggggggccgggcaggggccgaguccaggcacguggguggcgcccucacccacccuguccccccaggaagcagguccuggggaccaagguggacgcggagcgugacggcgugaaggugcccaccacgcuggccgaguacugcgugaagaccaaggcgccggcgcccgacgagggcucagaccucuucuacgacgacuacuacgaggacggcgagguggaggaggaggccgacagcugcuucggggacgaugaggaugacucuggcacggaggaguccugacaccaccagaauaaacuugccgaguuuaccucacuagggccggacccguggcuccuuagacgacagacuaccucacggagguuuugugcugguccccgucuccucugguuguuucguuuuggcuuuuucucccuccccaugucuguucuggguuuucacgugcuucagagaagag

SEQ ID NO: 16767 - RNA, 9972 nt, Homo sapiens
cucuucucugaagcacgugaaaacccagaacagacauggggagggagaaaaagccaaaacgaaacaaccagaggagacggggaccagcacaaaaccuccgugagguagucugucgucuaaggagccacggguccggcccuagugagguaaacucggcaaguuuauucugguggugucaggacuccuccgugccagagucauccucaucguccccgaagcagcugucggccuccuccuccaccucgccguccucguaguagucgucguagaagaggucugagcccucgucgggcgccggcgccuuggucuucacgcaguacucggccagcguggugggcaccuucacgccgucacgcuccgcguccaccuugguccccaggaccugcuuccuggggggacagggugggugagggcgccacccacgugccuggacucggccccugcccggccccccucccccagguccgacgcucaccccaacgcucagguuucucuuaaaacggcguguggcgaccacuuaggacaaagcccugugcgugaggaacuccagggggagaaaugacagaggagggggcucgggaagggcaggaggugcgggugggaggcuggacgggcgcagugcagucacacccgccugccccgccccgaagcacaacccaagggacccaucaggagcugggagaaaauaacgaugccggcaacagggagggcccaugcugccccacuggggggcaaaagccuuccucagcgcaggagcaaaggaagcagcugggagggcccaaggacaggaggcaggaccaucccuggagacgggaaccagcacaggugagaugggaaacgcaaaaacggccugagccucuccguggccucagcaggauucuaaacccgggggccuggccaccccggccuccggauucuaaaccggggggccuggccaucccagccucuggauucuaaacccgggggccuggccaucccagccuccggauucuaaacccgggggccuggccaccccggccuccggauucuaaacguggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaacccggggggccuggccaccccggccuccggauucuaaaccggggggccuggccaccccggccuccggauucuaaacccggggggccuggccaccccggccuccggauucuaaacccggggggccuggccaccccggccuccggauucuaaacccggggggccuggccaccccggccuccggauucuaaacguggggggccuggccaccccggccuccggauucuaaaccuggggggccuggccaccccggccuccggauucuaaacguggggggccuggccaccccggccuccggauucuaaaccugggggccuggccaccccggccuccggauucuaaaccuggggggccuggccaucccagccucuggcaggaagggaggacaaguuagcucaaacuuccuggagggcaccguguacacccggcccuaugaggggcugcaccgcgcacaccaggaccuacgaggaaccugcccccggcuccaccuccaggacacgcgucaagaauguccccccaggacuggaagcaaaggggcuuccggggguggcacagcagggccaggcggcacgcugaccccauuugacagaaaacaggaacgaggcugcagccgcaggcaaugggcucgagccccuaucaccgaccaggcacggcucugggcucuggggcuggcugcuaccagggugugcgggucccacagugcccgcaugggagggcaccagggagcagacagacagccccaagcccagcccacaagcccagugcuuuuuauggggaugcaugacgcguggagggcaggcgucuggccucagggacgucccuggguggcgggacccagcggacgccaagcuuugcuuuccaagcucuccgaugggcugggggggugacugacagugccccggggacggcacugcacggguggcagcaguggggagacgcaggggagggccaggguggacgggcugggggggugacggugccccggggacggcaccgcagagguggcggcuguggggagacgcaggggagggccagggugggaacugaccugcaccguggaggugccgccggcacaccgccagcaugagcuggaggacggucuggagguccuguucagcaagaccaacaucccugaccaagccgggcuccacggcagccugcccgacacagcucagcgggacuugggcugccacgaggccaacacgcacacagaugaaaaaacaggcagaaacggcgaccacagcagaguccacauggcacauguguguuggcccacagggaguuuugagggauaaaaauaguguggcuuuuauuucugugcugggaucucaaggagguggugccucagggagguggccgggaagaaccgggccaaggagccagccaccugggccaggugacacgaccggaccggggccaccgaggacaucugcaccagagggacggccagggcagcuacccugugaccuccagaggccagcaggugcuugcaggccacuucccaggaggccgcacggggcccgcccaccauggcugcucagagccgagaccgcccagcaccaggaugcugccccgagaugaccccacgacaccagguaccagcgagugcaggauggaaggugcccuggaugcuccuggguccuggggcgaggaagacacaugcauuaugugugcaauauuuuaaaaguuguuuuuaagauucuguuuauacaaaauaccaacaaaaauaggugaggccucugugaggaaaucuaugcaauaucacucugagaaaaaaaaaaaauggauaggaagggccucuauguaacaggaagagcaggaaccauuaaggccgucaacccguaaagaaagccuugucuuuguacacagacacgcacguguuuacacauucaugugaacacaggcacccaagagaaggggcuguggggcucagcucuggggcaugagggcgaugggaggagagggagagccgugggucaccacacacagccacgcaagcuaaguggacugcagguacagaaggcgccgguaggcgacugcacagcuguacccagagcucaccaggccaagagccugcagggacgcacuccagacaugaguaaggccaacaccccugacuaacagucagucacugggcacacacagcacgaccccauuuuuucauuaaagcacagacacauguucccuaacagucagucacugggcacacacagcacgaccccauuucuucauuaaggcacagacacauguucccuaacagucagucacugggcacacacagcacgaccccauuucuucauuaaagcacagacaugcguuaaacugaaaagccuggaagaaucuaugaaaacacuaaccaccaggccaggugcaguggcucacgccugucaucccagcacuuugggaggccgaggcggguggaucaccugaggucaggaguuugagaccagccuggcuaagauggugaaaucccaccucuacuaaaaauuacaaaaauuagcucggcgugguagugggcaccuguaaucccagcugcuuggcaggaugaagggggagaacugcuccaacccgaguaguggaggcugcagugagccgagaucgcaccacugcacugcagccuaggcaagagaguauaacucugucuccaaaaaaaaaaaaaaaaaaaaaggccggccgcgguggcucacgccuguaaucccugcacuuugggaggccgaggcagauggaucacgaggucaggagaucgagaccauccuggcuaacacgcugaaaccccgucucuacuaaaaauacaaaaaauuagccgggcguggugacgggcgccuguagucccagcuacuugggaggcugaggcaggagaauggcgugaacccgggaggcggagcuugcagugagccgagaucgcgccacugcacuccagccugggugacagagagagacucugucucaaacaaaaaaaaagaggaaaaggggcaagaagcugggcuugaaccuggcuggacccuccgccacucggcccggccuccaucugugacuggcacccuguaaaugggcaccaggaagcuccgccacccucaccaggaagguggggcugggcggccgugggaccaggggccggggugcaggccggaucugagucucuccucccgugacgcccccgcccgcccucaccggaugaugucuguguacucccgauccuuccccuugcucucuuuccacuuccuguacaucacggaggcguccacguuugcgggcgagaagguguugggcucguucaggagggagaucacacucaggagaaugguccuguggggagagugggucggaguggggcggcccggggcaccccagccuuccggcucuucucuggcccugagggucacggggacgccuggacccacccagcaggugaccuucaccuggccucauggccucugcuucugucucaggcccccagaacagcaggggcuggaccugcaucagucuccucccucccacgccaagaccagggagggcagcaaggugcagaccccuccgucagacccggggcugcccucacacccgcacguccugccuagacuacacuccaggacacacgggcaacacggcccagugcuuguaccuggggacgaggcccaggcggcacacguggcacgaggugaccaacccagagacggcuggguaaggagaaggccccaggacugaggauggcgggacaccucuaggugguuccagacgguggggccggccugggguccuggugggagucugcaccgacacacggugccgcaggccccgugaaagcaccuaccgugcagguacagcgaggcccaggaccgccagcuggcaggucccgaaucaggccuuggcgccacagccugugggggagcccggccuaccugauggucuggguggauacgggacggagcccggccuaccugauguucuggguggacacaggggguugggccggcuuaccugacguucugcgugggguuccaccucucugagggcagcuccccgcucugggggucguccaccggcggguggaggauggagauacacacgucccccgucugcacaagaagaagacaggucagaacaggucagaggucagcacgggcucccagugccccaggucccggaggaugaggacguggaggacgaggacgugaggcucccagcgccccgggucccggaaggacgaggacaugaggcucccagcgccucgggucccggaaggacgaggacgugaggcucccagcgccccgggucccggaggacgaggacgugaggcucccagcgccccgggucccggaaggaugaggacgugaggcucccagcacccugggucccggaggaugaggacuugaggcccgugggggccgcgcucaccucguagauguuagggugccacaucuuggucaggaaccgaaaggcugguggagaguauggguagucgauggggaacuugaggcgcgccugcaggggcagaaggcagguggcucaguccagcccagccccaagaccugccccagcucacaaggugcccaaggccaucccacucccagugcuggugccugagggugugugugagggacaccguauccugcccaaggcagggacucucacaggccuggggucaaguccccagaaggcugccugaagccuuuucugagucacccgagcugaucccagcuccuacacaguccagguggccgggacccggcccagcacaacugcuggggaacgugggcacuggcugcccgcguggcuccaggcccguggcagcccaggucaggcauaugggacccaggccaggggcacccaccagcagacagaauggacuggcaggggcuccaggcuccccuuggauggagcugaagcccaggaccagggcugcaccuccagggccuuggcagccaggguguggggaggguuagcacagaugauugcucaguuagcaaacacuugugacaccugcccuggcccaggccgugggaggggaugagucaguauggccgucugcccucagguguccggucuuggggggucaggcaggcagacccauaggucacagaaaccuggcaggacuccuucccugucagcaucgcccccuguggucacccaggcccuggagguccagaucugcuggcaaggacggccacagagggaggccugaagccacgugccaggugacagagcugucuggccugcagccuggggcgugaugccacccacggcccuccugggccacagcagguaaacaaggaagccucacuguuuuccugcugggccccagugccagacacagagguugucugggucagggguccugguggcacucagcacuccaaggcacgagagcagcacccccagagcgaucgugguggaagccuggacagggagggcacucagggggucuuggaucgugggcgaggucuggacagggagggcacucagggggucuuggaucgugggcgaggucuggacagggagggcacucgggggucuuggaucaugggcgaggucuggacagggagggcacucgggggucuuggaucgugggcgaggucuggacagggagggcacucgggggucuuggaucgugggcgaggucuggacagggagggcacucgggggucuuggaucgugggcgaggucuggacagggagggcacucgggggucuuggaucgugggcgaggucuggacagggcgggcacucgggggucuuggaucgugggcgaggccuugacagggaggguacucgggggucuuggauugugggcgaggucuggacagggagggcacucagggggucuuggaucgugggugaggucuggacagggagggcacucagggggucuuggaucgugggcgaggucuggacagggaggguacucgggggucuuggauugugggcgaggccccucccggacaggcagggcacuuugggggucuuggaucguggacgggccccuccuggacagggagggcacgcggggugucuugggggguguccucuguuugacagggaacucacuggugccccguaaggcaagugacuuggccgcggccacagagcaaggcuggaacuucagucucagaacuguccugcgguuccccaagacuucaggccccccaagccuggugcuggguuucaggcggcaauccuugacaacagccaaggccucaucuguaccaaaccccaccaagucccaaugagccucuuauuuugggcaccucuaagaaugucuuuuccccggagcaaacccaggcucagaaaaggaaagcgcccugccaagggcagacagcaagucggcuguggagggcucucucuggcggccccugccccagggcucacuuuggcuccugaaggaacagcagcugcaggcaguggcugggcagcagcggcccugggcacucagcagguucuguauuuccacgcucccccaacucccucccaggcacagcgggaagggagaguccucguggguggcagcacccccgucucaacacuggcuucugaggacugacccuguggcagaugucuagaggcccccucccugggaaauccggaaaaccggauuauccccuaaugcuggcccaggaagcucugcccacaaucccuggcaaccggucuggugggcacagcagccagaaacccccauccccuccuuccagaacagcagccgccucacaggccuggcuucgagguggggcugcggcuccucagccagcugcucccccaagcagacagaaggggcuggcggaggagcugcuaaaaccauuuggcaaccucgagacccaaacucuguucccuguguggggacgcaggauuccagaugcagaacccacgggcgucccacucucugcucaggaaucgcccccagcagaccaggcugcugcccucacagccgcugagcgggugcgguucagacacuaauuagcucggagagcagacacauaucgugcgggaggcaucggucccucggccccacgcccgcagcuggccggggcagagcgggccgggcccugcagugucgugucguguccaggcucuuggcaggaagugacggugggagggggagauuccuggacagggugcucguuccccaccgcucacacagggccccucgcuuugucccucuggccccaagaacgaggucccugaacgcuaaaagaagucaaaggucacgucuggaucgugagaucaagaaaacugcccugguuuuggccugaguccuuuucacaugagacagaaacagccuccccgcucccaacaacaacaaaaacauccagaaacugcuuggaauuaaaccgccagagggcagaagaaacggcccagaacucgggguuugggucccaagaagccaccuguucaguggacucugagaaaggccaagaccagcugggaugagcgagcccggagcuucugaggucgggguccgggacgcgggcccgagccgggaggccuggagagagcugcagggagcaggugggaggcacgccccuacuucggccuucccgagggcgcagguuacauaaagcaggggauggagcccagggcgccuggccggcugcuacuggcaaggguggccgcuuuccaggcggguccuggcugccaaggcucauccgggccuuuguuggagacugagcgaguggccgcgccagccacccccaggcuggccucgcucccccgcucacgggcccagcuccccaacaauagcagcuacggggucugggggggccucuuugucuccuccggggagggcggggagggcagcugaaaggccggcgcggccugggcuccgcucccucuuucucgcaggggcggagggggaggcagccgggguccagcccccgccaaggaggaggugggcaagagccccacgcccagaugcuacagggagggcccccggccaccccuccgggggccaagagccuaacaggggaccggacgaugccuugaagggaacuggggauuuucgaggacugcagcagaggcugaagguccccgagacgguccgaggagggggccgggcagagcugggugggggaacguggccauagaagggaaacgagcccaagccaggaggcuucggggcccgcccagcaacagcgcuaggaccgcggggcagggagcugguucccggcgcccgaggucgcucgugggcuccgggacccgggcgggggucgccgcgcucaccuugaaguagccgcccucguaguagguguuggggggcccgaagauggccaccucccaguuguauagaucgcccucguccaccagugucacgcggaaucccucgaccggcucuuccugcagccccuugagcuccagcagcagcgccuucugcgagcugggcacuagcggccgagccauggcggcggcggaggggcccggggucggagcagcgcggggccgcgcgaccaccgcgaguucgcgagacgggccgggccgcgcaccguccgggggggagccaccggggccgccgccugccuccuccucugcgccgccgccgccgcccggggaccccgagcgcuccagcagcucuggcg

SEQ ID NO: 16768 - RNA, 17637 nt, Homo sapiens
ugauuggcuggggcacgggcggccggcucccccucuccgaggggcaggguuccucccugcucuccaucaggacaguauaaaaggggcccgggccagucgucggagcagacgggaguuucuccucggggucggagcaggaggcacgcggagugugaggccacgcaugagcggacgcuaacccccuccccagccacaaagagucuacaugucuagggucuagacauguucagcuuuguggaccuccggcuccugcuccucuuagcggccaccgcccuccugacgcacggccaagaggaaggccaagucgagggccaagacgaagacaguaagucccaaacuuuugggagugcaaggauacucuauaucgcgccuugcgcuuggucccgggggccgcggcuuaaaacgagacguggaugauccggagacucgggaauggaagggagaugaugagggcucuuccucggcgcccugagacaggagggagcucacccuggggcgagguugggguugaacgcgccccgggagcgggaggugaggguggagcgcggcgugaguuggugcaagagagaaucccgagcgcgcaaccggggaaguggggaucugggugcagagugaggaaagcacgucgaagaugggaugggggcgccgagcggggcauuugaagcccaagauguagaagcaaucaggaaggccgugggaugauucauaaggaaagauugcccucucugcgggcuagaguguugcuggggccgugggggugcugggcagccgcggagggggugcggagcgugggcggguggaggaugagaaacuuuggcgcggacucggcggggcgggguccuugcgcccccugcugaccgaugcugagcacugcgucucccgguccaacgcuuacuggggcaggagccggagcgggaagacccggguuauugcugggugcggacccccaccucuagaucuggaaaguaaagccagggauggggcagcccaagccucuuaaagagguagucgggccggugaggucggccccgccccggccccauugcuuagcguugcccgacaccuaguggccgucuggggagccgcuagcgcggugggagugguuagcuaacuucuggacuauuugcggacuuuuugguucuuuggcuaaaagugaccuggaggcauuggcuggcuuugggggacuggggauggccccgagagcgggcuuuuaagaugucuaggugcuggagguuagggugucuccuaauuuugagguacauuucaagucuugggggggccucccuuccaaucagccgcucccauucuccuagccccgcccccgccaccccaccugcccagggaaugggggcgggaugagggcuggaccucccuucucuccucccucgcccuccuccugucucuaccacgcaagccacuccccacgagccugcccucccgauggggccccuccuauucuccccccgcccucccccucucacccugugguuuuuauuucacuuggcuucagcgccaaugggcugagguuggaguuggaagccaccgcggacuaaagcuuuguuuaaauuccugagaacuggaaagaguuacagccucccuggccaggcgccucggcgcugucacccgcgcugaugaggagcaggcgagcuuuuaaggauuugaggaaagaagaacggggggaggggcgggaagugaaaaauccaagugugccucuuagacccgggggaaaggugguuaagcuggggguugcagucacuacugacaacgccccucuuccgccugucccagucccaccaaucaccugcguacagaacggccucagguaccaugaccgagacguguggaaacccgagcccugccggaucugcgucugcgacaacggcaagguguugugcgaugacgugaucugugacgagaccaagaacugccccggcgccgaaguccccgagggcgagugcugucccgucugccccgacggcucaggugcggcugcgcucggggccuggggccuggggccuggggccuggggccuggggcuggggcuggggguggucggcgcucgcuggcccuccgugcuggaggccucugccgacgggagcagcauuagcaaaccuuggcucuaacgcgcgucucuucguccccuagagucacccaccgaccaagaaaccaccggcgucgagguaaucuccugcccucgaauuuugccccugcgcggcccgugacuccucacaguccucccuucucuaaccuggccucuuguuucuucucccccaaucccacagggacccaagggagacacuggcccccgaggcccaaggguaagcguugcacucugggcuguggggggcugcaggugggcauggcucucggccccacgcucaccccggccccgcccucucccccugcagggacccgcaggccccccuggccgagauggcaucccuggacagccuggacuucccggaccccccggaccccccggaccucccggacccccuggccucggaggaguaaguggagaggccuuguguguccacucuccccuguuuuguuuuuguuuuuuggcagaugacauaauuuuauacuuugaaauaauuucaaacuuacagaaaaguugcaagaauccuacaggaaacucucacauacccuucacaguuugugacaugugcuuuauuagucucuguuuauguauauguaucuuuuuuuuucugaacuguuugagcaaguugcuaacaucaggcucuuuugcgccuaaauacuuagguguguuuuuccuaaaaacaagagcauucucuuaacugaccuacacaaugauuaaauucacucucuaaugugcaguccguauucaaaguucaccgaugucccgauaauguccuuuauagauuccaccccccaccaccccaaucugggauccaguccaggauuauguauugcguuuaaucaucaugucucuaguuuccacaaauguagaacguuccucagacuuucuuugucuuuaguggcacugggaguuuugaugaguccaguuguuuugcagacugucccucaauuugggauugucucauuagauuagaugcagggaugcaucuuugcaggaaugucuuaaaagcaauguuauucuucucagcacaucacaccaggaagugcaugaugucaguuucuuccauccucagugccgucuucugccuuucaauucacuguccucacucugacuucucuuguuuguucuagaacuuugcuccccagcugucuuauggcuaugaugagaaaucaaccggaggaauuuccgugccuggccccauggugagccagcagggggagcauggaugacagaagagagaauggguauccagaggaggugggcauaggcggcugguauagacagcuugggagguccagaucaccuuugggaccucagaguccagaaaggaugcaggacgacuggguggucccaacaggcaugaaugacuacauccacaugcuuuccuacagagggaucaccaugaccccccuuucuucucccucuauagggucccucugguccucguggucucccuggccccccuggugcaccugugaguauccaggacgucuucauaugccuccuugggcuuuggucuuuuggagggaagacugggaugagggcaggagagaugcucagagaucucuugguaagauuggagaagguugacagggacuugucuucuaacccaucuuuuuccuucuucucaaggguccccaaggcuuccaaggucccccuggugagccuggcgagccuggagcuucaguaagcacucucuauacagauucauacuccuucuacaaacacacagacucuccuauagaagaacucccaggccuggggucuuccuuaccucuucccuucaaucccagccuuccccuucuuuuuuucuuauccauauucuaaccaccucuucuaucuuuucuagggucccauggguccccgaggucccccaggucccccuggaaagaauggagaugauguaaguauccccagcaagaagauaccaucugaccccauggccuccauggguuggguccugcaauuuccacuccaccacauuugggaacgauacucagaggaaggagggcaaguccucucugaugcacggacugcccuggaacaaugaucuuuucgcuuagugagaugauuccauguccccaacaaagugacuguucuccucaccccagccaccuuagagcaauccccaaccccaucccuuuggggaaauuggugcgcagauggugaaauuaaaaugcuggugacagaaguagacagaaauuccuuuagaggcacucagauuucaccaaacgaagguuucacuguagauuuaaacugagcucuagauucaaagauaagauucugggcccccaaaccugaccugcaacaauccaaagaagacugagaccuucuccacuuuuccagccccuaggcggugguggggaggcagaggcaugauggucuuuucucucccucucagggggaagcuggaaaaccuggucguccuggugagcgugggccuccugggccucaggugagcagggggcuguggcugaaccugggcuucacugcacuugggcuucauuuaggagcuggguccacagugauguguucuaauggcccuuccuugucuucuucaucucucuccagggugcucgaggauugcccggaacagcuggccucccuggaaugaagggacacagagugagucaccuuugagucauuuaagcuccccaagucccuagcauacccccauccagucccaaccucuuccccaaaagauacugaguugcaucaugguggguggcagcuacagaagucccaagggacagagaguggacauccaaaagcaccucccuccaugggaaagcagucccgauuaaacgauugggugagaucuagagccaguugggguuuagucuagcucagaaacaaagggauggcggugaugaccucccaaggcucuuucucagaucuagguggaugucaaggcuguuccacccccuccacagguucuuaccuucuaccucuuuccugcuuuaggguuucagugguuuggauggugccaagggagaugcugguccugcugguccuaagguaagaggcugucugaacaucaugguccuccacauccccagagucccaccaugaaugaauuucucacucauuauucucugaucuacagggugagccuggcagcccuggugaaaauggagcuccuggucagauggugagugugcccaguuccagagggcagggauggggcaggaggcaggggcaagauggaggccugggggaacaaggcugucucccaucucaucugacuucucuugguuugguugucagggcccccguggccugccuggugagagaggucgcccuggagccccuggcccugcuguaaguacuccuggccccuugggggaucccugagcucuggaaggggcuccccaggaacucuagggacuggccagugcucaguggacuuaacggggcuuccccucucuccugcagggugcucguggaaaugauggugcuacuggugcugccgggcccccugugaguguggccuguaggccucagggccugggaguggggaggggucucaguaucugcucuuggggcugacaaugggagcagguuauguuggucugaaccccaggacuuccucugucccagggugugacuugcagcugccaucucuuccuucucgcugacaucuccauuucauucacagggucccaccggccccgcugguccuccuggcuucccuggugcuguuggugcuaaggugagaccccccacucuccucuaagcaugacccucaugggccaagggguucaugucucccuguuccccaaaccaaagggacccagaguggcaagagagcagcccguucacuaacaccuuuguccuggguucuccgucucugaucuuagaguccugaucauugcucuccugucccugucuccccuuccuccugccaucccgagaggcaagguuggguuucccaggguggcuucugauauguccuuucuucugauucagggugaagcugguccccaagggccccgaggcucugaagguccccagggugugcguggugagccuggccccccuggcccugcuggugcugcuggcccugcuguaaguguccccgacucaguguccccuuugccacuuucuaaccucagaguccuugccuguugcugacacuccuuucucugugccacagggaaacccuggugcugauggacagccuggugcuaaaggugccaauguaaguauccugccaggcuucagucccacuccugccgccugcagccugccugccccuuucccucugcuccuaggcucacgcccuggcugucugccucccacagggugcuccugguauugcuggugcuccuggcuucccuggugcccgaggccccucuggaccccagggccccggcggcccuccuggucccaaggguaacagcgugaguaccaaacucucccuucugcccaccccaugcacuggcuccagugcggcucucaucuggggagcaggaagacgcaggccaacugagcgcccccgacucucagcucauccucuucuccccccuugcagggugaaccuggugcuccuggcagcaaaggagacacuggugcuaagggagagccuguaagucuccccgccauccuucuugcagcccagcccacccugcccuaggagcccccugagggaaauccagaaaggaagaggagccccuagucuucugggggagucccugccacacccccaggaaccccugacacuggaggcccagccucagccggcucugaggcuggcacaggauggccccucaccacaggccgccuccuccucucggcccucuccagggcccuguugguguucaaggacccccuggcccugcuggagaggaaggaaagcgaggagcucgaggugaacccggacccacuggccugcccggacccccuggcgagcguguaagugucccugcccgcccccucccgcuccacccucauugccuggcuggugccugugugucgcggaguucacuggccuccucuccuccugcaggguggaccugguagccgugguuucccuggcgcagaugguguugcuggucccaagguaaccucuccuugcggccggggggcugacccugccgcucccugggcaucuucuuccucuuuuggcccguggcaaagagccacaaacuugagacccuaacuguuccugugacuucccccaaccagggucccgcuggugaacgugguucuccuggcccugcuggccccaaaggaucuccuggugaagcuggucgucccggugaagcuggucugccuggugccaaggugaggccccaggcuuucagccuggcuuggccaggcccugaccaucccguguagggucugggaugaggcguucuggaucaggcccaagggucugcccucuggaguccucccccaccuccaucaugcuucuccccaagucccacucauaccucucugccucccuagggucugacuggaagcccuggcagcccugguccugauggcaaaacuggccccccuguaaguaucacucccccugaacccccugccauuguccugucugccucccugcuguccucacugcugcuuucgugccucccauccuuagggucccgccggucaagauggucgccccggacccccaggcccaccuggugcccguggucaggcuggugugaugggauucccuggaccuaaaggugcugcugugaguauuaagugaggauccaugaagagccagggacaaacacaccugagacuugaaggaguccugggcucugggcucagcugugccgcugaccugccguguggccacucacucucacuuucuggaccucagccucccuaucuguaaaaugaaagacuucucggcggggcacgguggcucaugccuguaaucccagcacuuugggaggccaaggcgggcagaccaugaggucaggaguuugagaccagucgggccaacauagugaaaccacgucucuacuaaaaauacaaaagauuagcugggugugguggugugcaccuguaaccccagcuagucaggaggcugaggcaggagaauugcaugaacccgggagguggagguugcagugagcugagaucacgccauugcacuccagccugggcaacagugcgagauuccaucucaaaaaaaaaaaaaaagaagaaagaaagaaagaaaaaaugaaacacuucuccaggcuccaugaccacugcucuguccuggaaauaaguguuguugguggcccuccaccccgacacguggggauaggacaggccuuugauaugauaggcacccccagucuugguggauucuuugagguccaaaaggagauagcagagaagaugaaagcccuuugcagugcaggccacagcgggcaucuaacagggaaaaggcagaggagccuggaagggcaucuugggaggagugggcucagaaagggcccagcaagaagcaccugcaggggcauuccccgggggccaaacagucuuuugaaaagaaagucccuuaaaaagucccacucagaguaaaugagaggccccaggaggcccuggcuucucacuucagcccccucaacccuaacucccuuucuccacagggagagcccggcaaggcuggagagcgagguguucccggacccccuggcgcugucguaaguaucuccuuuccaucccuaccuccuucccauugcugccccggcacuuucuccucccugcaggaggggugcuagaggccacgguccucagcugcucggggccuccuaacccugaguuccccuuugcucucucccugcaggguccugcuggcaaagauggagaggcuggagcucagggacccccuggcccugcugugagugucccugauggggagaucuggggagcagaaaaggggagacacccucagccccucgucuccucggccuccccgugacuguaguguucucucugugcagggucccgcuggcgagagaggugaacaaggcccugcuggcucccccggauuccaggugaggccucauggcugucaggaugcugggagguagggguaggaaacaccucuuuggucucuuccagauucuaaaccuucccucccuucuucccccauuucccaccuacagggucucccugguccugcugguccuccaggugaagcaggcaaaccuggugaacagguaagagggagcagccggccagaggggugggagaugcagggaauccagagggacaggcccccgcuccuagcuaaucagacagccaucaacuagagggauugagguuagacgccggaaagaacuuccucccaugaagggagcagcacagagggaagugggggcugcaugauugcuagucugggugacuucuuuuaagagcugcuggaauaugcugugacuuucccucaacccuucuauugauaaaucuugguccauaguuuggggaggggggaagccuuugacacaucccuaggaggaagagaggggcuguuugggauaaucucaauucagugcugagaagggguuccucucuaaucacggccagaccccaggaggaaggaccgugcuuuccagcagaguggccccagguggguuuugcucacugucuguuccucucucccucccccucaggguguuccuggagaccuuggcgccccuggccccucuggagcaagaguaaguaggccucucucgcugcauccgucaaggugcgucguacuuggcccuaucuccagagcagccuucacaugcccuguccuucccuucuagggcgagagagguuucccuggcgagcguggugugcaaggucccccugguccugcugguccccgaggggccaacggugcucccggcaacgauggugcuaaggugagggcagcguggaaggggcucuggcaaguggcccagggaccaggucucaccccuccugcagcaggggauggcgggccaugaccaaagccauggagauagggugugggguggggggaaaagaccagggcaggggcccacacacagccuggagucugggcugugagucuuuucaucuuuucucaaggcuugucguuggccuuggaaacaagccugggagauaccaagcggggcuuagggcugugacccacucuuggggccccaggccucacuccagucuucuugguugucacauagggugaugcuggugccccuggagcucccgguagccagggcgccccuggccuucagggaaugccuggugaacguggugcagcuggucuuccagggccuaagggugacagaguaaguucaaccuucccccuccccugagcccuacauggcucccaucucugccugcuuugaaucucucagcaucucuccuucucucugggaucugucccucuucucgcuaauccucccuucuuccccuuuccccucuggccuuuuugcugaugaauccucucccugugguccaggcccaucuauccccauggguuaccauggugaugagaggugggggcaucuccuugguggaggcucccuuauucaucccgcuacacaagucaggggccucuuaaccucaguuccaccugagucuccaggcaggcacccuuuuuccugaaagaaucuuugaguccuuggcccagguggaggcagggcagagcugcagagggccucucaggaaacccagacacaagcagaacacuauaggucaccuccuugccccacacuggaaaucucaagcuuauccaugucuuuagggugaugcuggucccaaaggugcugauggcucuccuggcaaagauggcguccguggucugacuggccccauugguccuccuggcccugcuggugccccuggugacaaggugagguggccgccuccccaccuucugcccuaacacauagccuccucagcaggccugggcacgguuccgugggguugcguugggagagcagguccugccaaacugagcugucaaccugggaaccuggagggaccagaaggaggggaggcucuccuggggucaucuacuaggaguauucaggggaggcccugacccugagccucuugucccuugcucucagggugaaaguggucccagcggcccugcuggucccacuggagcucguggugcccccguaaguacagaagaccuguuaagaccccauacuuggcccuucccucccuucacacagcaccccuggcccugucugugccuucaccccuugccucuccccucaccgcauccccgccuucccuccugucagcgcaucucuccaaucugacuccuuuucuucuagggagaccguggugagccugguccccccggcccugcuggcuuugcuggccccccugugaguaccaagacccccaucauuuuucaucaccgacugggaccugggaccucgagggacggaaugaggacaaaggcgucagccauccucaggggagaaggguggagacgggauuguuucccacccaagcaucuuccugccuccauuacugcuccucccccagguaguggaaacuccugccuccuucccuccauucaccgcccugcuuccucccccagggugcugacggccaaccuggugcuaaaggcgaaccuggugaugcuggugcuaaaggcgaugcuggucccccuggcccugccggacccgcuggacccccuggccccauugugaguggcuuggcccucugugcccacgaggcuggugggcugggacccaggacggguccaggcuugaugccucugugcucuccuacaggguaauguuggugcuccuggagccaaaggugcucgcggcagcgcuggucccccugugaguaucacccgccucucuguugagccucuccccucuccccaggcagcgguggcaggugagggcagcugggucggaugaguuggcuguucucccucugacuguuccuauguucucuccuuccagggugcuacugguuucccuggugcugcuggccgagucgguccuccuggccccucuguaagucucugcagcagaguccacugcucuagguugggggugcugggugggggcugccagaaggaugguggggcugacugaggacccaaugaugcaccagagcccccuggagucugacagccccuccuauccucauccagggaaaugcuggacccccuggcccuccugguccugcuggcaaagaaggcggcaaagguccccguggugagacuggcccugcuggacguccuggugaaguuggucccccuggucccccuggcccugcuggcgagaaaggauccccuggugcugaugguccugcuguaagugccagcucagaucucugcagcuccggaggugugcagagcuggggaggggucccugugcugcucucuggcaccucaccccuguuugccucccaaagggugcuccugguacucccgggccucaagguauugcuggacagcgugguguggucggccugccuggucagagaggagagagaggcuucccuggucuuccuggccccucuguaagugccccccucaccuuggggggcccugagaaaaaccaucacaggacuuggaguggggcggagccaaggagaacagauuugguagagaugacuccagcggacucaaggguccucccagacccuaucucuggccugacucuuucuucucccuuagggugaaccuggcaaacaaggucccucuggagcaaguggugaacguggucccccuggucccaugggccccccuggauuggcuggacccccuggugaaucuggacgugaggugagcaguccccagcccccaugccaguacccucagcauggccauuguggccuugccuaagcccucuuccccggcugacucucacuucucucucucucucucugcagggggcuccuggugccgaagguuccccuggacgagacgguucuccuggcgccaagguaagauggcaacacuccaugaccacagccuugucugcugcuucccugccccauccuggcccuucacccggggcugacccauauuccccugcucuccccgccagggugaccguggugagaccggccccgcuggacccccuggugcuccuggugcuccuggugccccuggccccguuggcccugcuggcaagaguggugaucguggugagacuguaaguagcugggcuccaguucccuguaccuggucaggccagggacucuucaggccuccuuagaggccuggggaugggugucggacuucacccaggcagggggaggaaaggagauccugcaagaugucagggccuuaauccaaaaaacugaguuaaagcucagccccaaguccccucucccagacaggaccgccucucccaugaguuggccccagcucccgugaagauugcaguggggagguuucccugggaguugggagagauggccacagugggaagcagcugaggagagagagauccagcagaggggaggccucauccugcagccccagccucagccuucccuggccaagagcucaugcuuuccuugcucuccccaggguccugcuggucccaccgguccugucggcccuguuggcgcccguggccccgccguaaguacccugcugugucccccaugccuuuagaacucuacagaugcagacagugccccacucgaugccaauggaacuuccgccugacaguuugucccuuucucucuucuagggaccccaaggcccccguggugacaagggugagacaggcgaacagggcgacagaggcauaaagggucaccguggcuucucuggccuccagggucccccuggcccuccuguaaguaugcucagccccuccccaguccccaugcugugcugugggauaggagggggagcuucgccucaguuucccccucuggauagucauucuuuccccucccuaguggggacuggggucugaagauuugugggcauguccaaguagcuucugagagggugagggguacacagagagggauuaugggagaggucucugccuauggacacccucgggcuagauuuccagaauaaugaaggggcauggguugcccacacugcccuugucucuccagccaggcccucaggcuacauuugacgcucacugggccugaacugccuuuuuuaucuguccuucagggcucuccuggugaacaaggucccucuggagccucugguccugcugguccccgaguaagucaugccuucucucuccucuuccugagccccaagcccaggcucaccucggggacccuugccagggacccaggcacccuuugccucucuggagaaggguucagggacagggagugggcaaagagaggaagaauccugaacaaacaaucugaucuagcuuuggccucucugcuccccaauccguccuccccuggcucagcggcugggaggagcuauggcauguccuauggaaagaggcugaggcuggcucuaugagccguggggccagagccagcagggaggguggugggccucuccuccagagcugggguuguucgggcuucuggcagccuuucucaaaccauuucccccacuccagggucccccuggcucugcuggugcuccuggcaaagauggacucaacggucucccuggccccauugggcccccugguccucgcggucgcacuggugaugcugguccuguuguauguagccccucauccccucugcucauggcccuccagcccccaaagcacuuggaugccgguaauccccacucucuucccucucugugcaggguccccccggcccuccuggaccuccuggucccccugguccucccagcgcugguuucgacuucagcuuccugccccagccaccucaagagaaggcucacgaugguggccgcuacuaccgggcugaugaugccaaugugguucgugaccgugaccucgagguggacaccacccucaagagccugagccagcagaucgagaacauccggagcccagagggcagccgcaagaaccccgcccgcaccugccgugaccucaagaugugccacucugacuggaagaguggugagggccugcccuagccucucccucccuccuacuccugccaugccaggguccccaugcccauaugugccccuaccauauggugcuggcugcucccuuucccugacuccaucuugcccugcccuaccacaggagaguacuggauugaccccaaccaaggcugcaaccuggaugccaucaaagucuucugcaacauggagacuggugagaccugcguguaccccacucagcccaguguggcccagaagaacugguacaucagcaagaaccccaaggacaagaggcaugucugguucggcgagagcaugaccgauggauuccaggugcgugagcuggaccucagagccaguguuaggagaugggcuagcccagugcucagaagggacaugaaguccuggaguaggucucugcuaagggugauggacagagcugggcugggaggcaggggucucaggucccugauagugguucagacacaggcugccgaugggcagguggugccuccucucgauauaacggugcauugggcagcucucugaggacccuggacagggaggccaggcaggacuagagguucccgcauagcggcucacucuucccucucuccccuccccugcaguucgaguauggcggccagggcuccgacccugccgauguggccauccagcugaccuuccugcgccugauguccaccgaggccucccagaacaucaccuaccacugcaagaacagcguggccuacauggaccagcagacuggcaaccucaagaaggcccugcuccuccagggcuccaacgagaucgagauccgcgccgagggcaacagccgcuucaccuacagcgucacugucgauggcugcacggugagugcccagaauccccaggcagggccccaccucuccggccuugggcuuuuuggccaggccauagugcccucucuccaucacucccacgugguaaugcccccucccguugucuccgccccaccccagagucacaccggagccuggggcaagacagugauugaauacaaaaccaccaagaccucccgccugcccaucaucgauguggcccccuuggacguuggugccccagaccaggaauucggcuucgacguuggcccugucugcuuccuguaaacucccuccaucccaaccuggcucccucccacccaaccaacuuuccccccaacccggaaacagacaagcaacccaaacugaacccccucaaaagccaaaaaaugggagacaauuucacauggacuuuggaaaauauuuuuuuccuuugcauucaucucucaaacuuaguuuuuaucuuugaccaaccgaacaugaccaaaaaccaaaagugcauucaaccuuaccaaaaaaaaaaaaaaaaaaagaauaaauaaauaacuuuuuaaaaaaggaagcuugguccacuugcuugaagacccaugcggggguaagucccuuucugcccguugggcuuaugaaaccccaaugcugcccuuucugcuccuuucuccacaccccccuuggggccuccccuccacuccuucccaaaucugucuccccagaagacacaggaaacaauguauugucugcccagcaaucaaaggcaaugcucaaacacccaaguggcccccacccucagcccgcuccugcccgcccagcacccccaggcccugggggaccugggguucucagacugccaaagaagccuugccaucuggcgcucccauggcucuugcaacaucuccccuucguuuuugagggggucaugccgggggagccaccagccccucacuggguucggaggagagucaggaagggccacgacaaagcagaaacaucggauuuggggaacgcgugucaaucccuugugccgcagggcugggcgggagagacuguucuguuccuuguguaacuguguugcugaaagacuaccucguucuugucuugaugugucaccggggcaacugccugggggcggggaugggggcaggguggaagcggcuccccauuuuauaccaaaggugcuacaucuaugugaugggugggguggggagggaaucacuggugcuauagaaauugagaugcccccccaggccagcaaauguuccuuuuuguucaaagucuauuuuuauuccuugauauuuuucuuuuuuuuuuuuuuuuuuuguggauggggacuugugaauuuuucuaaaggugcuauuuaacaugggaggagagcgugugcggcuccagcccagcccgcugcucacuuuccacccucucuccaccugccucuggcuucucaggccucugcucuccgaccucucuccucugaaacccuccuccacagcugcagcccauccucccggcucccuccuagucuguccugcguccucuguccccggguuucagagacaacuucccaaagcacaaagcaguuuuucccccuaggggugggaggaagcaaaagacucuguaccuauuuuguauguguauaauaauuugagauguuuuuaauuauuuugauugcuggaauaaagcauguggaaaugacccaaaca

SEQ ID NO: 16769 - RNA, 17637 nt, Homo sapiens
uguuugggucauuuccacaugcuuuauuccagcaaucaaaauaauuaaaaacaucucaaauuauuauacacauacaaaauagguacagagucuuuugcuuccucccaccccuagggggaaaaacugcuuugugcuuugggaaguugucucugaaacccggggacagaggacgcaggacagacuaggagggagccgggaggaugggcugcagcuguggaggaggguuucagaggagagaggucggagagcagaggccugagaagccagaggcagguggagagaggguggaaagugagcagcgggcugggcuggagccgcacacgcucuccucccauguuaaauagcaccuuuagaaaaauucacaaguccccauccacaaaaaaaaaaaaaaaaaaagaaaaauaucaaggaauaaaaauagacuuugaacaaaaaggaacauuugcuggccugggggggcaucucaauuucuauagcaccagugauucccuccccaccccacccaucacauagauguagcaccuuugguauaaaauggggagccgcuuccacccugcccccauccccgcccccaggcaguugccccggugacacaucaagacaagaacgagguagucuuucagcaacacaguuacacaaggaacagaacagucucucccgcccagcccugcggcacaagggauugacacgcguuccccaaauccgauguuucugcuuugucguggcccuuccugacucuccuccgaacccagugaggggcugguggcucccccggcaugacccccucaaaaacgaaggggagauguugcaagagccaugggagcgccagauggcaaggcuucuuuggcagucugagaaccccaggucccccagggccugggggugcugggcgggcaggagcgggcugagggugggggccacuuggguguuugagcauugccuuugauugcugggcagacaauacauuguuuccugugucuucuggggagacagauuugggaaggaguggaggggaggccccaagggggguguggagaaaggagcagaaagggcagcauugggguuucauaagcccaacgggcagaaagggacuuacccccgcaugggucuucaagcaaguggaccaagcuuccuuuuuuaaaaaguuauuuauuuauucuuuuuuuuuuuuuuuuuuugguaagguugaaugcacuuuugguuuuuggucauguucgguuggucaaagauaaaaacuaaguuugagagaugaaugcaaaggaaaaaaauauuuuccaaaguccaugugaaauugucucccauuuuuuggcuuuugaggggguucaguuuggguugcuugucuguuuccggguuggggggaaaguugguugggugggagggagccagguugggauggagggaguuuacaggaagcagacagggccaacgucgaagccgaauuccuggucuggggcaccaacguccaagggggccacaucgaugaugggcaggcgggaggucuuggugguuuuguauucaaucacugucuugccccaggcuccggugugacucugggguggggcggagacaacgggagggggcauuaccacgugggagugauggagagagggcacuauggccuggccaaaaagcccaaggccggagagguggggcccugccuggggauucugggcacucaccgugcagccaucgacagugacgcuguaggugaagcggcuguugcccucggcgcggaucucgaucucguuggagcccuggaggagcagggccuucuugagguugccagucugcugguccauguaggccacgcuguucuugcagugguaggugauguucugggaggccucgguggacaucaggcgcaggaaggucagcuggauggccacaucggcagggucggagcccuggccgccauacucgaacugcaggggaggggagagagggaagagugagccgcuaugcgggaaccucuaguccugccuggccucccuguccaggguccucagagagcugcccaaugcaccguuauaucgagaggaggcaccaccugcccaucggcagccugugucugaaccacuaucagggaccugagaccccugccucccagcccagcucuguccaucacccuuagcagagaccuacuccaggacuucaugucccuucugagcacugggcuagcccaucuccuaacacuggcucugagguccagcucacgcaccuggaauccaucggucaugcucucgccgaaccagacaugccucuuguccuugggguucuugcugauguaccaguucuucugggccacacugggcugagugggguacacgcaggucucaccagucuccauguugcagaagacuuugauggcauccagguugcagccuugguuggggucaauccaguacucuccugugguagggcagggcaagauggagucagggaaagggagcagccagcaccauaugguaggggcacauaugggcauggggacccuggcauggcaggaguaggagggagggagaggcuagggcaggcccucaccacucuuccagucagaguggcacaucuugaggucacggcaggugcgggcgggguucuugcggcugcccucugggcuccggauguucucgaucugcuggcucaggcucuugagggugguguccaccucgaggucacggucacgaaccacauuggcaucaucagcccgguaguagcggccaccaucgugagccuucucuugagguggcuggggcaggaagcugaagucgaaaccagcgcugggaggaccagggggaccaggagguccaggagggccggggggacccugcacagagagggaagagaguggggauuaccggcauccaagugcuuugggggcuggagggccaugagcagaggggaugaggggcuacauacaacaggaccagcaucaccagugcgaccgcgaggaccagggggcccaauggggccagggagaccguugaguccaucuuugccaggagcaccagcagagccagggggacccuggagugggggaaaugguuugagaaaggcugccagaagcccgaacaaccccagcucuggaggagaggcccaccacccucccugcuggcucuggccccacggcucauagagccagccucagccucuuuccauaggacaugccauagcuccucccagccgcugagccaggggaggacggauuggggagcagagaggccaaagcuagaucagauuguuuguucaggauucuuccucucuuugcccacucccugucccugaacccuucuccagagaggcaaagggugccugggucccuggcaaggguccccgaggugagccugggcuuggggcucaggaagaggagagagaaggcaugacuuacucggggaccagcaggaccagaggcuccagagggaccuuguucaccaggagagcccugaaggacagauaaaaaaggcaguucaggcccagugagcgucaaauguagccugagggccuggcuggagagacaagggcagugugggcaacccaugccccuucauuauucuggaaaucuagcccgaggguguccauaggcagagaccucucccauaaucccucucuguguaccccucacccucucagaagcuacuuggacaugcccacaaaucuucagaccccaguccccacuagggaggggaaagaaugacuauccagagggggaaacugaggcgaagcucccccuccuaucccacagcacagcauggggacuggggaggggcugagcauacuuacaggagggccagggggacccuggaggccagagaagccacggugacccuuuaugccucugucgcccuguucgccugucucacccuugucaccacgggggccuuggggucccuagaagagagaaagggacaaacugucaggcggaaguuccauuggcaucgaguggggcacugucugcaucuguagaguucuaaaggcaugggggacacagcaggguacuuacggcggggccacgggcgccaacagggccgacaggaccggugggaccagcaggacccuggggagagcaaggaaagcaugagcucuuggccagggaaggcugaggcuggggcugcaggaugaggccuccccucugcuggaucucucucuccucagcugcuucccacuguggccaucucucccaacucccagggaaaccuccccacugcaaucuucacgggagcuggggccaacucaugggagaggcgguccugucugggagaggggacuuggggcugagcuuuaacucaguuuuuuggauuaaggcccugacaucuugcaggaucuccuuuccucccccugccugggugaaguccgacacccauccccaggccucuaaggaggccugaagagucccuggccugaccagguacagggaacuggagcccagcuacuuacagucucaccacgaucaccacucuugccagcagggccaacggggccaggggcaccaggagcaccaggagcaccaggggguccagcggggccggucucaccacggucacccuggcggggagagcaggggaauaugggucagccccgggugaagggccaggauggggcagggaagcagcagacaaggcuguggucauggaguguugccaucuuaccuuggcgccaggagaaccgucucguccaggggaaccuucggcaccaggagcccccugcagagagagagagagagaagugagagucagccggggaagagggcuuaggcaaggccacaauggccaugcugaggguacuggcaugggggcuggggacugcucaccucacguccagauucaccaggggguccagccaauccaggggggcccaugggaccagggggaccacguucaccacuugcuccagagggaccuuguuugccagguucacccuaagggagaagaaagagucaggccagagauagggucugggaggacccuugaguccgcuggagucaucucuaccaaaucuguucuccuuggcuccgccccacuccaaguccugugaugguuuuucucagggccccccaaggugaggggggcacuuacagaggggccaggaagaccagggaagccucucucuccucucugaccaggcaggccgaccacaccacgcuguccagcaauaccuugaggcccgggaguaccaggagcacccuuugggaggcaaacaggggugaggugccagagagcagcacagggaccccuccccagcucugcacaccuccggagcugcagagaucugagcuggcacuuacagcaggaccaucagcaccaggggauccuuucucgccagcagggccagggggaccagggggaccaacuucaccaggacguccagcagggccagucucaccacggggaccuuugccgccuucuuugccagcaggaccaggagggccaggggguccagcauuucccuggaugaggauaggaggggcugucagacuccagggggcucuggugcaucauuggguccucagucagccccaccauccuucuggcagcccccacccagcacccccaaccuagagcaguggacucugcugcagagacuuacagaggggccaggaggaccgacucggccagcagcaccagggaaaccaguagcacccuggaaggagagaacauaggaacagucagagggagaacagccaacucauccgacccagcugcccucaccugccaccgcugccuggggagaggggagaggcucaacagagaggcgggugauacucacagggggaccagcgcugccgcgagcaccuuuggcuccaggagcaccaacauuacccuguaggagagcacagaggcaucaagccuggacccguccugggucccagcccaccagccucgugggcacagagggccaagccacucacaauggggccaggggguccagcggguccggcagggccagggggaccagcaucgccuuuagcaccagcaucaccagguucgccuuuagcaccagguuggccgucagcacccugggggaggaagcagggcggugaauggagggaaggaggcaggaguuuccacuaccugggggaggagcaguaauggaggcaggaagaugcuugggugggaaacaaucccgucuccacccuucuccccugaggauggcugacgccuuuguccucauuccgucccucgaggucccaggucccagucggugaugaaaaaugaugggggucuugguacucacaggggggccagcaaagccagcagggccggggggaccaggcucaccacggucucccuagaagaaaaggagucagauuggagagaugcgcugacaggagggaaggcggggaugcggugaggggagaggcaaggggugaaggcacagacagggccaggggugcugugugaagggagggaagggccaaguauggggucuuaacaggucuucuguacuuacgggggcaccacgagcuccagugggaccagcagggccgcugggaccacuuucacccugagagcaagggacaagaggcucagggucagggccuccccugaauacuccuaguagaugaccccaggagagccuccccuccuucuggucccuccagguucccagguugacagcucaguuuggcaggaccugcucucccaacgcaaccccacggaaccgugcccaggccugcugaggaggcuauguguuagggcagaagguggggaggcggccaccucaccuugucaccaggggcaccagcagggccaggaggaccaauggggccagucagaccacggacgccaucuuugccaggagagccaucagcaccuuugggaccagcaucacccuaaagacauggauaagcuugagauuuccaguguggggcaaggaggugaccuauaguguucugcuugugucuggguuuccugagaggcccucugcagcucugcccugccuccaccugggccaaggacucaaagauucuuucaggaaaaagggugccugccuggagacucagguggaacugagguuaagaggccccugacuuguguagcgggaugaauaagggagccuccaccaaggagaugcccccaccucucaucaccaugguaacccauggggauagaugggccuggaccacagggagaggauucaucagcaaaaaggccagaggggaaaggggaagaagggaggauuagcgagaagagggacagaucccagagagaaggagagaugcugagagauucaaagcaggcagagaugggagccauguagggcucaggggagggggaagguugaacuuacucugucacccuuaggcccuggaagaccagcugcaccacguucaccaggcauucccugaaggccaggggcgcccuggcuaccgggagcuccaggggcaccagcaucacccuaugugacaaccaagaagacuggagugaggccuggggccccaagagugggucacagcccuaagccccgcuugguaucucccaggcuuguuuccaaggccaacgacaagccuugagaaaagaugaaaagacucacagcccagacuccaggcugugugugggccccugcccuggucuuuuccccccaccccacacccuaucuccauggcuuuggucauggcccgccauccccugcugcaggaggggugagaccuggucccugggccacuugccagagccccuuccacgcugcccucaccuuagcaccaucguugccgggagcaccguuggccccucggggaccagcaggaccagggggaccuugcacaccacgcucgccagggaaaccucucucgcccuagaagggaaggacagggcaugugaaggcugcucuggagauagggccaaguacgacgcaccuugacggaugcagcgagagaggccuacuuacucuugcuccagaggggccaggggcgccaaggucuccaggaacacccugagggggagggagagaggaacagacagugagcaaaacccaccuggggccacucugcuggaaagcacgguccuuccuccuggggucuggccgugauuagagaggaaccccuucucagcacugaauugagauuaucccaaacagccccucucuuccuccuagggaugugucaaaggcuuccccccuccccaaacuauggaccaagauuuaucaauagaaggguugagggaaagucacagcauauuccagcagcucuuaaaagaagucacccagacuagcaaucaugcagcccccacuucccucugugcugcucccuucaugggaggaaguucuuuccggcgucuaaccucaaucccucuaguugauggcugucugauuagcuaggagcgggggccugucccucuggauucccugcaucucccaccccucuggccggcugcucccucuuaccuguucaccagguuugccugcuucaccuggaggaccagcaggaccagggagacccuguaggugggaaaugggggaagaagggagggaagguuuagaaucuggaagagaccaaagagguguuuccuaccccuaccucccagcauccugacagccaugaggccucaccuggaauccgggggagccagcagggccuuguucaccucucucgccagcgggacccugcacagagagaacacuacagucacggggaggccgaggagacgaggggcugagggugucuccccuuuucugcuccccagaucuccccaucagggacacucacagcagggccagggggucccugagcuccagccucuccaucuuugccagcaggacccugcagggagagagcaaaggggaacucaggguuaggaggccccgagcagcugaggaccguggccucuagcaccccuccugcagggaggagaaagugccggggcagcaaugggaaggagguagggauggaaaggagauacuuacgacagcgccaggggguccgggaacaccucgcucuccagccuugccgggcucucccuguggagaaagggaguuaggguugagggggcugaagugagaagccagggccuccuggggccucucauuuacucugagugggacuuuuuaagggacuuucuuuucaaaagacuguuuggcccccggggaaugccccugcaggugcuucuugcugggcccuuucugagcccacuccucccaagaugcccuuccaggcuccucugccuuuucccuguuagaugcccgcuguggccugcacugcaaagggcuuucaucuucucugcuaucuccuuuuggaccucaaagaauccaccaagacugggggugccuaucauaucaaaggccuguccuauccccacgugucgggguggagggccaccaacaacacuuauuuccaggacagagcaguggucauggagccuggagaaguguuucauuuuuucuuucuuucuuucuucuuuuuuuuuuuuuuugagauggaaucucgcacuguugcccaggcuggagugcaauggcgugaucucagcucacugcaaccuccaccucccggguucaugcaauucuccugccucagccuccugacuagcugggguuacaggugcacaccaccacacccagcuaaucuuuuguauuuuuaguagagacgugguuucacuauguuggcccgacuggucucaaacuccugaccucauggucugcccgccuuggccucccaaagugcugggauuacaggcaugagccaccgugccccgccgagaagucuuucauuuuacagauagggaggcugagguccagaaagugagagugaguggccacacggcaggucagcggcacagcugagcccagagcccaggacuccuucaagucucagguguguuugucccuggcucuucauggauccucacuuaauacucacagcagcaccuuuagguccagggaaucccaucacaccagccugaccacgggcaccaggugggccuggggguccggggcgaccaucuugaccggcgggacccuaaggaugggaggcacgaaagcagcagugaggacagcagggaggcagacaggacaauggcaggggguucagggggagugauacuuacaggggggccaguuuugccaucaggaccagggcugccagggcuuccagucagacccuagggaggcagagagguaugagugggacuuggggagaagcaugauggaggugggggaggacuccagagggcagacccuugggccugauccagaacgccucaucccagacccuacacgggauggucagggccuggccaagccaggcugaaagccuggggccucaccuuggcaccaggcagaccagcuucaccgggacgaccagcuucaccaggagauccuuuggggccagcagggccaggagaaccacguucaccagcgggacccugguugggggaagucacaggaacaguuagggucucaaguuuguggcucuuugccacgggccaaaagaggaagaagaugcccagggagcggcagggucagccccccggccgcaaggagagguuaccuugggaccagcaacaccaucugcgccagggaaaccacggcuaccagguccacccugcaggaggagaggaggccagugaacuccgcgacacacaggcaccagccaggcaaugaggguggagcgggagggggcgggcagggacacuuacacgcucgccaggggguccgggcaggccaguggguccggguucaccucgagcuccucgcuuuccuuccucuccagcagggccaggggguccuugaacaccaacagggcccuggagagggccgagaggaggaggcggccuguggugaggggccauccugugccagccucagagccggcugaggcugggccuccagugucagggguuccuggggguguggcagggacucccccagaagacuaggggcuccucuuccuuucuggauuucccucagggggcuccuagggcagggugggcugggcugcaagaaggauggcggggagacuuacaggcucucccuuagcaccagugucuccuuugcugccaggagcaccagguucacccugcaaggggggagaagaggaugagcugagagucgggggcgcucaguuggccugcgucuuccugcuccccagaugagagccgcacuggagccagugcauggggugggcagaagggagaguuugguacucacgcuguuacccuugggaccaggagggccgccggggcccugggguccagaggggccucgggcaccagggaagccaggagcaccagcaauaccaggagcacccugugggaggcagacagccagggcgugagccuaggagcagagggaaaggggcaggcaggcugcaggcggcaggagugggacugaagccuggcaggauacuuacauuggcaccuuuagcaccaggcuguccaucagcaccaggguuucccuguggcacagagaaaggagugucagcaacaggcaaggacucugagguuagaaaguggcaaaggggacacugagucggggacacuuacagcagggccagcagcaccagcagggccaggggggccaggcucaccacgcacacccuggggaccuucagagccucggggcccuuggggaccagcuucacccugaaucagaagaaaggacauaucagaagccacccugggaaacccaaccuugccucucgggauggcaggaggaaggggagacagggacaggagagcaaugaucaggacucuaagaucagagacggagaacccaggacaaagguguuagugaacgggcugcucucuugccacucugggucccuuugguuuggggaacagggagacaugaaccccuuggcccaugagggucaugcuuagaggagaguggggggucucaccuuagcaccaacagcaccagggaagccaggaggaccagcggggccggugggacccugugaaugaaauggagaugucagcgagaaggaagagauggcagcugcaagucacacccugggacagaggaaguccugggguucagaccaacauaaccugcucccauugucagccccaagagcagauacugagaccccuccccacucccaggcccugaggccuacaggccacacucacagggggcccggcagcaccaguagcaccaucauuuccacgagcacccugcaggagagaggggaagccccguuaaguccacugagcacuggccagucccuagaguuccuggggagccccuuccagagcucagggaucccccaaggggccaggaguacuuacagcagggccaggggcuccagggcgaccucucucaccaggcaggccacgggggcccugacaaccaaaccaagagaagucagaugagaugggagacagccuuguucccccaggccuccaucuugccccugccuccugccccaucccugcccucuggaacugggcacacucaccaucugaccaggagcuccauuuucaccagggcugccaggcucacccuguagaucagagaauaaugagugagaaauucauucauggugggacucuggggauguggaggaccaugauguucagacagccucuuaccuuaggaccagcaggaccagcaucucccuuggcaccauccaaaccacugaaacccuaaagcaggaaagagguagaagguaagaaccuguggaggggguggaacagccuugacauccaccuagaucugagaaagagccuugggaggucaucaccgccaucccuuuguuucugagcuagacuaaaccccaacuggcucuagaucucacccaaucguuuaaucgggacugcuuucccauggagggaggugcuuuuggauguccacucucugucccuugggacuucuguagcugccacccaccaugaugcaacucaguaucuuuuggggaagagguugggacuggauggggguaugcuagggacuuggggagcuuaaaugacucaaaggugacucacucugugucccuucauuccagggaggccagcuguuccgggcaauccucgagcacccuggagagagaugaagaagacaaggaagggccauuagaacacaucacuguggacccagcuccuaaaugaagcccaagugcagugaagcccagguucagccacagcccccugcucaccugaggcccaggaggcccacgcucaccaggacgaccagguuuuccagcuucccccugagagggagagaaaagaccaucaugccucugccuccccaccaccgccuaggggcuggaaaaguggagaaggucucagucuucuuuggauuguugcaggucagguuugggggcccagaaucuuaucuuugaaucuagagcucaguuuaaaucuacagugaaaccuucguuuggugaaaucugagugccucuaaaggaauuucugucuacuucugucaccagcauuuuaauuucaccaucugcgcaccaauuuccccaaagggaugggguuggggauugcucuaagguggcuggggugaggagaacagucacuuuguuggggacauggaaucaucucacuaagcgaaaagaucauuguuccagggcaguccgugcaucagagaggacuugcccuccuuccucugaguaucguucccaaaugugguggaguggaaauugcaggacccaacccauggaggccauggggucagaugguaucuucuugcuggggauacuuacaucaucuccauucuuuccagggggaccugggggaccucggggacccaugggacccuagaaaagauagaagaggugguuagaauauggauaagaaaaaaagaaggggaaggcugggauugaagggaagagguaaggaagaccccaggccugggaguucuucuauaggagagucuguguguuuguagaaggaguaugaaucuguauagagagugcuuacugaagcuccaggcucgccaggcucaccagggggaccuuggaagccuuggggacccuugagaagaaggaaaaagauggguuagaagacaagucccugucaaccuucuccaaucuuaccaagagaucucugagcaucucuccugcccucaucccagucuucccuccaaaagaccaaagcccaaggaggcauaugaagacguccuggauacucacaggugcaccaggggggccagggagaccacgaggaccagagggacccuauagagggagaagaaaggggggucauggugaucccucuguaggaaagcauguggauguagucauucaugccuguugggaccacccagucguccugcauccuuucuggacucugaggucccaaaggugaucuggaccucccaagcugucuauaccagccgccuaugcccaccuccucuggauacccauucucucuucugucauccaugcucccccugcuggcucaccauggggccaggcacggaaauuccuccgguugauuucucaucauagccauaagacagcuggggagcaaaguucuagaacaaacaagagaagucagagugaggacagugaauugaaaggcagaagacggcacugaggauggaagaaacugacaucaugcacuuccuggugugaugugcugagaagaauaacauugcuuuuaagacauuccugcaaagaugcaucccugcaucuaaucuaaugagacaaucccaaauugagggacagucugcaaaacaacuggacucaucaaaacucccagugccacuaaagacaaagaaagucugaggaacguucuacauuuguggaaacuagagacaugaugauuaaacgcaauacauaauccuggacuggaucccagauugggguggugggggguggaaucuauaaaggacauuaucgggacaucggugaacuuugaauacggacugcacauuagagagugaauuuaaucauuguguaggucaguuaagagaaugcucuuguuuuuaggaaaaacacaccuaaguauuuaggcgcaaaagagccugauguuagcaacuugcucaaacaguucagaaaaaaaaagauacauauacauaaacagagacuaauaaagcacaugucacaaacugugaaggguaugugagaguuuccuguaggauucuugcaacuuuucuguaaguuugaaauuauuucaaaguauaaaauuaugucaucugccaaaaaacaaaaacaaaacaggggagaguggacacacaaggccucuccacuuacuccuccgaggccaggggguccgggagguccgggggguccgggggguccgggaaguccaggcuguccagggaugccaucucggccaggggggccugcgggucccugcagggggagagggcggggccggggugagcguggggccgagagccaugcccaccugcagccccccacagcccagagugcaacgcuuacccuugggccucgggggccagugucucccuugggucccugugggauugggggagaagaaacaagaggccagguuagagaagggaggacugugaggagucacgggccgcgcaggggcaaaauucgagggcaggagauuaccucgacgccggugguuucuuggucggugggugacucuaggggacgaagagacgcgcguuagagccaagguuugcuaaugcugcucccgucggcagaggccuccagcacggagggccagcgagcgccgaccacccccagccccagccccaggccccaggccccaggccccaggccccaggccccgagcgcagccgcaccugagccgucggggcagacgggacagcacucgcccucggggacuucggcgccggggcaguucuuggucucgucacagaucacgucaucgcacaacaccuugccguugucgcagacgcagauccggcagggcucggguuuccacacgucucggucaugguaccugaggccguucuguacgcaggugauuggugggacugggacaggcggaagaggggcguugucaguagugacugcaacccccagcuuaaccaccuuucccccgggucuaagaggcacacuuggauuuuucacuucccgccccuccccccguucuucuuuccucaaauccuuaaaagcucgccugcuccucaucagcgcgggugacagcgccgaggcgccuggccagggaggcuguaacucuuuccaguucucaggaauuuaaacaaagcuuuaguccgcgguggcuuccaacuccaaccucagcccauuggcgcugaagccaagugaaauaaaaaccacagggugagagggggagggcggggggagaauaggaggggccccaucgggagggcaggcucguggggaguggcuugcgugguagagacaggaggagggcgagggaggagagaagggagguccagcccucaucccgcccccauucccugggcaggugggguggcgggggcggggcuaggagaaugggagcggcugauuggaagggaggcccccccaagacuugaaauguaccucaaaauuaggagacacccuaaccuccagcaccuagacaucuuaaaagcccgcucucggggccauccccagucccccaaagccagccaaugccuccaggucacuuuuagccaaagaaccaaaaaguccgcaaauaguccagaaguuagcuaaccacucccaccgcgcuagcggcuccccagacggccacuaggugucgggcaacgcuaagcaauggggccggggcggggccgaccucaccggcccgacuaccucuuuaagaggcuugggcugccccaucccuggcuuuacuuuccagaucuagagguggggguccgcacccagcaauaacccgggucuucccgcuccggcuccugccccaguaagcguuggaccgggagacgcagugcucagcaucggucagcagggggcgcaaggaccccgccccgccgaguccgcgccaaaguuucucauccuccacccgcccacgcuccgcacccccuccgcggcugcccagcacccccacggccccagcaacacucuagcccgcagagagggcaaucuuuccuuaugaaucaucccacggccuuccugauugcuucuacaucuugggcuucaaaugccccgcucggcgcccccaucccaucuucgacgugcuuuccucacucugcacccagauccccacuuccccgguugcgcgcucgggauucucucuugcaccaacucacgccgcgcuccacccucaccucccgcucccggggcgcguucaaccccaaccucgccccagggugagcucccuccugucucagggcgccgaggaagagcccucaucaucucccuuccauucccgagucuccggaucauccacgucucguuuuaagccgcggcccccgggaccaagcgcaaggcgcgauauagaguauccuugcacucccaaaaguuugggacuuacugucuucgucuuggcccucgacuuggccuuccucuuggccgugcgucaggagggcgguggccgcuaagaggagcaggagccggagguccacaaagcugaacaugucuagacccuagacauguagacucuuuguggcuggggaggggguuagcguccgcucaugcguggccucacacuccgcgugccuccugcuccgaccccgaggagaaacucccgucugcuccgacgacuggcccgggccccuuuuauacuguccugauggagagcagggaggaacccugccccucggagagggggagccggccgcccgugccccagccaauca

SEQ ID NO: 16770 - RNA, 609 nt, Homo sapiens
aguugcagcuacuucucugcccgcgggagacgcggcgcaccggagucugcgcgggugggagcggcuccggggcggucccgccacgggacccacggggcuuccgccuccucugccggguccaucagggcucccgauuaguucauucauucaacaaacguccgccgagcagccggggcgccgaggcuggaggggacagcggugaacagaacccccgcccccuaacugcgcucaaggccagugggccagucgggggcucagacgaguggggaggcccucacgagccugggcgccaugggcccagcuaacagagggcacuucuugccggaagggagagcgcaccccuggcccggccuggguccaggcggccgcggcgggagcugggcugggggauucccagaggaugugauguguuggcuacaacugcgggccaggguagggaagugccaggggguguugggggugggagggcaagaggggaagauaaauugaagcuggggaggugcagggggcuugcacuuuauucuaccagccgcccaccccgccgcccacacacacacacacacacacacacacacgcgcgcgcgcgcacacacacaaaauuaagaggag

SEQ ID NO: 16771 - RNA, 19414 nt, Homo sapiens
uccucuuaauuuugugugugugcgcgcgcgcgcgugugugugugugugugugugugugugugggcggcggggugggcggcugguagaauaaagugcaagcccccugcaccuccccagcuucaauuuaucuuccccucuugcccucccacccccaacacccccuggcacuucccuacccuggcccgcaguuguagccaacacaucacauccucugggaaucccccagcccagcucccgccgcggccgccuggacccaggccgggccaggggugcgcucucccuuccggcaagaagugcccucuguuagcugggcccauggcgcccaggcucgugagggccuccccacucgucugagcccccgacuggcccacuggccuugagcgcaguuagggggcggggguucuguucaccgcuguccccuccagccucggcgccccggcugcucggcggacguuuguugaaugaaugaacuaaucgggagcccugauggacccggcagaggaggcggaagccccgugggucccguggcgggaccgccccggagccgcucccacccgcgcagacuccggugcgccgcgucucccgcgggcagagaaguagcugcaacuccgcuccccggccccagccgccuccuccccgccgcccucccccgcccccgcccccucgcucccucccgcucuuugucuccugggcgcccggcuucuccgccacgcgccccccaccccgacgccccuuccccggagacccccgcggaccccugccgacgcgacgccgcgcgaaucggcccugccaggcgggggccccgcguccggccaggccuggcgggcggcaggggcggggagggagguggcgcucgcucuucgcucuucucucucucucucucucugucacacacacacacacgcacacgcacacgcacacacacacggagcauccucccgucaggucuccugguccagccccgcccgcgccuccugcuuccagcgaaccuguucccucuccccacaucccccgcccuccaucucccccggcucugggacccuucccgccgaccucacccccacccccgggauggagcggcucgagcccgcccggagccccccgcggccggggugacgguccccccaccccucuccugcccggcccccgccucgagcaccaugggccugagggguucccggggcgccagacgcugaagaugaccgaugccggaggugaggggccgggcgcccugggguggaccgggaacuggggcuagggccacucgggcccgcggugggacccugagugggguugggcagggcuaagcgacaagggccuuucuuccccuaucccuagggggaccgcacggggcuggggugccgggcugucaggggagggggcggagauaggauuuauggcccuaauccccucccucccgcccgacgcccggagaaauuaauaaaaagcugguguggggggagggggagagggcuuaacucuuucuugcccggcggggaguugugcugaugguuuggagagaaacuagccaccgggcucugacuggggagaagggcucugagaguggaguaggugcccuguccccaaccucaccccaucuccaacagugcuuugagggggugcccgacuccugaggacuaccccaagccuggggccaguggacggccggcgauaugggaaggggggaccaccucucuggcuccacaacugccuccccgaccgcuagucuccuuucccauccaccucuucccggccucucccaguugcacuucucucugucgcuuucuccucuucaggggcccuuuccuaucgccugcccgaagggcuucucccuucucucccacccucgggcgucacuuagagcggcggaagcccuuguucccagugccaguucccguggccccacucucggugugaucucuuucuucucagcagcccuguggacucuccgccaguuugugugucugucucugcuucuuccuacuccucacuuccuuccgcucccgcucccgcucccuccccaggaauugugcgcccuuucuuccuuucuccuucuccugggucccaagaggcugugagcucaccugccucccuuucucccagagaagggucaaaggucauuggugcuccuucuccaggauuggaagccuuggggggaaggguauccagaggaaccgguucaaucccacccuugugcaguuaccuggcugaaugggggugugugugugugugugugugugugugugugagagagugugcggggugugugugggagugagagugggggcggguuuggugucuaauuuuucuaggcucaguuuuggaaggagaggguugggugggaggggucuggugacccccuggacacaauguagggagggucccccuacacaccccagaaaguuaguuguugaagggaagaaaagagagcaguuugugcugaaucaggauggaccgagaauggcuuugagcaggaaaccccaauccagcccagagggugccuggaagaggaggacuccagccagcagaggaucucgacccuggaaugggcucuugaauaaagaacacaggaucuucauucucagaggcagaaaggagacaacacuacugcccucagagagccuccauucugaugggagaggcaguuccugucuucacagucccuagucugacggaagaauacguggacccuuucuucucugggcucccaucugauuggugggggggagaugagaccuauuuaaggaaucagugaaguaugaagaauuccccauuucccaguaguuggagaaggguggauuuagaaauuacgaagacaaaugagaggagggagggcuaccuaggacagcuuccugaaggagguggcagcuggguccuagccagauaaggcuuugugguugaaucaggaaaugugguuaauucuuagggucagccuuccuucccaucuggccugucaggacaggaagaaauguucuagaucuuugcuaguagccccuggaguucaagaauggcaggaggguucucggagagucugcuucccugaugaccccuucccacaccucauuuucugcuuucagccccaggcauuuauggaaucuggaggugguuuuguuuuuuguuuuuuuuuuugagacagaguuuugcgcuuguugcccaggcuggagugcaauggcacgaucucggcucacugcaaccuccggcucccagcuucaagcgauucuccugccucugucucccgaguagcugggauuacaggaaugugccaccacacccggcuaauuuuguauuuuuaguagagacaguuuuuuccauguuggucaggcuggucucaaacucccgaccucaggugaucugcccgccucggccucccaaagugcugggauuacaggcgugaggcacugcgcccagccuagaggugguuuugaugcuucucccaguccuggucaguguggagcagcuucccucccucuaugcuuaucucuuccuccaccccuaaacugaagaucaucaccuaggauagcgcagaggggcaggagcccuggcucaaggcugaguucugccucuuuuauuauuauuauuauuauugcuuuuauuuauuuauuuacuuauuuacuuaauuuuuuuuuuuuugagauggagucucccucuugucacccaggcuggagugcaauggcaugaugucggcucacugcaaccuccaccucucagguucaagugauucuccugccucagccuccugaguagcugggauuacaggugugcaccaccacacccaacuaauuuuuguguuuuuaguagagacgggguuucaccauguuggccagguuggucucaaacuccugaccucaggugaucugcccgccucggccucccaaagugcugggauuacaggcgugagcuaucacgcccagcuacuuacuuauuuuugagaugagggucucacuauguugcccaggcuggucuagaauuccugggcucaagugauccucccaccucagucuccugaguagcuaggauuauaagcaugcaccaacuuugccuggcuuccucucaucuccuguuucucaguuuucacaucuguaaaguggcgauauguaucuguaaaguggggauaugaaaauucccaggccaggcgcgguggcucacgccuguaaucccaacacuuugggaggccgaggcggguggaucacgaggucaggagaucaagaccauccuggcuaacauggugaaacccugucucuacuaaaaauacaaaaaaauuagccaggcgugguggugggcgacuguagucccagcuacucgggaggcugaggcaggagaauggcguggacccgggaggcagagcuugcagugagccaagauagcgccacugcacuccagccugggugacagagugagacuccgucucaaaaaaaaaaaaaaaaauucccaaggcuggccacaguaaagguagaugaugucuauguaauaacagaaaagaagaguuggaaaagaccccagcaggcauguggccuagccuuccuacaucugacacauguaugaucuagcucagugccuugccauucuccuggggaccugaguguuagaaguaauuggaggucaugucucagccaugcagcguccccuugccuuaaaccaucaauggccccugggcuuccucacucuccccccagccaguauccccuggccagugggcucccuagggcuacuggaauccuacaucugcuugaaagccuauucaaaugguuucagcuauauauauccuucccuaucugcccucccuucuugcuucccaccaaaaaaccuugaaccaaaacaaaaaaaacccuacccauucacacuucuucccagaacauaguugcaucauagagguuuggcuguccauugugugcuguguguauuccucguacccuccuacaucuaugagucugucaagaacugugagaacugugucuggaacaguggcccugcugauggugccagcuuccugaacagcucuuguucagaaaggcagguggugagggcaccagugauggggguguagggaagggggaggcaggauuggaaaagagauggagaauugauggaugcaaagauagguggauggacagauggcggcagguguugggugcaugggagcagaugugggauggacggauggguggauagaugggugagugaauggaugaugaguaggcaaguagauagguggaugagugcauagguggguagacggaugguagaaccuggguccugguccugauuuugccauuaacuugcuaugugaucuugggccaaucacucccccuucuguuucuucauuuguaacaugagaggauuggauuuaauaaucuccaugacuucucccagauuugauuggacaguugaugauugaaagcuuuuaggggaugcuaaugaugcgaaggcccaagacagugaaggggagaaguucagugacccacgugaaggcacacagcaaaucaguggaccaggauaccaggaccacagggcucagccugugucugugccuugguuuugcgucugcccccacccuccuacuauacugccugccccggcgcccaccaucuggguuaugauuccaguggcuucucuuccaggggacagaagaaggguucuaagguaaggggaggggccaacaggccuggagcagguagccuuccacaucucuucugccucggucagccugaaucucuaacccaggcucucuuuuucuuucucuccccucuuguccuucccagcucucuugagucauggcuucuucaaagcuccgagaacccguggaugaaguuuuugguaaguucuguguggcucuaucucuagccaauagacacagccauagaguacuuccuuccugggccaccaggcauugaaggggauagggugcuucuuggcagcuucagagugugugugugugugugugugugugugugugugugugcgcgcgcgcgugcacgcgugcagguauuguggccugacccuuugucaccacuaucuuaguggacacaccaguuauaacaauaagggucuccauuuauuaagugcuucucuuaugccagauacuagguuaagcacccccaucucacaugcacuguauuaguuaacccuuacaauaauguaagcccaguuuacagaccaggaguguaggguacagagggcugaagugacuugcuuucaagaucacauugcaaguuaguggcagggcugggacuagaaccccaaacugccagacuuccugcucuuagugacuauccuauacaucuguaaacuccagcccagaugacacacguuaccuccaagucacauaaauaagugcaagggaccucacccugcuuggaugugugcugaaaucaaaugcauaacauacacagccucaauacccccaggcuggcccccucaugcuggccugcacgcccacguccucaguacacacuggggugcaugcacacaccacgguaccaucauuuacccccugcaaucuucucuuguguggacuggagaaagaaaccaccccagcugggcagaguucccagcaugcacuggggcggaaagccgguuucccagcgggauuccgguggaggagucaggaggaguccugagcaaaggaacuuggaggaaugagggagagggugagagcggccugcuccucgaggggcuccuaugccagaggguccccagcuucuccucaucucucccuucuucccucucuccccuggucaugccaggaacugcugcuucccaucccagucuccuccagcuccccuagccuugaacugccucagggccucaaucucagugucugucccuacucaggccugacuuaagcccaggccugacggaaacgagcucucccuucccugggcuuuucugccccuacuccccaaccucccuacccucuacuccccacaccaaccccugccuguuuuccucacugcugagguagcugcguccucacugcuuccugaugugaaaggccauuaaauauuuaugaauucccacugcccagggcugggaggagcaggaagagggggaggaggauagggaaggagggcaggaacagagaagagggaagagauagaagcuggagggagagccucauagagcagaggacccaggacaggcuggcccaccuugccucaaaaccaccaagccccuuaggaguccccuugcuccccagccccuccaagguaagauggccauggugcugauauggcccagagucaggagcaagggaccccucucccuguuuugaguuggcugggcaccagcuaggugccagaaggguagaggaugccagaucccuggccugggagccacucuccuuaacucccucuguccccuuggccaaagguguccuccuguccuccuugagccucaguuuucccauccauacaaugagagguuggacucaaaauuccuucccaucucugcuucagagaggguguagcaugcuuaaugcuuaccaacagagcuagaccgucugucuguaacccugaccggcuccucaccagcuuuaugcccucgggcaaauuaaggcugcccuggggauuccuggagucccuucuuuguagggcuguggggaggcucaaaugagauaguaauuguaaagcacuuagaacagugccuagcacaguaagagcucaauaaggauuagcucuuauuuuucugugguucagccuucaauccuugcugcugcuuccaggcagugccuggagauucugugucagggggcugggaacagagggcucccucccccagcucagccccaggggcuggaaacaccagcagguugcccccuggacaacugcaaucuccucucgguguccacccucccauuucaaccagacccuuccuuccccucgcaggcugugcuggcccccucgcugcuccccagaugcuccaagcccaaggcugcaccauucucucuccuuagaaugcucuuuuuguuccuucugcaaccucggcucuuuaugguuacccagaccucagccuggcugccauauuuaaagaaguagccucccagucuccccgucuuuucauccauucgacaaauauuuauagagcuccuaauaugcaucaggcucuguccuuggcucuggggagacagcaaagaacaagccagacaaaaucacuguccucauggagcucaaauuuucgugcaggggcaaguagggggacagaugaucaaagcacacacaaauaaacaaggaacauacuagacgguggggagugcugggcagaggauugaaauguggacgugaugggaugugggcaugggcauggaggugaccuucaucagcacccgugugugucuggaguccaucuccgccaaagcaugcacuaguccauggaagugugacuuugcuucaacacuuccugaacaccugcuccuugucaggugccacaccaggcucucaugauacacaguggacagggaaggguuucacccucugcagguugcaggccagcaugaggagacagucauuggcgaccauaucccgaccguaucgugaccauaugguaguguggugcggcugucagacggugcugugucagaauugaucagccggacaaagaagggcuggagagagauggagcauagggauggaggugggaagugagguagaggcagguacacauauagguaucaguauaagcaauucaguugaucccacagacgccaucaccagcgagcgccuguugagcucguacuaagucauagcauuauggcaaaguacuguauauggauuauuuuauuugaugcucacaaccacccuauaaggaagauagugcuaguauaaucccauuuuacacaugagaaagcugacaccuaaaaggaaguaacuugcccagagucacccagccggcaaaugauagaacuggcuucagccuggccaucugggccagggccagugcucuuagccauagucauguaagaggaggaaucuguugggaacacagaaagggugggcugggccccucaggccuugaauagagagcugaauagcauggacuuuauauuguuagcuuugggaccccuucugcgagaguuucaaaagcaggagaguaugggacauggucagaaaugugcuucaggccgggcgcgauggcccacaccaguaaucccagcacucugggaggccaaggcgggcagaucacuugaggccaggaguucaagaccagccugaccaacauggcgaaaccccaucucuacuaaaaauacaaaaguuagccaggugugguggcacacaccuguagucccagcuacuugggaggcugagccaggagaaucgauugagccugggagguggagguugcagugagcuaagaucaugccacugcacucuagccuggguggcagagcaagauucugucuccacaagaaaaaaaaaaaagaaaggugcuucagaaaguuucuucuagucacauggaagguacgaggaggagccagacaggaggcagggagcgaaggagggauaguugcauguuuugggguggcagggggugggaggugggggcagcuccccuccacucaggugaaggccugagcuaaggcaguucgguccagaggagaggagagcccagguuccaugggugugaggaggccaaucaacagaacauuuuucuuucauuaaaagggugugcuaagcaccuacugugugccaggcacuguucucugccugugguagagcagugaacaaagcagaaaccuguccucauggagcugacauucuaauggguggagaaagaccauaaaugauauaagcaaaauauauagcaugccagagaaugagaaaugauauaggaaaaaaacaggaguggaguuuuggagugggggggcuauuauaaauuggguggucagggaaggccucagugagagaaagcauuuaagcgaagacuugaaggaagugagggagagaaccacgcagaaaucuguggaaagagccuugcagaaaaagggcagaggaggugcaaaggcccugcaaugcaggcuggcuugugugaggaugagccaggcggccaggaugguuggaguggagggacaggaguagugcucagacaggcaagggagcauaggcugacucuggaaggccacugggagaacuuugacucuuaaucugcauaagauggaagucacuggaggguucugaacaggggagugauauaaacugacacguuugaucaggaucacucuggcugcuguguugaaaauagacuagaugggaaagggagacggaaggaagaccagcuaggaggcuguuuguaauaauccaggcuaaaagaugauggcaguuuagaccuucuggucuaagagacugugaauucucccucucacuucccucccuuuccucccauccucuccccucuuuuucuuuccucuccucuccucucccuuccucugcucuccucccuuucucuccauauguacgcauguauaggaguauguguauacauucgcauacacaaacaauaauuuauuaaggaaaaucucaaacagauucaaaauuagagauuacagcaaaguguagucuaucaugcacucaagaacucauuacccagccucaacaaugaccuagucauagccagucuaguuucauaucuaucccauccacgcccucccccuauugcccuggauuauguggaaccuaguccaaaacaucauaucccuucaccguaaauauuucaguaugucuagcuauuuuuugaaaguagagcuaacaggaauuguggaugaauccguuuguaggaugguagggaaagcagugaagaaugacuccagggguucagcugagcaacuagaagaauggagcuacuguucaccaagacugggaggagcagcucuggggugggagagaucaggagauugcagcaccuguaggcugaagaccccugguggacaucaaaguggaggugucaacuagacaguuggacaugaauuaccaacugggucuggggcugagagagaagaaggguagcuuagggcugucugacucgggcgacuuggguggacaagggggcuuuucacugagucaaggaagagaguagaagcugguuugagguuacaugaucgguucauuuugaugaguugagcuugagacaccuuggggucuuugacgugguaacuuccuuggcaggugccugagugcccacacucagaauucaggggagggugucaaggcuggaaauagaaauaggugguaguuaagccaggagagcaacugggguggcuuagggguugucuacagaacgaaacaggagcagacaaggcagggugggcaugagugacagaauagggccccugagaucaugcuggguggaguggggaggaaaagucuugacccaucuugaagccugggaagacucuuucuguuuggagaccccagugccaagcucagcacugguacagcaugagggcuucauuccgaggugcagcacgugacaaguggagcuaugagcaauaaggacuuuaacgcuggacccacugggucugcccacucuuccuccauguccucaugcaagaucuagcacagggccacagacccaggacagaagagagguuucggggacuauggggcuuuccuuccugccacugccaguggauucugggggugucccuuugcuccacuccaacugcaagcccucuagaugcucagcagugcuaucucugagugagacccugcgcguggcacagcaagccaguguccccaguagggccagucucuagagccagccuagccaggcucaaauccuggaccauugcuagcugguggcuuuagucaagugacuuaaccucucugaguuuuaguuugcucagcuguaaaguaugcauaguaacuguccuaaccccaccggguuguuuugagugagagaugauguauguacacugucugguguguaguaaguguuucuuaaaugguggccauuauuuccaucaucucuccagccucaucccucaacccuucucuccacaaagcuacccuccaacugucccuggagguaccacccuuguuucccuacuuccuagcauugcauauaccuguuuugcccaccucaucucuuacagacuccuacccagacguuaaaacccagcuuugguguuuccuccucugaugcauccaaacagggcugccguuccuccgugucuacaggaggguucaucacacggcgcuguauuuuagcgccggcauuucugcuuccccugcacacccgcccacucccaccugagacggggagacacccuguuuuucaucugucugugcucccagcacucaagaacacggguugaaugccuggggugugggugcagguggccccugaggugggccucugggcuugccgucaccucucaugugucuggucucugcuccccucccccgguucgcagaccuggacuuggcugugccagagacggccagacuggacagcaguuuacacaaggcccgggcccaacuguuggccaagggccggagacaccggccaucccgcuccaggcuucgggacagugccagcuccgcggaggauggugaaggcucggaugggcccggaggcaagguuggggcaaguuaggaaaacacauauacacccucccaccccucccucuccucccaccccuggauaaucucuccagagugcucuuccagggaaaccacauccccagacuccugaccuaguaaugcugccaaguguuagcugcaguucacuucuggcucauuuaauccuguguaaagaagauauuauuagccccauuuuacagcugaggaaacugaggcccugagagguccaggagcaaagucacaguaagugaaggagggggaauucagccccagccugugugacucaaaguuccuguuucccaccucucacucuccagccaccccgcugccuaaggcaugaggaaacccucccucuaggccccggaaggacccucagggcccgcaguuuacagggugaaagucucccagcuccuccgggaagggaggaggaggguucucggugagcggcugcccccucguccaggugaccgauggcugcgggagcccccugcaccggcugcgcucgccuuugcacucaggcccgggguccccggccgggggcucuuucugccuggauccuccgggguugcggcgcagccuggacgaggacgagccgccgcccucgccgcucacacgcuaccggccccugcacaacgcugcgucgcacgagggccuggccgccgccuccugcucuccgccgcgcuccgcgcccuccuccgacagcucccccagcuucgugcgccgccacccgcgcgcagagccgcacagcgaaggugagaggcggccagcgccgcaccuccugcuggucgcucccgggcgcagcagcccucccggucccggcgcgcaccgcagccgcggaaggggcagcugagcaggguggcugggggaggugaagaguaaacgccgccgcucacucauucuuuaccgagcgccuacuaagugccagauccugugggcucugggacacccaggugagcaaacacaugcagucuuuaucaucauagugguuuaguggagaaacaaucaaaucaggccuggcuggcggcucacgccuguaaucccaacaccuugggaggccgagauggaggaucgcuugagcccaggaguucgagaccagccugggcaacauagcgagaccgucuccagaaaaaauuaaaaaauuagccccgcgugguaugcaccuguagaaccagcuacuuggaaggcugaggcgggaggauagcuugaacccgggaguuuugagcugcagugagcuaugaucacuccuugccucaaaaacaaaacaaaacaaaaacccaaucaaaucaucccuuaacuaaaugucuaguuauaaacuauaacaagugcuauuugggaaaugugugcggcagcauggcgggagagcauacaccaggaugcuuggccuggcuaggaacauccuggaaaugacauuugagccaaguuuggaagguugguuagauguuggccaggauaggccgagugcaguggcucacgcuuguaaucccagcacuuugggaggccgaggcggguggaucaccugaggucaggaguucgagaccagccuggacaacaugaugaaacccugucugaacuaaaaacacaaaaaauuagccgggugugguggcgggcgccuguaaucccagcuacucaggaggcugaggcaggagaauugcuugaacccgggagguggaaguugcagugagccaagaucacgccauugcacuccagccugggcaacaagagcaaaacucugucucaaaaaaaaaaaaaaaaaaaaaaguuggccaggauaaaauugaguaaaugguagugauuccuaccuuuuuggaacguuuuauaguuuguaaaaggcugucauaagcaucccauuaggucccaugaagcagguagauguuauuauccccauauuuaaaauggaggaaggccagagagguaaaguggcuuauccuaggacacccagcuagugaaggccaccagagccaggaugccugauucuaagucaagagaauuucuaccaccccacacuggcagccgaaggaggcaggcagggcagcaaacaggcaguuuccuuccuucucucccuggaaagaugacagccgugacgccaguccuccugagcccgccagccccaccaucggccucgauaagaagacucgccgaaaguuccuggaccuggggugaguggaggcggggcuagaucgcagggcuuggagcugcugggguaagggguagcacagugggcagcccugccccacuuccugcugccuccccacagggucacccugcgccgagcauccacgggcaagagccggaaggagaaaggcagcaaccgacuguccaugggcagcaggugagaggugcccauggcggcccacccacagcucccgccccuggcuccccaugugcucugguccuccccucuguacccacacccaugcuggacacucucucugcagggagucaguggagggguccggcaggucagggggcuccccguuccugccuuuuuccugguucacggacagcggcaagggcucagcauccucggguagcaccaccucccccaccugcuccccuaaacacgagggcuucagcccuaagaagucagcuucccagguaaguccaugccuuucuuguccccaaacuggcccccagucucaggugacaugagggcguacuucaccuuggcucaggcugggauucagacauuccuggaaucaauuuguccauccauggagccaugcagugauccguuacuucaugcauucucugaauucauucguucacucuuccacuccuucauauucugaguaguucauuccuugauucagucaaugcuucaugcauucaacaaaucacuaaacacugauucccuacuguucacccagcuggagacuuccuucauuccugcuaacucuucugccugguuaaguucuaaccccacuccugugugaggagcugggccaccugcuugguagggugaggccugggggauauagagacaaacaggaccccaaccuaguggucugaaagcuuacaacccuaugugaugugagacgaguaagagaagcaaugaugagcaacugcuuauguucagagcgcccucuacaguuuacaaagccccaaaugcguuucugcuuuacucucacaaaggcucggugaaguagggagggaaggcaugcucaucuccauuguacagaugagcaaaggaaggcccagagagaaggggcuugcccacagacuggcacagauauaggugccaagcucuacaacccccagcccaguacuuguucuacgguucuguuucuuacgugcagcugggcagaggagaaaaucagaagcugggaauucugggaagaaagaaucccuucggaccuggaacuuccuucuuuccuccuucucuuucuuccuucccuuaugcuggucacugggacaccaugaugaacaagauacaacccaggcccuccuagagcucacaguccagugaggauaaagaccucuaaucaggcacuuauuagcugggguacuaaggccaggcgggaggcgcauagcagagacaccugacccagccugggggaaucucgguggucugccuguaggaagugacaccuugccugagaccgccuccauuccuacuaaccuggcuugguucuagccccauguccuccagauggcugccugcucucccaaaggcuucagguccugaugccugacaugaguuaucauguccugugugcaggcccagcuccuggcucaugcacaggaggcacugagcaacuccuggugccuaguccaggacuucggcuccacccagauagggaugguggguugggggugaacucuccucaguggcaugcaccuuuuucugucuaggaauccacucugagugaugacuccacgccccccagcagcagccccaagauccccagugggcccuggcaggaggccaaauguucuuaccccuaccacacgcugucucagucuucagaugaggugagcaaggcuggcccagggugcccacggaguccugaccucugacucugcaaggugcucaggucacaggccaagccucccccucacucuccuuggucucugcccaguuccuggaugaaccccuccccccuguccaccacuggaccagccagcaggugggccaguggcugcagagccucaaccuggaacaguaugcugcugaguuugcugcacggcagguagacgggccgcagcugcugcagcuggacggaagcaaacuaaaggugggucagaguggaagggccaugacccagcccaguuacuugaggugacuuucaaggauuugaagucccucauccugaccuuugacccucagcccagccuccugggcugaccuuuucacuccaucuguggccaccacccugaccucugaccucuaggcaagguccuuggucuaaucuuuugaguuguagcaugaaucccuaguuugacuugaaacucuaguccaugacuucagugugaccuucaagcuccagcccuggucuccaggcugaccuugcccucuaggaugacccuugaugcauaugaguguccugguaucaugggaagccacaucucccccuggucagcuuggucugauucugucucagaggcuagugguaauagugggcagggggaggcuguaggaagggggugguggccucugaccuauaagcugggagguuccuggccugucuccugcucucugcugaguugcuuggggcagggauggugaaaagagcccccaggaagucucuggaagugaggaggguccuugggcacuaacugugugaccuugggcaagugacuccccaucucugggccucaggagguugggcagguccgggccaaggcugaaauacugaguggaggaauggugggggaggaggaggaagcgccuaauacccccaacccucaucuuucccaaccacacucauuccaaauucuugcucuggggguucugauccaugggcaggucacggugugggaggcggaggcuccacuccagggaggauuuggagcuccacagaguacaccuggggcaaaaggagccugggcgugggaggccaggacugggaagguucugggacucucucccucaccccggacuccuccccagagccuggggcucagcaacucucaugaccgggcacuggugaagcgcaaguugaaggagauggcagcagcugccgagaaggagcgcaaggcccaggagaaggcugcgcggcagcgggagaagcuccggcgccgagagcaggaggccaagaagagcuaggggagggugcacaggcgcuggcacccggcaggggcagccacuggcuccgcgggcacaggccucaccagggaggcuggaccugggcgcugcacuugggcuagccuggucccacgcucucaggggggacaugcucucucuuacccugucacuuggucuagacccagagaccccagaaagggagaccccagggagagggccuaguaauaaauccuauuuugaggacuuguuuggcacagaguuccugggggaggagcagaugaaggggagagggcagagaggccagggcugaggcaagucugggaggcugggucaggcugucccauugcccucaggccaucguggggcugggguggaggggagcuaggaggccugccugccugcuugccugccagaggcccugaggccgggccccagggcucagagcugggcugggcauuucagcaggagcccaugugggagcggcuccucuccacucuuccagggggcuguguggugggagagcucuguccugcucccccaagaggccagugggcgcugcagcaagucgcacucaggguagacucccagccaaacuccucaacaggagcgcagagaaagcagccuggggcgagugcagucuuugccaggacucaagaggggaggaugaacauccccuucucccucuccccuccucuguccugugggucccagggggcgagaugacaccacacaggucugccucucagggcccauucaagaccuggucuuugacccauucuccaagccaggacucccuucacuuccugcugcuuccucagagggcaccuaaguccucuuugggagcugagcaaacaggaacugauagggacagaggacaccacuuccaccagccaaggccuaggagcugcugaccuggucagcccucaccccagccaggcagagaggcaaaaccuggggguccccggcagcuacgagauuggaaagguucaucagcccucccccaucugccccaggcauugucagggaaucagugggcucagaacuggcaggcggugcaagcucugcuucccugggccacacugagggcuggggccagcucccuggauggggguggaguuuaccagcagccuggggacagcauguguccuuuuuaggaaauguccuuggaggaaguguucauguguggcgcuggucagcagcuagucccgcuuccaggacacuggucagaguuaccgaugaggccugggggcucccgcuuggaaaccccuccagcuccucccaucugcccagacagagcggcagauggcaccaaugcaugcuggcucccucauuccugcccaggggcuguggcuuacggccagcacccuguaccugggacucagcccuuauccccccucugcuaucugugcugggagaggggcuucggagggaaacagauaugaggacacuggcaccaucugggccugguggcagggccaugggagguuggaaggcacccacauccuuaaagccaucaguagcuauagugggugcccaccugcaugugaaggggaggcaguucucaauuuauuucaauaaauccuuaugaugugccagu

SEQ ID NO: 16772 - RNA, 19414 nt, Homo sapiens
acuggcacaucauaaggauuuauugaaauaaauugagaacugccuccccuucacaugcaggugggcacccacuauagcuacugauggcuuuaaggaugugggugccuuccaaccucccauggcccugccaccaggcccagauggugccaguguccucauaucuguuucccuccgaagccccucucccagcacagauagcagaggggggauaagggcugagucccagguacagggugcuggccguaagccacagccccugggcaggaaugagggagccagcaugcauuggugccaucugccgcucugucugggcagaugggaggagcuggagggguuuccaagcgggagcccccaggccucaucgguaacucugaccaguguccuggaagcgggacuagcugcugaccagcgccacacaugaacacuuccuccaaggacauuuccuaaaaaggacacaugcuguccccaggcugcugguaaacuccacccccauccagggagcuggccccagcccucaguguggcccagggaagcagagcuugcaccgccugccaguucugagcccacugauucccugacaaugccuggggcagaugggggagggcugaugaaccuuuccaaucucguagcugccggggacccccagguuuugccucucugccuggcuggggugagggcugaccaggucagcagcuccuaggccuuggcugguggaagugguguccucugucccuaucaguuccuguuugcucagcucccaaagaggacuuaggugcccucugaggaagcagcaggaagugaagggaguccuggcuuggagaaugggucaaagaccaggucuugaaugggcccugagaggcagaccuguguggugucaucucgcccccugggacccacaggacagaggaggggagagggagaaggggauguucauccuccccucuugaguccuggcaaagacugcacucgccccaggcugcuuucucugcgcuccuguugaggaguuuggcugggagucuacccugagugcgacuugcugcagcgcccacuggccucuugggggagcaggacagagcucucccaccacacagcccccuggaagaguggagaggagccgcucccacaugggcuccugcugaaaugcccagcccagcucugagcccuggggcccggccucagggccucuggcaggcaagcaggcaggcaggccuccuagcuccccuccaccccagccccacgauggccugagggcaaugggacagccugacccagccucccagacuugccucagcccuggccucucugcccucuccccuucaucugcuccucccccaggaacucugugccaaacaaguccucaaaauaggauuuauuacuaggcccucucccuggggucucccuuucuggggucucugggucuagaccaagugacaggguaagagagagcauguccccccugagagcgugggaccaggcuagcccaagugcagcgcccagguccagccucccuggugaggccugugcccgcggagccaguggcugccccugccgggugccagcgccugugcacccuccccuagcucuucuuggccuccugcucucggcgccggagcuucucccgcugccgcgcagccuucuccugggccuugcgcuccuucucggcagcugcugccaucuccuucaacuugcgcuucaccagugcccggucaugagaguugcugagccccaggcucuggggaggaguccggggugagggagagagucccagaaccuucccaguccuggccucccacgcccaggcuccuuuugccccagguguacucuguggagcuccaaauccucccuggaguggagccuccgccucccacaccgugaccugcccauggaucagaacccccagagcaagaauuuggaaugagugugguugggaaagaugaggguuggggguauuaggcgcuuccuccuccucccccaccauuccuccacucaguauuucagccuuggcccggaccugcccaaccuccugaggcccagagauggggagucacuugcccaaggucacacaguuagugcccaaggacccuccucacuuccagagacuuccugggggcucuuuucaccaucccugccccaagcaacucagcagagagcaggagacaggccaggaaccucccagcuuauaggucagaggccaccacccccuuccuacagccucccccugcccacuauuaccacuagccucugagacagaaucagaccaagcugaccagggggagauguggcuucccaugauaccaggacacucauaugcaucaagggucauccuagagggcaaggucagccuggagaccagggcuggagcuugaaggucacacugaagucauggacuagaguuucaagucaaacuagggauucaugcuacaacucaaaagauuagaccaaggaccuugccuagaggucagaggucagggugguggccacagauggagugaaaaggucagcccaggaggcugggcugagggucaaaggucaggaugagggacuucaaauccuugaaagucaccucaaguaacugggcugggucauggcccuuccacucugacccaccuuuaguuugcuuccguccagcugcagcagcugcggcccgucuaccugccgugcagcaaacucagcagcauacuguuccagguugaggcucugcagccacuggcccaccugcuggcugguccagugguggacaggggggagggguucauccaggaacugggcagagaccaaggagagugagggggaggcuuggccugugaccugagcaccuugcagagucagaggucaggacuccgugggcacccugggccagccuugcucaccucaucugaagacugagacagcgugugguagggguaagaacauuuggccuccugccagggcccacuggggaucuuggggcugcugcuggggggcguggagucaucacucagaguggauuccuagacagaaaaaggugcaugccacugaggagaguucacccccaacccaccaucccuaucuggguggagccgaaguccuggacuaggcaccaggaguugcucagugccuccugugcaugagccaggagcugggccugcacacaggacaugauaacucaugucaggcaucaggaccugaagccuuugggagagcaggcagccaucuggaggacauggggcuagaaccaagccagguuaguaggaauggaggcggucucaggcaaggugucacuuccuacaggcagaccaccgagauucccccaggcugggucaggugucucugcuaugcgccucccgccuggccuuaguaccccagcuaauaagugccugauuagaggucuuuauccucacuggacugugagcucuaggagggccuggguuguaucuuguucaucauggugucccagugaccagcauaagggaaggaagaaagagaaggaggaaagaaggaaguuccagguccgaagggauucuuucuucccagaauucccagcuucugauuuucuccucugcccagcugcacguaagaaacagaaccguagaacaaguacugggcuggggguuguagagcuuggcaccuauaucugugccagucugugggcaagccccuucucucugggccuuccuuugcucaucuguacaauggagaugagcaugccuucccucccuacuucaccgagccuuugugagaguaaagcagaaacgcauuuggggcuuuguaaacuguagagggcgcucugaacauaagcaguugcucaucauugcuucucuuacucgucucacaucacauaggguuguaagcuuucagaccacuagguugggguccuguuugucucuauaucccccaggccucacccuaccaagcagguggcccagcuccucacacaggagugggguuagaacuuaaccaggcagaagaguuagcaggaaugaaggaagucuccagcugggugaacaguagggaaucaguguuuagugauuuguugaaugcaugaagcauugacugaaucaaggaaugaacuacucagaauaugaaggaguggaagagugaacgaaugaauucagagaaugcaugaaguaacggaucacugcauggcuccauggauggacaaauugauuccaggaaugucugaaucccagccugagccaaggugaaguacgcccucaugucaccugagacugggggccaguuuggggacaagaaaggcauggacuuaccugggaagcugacuucuuagggcugaagcccucguguuuaggggagcaggugggggagguggugcuacccgaggaugcugagcccuugccgcuguccgugaaccaggaaaaaggcaggaacggggagcccccugaccugccggaccccuccacugacucccugcagagagaguguccagcauggguguggguacagaggggaggaccagagcacauggggagccaggggcgggagcugugggugggccgccaugggcaccucucaccugcugcccauggacagucgguugcugccuuucuccuuccggcucuugcccguggaugcucggcgcagggugacccuguggggaggcagcaggaaguggggcagggcugcccacugugcuaccccuuaccccagcagcuccaagcccugcgaucuagccccgccuccacucaccccagguccaggaacuuucggcgagucuucuuaucgaggccgaugguggggcuggcgggcucaggaggacuggcgucacggcugucaucuuuccagggagagaaggaaggaaacugccuguuugcugcccugccugccuccuucggcugccaguguggggugguagaaauucucuugacuuagaaucaggcauccuggcucugguggccuucacuagcuggguguccuaggauaagccacuuuaccucucuggccuuccuccauuuuaaauauggggauaauaacaucuaccugcuucaugggaccuaaugggaugcuuaugacagccuuuuacaaacuauaaaacguuccaaaaagguaggaaucacuaccauuuacucaauuuuauccuggccaacuuuuuuuuuuuuuuuuuuuuuugagacagaguuuugcucuuguugcccaggcuggagugcaauggcgugaucuuggcucacugcaacuuccaccucccggguucaagcaauucuccugccucagccuccugaguagcugggauuacaggcgcccgccaccacacccggcuaauuuuuuguguuuuuaguucagacaggguuucaucauguuguccaggcuggucucgaacuccugaccucaggugauccacccgccucggccucccaaagugcugggauuacaagcgugagccacugcacucggccuauccuggccaacaucuaaccaaccuuccaaacuuggcucaaaugucauuuccaggauguuccuagccaggccaagcauccugguguaugcucucccgccaugcugccgcacacauuucccaaauagcacuuguuauaguuuauaacuagacauuuaguuaagggaugauuugauuggguuuuuguuuuguuuuguuuuugaggcaaggagugaucauagcucacugcagcucaaaacucccggguucaagcuauccucccgccucagccuuccaaguagcugguucuacaggugcauaccacgcggggcuaauuuuuuaauuuuuucuggagacggucucgcuauguugcccaggcuggucucgaacuccugggcucaagcgauccuccaucucggccucccaagguguugggauuacaggcgugagccgccagccaggccugauuugauuguuucuccacuaaaccacuaugaugauaaagacugcauguguuugcucaccugggugucccagagcccacaggaucuggcacuuaguaggcgcucgguaaagaaugagugagcggcggcguuuacucuucaccucccccagccacccugcucagcugccccuuccgcggcugcggugcgcgccgggaccgggagggcugcugcgcccgggagcgaccagcaggaggugcggcgcuggccgccucucaccuucgcugugcggcucugcgcgcggguggcggcgcacgaagcugggggagcugucggaggagggcgcggagcgcggcggagagcaggaggcggcggccaggcccucgugcgacgcagcguugugcaggggccgguagcgugugagcggcgagggcggcggcucguccucguccaggcugcgccgcaaccccggaggauccaggcagaaagagcccccggccggggaccccgggccugagugcaaaggcgagcgcagccggugcagggggcucccgcagccaucggucaccuggacgagggggcagccgcucaccgagaacccuccuccucccuucccggaggagcugggagacuuucacccuguaaacugcgggcccugaggguccuuccggggccuagagggaggguuuccucaugccuuaggcagcgggguggcuggagagugagaggugggaaacaggaacuuugagucacacaggcuggggcugaauucccccuccuucacuuacugugacuuugcuccuggaccucucagggccucaguuuccucagcuguaaaauggggcuaauaauaucuucuuuacacaggauuaaaugagccagaagugaacugcagcuaacacuuggcagcauuacuaggucaggagucuggggaugugguuucccuggaagagcacucuggagagauuauccaggggugggaggagagggaggggugggaggguguauauguguuuuccuaacuugccccaaccuugccuccgggcccauccgagccuucaccauccuccgcggagcuggcacugucccgaagccuggagcgggauggccggugucuccggcccuuggccaacaguugggcccgggccuuguguaaacugcuguccagucuggccgucucuggcacagccaaguccaggucugcgaaccgggggaggggagcagagaccagacacaugagaggugacggcaagcccagaggcccaccucaggggccaccugcacccacaccccaggcauucaacccguguucuugagugcugggagcacagacagaugaaaaacagggugucuccccgucucaggugggagugggcgggugugcaggggaagcagaaaugccggcgcuaaaauacagcgccgugugaugaacccuccuguagacacggaggaacggcagcccuguuuggaugcaucagaggaggaaacaccaaagcuggguuuuaacgucuggguaggagucuguaagagaugaggugggcaaaacagguauaugcaaugcuaggaaguagggaaacaagggugguaccuccagggacaguuggaggguagcuuuguggagagaaggguugagggaugaggcuggagagaugauggaaauaauggccaccauuuaagaaacacuuacuacacaccagacaguguacauacaucaucucucacucaaaacaacccggugggguuaggacaguuacuaugcauacuuuacagcugagcaaacuaaaacucagagagguuaagucacuugacuaaagccaccagcuagcaaugguccaggauuugagccuggcuaggcuggcucuagagacuggcccuacuggggacacuggcuugcugugccacgcgcagggucucacucagagauagcacugcugagcaucuagagggcuugcaguuggaguggagcaaagggacacccccagaauccacuggcaguggcaggaaggaaagccccauaguccccgaaaccucucuucuguccugggucuguggcccugugcuagaucuugcaugaggacauggaggaagagugggcagacccaguggguccagcguuaaaguccuuauugcucauagcuccacuugucacgugcugcaccucggaaugaagcccucaugcuguaccagugcugagcuuggcacuggggucuccaaacagaaagagucuucccaggcuucaagaugggucaagacuuuuccuccccacuccacccagcaugaucucaggggcccuauucugucacucaugcccacccugccuugucugcuccuguuucguucuguagacaaccccuaagccaccccaguugcucuccuggcuuaacuaccaccuauuucuauuuccagccuugacacccuccccugaauucugagugugggcacucaggcaccugccaaggaaguuaccacgucaaagaccccaaggugucucaagcucaacucaucaaaaugaaccgaucauguaaccucaaaccagcuucuacucucuuccuugacucagugaaaagcccccuuguccacccaagucgcccgagucagacagcccuaagcuacccuucuucucucucagccccagacccaguugguaauucauguccaacugucuaguugacaccuccacuuugauguccaccaggggucuucagccuacaggugcugcaaucuccugaucucucccaccccagagcugcuccucccagucuuggugaacaguagcuccauucuucuaguugcucagcugaaccccuggagucauucuucacugcuuucccuaccauccuacaaacggauucauccacaauuccuguuagcucuacuuucaaaaaauagcuagacauacugaaauauuuacggugaagggauaugauguuuuggacuagguuccacauaauccagggcaauagggggagggcguggaugggauagauaugaaacuagacuggcuaugacuaggucauuguugaggcuggguaaugaguucuugagugcaugauagacuacacuuugcuguaaucucuaauuuugaaucuguuugagauuuuccuuaauaaauuauuguuuguguaugcgaauguauacacauacuccuauacaugcguacauauggagagaaagggaggagagcagaggaagggagaggagaggagaggaaagaaaaagaggggagaggaugggaggaaagggagggaagugagagggagaauucacagucucuuagaccagaaggucuaaacugccaucaucuuuuagccuggauuauuacaaacagccuccuagcuggucuuccuuccgucucccuuucccaucuagucuauuuucaacacagcagccagagugauccugaucaaacgugucaguuuauaucacuccccuguucagaacccuccagugacuuccaucuuaugcagauuaagagucaaaguucucccaguggccuuccagagucagccuaugcucccuugccugucugagcacuacuccugucccuccacuccaaccauccuggccgccuggcucauccucacacaagccagccugcauugcagggccuuugcaccuccucugcccuuuuucugcaaggcucuuuccacagauuucugcgugguucucucccucacuuccuucaagucuucgcuuaaaugcuuucucucacugaggccuucccugaccacccaauuuauaauagcccccccacuccaaaacuccacuccuguuuuuuuccuauaucauuucucauucucuggcaugcuauauauuuugcuuauaucauuuauggucuuucuccacccauuagaaugucagcuccaugaggacagguuucugcuuuguucacugcucuaccacaggcagagaacagugccuggcacacaguaggugcuuagcacacccuuuuaaugaaagaaaaauguucuguugauuggccuccucacacccauggaaccugggcucuccucuccucuggaccgaacugccuuagcucaggccuucaccugaguggaggggagcugcccccaccucccacccccugccaccccaaaacaugcaacuaucccuccuucgcucccugccuccugucuggcuccuccucguaccuuccaugugacuagaagaaacuuucugaagcaccuuucuuuuuuuuuuuucuuguggagacagaaucuugcucugccacccaggcuagagugcaguggcaugaucuuagcucacugcaaccuccaccucccaggcucaaucgauucuccuggcucagccucccaaguagcugggacuacaggugugugccaccacaccuggcuaacuuuuguauuuuuaguagagaugggguuucgccauguuggucaggcuggucuugaacuccuggccucaagugaucugcccgccuuggccucccagagugcugggauuacuggugugggccaucgcgcccggccugaagcacauuucugaccaugucccauacucuccugcuuuugaaacucucgcagaaggggucccaaagcuaacaauauaaaguccaugcuauucagcucucuauucaaggccugaggggcccagcccacccuuucuguguucccaacagauuccuccucuuacaugacuauggcuaagagcacuggcccuggcccagauggccaggcugaagccaguucuaucauuugccggcugggugacucugggcaaguuacuuccuuuuaggugucagcuuucucauguguaaaaugggauuauacuagcacuaucuuccuuauagggugguugugagcaucaaauaaaauaauccauauacaguacuuugccauaaugcuaugacuuaguacgagcucaacaggcgcucgcuggugauggcgucugugggaucaacugaauugcuuauacugauaccuauauguguaccugccucuaccucacuucccaccuccaucccuaugcuccaucucucuccagcccuucuuuguccggcugaucaauucugacacagcaccgucugacagccgcaccacacuaccauauggucacgauacggucgggauauggucgccaaugacugucuccucaugcuggccugcaaccugcagagggugaaacccuucccuguccacuguguaucaugagagccugguguggcaccugacaaggagcagguguucaggaaguguugaagcaaagucacacuuccauggacuagugcaugcuuuggcggagauggacuccagacacacacgggugcugaugaaggucaccuccaugcccaugcccacaucccaucacguccacauuucaauccucugcccagcacuccccaccgucuaguauguuccuuguuuauuugugugugcuuugaucaucugucccccuacuugccccugcacgaaaauuugagcuccaugaggacagugauuuugucuggcuuguucuuugcugucuccccagagccaaggacagagccugaugcauauuaggagcucuauaaauauuugucgaauggaugaaaagacggggagacugggaggcuacuucuuuaaauauggcagccaggcugaggucuggguaaccauaaagagccgagguugcagaaggaacaaaaagagcauucuaaggagagagaauggugcagccuugggcuuggagcaucuggggagcagcgagggggccagcacagccugcgaggggaaggaagggucugguugaaaugggaggguggacaccgagaggagauugcaguuguccagggggcaaccugcugguguuuccagccccuggggcugagcugggggagggagcccucuguucccagcccccugacacagaaucuccaggcacugccuggaagcagcagcaaggauugaaggcugaaccacagaaaaauaagagcuaauccuuauugagcucuuacugugcuaggcacuguucuaagugcuuuacaauuacuaucucauuugagccuccccacagcccuacaaagaagggacuccaggaauccccagggcagccuuaauuugcccgagggcauaaagcuggugaggagccggucaggguuacagacagacggucuagcucuguugguaagcauuaagcaugcuacacccucucugaagcagagaugggaaggaauuuugaguccaaccucucauuguauggaugggaaaacugaggcucaaggaggacaggaggacaccuuuggccaaggggacagagggaguuaaggagaguggcucccaggccagggaucuggcauccucuacccuucuggcaccuagcuggugcccagccaacucaaaacagggagaggggucccuugcuccugacucugggccauaucagcaccauggccaucuuaccuuggaggggcuggggagcaaggggacuccuaaggggcuuggugguuuugaggcaaggugggccagccuguccuggguccucugcucuaugaggcucucccuccagcuucuaucucuucccucuucucuguuccugcccuccuucccuauccuccucccccucuuccugcuccucccagcccugggcagugggaauucauaaauauuuaauggccuuucacaucaggaagcagugaggacgcagcuaccucagcagugaggaaaacaggcagggguugguguggggaguagaggguagggagguuggggaguaggggcagaaaagcccagggaagggagagcucguuuccgucaggccugggcuuaagucaggccugaguagggacagacacugagauugaggcccugaggcaguucaaggcuaggggagcuggaggagacugggaugggaagcagcaguuccuggcaugaccaggggagagagggaagaagggagagaugaggagaagcuggggacccucuggcauaggagccccucgaggagcaggccgcucucacccucucccucauuccuccaaguuccuuugcucaggacuccuccugacuccuccaccggaaucccgcugggaaaccggcuuuccgccccagugcaugcugggaacucugcccagcuggggugguuucuuucuccaguccacacaagagaagauugcaggggguaaaugaugguaccguggugugugcaugcaccccaguguguacugaggacgugggcgugcaggccagcaugagggggccagccuggggguauugaggcuguguauguuaugcauuugauuucagcacacauccaagcagggugaggucccuugcacuuauuuaugugacuuggagguaacgugugucaucugggcuggaguuuacagauguauaggauagucacuaagagcaggaagucuggcaguuugggguucuagucccagcccugccacuaacuugcaaugugaucuugaaagcaagucacuucagcccucuguacccuacacuccuggucuguaaacugggcuuacauuauuguaaggguuaacuaauacagugcaugugagaugggggugcuuaaccuaguaucuggcauaagagaagcacuuaauaaauggagacccuuauuguuauaacugguguguccacuaagauaguggugacaaagggucaggccacaauaccugcacgcgugcacgcgcgcgcgcacacacacacacacacacacacacacacacacacacucugaagcugccaagaagcacccuauccccuucaaugccugguggcccaggaaggaaguacucuauggcugugucuauuggcuagagauagagccacacagaacuuaccaaaaacuucauccacggguucucggagcuuugaagaagccaugacucaagagagcugggaaggacaagaggggagagaaagaaaaagagagccuggguuagagauucaggcugaccgaggcagaagagauguggaaggcuaccugcuccaggccuguuggccccuccccuuaccuuagaacccuucuucuguccccuggaagagaagccacuggaaucauaacccagauggugggcgccggggcaggcaguauaguaggagggugggggcagacgcaaaaccaaggcacagacacaggcugagcccugugguccugguauccugguccacugauuugcugugugccuucacgugggucacugaacuucuccccuucacugucuugggccuucgcaucauuagcauccccuaaaagcuuucaaucaucaacuguccaaucaaaucugggagaagucauggagauuauuaaauccaauccucucauguuacaaaugaagaaacagaagggggagugauuggcccaagaucacauagcaaguuaauggcaaaaucaggaccaggacccagguucuaccauccgucuacccaccuaugcacucauccaccuaucuacuugccuacucaucauccauucacucacccaucuauccacccauccguccaucccacaucugcucccaugcacccaacaccugccgccaucuguccauccaccuaucuuugcauccaucaauucuccaucucuuuuccaauccugccucccccuucccuacacccccaucacuggugcccucaccaccugccuuucugaacaagagcuguucaggaagcuggcaccaucagcagggccacuguuccagacacaguucucacaguucuugacagacucauagauguaggaggguacgaggaauacacacagcacacaauggacagccaaaccucuaugaugcaacuauguucugggaagaagugugaauggguaggguuuuuuuuguuuugguucaagguuuuuuggugggaagcaagaagggagggcagauagggaaggauauauauagcugaaaccauuugaauaggcuuucaagcagauguaggauuccaguagcccuagggagcccacuggccaggggauacuggcuggggggagagugaggaagcccaggggccauugaugguuuaaggcaaggggacgcugcauggcugagacaugaccuccaauuacuucuaacacucagguccccaggagaauggcaaggcacugagcuagaucauacaugugucagauguaggaaggcuaggccacaugccugcuggggucuuuuccaacucuucuuuucuguuauuacauagacaucaucuaccuuuacuguggccagccuugggaauuuuuuuuuuuuuuuuugagacggagucucacucugucacccaggcuggagugcaguggcgcuaucuuggcucacugcaagcucugccucccggguccacgccauucuccugccucagccucccgaguagcugggacuacagucgcccaccaccacgccuggcuaauuuuuuuguauuuuuaguagagacaggguuucaccauguuagccaggauggucuugaucuccugaccucgugauccacccgccucggccucccaaaguguugggauuacaggcgugagccaccgcgccuggccugggaauuuucauauccccacuuuacagauacauaucgccacuuuacagaugugaaaacugagaaacaggagaugagaggaagccaggcaaaguuggugcaugcuuauaauccuagcuacucaggagacugaggugggaggaucacuugagcccaggaauucuagaccagccugggcaacauagugagacccucaucucaaaaauaaguaaguagcugggcgugauagcucacgccuguaaucccagcacuuugggaggccgaggcgggcagaucaccugaggucaggaguuugagaccaaccuggccaacauggugaaaccccgucucuacuaaaaacacaaaaauuaguugggugugguggugcacaccuguaaucccagcuacucaggaggcugaggcaggagaaucacuugaaccugagagguggagguugcagugagccgacaucaugccauugcacuccagccugggugacaagagggagacuccaucucaaaaaaaaaaaaauuaaguaaauaaguaaauaaauaaauaaaagcaauaauaauaauaauaauaaaagaggcagaacucagccuugagccagggcuccugccccucugcgcuauccuaggugaugaucuucaguuuagggguggaggaagagauaagcauagagggagggaagcugcuccacacugaccaggacugggagaagcaucaaaaccaccucuaggcugggcgcagugccucacgccuguaaucccagcacuuugggaggccgaggcgggcagaucaccugaggucgggaguuugagaccagccugaccaacauggaaaaaacugucucuacuaaaaauacaaaauuagccgggugugguggcacauuccuguaaucccagcuacucgggagacagaggcaggagaaucgcuugaagcugggagccggagguugcagugagccgagaucgugccauugcacuccagccugggcaacaagcgcaaaacucugucucaaaaaaaaaaacaaaaaacaaaaccaccuccagauuccauaaaugccuggggcugaaagcagaaaaugaggugugggaaggggucaucagggaagcagacucuccgagaacccuccugccauucuugaacuccaggggcuacuagcaaagaucuagaacauuucuuccuguccugacaggccagaugggaaggaaggcugacccuaagaauuaaccacauuuccugauucaaccacaaagccuuaucuggcuaggacccagcugccaccuccuucaggaagcuguccuagguagcccucccuccucucauuugucuucguaauuucuaaauccacccuucuccaacuacugggaaauggggaauucuucauacuucacugauuccuuaaauaggucucaucucccccccaccaaucagaugggagcccagagaagaaaggguccacguauucuuccgucagacuagggacugugaagacaggaacugccucucccaucagaauggaggcucucugagggcaguaguguugucuccuuucugccucugagaaugaagauccuguguucuuuauucaagagcccauuccagggucgagauccucugcuggcuggaguccuccucuuccaggcacccucugggcuggauugggguuuccugcucaaagccauucucgguccauccugauucagcacaaacugcucucuuuucuucccuucaacaacuaacuuucugggguguguagggggacccucccuacauuguguccagggggucaccagaccccucccacccaacccucuccuuccaaaacugagccuagaaaaauuagacaccaaacccgcccccacucucacucccacacacaccccgcacacucucucacacacacacacacacacacacacacacacccccauucagccagguaacugcacaagggugggauugaaccgguuccucuggauacccuuccccccaaggcuuccaauccuggagaaggagcaccaaugaccuuugacccuucucugggagaaagggaggcaggugagcucacagccucuugggacccaggagaaggagaaaggaagaaagggcgcacaauuccuggggagggagcgggagcgggagcggaaggaagugaggaguaggaagaagcagagacagacacacaaacuggcggagaguccacagggcugcugagaagaaagagaucacaccgagaguggggccacgggaacuggcacugggaacaagggcuuccgccgcucuaagugacgcccgagggugggagagaagggagaagcccuucgggcaggcgauaggaaagggccccugaagaggagaaagcgacagagagaagugcaacugggagaggccgggaagagguggaugggaaaggagacuagcggucggggaggcaguuguggagccagagaggugguccccccuucccauaucgccggccguccacuggccccaggcuugggguaguccucaggagucgggcacccccucaaagcacuguuggagauggggugagguuggggacagggcaccuacuccacucucagagcccuucuccccagucagagcccgguggcuaguuucucuccaaaccaucagcacaacuccccgccgggcaagaaagaguuaagcccucucccccuccccccacaccagcuuuuuauuaauuucuccgggcgucgggcgggagggaggggauuagggccauaaauccuaucuccgcccccuccccugacagcccggcaccccagccccgugcggucccccuagggauaggggaagaaaggcccuugucgcuuagcccugcccaaccccacucagggucccaccgcgggcccgaguggcccuagccccaguucccgguccaccccagggcgcccggccccucaccuccggcaucggucaucuucagcgucuggcgccccgggaaccccucaggcccauggugcucgaggcgggggccgggcaggagagggguggggggaccgucaccccggccgcggggggcuccgggcgggcucgagccgcuccaucccgggggugggggugaggucggcgggaagggucccagagccgggggagauggagggcgggggauguggggagagggaacagguucgcuggaagcaggaggcgcgggcggggcuggaccaggagaccugacgggaggaugcuccgugugugugugcgugugcgugugcgugugugugugugugacagagagagagagagagagaagagcgaagagcgagcgccaccucccuccccgccccugccgcccgccaggccuggccggacgcggggcccccgccuggcagggccgauucgcgcggcgucgcgucggcagggguccgcgggggucuccggggaaggggcgucgggguggggggcgcguggcggagaagccgggcgcccaggagacaaagagcgggagggagcgagggggcgggggcgggggagggcggcggggaggaggcggcuggggccggggagcggaguugcagcuacuucucugcccgcgggagacgcggcgcaccggagucugcgcgggugggagcggcuccggggcggucccgccacgggacccacggggcuuccgccuccucugccggguccaucagggcucccgauuaguucauucauucaacaaacguccgccgagcagccggggcgccgaggcuggaggggacagcggugaacagaacccccgcccccuaacugcgcucaaggccagugggccagucgggggcucagacgaguggggaggcccucacgagccugggcgccaugggcccagcuaacagagggcacuucuugccggaagggagagcgcaccccuggcccggccuggguccaggcggccgcggcgggagcugggcugggggauucccagaggaugugauguguuggcuacaacugcgggccaggguagggaagugccaggggguguugggggugggagggcaagaggggaagauaaauugaagcuggggaggugcagggggcuugcacuuuauucuaccagccgcccaccccgccgcccacacacacacacacacacacacacacacgcgcgcgcgcgcacacacacaaaauuaagagga

SEQ ID NO: 16773 - RNA, 5220 nt, Homo sapiens
cagcauuugauuguggcuugggacgcgaggagaggcgcgcagcgaccgccugacggcaggcaaugguguaagcgccucucggccucccccuccccccagacgcggccggguccucccuucgccuucuggacacacaccccugccucgucucuuccgccucucucgcacuccgguccguuccuguccucugcggaggccagcccuggggaggugcagcgcccgccaggaugaguggcuccuucgaucgcaagcucagcagcauccucaccgacaucuccagcucccuuagcugccaugcgggcuccaaggacucgccuacccugcccgagucuucugucacugaccugggcuacuacagcgcuccccagcacgauuacuacucgggccagcccuauggccagacggugaaccccuacaccuaccaccaccaauucaaucucaaugggcuugcaggcacgggcgcuuacucgcccaagucggaauauaccuacggagccuccuaccggcaauacggggcguaucgggagcagccgcugccagcccaggacccaggugagggccacggggucgcgaggacagugggagacacuggaagguucccgagggaggaaaaggcauggacuggaagccaaaaucuaggaaaacuucuaagaaaaguacugucuggaguuagagaaguuggccuagaugacccucagagggaccaggcgaccuuccagccccgggugugcaagcauuuggggcgcgaugugcgcagugcgccgcggucccggaugaggaucgggaugagcugagagaggaaggggaaggcuguggguuguuaggaaaccuccgaaucgaggugauuucgugggcauuucagcaggcgauccucgaucaagucgcagagggcuuggggguaggcggcaggggcuggaaacucuaggggcccuccuuuggauaagggauggggagacuaggagucgugagggggcaaugagaaggacccacggaaguugcgggaaagcggagggaagcagccaccgagaggcagagaagcugaaaaagggaaaagugaaggcagcaagagggaaguauggaaagacagugagagaaagggcagaagaaacaagaaaggaaggagagaaggaaggggggaagaagggggacagggaaagaaagaaagucugcacuauccuugcaacuuuucugaaaaucuaaagagauucuaaaaugaaacuuuuuuaaagggcggggggcggacgggaaggagcgagagaaacaaccgacggcgagaugggacugggaagggggcggcuagcagccgggcggcgaggagccccgaggcugggaggcgagccgggaaggcgucgugagcgaagccgaggcgguccuggcgcaggcggcggcuggcgccggggacagugcugcggcggccgggcgcggagcugggagcgccgcguugugggccgcggccaguucuggcucuggggccgcggcuccccccugggccgcgggcagcggagcgcgcggccgggaaucccgcggcgagucggugggcggaagcgaggggcguccggcggggcccuggagggucgcaggagucgcaggccgaggcugaaccgcccccucuuccgcccggugcguuccccgcagugucggugaaggaggagccggaagcagaggugcgcauggugaaugggaagcccaagaagguccgaaagccgcguacgaucuacuccagcuaccagcuggccgcccugcagcgccgcuuccagaaggcccaguaccuggcgcugcccgagcgcgccgagcuggccgcgcagcugggccucacgcagacacagguugguguuuggcuguccagggccgcgggggcgcgcgggaccccguaguuccccgcgcgcugccgagccuggcuggccacugaagggcccugcgggcuccuggaacucuugccuuugggaugggggccugcgagguucaacuucggugggaagguucugcguuagcacguguacaagugagcauaguugugaacccgugcaacuguguauguuccccuacuccagaauucccagcucccaagucccccagcagugcuagucacuuaguaggaguccacaucguguuuucccuccaggcuaggcaugugugcagacugucugugugcauguauaggcgaguguguuugcacacaugcugugugggucugcaugcaccggaggaugcucauguaaggagugugauccugccggggucauugugcauaacgaugggggcaugugugugugacugugcgcccugaauguauaugcguucugaaugcauguucagaaaugugugcuugcaucaaaauaccacauuccugcucagcacuugaacgcucaagagaggccaaauucccuaccugaaggagauggggacucaaaagugagugccgcacccccacccucauccagucccuaaagcccccagcagccugucacugcucaggggaggagcaguggaugccuggcucccuccagguguugacaggcgggccuagguuguggcuguggcugcguggggccccauccgccgggaaucugggucaccuggugaggagcugauucauuguuuguaccagucaugggguggggaguggcagggggagggggagauaccccaggggaaauuuggggaaucauggcucaccugcuccugaguccccaggucacccccauuauccagcccgagcccaggagaacuucuccacaccugagugugugaaugugggugcucauguuguggggugcuuaucuggguguaucugugucugcguguauuuuuauugucuggugucugugugugaggcugugagugggaacguggcuggguauggagauguguauguggguguguuugucucuguguaucugugcaccucugcuuaugggugucuaaugugaaugaaaugcuacaaaccguccaucucccaccucaacggccuuuuauugagugcuuacuacauaccaggcugcuuuaaguuuuuuauaugucguaccuuauuugagccucagaaugacccuaugaggcagguaauagugcuguucucauccccauuuugcagacaagaggaagucaagaacaagagagguuaaacaacuugcccaaggucacgcuuaguaagugacagagcagaauuuggacccaggcagcugaacguuccuagccacaauucuaucccagauccaagaaacugggagucaggaggccuguuuuuugccugauucuuaugugaaauuggguucuggccuuucuuuuucuuggcuagguucuucccaggguuguuuuagcauucugagaggcuaacuagcuaccccuuucuucucuggcccaggugaaaaucugguuccagaaccgccguuccaaguucaagaaacucuacaagaacggggaggugccgcuggagcacagucccaauaacagugauuccauggccugcaacucaccaccaucacccgcccucugggacaccucuucccacuccacuccggccccugcccgcagucagcugcccccgccgcucccauacagugccucccccagcuaccuggacgaccccaccaacuccugguaucacgcacagaaccugaguggaccccacuuacagcagcagccgccucagccagccacccugcaccaugccucucccgggcccccgcccaacccuggggcuguguacugagcacccaucuggccugcacccuugacaaaggaccccaggaccaggcagaaggcgccuccguccuagccacucaggaaucaucgaggagcacagggaaaaggaacucccuuucccccucccuugccccuuccuccagggacccaagcgcuuccagaugacaauugcauggaccaaggaugcccccugaaccucccucccucugccuagacacugggguaccccuccagauguggggacauuccaccccaguggggacagccauuccccuaccugcuccaggagccuggauuggcuuuaaauggcucaucaucuuccagcuucuuaaacuuagugccuguucccagacuggagaccuugggaugggggagaguguggaggguuugcggguccugccugugcuggggcaccuggcaccguggaucuuaaaacuugccaggccuaguuccuccugagccucugguggucucccccugcucgagcggccccucggccaauaagacaguggacaucaugacgaggacuccggguggggaccugaacuggucaccgcccugcacuucuagcccucauuuaagauuugagggugaaaccaaagaaaacccccuaagugagggaaucuuuuaauauuuguggcuuuagaggaaagaacuaaaggagccaucucucuccccucuccuccguuccgagaggaggggugggucucagacguuuuuccuauggacuuauuucuuccauguccaggacuuugcacaacuuugguuuuaaaagcuguugaaaaauaggaaaacaaagggcauuguucacagauagggccaagucuccccuugcaagggugccucuguucugucccugcccccaccucaccuucucuacuccuccaguaaguuggcaguuuuggugccaaaccccaaaucuccaaagagacauaccaggcaagacaaacccccaaacaccuccuuuccgguggccuuggaaacagauugcuccgagcuggagaaugucgggugagguguaugggagaggaggggagaguuagaacuugugccuuugggaguaagggguaacugccuggagggcugguggcacugccccucccugacccagacaucccaccaaagcuaacuuucccccaccccugaugcaguaaaacauugaaaaaaaaaaaaaaggagagguagaagacuguagcuauauauauaaauauauaguaaguuuuuuuuuuuuaagagcaacagagagaagcagccuccucccugcugcgguuuccuauuuauguggccauguuccuccuggacggaucucccuguguguuucaagcugagagaugugggcuccggcuggauuuggguuuugugggaggugcaggggccaagagagacgugguaggucuccaagagucccacccgggggggaagaagcaaagccaucucccacccccucccagccuucucauuucugcuuucuuacuggacucaucuuuauauauaauguuaauaaaaaagacgaaaaua

SEQ ID NO: 16774 - RNA, 5220 nt, Homo sapiens
uauuuucgucuuuuuuauuaacauuauauauaaagaugaguccaguaagaaagcagaaaugagaaggcugggagggggugggagauggcuuugcuucuucccccccgggugggacucuuggagaccuaccacgucucucuuggccccugcaccucccacaaaacccaaauccagccggagcccacaucucucagcuugaaacacacagggagauccguccaggaggaacauggccacauaaauaggaaaccgcagcagggaggaggcugcuucucucuguugcucuuaaaaaaaaaaaacuuacuauauauuuauauauauagcuacagucuucuaccucuccuuuuuuuuuuuuuucaauguuuuacugcaucaggggugggggaaaguuagcuuuggugggaugucugggucagggaggggcagugccaccagcccuccaggcaguuaccccuuacucccaaaggcacaaguucuaacucuccccuccucucccauacaccucacccgacauucuccagcucggagcaaucuguuuccaaggccaccggaaaggagguguuuggggguuugucuugccugguaugucucuuuggagauuugggguuuggcaccaaaacugccaacuuacuggaggaguagagaaggugaggugggggcagggacagaacagaggcacccuugcaaggggagacuuggcccuaucugugaacaaugcccuuuguuuuccuauuuuucaacagcuuuuaaaaccaaaguugugcaaaguccuggacauggaagaaauaaguccauaggaaaaacgucugagacccaccccuccucucggaacggaggagaggggagagagauggcuccuuuaguucuuuccucuaaagccacaaauauuaaaagauucccucacuuaggggguuuucuuugguuucacccucaaaucuuaaaugagggcuagaagugcagggcggugaccaguucagguccccacccggaguccucgucaugauguccacugucuuauuggccgaggggccgcucgagcagggggagaccaccagaggcucaggaggaacuaggccuggcaaguuuuaagauccacggugccaggugccccagcacaggcaggacccgcaaacccuccacacucucccccaucccaaggucuccagucugggaacaggcacuaaguuuaagaagcuggaagaugaugagccauuuaaagccaauccaggcuccuggagcagguaggggaauggcuguccccacugggguggaauguccccacaucuggagggguaccccagugucuaggcagagggagggagguucagggggcauccuugguccaugcaauugucaucuggaagcgcuugggucccuggaggaaggggcaagggagggggaaagggaguuccuuuucccugugcuccucgaugauuccugaguggcuaggacggaggcgccuucugccugguccugggguccuuugucaagggugcaggccagaugggugcucaguacacagccccaggguugggcgggggcccgggagaggcauggugcaggguggcuggcugaggcggcugcugcuguaagugggguccacucagguucugugcgugauaccaggaguugguggggucguccagguagcugggggaggcacuguaugggagcggcgggggcagcugacugcgggcaggggccggaguggagugggaagaggugucccagagggcgggugaugguggugaguugcaggccauggaaucacuguuauugggacugugcuccagcggcaccuccccguucuuguagaguuucuugaacuuggaacggcgguucuggaaccagauuuucaccugggccagagaagaaagggguagcuaguuagccucucagaaugcuaaaacaacccugggaagaaccuagccaagaaaaagaaaggccagaacccaauuucacauaagaaucaggcaaaaaacaggccuccugacucccaguuucuuggaucugggauagaauuguggcuaggaacguucagcugccuggguccaaauucugcucugucacuuacuaagcgugaccuugggcaaguuguuuaaccucucuuguucuugacuuccucuugucugcaaaauggggaugagaacagcacuauuaccugccucauagggucauucugaggcucaaauaagguacgacauauaaaaaacuuaaagcagccugguauguaguaagcacucaauaaaaggccguugaggugggagauggacgguuuguagcauuucauucacauuagacacccauaagcagaggugcacagauacacagagacaaacacacccacauacacaucuccauacccagccacguucccacucacagccucacacacagacaccagacaauaaaaauacacgcagacacagauacacccagauaagcaccccacaacaugagcacccacauucacacacucagguguggagaaguucuccugggcucgggcuggauaaugggggugaccuggggacucaggagcaggugagccaugauuccccaaauuuccccugggguaucucccccucccccugccacuccccaccccaugacugguacaaacaaugaaucagcuccucaccaggugacccagauucccggcggauggggccccacgcagccacagccacaaccuaggcccgccugucaacaccuggagggagccaggcauccacugcuccuccccugagcagugacaggcugcugggggcuuuagggacuggaugagggugggggugcggcacucacuuuugaguccccaucuccuucagguagggaauuuggccucucuugagcguucaagugcugagcaggaaugugguauuuugaugcaagcacacauuucugaacaugcauucagaacgcauauacauucagggcgcacagucacacacacaugcccccaucguuaugcacaaugaccccggcaggaucacacuccuuacaugagcauccuccggugcaugcagacccacacagcaugugugcaaacacacucgccuauacaugcacacagacagucugcacacaugccuagccuggagggaaaacacgauguggacuccuacuaagugacuagcacugcugggggacuugggagcugggaauucuggaguaggggaacauacacaguugcacggguucacaacuaugcucacuuguacacgugcuaacgcagaaccuucccaccgaaguugaaccucgcaggcccccaucccaaaggcaagaguuccaggagcccgcagggcccuucaguggccagccaggcucggcagcgcgcggggaacuacggggucccgcgcgcccccgcggcccuggacagccaaacaccaaccugugucugcgugaggcccagcugcgcggccagcucggcgcgcucgggcagcgccagguacugggccuucuggaagcggcgcugcagggcggccagcugguagcuggaguagaucguacgcggcuuucggaccuucuugggcuucccauucaccaugcgcaccucugcuuccggcuccuccuucaccgacacugcggggaacgcaccgggcggaagagggggcgguucagccucggccugcgacuccugcgacccuccagggccccgccggacgccccucgcuuccgcccaccgacucgccgcgggauucccggccgcgcgcuccgcugcccgcggcccaggggggagccgcggccccagagccagaacuggccgcggcccacaacgcggcgcucccagcuccgcgcccggccgccgcagcacuguccccggcgccagccgccgccugcgccaggaccgccucggcuucgcucacgacgccuucccggcucgccucccagccucggggcuccucgccgcccggcugcuagccgcccccuucccagucccaucucgccgucgguuguuucucucgcuccuucccguccgccccccgcccuuuaaaaaaguuucauuuuagaaucucuuuagauuuucagaaaaguugcaaggauagugcagacuuucuuucuuucccugucccccuucuuccccccuuccuucucuccuuccuuucuuguuucuucugcccuuucucucacugucuuuccauacuucccucuugcugccuucacuuuucccuuuuucagcuucucugccucucgguggcugcuucccuccgcuuucccgcaacuuccguggguccuucucauugcccccucacgacuccuagucuccccaucccuuauccaaaggagggccccuagaguuuccagccccugccgccuacccccaagcccucugcgacuugaucgaggaucgccugcugaaaugcccacgaaaucaccucgauucggagguuuccuaacaacccacagccuuccccuuccucucucagcucaucccgauccucauccgggaccgcggcgcacugcgcacaucgcgccccaaaugcuugcacacccggggcuggaaggucgccuggucccucugagggucaucuaggccaacuucucuaacuccagacaguacuuuucuuagaaguuuuccuagauuuuggcuuccaguccaugccuuuuccucccucgggaaccuuccagugucucccacuguccucgcgaccccguggcccucaccuggguccugggcuggcagcggcugcucccgauacgccccguauugccgguaggaggcuccguagguauauuccgacuugggcgaguaagcgcccgugccugcaagcccauugagauugaauugguggugguagguguagggguucaccgucuggccauagggcuggcccgaguaguaaucgugcuggggagcgcuguaguagcccaggucagugacagaagacucgggcaggguaggcgaguccuuggagcccgcauggcagcuaagggagcuggagaugucggugaggaugcugcugagcuugcgaucgaaggagccacucauccuggcgggcgcugcaccuccccagggcuggccuccgcagaggacaggaacggaccggagugcgagagaggcggaagagacgaggcagggguguguguccagaaggcgaagggaggacccggccgcgucuggggggagggggaggccgagaggcgcuuacaccauugccugccgucaggcggucgcugcgcgccucuccucgcgucccaagccacaaucaaaugcug

SEQ ID NO: 16775 - RNA, 1370 nt, Homo sapiens
ugaagcauaauacuuuuuaauaguaucuuaaauguuauuuucuuucccaaaucccuuuauauuauuauaucaugugcuuuucacaacugcaugcauucucuuuggggaccuuccagucucauucugacuuguaagucagagagcauugaucuuggaagaccaggauuuguuaacggagucgcggugcaaacuugggcaaguuuuucaguugcuuuguuccuuucacucugcugagcuagacuuggaguggacgacucugaagggaaauucccugcuucuuuucagagucccaauuuaauuuacaggcuagcaauuguuuuuuuaagguuggaucaacaccaaguagggacuuggaaacguggagaaagacagauguaagugucacacgaggcaaggucgccauuaaauacacaaauauaaugcaaaucacaugcaaaugauaugcaaaccuugcauuaauuuguaggaucuuaguuuggagcuuguaaguagcacugagauccuauaaggauuuaaaacuaauguuuuuuagguuaaauuaaauguaauacuuuuugaagguaucgcuuucucugugauucagggacucaacuguguaaaguuugacacugcucccuacucccgcccccaaaaauuauuucacuaguguuugacuccaaccuacacccagcgccgcgcccacucuccagcucagccugacgucacgugacauuauauuugcauacuaccugggacugggugugacgcuccccuauucugcgucuucucauugguggcgcuggagaaccagcccucuucuguacaggccaaucagcagccccugggauguuggaaaaccgaagggggcggugugaggguggggucuuggcuuggaucgcuaggcucaucgaccaaucauccucaggaaagggaaggcuaagcuguggauuggcugggguggaaggucuggguuuccgcaguccaaugacagcucuaggaugagggggccgguccccgccccguacagcagauaagcagcggccucggggguuggggggcugugugagucucgcaguggggcugaggcaggcagccgggagagccauggcgggggccgcagcgggcggcagaggcggaggugccugggggccggggcgcggaggggccggggggcuccggcggggcugcucucccccagcccccgccggcuccccccgggcugggcugcagccgcucagggccacgauccccuuccagcugcagcagccgcaccagcgccgggacggggguggccgugcaggugagccgggccuggagcgggugccguggaaggagccauugggggagggggggcgcgugaccgcgggagggggacggggagaagugugagg

SEQ ID NO: 16776 - RNA, 1370 nt, Homo sapiens
ccucacacuucuccccgucccccucccgcggucacgcgcccccccucccccaauggcuccuuccacggcacccgcuccaggcccggcucaccugcacggccacccccgucccggcgcuggugcggcugcugcagcuggaaggggaucguggcccugagcggcugcagcccagcccggggggagccggcgggggcugggggagagcagccccgccggagccccccggccccuccgcgccccggcccccaggcaccuccgccucugccgcccgcugcggcccccgccauggcucucccggcugccugccucagccccacugcgagacucacacagccccccaacccccgaggccgcugcuuaucugcuguacggggcggggaccggcccccucauccuagagcugucauuggacugcggaaacccagaccuuccaccccagccaauccacagcuuagccuucccuuuccugaggaugauuggucgaugagccuagcgauccaagccaagaccccacccucacaccgcccccuucgguuuuccaacaucccaggggcugcugauuggccuguacagaagagggcugguucuccagcgccaccaaugagaagacgcagaauaggggagcgucacacccagucccagguaguaugcaaauauaaugucacgugacgucaggcugagcuggagagugggcgcggcgcuggguguagguuggagucaaacacuagugaaauaauuuuugggggcgggaguagggagcagugucaaacuuuacacaguugagucccugaaucacagagaaagcgauaccuucaaaaaguauuacauuuaauuuaaccuaaaaaacauuaguuuuaaauccuuauaggaucucagugcuacuuacaagcuccaaacuaagauccuacaaauuaaugcaagguuugcauaucauuugcaugugauuugcauuauauuuguguauuuaauggcgaccuugccucgugugacacuuacaucugucuuucuccacguuuccaagucccuacuugguguugauccaaccuuaaaaaaacaauugcuagccuguaaauuaaauugggacucugaaaagaagcagggaauuucccuucagagucguccacuccaagucuagcucagcagagugaaaggaacaaagcaacugaaaaacuugcccaaguuugcaccgcgacuccguuaacaaauccuggucuuccaagaucaaugcucucugacuuacaagucagaaugagacuggaagguccccaaagagaaugcaugcaguugugaaaagcacaugauauaauaauauaaagggauuugggaaagaaaauaacauuuaagauacuauuaaaaaguauuaugcuuca

SEQ ID NO: 16777 - RNA, 6989 nt, Homo sapiens
ccuguggugcucugggucgcaguuguccucagaguugccugauuggaaaaaucuccagggcgagggaucagucucgaggcugccgguuccccuggcccucagggauggagccaaggucccagggcggguuuucuuuccuaggaagugguugcuggguucugaggaguuucccccuuggcagccaugagccggcaguucugguagugacugcugggcccugcuggacagcggucgcaugcagcuccuaugaggccccugccgccggucggcgauguccggcuggagcugucgccuccgccgccgcugcugccggugccgguugugagcgggucuccagucggcuccucugggcgucucauggccucuagcagcucccuggugcccgaccggcugcgccugccgcucugcuuccugggugucuuugucugcuauuuuuacuaugggauccugcaggaaaagaugugagcgaccccgggggcgggccgacagucucuccccagccugugacagggaucccgggccuucugccucuggacccgggcuuuccucuuguccuccugcccggcugucgcccucuuagcacccuacuacuuuugcagcuauggcugagccuacccagaauuccagaacuccaggauuauuuucuggauucuucggacuugguuauuuucuuuucuuagcuguuuuuccccgcuugguucuaagggccugcguuuuacaggcugagacuucuauuccucaaacaggacccgagucggcccccuuuugguacucccagaugcuugcaaacaaccuauucguccucggccuuggugccauagccgaaauaccgucuccuccugccugggguaccugauuucacuaucucguucugcauguuuccucuccgucuuuuucggguauucuuuucuuaggcuuuggaaucaguaggcugggaugucuaguuucuagauccaguaaaaucagccccuuuugcaaaugagccuagugguccuuaacaaacucugccuacauccagagaggcaagauaauuuuaaaguuuucaguggcucgggauauauuagaugacagugagugaaauacacuaauuucucccucuuuucucaugcauuucauuucuagaacaagaggaaaguauggggaaggagccaagcaggagacguucaccuuugccuuaacuuuggucuucauucaaugugugaucaaugcuguguuugccaagaucugugaguacccagauaguaauuuguuggguaccccaccaccccaaguucccucaguaugcugggcauuaagcauugauucaaccuuaaaggcuaacucaugaucuccaccccauuuuguacuuacacagccucucugugaagucuguaaaacuaaugacuuugaaguggaguaaaauauuauuuccccaauuuuuaucagcuucugaguuagaaauguucagagaaugggucuucuauauuccaaauccccauugaaaauacuuaaaacauuuuuuucuuucccuuugaguuucuuuugugugucagcuucaagcaugcuuugagcauucucucuuuguucccuggggacuagcagcagagcugacuggucccuugaacugaaugaggcccccaccuccacccugcauguggucuuuuguugggcuuagguagaauuggaaagaugaauaauuuucagagauuucccaguguaacaggacagaaauagcuugugucuuguuugacagacaaguuccuuucauguggcuucagcuuugcuuagugguccauccuagccccaccagguuucucuuguuuuuuuuuuuuuuucuuuucuuuucuuuuuuuuuuuuuuuuuuugucuucucccagugauccaguuuuuugacacugccaggguggaucguacccggagcuggcucuaugcugccuguucuaucuccuaucugggugccauggucuccagcaauucagcacuacaguuugucaacuacccaacucaggugaaaccucagggugggaugaugguuggcucagauaucauuugaaaaggacuaagaguucuucccucaggucugugaguuaaaaaaaaaaaaaaaaaaaagauaacgguccuguaagacauugggaguguauagaaccauagaacuuacguuuaguggugguggguugggccaugauagggcugcuuucugaggcugaggucucuggugcaggcccugugcuuacucaucuuaaucagugcgguaccuagcauaguaccugacacaucacagaugcucagaaauuauuugcuggauuuaauuucagguccuugguaaauccugcaagccaaucccagguaagcaaagaagauggucuuccucuucugucgucacucuuccuauaguaagcucucucucugcuacaacugugucccucucggcuucaucaucccaucauggcugucuccagggacuuucccccagcucucccugcugcccauccugucaucugugucacuucuugugauguucauaggcugguaauccuuaauaggagcuaaaggcugaccuagccugcuucacuuggucagccauuucuguguugcauguguuuauauugucauuagacaacuuaauucccauuuugaucaucaguuucuuuaucucaacuucuuuuccuucuccacuguucccuacccuuguccugucccuuccuggacuuuucaccuuuguucucuaccuccucccugucuuauacuuaacccuguugcucaauccuuaucuaggugccagccuggcacccuccuuuuguccucucuaagccuuccuucucagucauucuuuucucccugagucuuuucuugguuccugggagggagggcauuggggucaucaauaccuuauggaugccugaauuuuccacucuguuuuuucccuguagucaugcuccuuggggugacccucuugaagaagaaguacccguuggccaaguaccugugugugcuguuaauuguggcuggaguggcccuuuucauguacaaacccaagaaaguuguugggauagaagaacacacagucggcuauggagagcuacucuugguaugagauccuguuggggaaggcacccuuuuccagcaaacuuaaccaaaggauagucucaccuaggcagguagaaggccaguucugugucaagggagguuguggugcuccuuguccccauaucugcucuuugcugcaggccccugacucuauuaaugccauagugggaaaccugaaauauuuaacuacaacucagcucucauucuggagaagagauaacucugaggguuguggcugaauccuggugugaggucacagagaccugagagcaaagagggaaggaauaaugucucucacuguggcuuuccaagaaaccuggaagccagaguuuaaaauaauaugauaguagcugguauguaugcauuaggcacuguuccgaguguuuuacauguuaauugacuaauuuuuacaacaauaaucucauauguaguauuaucuccauuuuacagaugaagaaacuaggcacagagaaguuaacucgcuugcccauggucacuuggcuauuugaagugguagagucaggauuccaauccaggcagccuaagcacaggauccggucucuggagcacuauacuccaagcuaggaagcuaaccugcugggacuaccuuuccccucccaguauguugggaagugagcuuccugcucuacucugauuacaaaaucacuacguagcucaguuagccugucaguccagugcgugggccggggggcgggggugggggguagugagcauggucucuccccaccuuccaccugugaccaaauggcaacguuuuguucugaggacuuuaaaggcaguggcuuuccaaggagccugagagugagaauccuguguccuggguuuggaaagggcccuguuggccacuucacugcaggcugcacccuuucuuucccagcuauuaucgcugacccuggauggacugacugguguuucccaggaccacaugcgggcucauuaccaaacaggcuccaaccacaugaugcugaacaucaaccuuuggucgacauugcugcugggaaugggugagagccaguucugcuguucuucccauguaucaccagagggcaggcugcccucauccuuuugaucccucuagcuguuaguugcccagaccaagggccugaauuaguuccaagaugcccuuuuguucaagcccuugagaaaccuuccuggaaaaaccugcaccagcaggauuuguuugcuacuuguuacuggcacaaugaaggagagucgugugucaguugucaugggaagacacucaguaguaaaacacagggagguaccugggaacuuucccuuucaugagggaaaugagacacacguagugcucacaggaaacagaguuagcuguacacugaagacaguucaaaugugaaugauuugcuuugaaaucagugcuuccuaacuuuucaaauuugggcacauguagaaaguauuuuuuauacagcacacugggguuaaugguggaggcugcugauggcugaaggugacuaaugcgaggggcuuccuugagcuaaggaugugugggucagcaucucuacagcaucugaggauuucugcuuguaaucacuuugguagaaguaacucauuaacuuucaagccuuucucacaaaauucucuuuaguuucucuaaucagagaaaaauaugagaagaaucaaugaugagacgaugcaaacccacaccauacacuuucccgcgucccaccucccuugcaguucuuuaacaggccaugugcaggagugucugugugugugugugugugugugugugugcgcacauuuugugugcacaaaaugcgccguacauuuguugacaugucuucucaggaauccuguucacuggggagcucugggaguucuugagcuuugcugaaagguacccugccaucaucuauaacauccugcucuuugggcugaccagugcccugggucaggugagugcuugaaaggggauggcuuggcuucccuacucuggcagcugguucccuaagaaagacuggccuggcuggaagaagaggguggcaagauuagcccugaggucuguuuauagacuuuagaccaauggcagauacccagaagcccaccggaccucaccuuuaucuuucucuagagcuucaucuuuaugacgguuguguauuuugguccccugaccugcuccaucaucacuacaacucgaaaguucuucacaauuuuggccucugugauccucuucgccaaucccaucagccccaugcagugggugggcacugugcuuguguuccuggguaaguggccacacagagacacagugacagcugaauuuuuucuccuaaaauuuacuuguauauuuaugaaauuuguuuaaauauuuuagagaaaacuuuucucuuuuuuuugagacggaguuucgcucuuguugcccaggcuggagugagugcagugguacgaucucagcucaccaaucgggugagccuccuccuccuccuggguucaagcaauucuccugccucagcauccggaguagcuaggauuacaggcaugcaccaccaugcccggaugauuuuguauuuuuaguagagaugggguuucuccguguuggucaggcuggucucgaacucccaaccucaggugauuccccccgccucagccucccagagugcugggauuacaggcaugagccaccgcgcucagcccagagaaaacuuuuuuaaaagagaaaagaggcugagugugguggcucacgccuguaauucuaacacuuugggaggcugaggcaggaguaucgcuugaguuuaggaguucgagaccagccugggcaacaugaugagacccuugucucugcaaaaaaauacaaaaauuagcugagcaugguggcagacgccuguggucccagcuacucggggcugaggugggaggaucguuugagcccaggagguggaggcugaggugagcugugaucacaccacugcacucccaccugggugacagagugaaaaucuguauccaaagaaaauaaaaggagaaaaggaagcuuuauuucuaauccagccuuccuagggucucccucuguugcucaggcuggaguguaguggcaugaucauaguccacugcaaccuugaucuccuggacucaagugauccacccaccacagccucccgaguaguugcgauuauaggcauguaccacaauaccugaccaauuuuuuuuuuuuuuuuuguagcgauggggucuugcuguguugccuaggcuggccuuaaacuccugggcucaaaugauccuccugccucagucucccaaaaugcugggauugcaggugugagucaccacauucagccauagccuagaaguuuugacucuuaaauuucuuuuagucuugcuguauuauauauguaucuauaucuaucuguaucucuauauagauauauuuauauagauacagauaucuguaauaacuaguauccuggugccauucucuugucucugaggaaguuacauaaaaccaguguucugacauguauuuuauuuaaagcccccauuuuggagauacaaggccgacuaccccaccccaccacaaucauugguaaguuucauuuccccccauaaggcuaagcccauuuucuuccuuuucauaggucuuggucuugaugccaaguuugggaaaggagcuaagaagacaucccacuaggaagagagagacuaccuccacaucaagaauauuuaaguuauuaucucaaacagugacaucucuugggaaaauggacuuaauaggaauaugggacugaguuccagucuuuuuuaauaaaauaaaaucaagcaaaaucacauauucuaaaaaaugcacuuggauuuuaacaagacagaguggugguuuuuguucuucaugcccuggagcagucuaugguaaauaaaagagggagggaagaggcagagcuggauguuca

SEQ ID NO: 16778 - RNA, 19746 nt, Homo sapiens
cacuggcuucacccagccucucccgcccgcagccagagcgagccgagccgcggccagcuccggcgggcagggggggcgcuggagcgcagcgcagcgcagccccaucaguccgcaaagcggaccgagcuggaagucgagcgcugccgcgggaggcgggcgaugggggcaggugccaccggccgcgccauggacgggccgcgccugcugcuguugcugcuucugggggugaguguuagccggagggggcccgcucccuuucccgggaucagaacuccgagaagagccgggcgccgccaccaaggaaacagaacagagcauuggggucccagauacugaggguggguggugggaaaggaccucugaugccgggaccacgaaggagggucuaggguucccggagcgcagaggcgacucuccaggguggagaugagggcaagaccggagcacggaugccgguccucagguaccgcagggggcggugggggagcugggaggggucuuucaagagggggcauggggcucuccgaugcccagguucuucggaagaggacacucgaaugccgggaucccgaagggacuuuccccucagcaucucggucucuggagagucgugggacagaaccaaggcgagagaaggagggggaacuggacggggacuagagaugagaggggcgagcugggcuggggcggggagcccgggacgacgggauggaacaauggaggaggucggagggacuggaggcagaggggacccggcaaggacaauggggaccggccagacaaugggggggaggggcgucggagggagagguuggggagcgggagagagguugagaaguggguuagggagggcagaagaggggcgacggcgagggcggcagagagauggaagcagaaggaaaggagacagagcggggcgcggacccugaaguggucggggucccgccugcccgcugagggacagugagacgagaagagagagcagaggcuuggacauuuccagcgccuguccccgcgcuccugcucgcggccucucccagucccggaauuggggcugcggaucuaaggcugggaggggagugcccacuucgccggggcgaacccgcucccgggguucccccacggccggcgggcuccuccgacgcgcguguucucacggcuugaagcagcgcagcggaucgcgagggacggagcgggugugccccuacccgggcuggcgguggcuacgucucggggugcagagcgccggggcgcacuaggcggggacccuuccuggccgcgcgcagcucuggcuacgcaggcgggaggcggcaggcagggggcgcugcggggcgaggcaagugcaguccgccgcugccugccugcgagucuggggcugcgcgccgcuccccaccuagcugcgcgacccgagcgccgcgcccaccgcgcuccgugggcucccgcgccucgaagggucgggauccggucugagccucuccuggcucucggugcaagccgcugggcaccuaacgagacgggggcgcccggacgccucggauucuguagcgcgguaucccgggccaccgacucggcaaaggucggcggguccuccgggugguccgacgagauugucagauguggccugcuuuauggccaugaaccgaaugcccuggaaggucuggcaacggaggaggcgucuucacucuccccgccagcaucuuucaucagagcacugcgccccaaauuccggcuuuacagauacggagacugaggcucugagaguuuaaacgacuuggccaagaucucacagcaaguugggccagagucguggcuagacuccccgaccugauucccagcucgguacucccccaccuuuucagggggcagccgcugucccagcucggggucacggcugcguuucccagcagggcgggggggguugacacuguccccagaguccgucggcgguagagccugcgggugaggugggcagagauucuguccgggugcgggccccagcccgaaagcucagccccaguucccuggagcugucaggaccuguggcugcguccggggauuugggagcgaccgcgggcacgucugcugacuaacgccgcugguuagagacgcugcucagacgcgggugggcgagcguagaccaggagagcggggaggagggaccggaucccagaggggcaacgacuugggcuccgggucugggcaagagcgaggguccccgcgcgaagacccaaggaaggaggggagcugggcguggaggaccugggcgcuugggaagguguaccccgacaggaaccugccgucugcagccccugcggcucccgccuccgccucggcgcgcggcugcucggucugggauggcugugcgcgguccgaguuucuuccugggccgcggugagagagagagggcugaaaccagagcgcgucccggcgggucggcuggcgggccgcgccgguaauggaggcacuuugucauucagacgucuguaaccagagccgccgggcuggcuaaugcgccuaauagggauggaacgagggcagcaaaugggcgugcgugagcggccgggcugagcuggguggaugguggauggggaggcagcuccgcgggggacgggccccuaccgcacuguuccagcccagucuggcucaagcgccucgcuucuucccugggggaccgcguggggaggcgggaauaaucgcaugugcugaguuccuacuaagugccuugcacuucccugguaguuucucuugaauuauuuaauccuuauaagguccuagcaaggugaauuuaguuauucccacuucgcaguugaggaaacagaaccuucuagacuuucaggcccgagaccaggcucccccagugagucagugguggcgucuuuguuggaacccaggaugcuuggccugggauguucucuuuccuacauaugccaggcucccucccgcccccuaccuucuagaucauggaaggagucguggcucugagagauuaaaucgugcccuaugccuuuggccccacacauuuagaucugagccccuucuccacacgcagaggcccugcccccucucaagucucuaugcuacauuaucuuggguaauuagcuccuuuccucccaacuccuccccuauccaaagggagugagggguaugugccagugccuccccuggguuugcaucgaccucaaaaggcccuccagguguuugaaaaucucucccaucccauggcggugaccacggccccauucacuuaagagcucuuugcugaagcuguuggaauggccagggcugauuauacugaaacauucguaugguuucaaauacuuucaacuguuucgcuguuucucucuuuucucuaauuaaaaaaaaugaaaauucuuaaaagucaauucaucuaaggauccuuccaccuuaguuccuuguaagccuugaaauggccaaaacaaaaagauuacaagcguucuuaaaaaugagaugaaaucauucugucaaaugugaaaugacuaaguguaacacauacaaauuucagggaaauuuaucugucaucccuauaaauuaauccuuuuggaucugauuuuggagcaauuagccugaauguuagucaccccucccuacuuggcuaaacucuccccuccugccuggggucuccuuaagaugagaugcuucuuugauaacuaacauuuauuaaauuccuacuguagaccagacauauuugcauaaauuauuucacuuaauucucccagcaauccugggcaauagacauuaucaacccaauguuuuaggugagaaaaacugagguuuagggaaauuaaguaauuuacccuaagcaacauacuauuaagaagcagaucuaggauuuuacaacauagggaacauaaaacaaggacaggaaaugcaugguuacuaauuaucuggccccuacuccaaaugcaguuuuuaagagaagagagaggaccucaggcugcagcagggagaacagguuucuuggcaggggcauuugcacaaagcccccacaccacccaagaccacuguagacagaucuccucagcuguccagagcccaacaaacuggaacacagccaauggccacaaaguagacccuggaggacagaaaagaggggucccaaaguacauaaauaccuuauuuacuuguguaauacuuacagcaauccuaugaugcagguacugucaucauuaccuaauuaugacccaggacaaguguggagccaggauucagaguggcgugagagcucacagauuguauucagaggcuugccuccuccugguucagauccuauuuacauaccuuuauauuuuuuauuauuuuuauuuuauuuauuuauuuauuuauuuugagacggacugucacucugccacccaggcuggagugcaguggcacgaucucgacucacugcaaccucugccuccuggguucaagcgauucuccugccucagccuccugaguagcugagacuacaggcgcccgccaccacgccuggcuaauauuuuguauuuuuaguagagaugggguuucaccauguuaggcaggauggucucgaucuccugaccucgugaucugccugccucggccucccaaagugcugggauuacaggcguaagccaccacgcccggccggcacaugccuuucuaccaaggcgaguuccacaguuucugaagauucaauuagaccuuaaauagauuagcguggugggggaaggguugcuucaggucacacucugguagcagcaagaagugacaacugauaccuugacaggaagggaggaaacagaaaagcuauauuaaaaaaaaaaaaaaggcugacaggagaacucaaaaagacaaaagugugguaauuugggaaaagaacaaaagaguuucccuguauugcagcccagaguaaucgcugguguaaauacagagucccugagucaugggaagccaugaagcuuugcuccagagacagggaagggugcagccaccauggugaaaagcaaaaaugaugagggcagcaaagccuggcagucuggaaucucggcuaaccaacagucgcucucccagaguucugguuaauugaggucauacaguauuuucauguauuucaacuccacgcguguaugcauugugucccuacugcaugccagauaccgcaucaggcccuggggcaauccagcucccucagggagcugacaguccaaugagggagucuauaaaguucaggccagacaaaagcagagagaaccggagaacaggcuggaugcguaacauggcagccccaccuaaucugugagcggugggugcaacaggaccacuuccuugaggaagugacauuuaagcagagcccuaaaggaugaaaagaaaucagaacaggcccuucuggaaucuugccucuugagggaaagccugcaucugggacccugaggcuccuggucugcagauguucccagcacugaguguguugcugcccuggaggaggugcggcaacaccaagguuccaccuccucuguugccugugccuguccugcuggucucaugaggaccacagacucccuccuggguugauccaaccugucuaucccccugacuccucuguuuccuuccccaccaaacccugaugaggccgcaggauauuuuaaaaggcuggagggaaaggagugucuuggccaugaucuggccaauguagaagaagcagaaugcccaaaacaagcuuguaaagcuucccucuggucccacgaccccaaagcccauacuucucagcaucaaaugagggcugcauggucuggagcuagcaaagcaggcuuuggaguuuuauuagacauuaaguuuuuuuuaaaggaacagaaauauaaagcaagccuccaccagccccuuccccuggggaaucugguguuaaauuguuacauccacgagcaaagaugcuucaguggcaggaaccugacuccccuuucccuugguuccagcccuguucccaguggccacaugggggagggggaggacugguggcuggaaaucaaaccguggcagggcagggcugcuggguggugagagcagccacugucccaucauugauaacaguucucccuuucucuccaucuuggugcgaggcuuuugccaaauggcuggccuuuugcccuggcaccaggcuguugccaucucuguagagaaaugaagacucagagggaagaugggcaagcaagacccccaguguagagucaggauucaaacccaagacccuggcccucuccuuucugcucuugggcauggacaucuuccauuuauuauuuaauauguggaauuaaggaccuggaguaaggcccugcuggccuuuguuagaaaaaggcccuccucuggguagauacaacccagcaggugcaaagcuuagcaaauggaguuugggauagguuucagcucuacuugccccguuggcugggagcccugugcaagcuacaaccuguccaaccauucaugacaucccuguugguaggcccuccgcugggccucuggccaccuuccccaugugguauauccuugggauuccaggaguugcuguaaccccaggaugaacuuugcagaaggucagcagcugaagcucugaccucacacccccagcagccugcacgggcacacugucccucacuugccuuuccccugucagcuuugauguuccuaacgccucccuggugagcucaucccagcccaggugguucuaauagaaggcagugggaggaggguguuugauuccccggaagaaccccccccaacccaccccagcuuucucuugccagucugacccuccgaucucccuccauccaggugucccuuggaggugccaaggaggcaugccccacaggccuguacacacacagcggugagugcugcaaagccugcaaccugggcgaggguguggcccagccuuguggagccaaccagaccgugugugagcccugccuggacagugaguagaggguggcgggcaggaggaggggagaagaaugggagggaggagaggggugaaagggaggggcgcuggggagaagcaugcccaguagaggccuuauaagaccaccacuguaaggucaucagaagugggucugacccaguguaggaggcgcuucucccagauucgagaagcugagaauggagaagggaagugugcagagggaggaggggaaccccaugggggaucuccaaggggugcccauucccagcucuggagaaggcagaggcuugguagaagaguguggcugggcagggaggaguagcugaugcuaagaccagcuaaaaauaucaucugcacugcaaaaucaauggcugccacuuauccccgguguguuugggggaagggagaggaggaucaaauccuggcugcccugaaggcugaccuugggggauccuggggguguggcuguuccucccuacaggccaacucuucuccagcuuugaccaggaagcagaguuuucccgaggcagcagggaugggggucagagcgccaugaagacguccuuacuguggggugacagaggggaggggagacggggagcugugcccauuccugccugggauuucuuccuuccuuccuuccuuccuuccuuccuuccuuccuuccuuccuuccuuccuuucucucucucucuuucuuuaccuuucuuuccuuucuuuccuuuccuuccuuccuuccuuccuucaacagaguuuugcucuguugcccagguugggagugcaauggcaugaucucaacucacugcaaccuccaccuccugguuucaagugauucucaugccucagccuccugaguagcugggacuacgggugcaugcaugccaccaugccuggcuaauucuuguauuuguaguagagaugggguuuuaccauguggaccaggcuggucucaaacuucuggccucaagugauccaccugccuuagccucccaaaguguugggauuagaggcgugagccaccgugcucgacccugccugggauuucuuucaggaggggagagaaucucaucuuccugggcuggugggucugggccccuuggccccagucuuguccagggucugaauucccucaugcuuuugagucaggagucucggucccugaucggugcccccaguccucaguugcugccuuugggccgugggcucccugcccuuuuccugacucccugccuucuaccuggcacucgaugcccaccuggagggcucgagggaaccauacucagauuauucuuuaauccggcugggaauaaggggauagagcuggggccucugaacccaccugcggaccuaguguuaccucuggauguccccccugagucuaucuguccuccaggcaaccccaacucuugguguuccccagacacacuguuuucccaucucugugcuuguggauccuguaacaccauuccccagccaagaaaugccugggcguauguguggaggugggacauccuccaaugccuuugccgucuugcuucauggccaccugcucuggcccuggccuaacaggguuuccauuccagggcggggguggccaaccaucagcuaucccagaaccuccaaaucugccucucuugcuuccuagacuccagcccaggacucuccucccaggaccuaaaugaugggaacccuuucccuucagucaaaggaccuucagcaggagguggggcggaggacaccaggagagggaaguuccagaaucucuggaagggaagggaggcaggcagagagguggcuuugagaauccucccuuccacuuccucccuccccuccauuuuccccuccuucccugucucccccuccuccaccuccagcugcauuaacaggcugccuuuacaagcccacuuuaugggacggagaccccagcggacuuucccucuacccuuaaaacguuuccacaaggaaaccuauuaagccccugccuucauucucugccaaaaaagaccacauuuuucacaccaccuaaaacccucucccaggaguuuucugcuaauuuucuguguuuugccaugagcaggcuucuccucuuccccuccugugugacuagacuuacccuccaucacacgccagccagccaggacccucuuguuuguauagcucagacauccugccuuugcuguuuguguuuggacguucuuucugcugucugaccauauuccuaccuccaaaguucaauguccucaucgcucuccacccccauggggcccaaucuuuauaggaucccaacuacgugccaaagcuuuauggcugaauuucauuuauuccucacuacaacccugugacugcagauauugcuccuuauuuuuacagagaaagaaaaagcucagagagguuaaguaaaacacccaaagucacacagcuuauaagcgauggaaauggauuuugaauccagaucugccugcuccuaggaaaagggacacaggguuccucugucagaauucacuugaaacugaagucucccuccaggcccuucuuccugggucuuuucuucucuccucuacccuuuuucuuucuuucuuucuuuuuuuuuuuuuuuuuuuuuugacagcgucucacucugucacccaggcuggagugcacuggugcagucuuggcucacuguaaccucugccucccaugcucaagcaauccucccaccucagcuucccgaguagcugggauuacagacgugcaccacuacacccagcuaauuuuuguauuuuuuauagagaugggguuuugccauguuggccaggcuggucuugaacuccuggccucaagugaucugcucgccuuggccucccaaagugcugggauuacaggagugagccaccacgcccagccuuuguccccaguucugccccuuucacuucucucuggcuuuuccuucuuugccuccucauccccccaccacacccccgaagccagugaccccuugcuccaucuugucucugaugccuuugaauaauguugagaccccccuacaggccucaguuucccccuaauggcgcuuuagccuuucugcuucugcuuccacauucugaacaaucuguccuucccugguucucagguuccuaaaucuaugcucuuccuguccuuggagcaaggauagguccugccagauccaggguggcacagaguuccccacccaaagcuggaaggggugaagaagaucuggcccuguuccuuccccucccuguacaaggaggcaaggacccuggcgugcccagccuccuucuccuuauucuggagugcacauccaguaauuaagaaaacaugagugaagaaugagcuuggacaucucccuugcauccuggccgaaagggcagacgacgcaugugcagaucucaaaagggugaucauauaguugugcagcuuguguacugcucaacaauauccaucugagagagugagugugggcuaagagccagcucucuagcuucaguggcuccugccuuaccugagcccucuugccugcagguccguccccacccucaggauccaagcccuucagcagcauggggguagugccaugggugggaaauucugcugucuaaccccggucacucccauuuaggcugcaucugagcccacaccuguguggagaggaacugaaggcagaugaggcaggaggcucccuaggggaaggccuaccuugccuggaccggguuagcagcccagcucuggcccgcggggagggcugggugggaaccacguucagauuauuccuuaaucaugcugggaacauaguacaggccugggaacucucaaagagaauuugccaagaaacuuagcggcaccagcuggguuaugccggaaagccucccggccggccagugcuucuggagccuggaggaugcggcuccgggccuccucccccuuucccaguuggcugccaccaacuuucacaggcuaggggucagggucccuuggaagagggugggagccgaugagaaggcugaaggaggaagucagcguccuggcaggcaauaggggagggagagacuccagcuccugcgucccgggugcccaaaagagcagacgacuaaaucugguguccgcugcgcucaggcgugacguucuccgacguggugagcgcgaccgagccgugcaagccgugcaccgagugcguggggcuccagagcaugucggcgccgugcguggaggccgacgacgccgugugccgcugcgccuacggcuacuaccaggaugagacgacugggcgcugcgaggcgugccgcgugugcgaggcgggcucgggccucguguucuccugccaggacaagcagaacaccgugugcgaggagugccccgacggcacguauuccgacgaggccaaccacguggacccgugccugcccugcaccgugugcgaggacaccgagcgccagcuccgcgagugcacacgcugggccgacgccgagugcgagggugagugcgguucggggggcggggggagugggggugcgggggugggcugggggcauaaggaagggcgcucucuggaggucgacaaggacccugccuggccugcuggggcagcuuggugaccuugaggcagcgugcaccuucccugagcuucaguccuuuccugguaaccuaagggaggaggucauuccccauccugucucagcaaagaaccccucucuguguuaccuucuuugggcuguuuggaaagugggcguucucagcgucccaggccgcggguacuacauuguaacucauccuccgggacgcauuucucuguggcuucccgcuagugauuagcugaacagcaagcagcucgaagguggccacuacccccagggcacagaacgggagaggucugauccaugaggcaggcuuucugaacuggaagagcagcuugaggacccucaggagcugggacccuuugacucugagcccuggucuagguccaugguggguuuuggcucugggaccugagauggaacccacccuguccuugacugacguuagggaguccacuccugucucugggccucgguuuccucacuggucauauggcugccaggguuguugcggguuagggaauacaguggggcuggcccacuucagcuugcccugucuaggggaggggucaaccguguuccgcaguuuagugaaggaugaggggcaugcagggaacacuaaggaggggcucuguggaagaagaaggaggggaggggcagaccuggggcucaaaagcccggggacaaggcagugcaugcucguggcugucagcuccagggauggaugggagcugggcgugcccaccuuagccaagcacaggccccaaggagauggggugguucuugggaugggagaaggaagccccgugggagccagggcagagcuguuuuggucucugguuggugacguccgucucaggggagacuggugggcuuuuccacuucggggagaggcuggcagugccuuuacauccuguccaucauccuguggccaugcacacauugagcuauuucccuuugagaacuaaccugcauccucagguugccuuuacccugagcaggcaauauaguaccuccuucagugagcccccaguuugaugggagagauagccuucgcccagucuaaugagagagacguggucccagcacuuaguccccagcugaaggagagauagcucucacuuuagagaucccccauucugauggaggcagcagagcuucugccucaguuagcacccagaucuccugccccuggggacccuccagucugauaggggcuccaacccacaccugccuuccaaguccugccaucucuggcuuuaggagcucaggauggggagggcuguuacgcugggcuaaggccagguugagcucaaagcuuccugccuuggagaaggaaugaggaguaggauguggugguucuguuggcaauugcccugggccaggagacaggcaaguggcaucaggcgccaggcagagcgcaggaaggguuucagcagccaggcaucaggcaagcaggcagcucauuucuguaggcaaguccagaccagccagcugggggcggggcggggggacuugggggcgcugcuagagcaaagaaagguggugacugugggaggagcaggcuuugucuuuuggggcauucacagauuccucucagauaccagcccacuuucccagccaccccgaaggaggagggugcuccugagggaguguucauaccagacccuguuccccuuucagcuucaggcucugaaggguuaaaugucagcucugggacaagagaccauuucaggaaauggaauuugauucuugguuuuguugcccccuccccuccagcguaccauacuuuccccgcauuuacuuacguuucaggugucaacauggugacucacccacccucagggcagaagggcuacccgcugccccagugaaauucgguuugaauagggauaaccuggucccuccaugcagcccggaaauggcugucaggaccugccaagggcuuaguagguuggaaugcuaguggacguggccacaucuggaucucauccccccgcccccgucagaggggauuggagagaugagggcagcuccccaagagucagugccgccucuggucuggccacgccuugcuacccucccagccuuccccuaccaugcucugaucucggugauggucucauucauugggcacccggacauguacacuccuucacccucuggcuuggggucagucugagcugagcugugucuccagccucuggacuugggcugccccccagcuugcccaguccccuggcagagcaagagaagacccuccccaguccaaugcuccaccuggggcugccagaagacagggcucugucuccuucacuaccucuggccccucccaggacggagacggggaagggugguuugggugacagauggcagccccucacugcuggcagccagauggauucuagauucacaucugggggcuuugccccucagaaggugcugaaaacgggccuuugaagcauuucaucuugaguggaagaggccagaagauggguggcagcuucuacuccugcuugggugggcaaagugggggcugggagggcagagcugggagccaguuacccuccccuucaccccauuggcauguccugccugcuuucccucccugccccaggcgugggaagugaggagggacgggguaggcaacauugcccagacaaguauccccaggccguccagagcccacaaccccuagcacugccccuggcuguguggcagaauggaaaaucccacccacuggugccaggaagggcuggguccccugccagggaggcuggcaaugcccagcuagcaugagagggucuagguggguggcaagucacagucuccccccgccagcugaggcauugagcuggaccugccucaugggccccuucuccacuggcucucugcuuccugaccaaggaggguuggggcuaccugaugcugucaucucugguuggcaggaucaggcuaggugggagccaggcaagacaggaaacagaggcuggccacuguccaagggcuggcuggagggaggcaauccagcugcccccgcaccccuccuuuccacccaagccuagagccugagacaugaggucaaaaagucggggagugcucucagggagguggugugggggaagcaccucucugaccagaccuguguacccucuucuuuccuuaggacaggagugacuagggucaucaaggacaagcuggggccagagagacauuucccagagugacuccagcucaaggccucccuguggucaggcuucuuuguguguuugcuccuagauaggccucucuagguacucaggagguggaauagaauuccaggaccauagccccagauggaagggagcuuagagacugucucucuuaauagccccauuagauaaauaaggaaaucaagguucugagagaaaagggggcugggccagagucacccagcaagucaguggcgaagcugaaggagaugcagcucugugggcccacaggccuugcucuuuagcaucaugacaucaugcacgcaaucccagcugugcauaacagcugggcacaagagcaccuggagccagggcggggacacaggaagaacacggcaguggguuagagcuaaaagggaggagugggggaaguggguccucacuccuguggccuuuucucccagagaucccuggccguuggauuacacgguccacacccccagagggcucggacagcacagcccccagcacccaggagccugaggcaccuccagaacaagaccucauagccagcacgguggcagguguggugaccacagugaugggcagcucccagcccguggugacccgaggcaccaccgacaaccucaucccugucuauugcuccauccuggcugcugugguugugggccuuguggccuacauagccuucaagagguaagagagggcacgguggcgacagagaggggagauguuugcccucaaggaagacuuugcugugaccuugaccugaaaacauacacacccuuuuaacucaaccccaaaccaagcucauccucacucaucaucugccgccccacuccagggugcagcaggucagcaggaggugaggggagaggauccaccuguccuguccuguccucuccugcccuguccuggcuccagccccucccacucccaugccgcaccacucccugacuccccacccccaacugcuuguguccucauccccaaccuccuucaccccacagucaccugcgugugcauaugucucuuccccuucgcuugucacacugggaaugcuguggcacccacauccaggaauccaggaugugcacgaacucccagaaggcauuuuaaagcuuuaaaugcauuuuccauucuuucuaaaaaaaaaaaaaaaaaaucaucaaaguaacacauccguguuuaggaaaaugcaaacaagaccaauaucuuucaaagcaaaaaguaaaagcccccuuuuaucuccccaaauccuacuucucuccuuauuggaaucuguuugaaauggauccuucccaacuauuuucugugugucuuuuuuuauaaacauguauauaaaccuuuuauaauuacauguaaacauggagggcuuuuuaggcaucagugagaucacauuguacauauucuacagcuuacuuuuuucacucagucucccucaggagaccuuuccucaggaauguagauuagcugaucauuuguaaccacucauucaauaguauggauggaugguaauuuauuuagccaguccccauugauggacauuuguuuuuuuuuuuuuuccaguuuuuuguuauugcuuauaauugcagaggaaauccuuuuauaugucacugcccacaugugggaguauuuuagaaggguagauugggagaagaggaguuccugagcagucacuuuugcugcacugcucauuccaggaacauuuacugaacacuuacagagggccccucugcccucauggagcuuucaggguaggugggggcagaugugcaaagaggagccuuagauggugggguggcgguuauaauugggcacccgccaugccccuggcccucacacggcagagcacagauacucagcugcaucggccacuacagccccucgcccccugaaaccuggccuguccucuggcuccagguggaacagcugcaagcagaacaagcaaggagccaacagccggccagugaaccagacgcccccaccagagggagaaaaacuccacagcgacaguggcaucuccguggacagccagagccugcaugaccagcagccccacacgcagacagccucgggccagggugagcagcggcccgcuggggagcugaggcggagcugaggcugaggaaacagaagcaauuaagauuagacuccaggaaggacugucgggggggcggcagggcuggcucagcggugccccuguagauggauggagaggcuggccgaggggaaugggagggagagguccucucuagaggaacgacuugggaaauggaggcuuuuacaaguuggagcauccagacucaucaagcuaauuguccccccugggggcuaauuauugcccaaaguagcugcaauuagccucuugcccuggacuucuggggaacaaguaguuaaguguguacccuaauuaguggcccauagcccagcuccgggacacuugcuguaguugucuagaacugagaagcccuaucuccuccucugccaugauuaauugcugggggggaagagaggagggauggggauagggauugggcuggagugacaggaggaagggacaacgaguccccccaggugccuucacuuccuggugccccacccaggaccuugucuuggccccaggccuccagauggggaggagcacugccucggcccuucuugggucucaccccagugcccacuguuggggaaaggaguucagggguaggaccugacucuccucugguuucucugcagcccucaagggugacggaggccucuacagcagccugcccccagccaagcgggaggagguggagaagcuucucaacggcucugcgggggacaccuggcggcaccuggcgggcgagcugggcuaccagcccgagcacauagacuccuuuacccaugaggccugccccguucgcgcccugcuugcaagcugggccacccaggacagcgccacacuggacgcccuccuggccgcccugcgccgcauccagcgagccgaccucguggagagucugugcagugaguccacugccacauccccggugugagcccaaccggggagcccccgccccgccccacauuccgacaaccgaugcuccagccaaccccuguggagcccgcacccccacccuuuggggggggcccgccuggcagaacugagcuccucugggcaggaccucagaguccaggccccaaaaccacagcccugucagugcagcccguguggccccuucacuucugaccacacuuccuguccagagagagaagugccccugcugccuccccaacccugccccugccccgucaccaucucaggccaccugcccccuucucccacacugcuaggugggccagccccucccaccacagcaggugucauauauggggggccaacaccagggaugguacuagggggaagugacaaggccccagagacucagagggaggaaucgaggaaccagagccauggacucuacacugugaacuuggggaacaaggguggcaucccaguggccucaacccucccucagccccucuugccccccaccccagccuaagaugaagaggaucggaggcuugucagagcugggagggguuuucgaagcucagcccaccccccucauuuuggauauaggucagugaggcccagggagaggccaugauucgcccaaagccagacagcaacggggaggccaagugcaggcuggcaccgccuucucuaaaugaggggccucagguuugccugagggcgaggggaggguggcaggugaccuucugggaaauggcuugaagccaagucagcuuugccuuccacgcugucuccagacccccaccccuuccccacugccugcccacccguggagaugggaugcuugccuagggccugguccaugauggagucagguuugggguucguggaaagggugcugcuucccucugccugucccucucaggcaugccugugugacaucaguggcauggcuccagucugcugcccuccaucccgacauggacccggagcuaacacuggccccuagaaucagccuaggggucagggaccaaggaccccucaccuugcaacacacagacacacgcacacacacacacaggaggagaaaucucacuuuucuccaugaguuuuuucucuugggcugagacuggauacugcccggggcagcugccagagaagcaucggagggaauugaggucugcucggccgucuucacucgcccccggguuuggcgggccaaggacugccgaccgaggcuggagcuggcgucugucuucaagggcuuacacguggaggaaugcucccccauccuccccuucccugcaaacaugggguuggcugggcccagaagguugugaugaagaaaagugggccagugugggaaugcggcaagaaggaauugacuucgacugugaccuguggggauuucucccagcucuagacaacccugcaaaggacuguuuuuuccugagcuuggccagaagggggccaugaggccucaguggacuuuccacccccucccuggccuguucuguuuugccugaaguuggagugaguguggcuccccucuauuuagcaugacaagccccaggcaggcugugcgcugacaaccaccgcuccccagcccaggguucccccagcccuguggaagggacuaggagcacuguaguaaauggcaauucuuugaccucaaccugugaugaggggaggaaacucaccugcuggccccucaccugggcaccuggggagugggacagagucuggguguauuuauuuuccuccccagcagguggggaggggguuugggggcuugcaaguauguuuuagcauguguuugguucuggggccccuuuuuacuccccuugagcugagauggaacccuuuuggcccccgagcugggggccaugagcuccagacccccagcaacccuccuaucaccuccccuccuugccuccuguguaaucauuucuugggcccuccugaaacuuacacacaaaacguuaagugaugaacauuaaauagcaaagaaaga

SEQ ID NO: 16779 - RNA, 10857 nt, Homo sapiens
gcugagccggaaggucugggugucauuuauugacagcaguuuauacacauuuguuuccuucccagugcaggcauagagcccgugagaagggcagucucugaaugagggggccaggaacguaggucggacacgucuuuggcaggcauguucagccccagcaggaugcaauccuucaaguuggaauuccacuggguaucugagagggaccaaggugggggguagagaggaagucuucaacaggacucacaucucgguccaggccuccucucucacuauacaaguccauccaaguuuuaggacccuggggggcaacagucaggcccacccaccucaacaggggcagauucuucaaucugugcccaguucacacacaccuguuuccgcuggucacacaguuaaagagaaucagacuuaugguaacagacagaccacuuccucucugccccuccccggcaccucucuucagcagcaucugcacaggaaccgcugggaagacggaggccugccuucucaguucagccgcacaugcccucauccgcaaaccuuccaucagugacaggacggaggccacacguggaucuaggcagacaccugugcuccccaguccaucacauacugccccgccugcgugcugccaaaugcuggugcccaggccggaacuccagcaggccccgaauugggaccuaaagcugguuugcauaggcacuuggcaauuuuugguagggagguggauaaaaaaguagauggaugugagaagaaugaaagaguuucauuugauagacuaauuagagaucugaagugauuuuaccuuuauuuccuucacuuuaagccaaucaugaaauuucacagugauuucuggggugggagcagaaggaaggcuguguuaagaaucaucggggcuguggcccagucagcccgcggaggugcaggcagggugggcccucacuggggcagcuggaggagcacggacugccccgcuggcagguaggugauguuccgagagcgugagagcugguacgcgauguccucugcagcuuccagcuugcgcagcucgaucaggccauccccugcaguggccagugaguuggcaaucagcucagcugccuuggagucgcccucagcagagaugauggccgccuuuuucuguugcucagccuaaaagaauggagguggagacaaagaucaaaccucagggcaccgcaugucaggcuacaaccaaaggcccuucaccagaaagccaccuucccaggcuccugaaggaacucggggaguuuacuuccuccugauggcuagcgggggaagcggggggaagcagagcacauugcccaccaguccuccccuauccuuucaugcucacuccuugucacgggagggauacaucucuguuggcugcaggaauauuugucuuauuucaaaguccucauuaauauuaauugcaaucuaguuuaacaacccuacucugagccaggagaagccaaggccaaggaaaacagaagcaaaagaaagguggaaucaauccucaaggcucaucuuuuccuccagccuuaagucuaaaggacuucaucaaagccaggacagggccgggugugguggcucaugccuguaauccuggcacuuugggaggcggaggcaggaggaucacuugagcccaggaggccaaggcugcagugagcuaugaucaugccauugcacuccagccugggccacagagcugucacaaacaaacaaacaaacaaacaaacaaacaaaaaaccucgggauggcuaaggaagagcagcaugcacuuuugacuguuccuagagcugccugugaguuaggcugguuccugaccagaauccaggcacccagagugagaucuccuaggcuugcccuaccaauaucaauaggaagacagcucucugcaacgugugaccuucaggagugugaggaagaagacaguauuaagccucccugaaauuacauacaauuuugaaaugacugggcccugcgucuauuugcucaacaaacauuuacuguauaccuacuaucaccaggcacuguacuagacuuauuauaaucucugaaguuauggcagauacaaagcaacacaagucucugcccacacaguguuuucauucuccaaaauuaaaucuaucccucuuuucccauuuuauuucuugcuguccccaucuccccaccaauuagggauacugguggugggaagaaggggacaacaauaaaugaacaugucuuugcaaauaccagaaagaccaggcugcuacgcaaauacacugugucccaucacauucuuugacacaucuggauggauuuagcacuagaaaaaaaucuagugacgaaagcacaucuggugcaacguuugaucuuuuuugcugucagcuuucacuauguaacuaugguuaaaaaugacuucucagugaagcugaaaauacuccaggagaaacauuuuuauuuguaagagaguguuuuugaucucagagaaguggaagaaaaauuacccuucagugauuuaggaacauaacuccacauauccuugacuagccccugaagacucuggaaccaauugcagaaguacaauuccuucaagccccuucugauuaucccggaagaagggaugacagaugaugaauuuccaggccacccagcaaauggggaagcugagugccggagaaaggggagagagaggcuccugccaucuggucgaaggcucaccuuuuccaccacaaaucuggcccucucugcuuccugcugagccaccuguuuggcuuccaccgcuucugugaacuccuucccgaaggucagaugugucuaaggggagagagugagcacaagaugaggcagugugauugcuucgacagcacugcugggagggcuccauggccgcuggaagaagaggccagcaauggcucuagcagcuggaggcauccgugaggccagaacacucuuccaccuccguaucuguauccaaacugaguuuacacccagacucucuggcugcccaaacugcuccuguauauuacucugucacucucaguacagugaccucauguagcaaauggcaccgggggcuuuugauggggcccacaggcaccagaagguaucuacucaaucgaccaccuccccagaggaggagaacuguggguucuaagacccccgccacugacuagugcucuuccaagggccuuugaugccuuguucaaagcccaaggaaggccagauggaaaacagggucccugagagugagggaggcagcugguucccagggauccaagagccugaugcucucuguuuauggauuaaccaguccgcgucuucccacagcagcuccaccacugaacaggaagaggacgagggacgguggaacgcaaaucaugguauucccaaugugaaugguucuguuaaacgguuuaaaagaaagagaaagcagguaaagucauuggucggcaugaggguuuagaagucugaugauccauagaccuucccuaaucaugucaggucugacgggacugucccuaaagauagcacaaacaaugggaagggaccucagaauuccuaaugcccagccuagagcaauuuacuuauucauccuaauuuuuauugaaaaagaaucaagagaagagcauugguuuugccaucaaauucuaguuguuucauuuccuccacucucccaaccucugcuuuuuaaaaaagcagcuccaaacuucuccugaagaguaaauccuggucucauucucuuccagaauuuuuaaccuccuaacucuaacugcagcuguuguacuucgccugauccauuucuaguuucuuagucaaaguuuggguaagaaaaucugauccugagacaugaaaaaugaaauguauaauuaaggaauaaaauuuauuucuacaagggccagcugagggcagcaaauuccccaugaaaccuaauuuucuucucacaccuuagauaggguuucuuguggucagcccacauuuccccagaauggaguaugugguuaaagucuaguaaaaugccaacuuuucccuuagguuuuuacucagcguuuucucacagccaagguguucagguuaacgguaauuacgagggaagggcccacagaauggcugcagccuggccucuugccagcagagggagccccaagcccccaggacuuccagcaggcggagcaagguggagcagugcccagggguuagcacuggguguugucaaguggcuguuuaaacagcugcacagaugccgggggaggcagugccuuucccuagcaaugcacgggagaacugaacaggaaacacuuuaccucacugcccgaacaaaucacuccaaaugguuuuucccagagaaucuagaaacacgaccccuuccccucacccuccucaaccugaaacgcuauccugccugcauugcuuucugaguuaugacauccaaugucauauaaacacacaagcuauagugucucaagaggauagcuuacgccucagagaugucccuugcccccuauaccaggccugggggaauccaaccguucguuuacacucuaucaccuuucacugggguucccagagcuuacuucacugagcuucggacuguaaaguguuaggaagcucccaggagucaggcugggaggucugugcuagggagaaggacuacccgagcuguucucuggucucuaccaggcaguuucugccugugucaaacaggguuaacaaggcaucacucucuggguaacaguuuggagaagguaaaacauuuagugguuagagacuaucuggauacaaccagaggucauaagaaaaauguguguggcagggggaagguaaaagaacccucaacugaaaaacccacggagacugccucaccucagcauguuuccguguuuucaagucucacaucuagcaaagcagaagggaggaccuaauagcgucuacccagaaauggagccaggcaccuaaacgagaacugcagccccuuccccuccucggucucccgaaggaucuuaccaaggacacgucauccaggaugagcccaaagguggcggcucgcucuguaaggucgucgcucaccugccuggagaccagcucucucugggugauuaguucuccagcaucaaagcgagccugguuucaaagggaggagcagaagggcaggucagguuaaugaggaagcagaaaaggaaccaggaaacuagcagccacaucccaaccaacccacugccaagcgcuuccugccaccuggcacccucccaggguggugcucugggcucgaggcuaaaggccccuguucacucaccaccacugacuugaggaucucaguugugauggacggcagcacacgcucaucauaguccucuccgaugcuggugaagaugcgaggaagcuggcuggcgacaggccggaagaggaugcgcagugugauguugacauucuguaaaucuuaggguaggggacaaacacuggaguuaaaaauaaaaaccacuguaggaaaacaaguguuuuuuuuuuguuuuuuuuuuuuuuugagacagguuuuugcucuuguugccuaggcuggaguacaaugggacaaucucggcucacuacaaccucugccucccagauucaagcaauucuccugccucagccuccugaguagcugggauuacaggcacgcgccgccacacccagcuguuuuguauuuuuaguagagacagggugucaccauguuaggcuggucucaaacuccugaccucaggugaucuaccugccucagccucccaaagugcugggauuacaggugugagccaccgcaccuggccacaaguggucuuuuauaugaccucuccuacuccaauuugcuacaauuuuuauuuauguauuuugagacagggucacauguugcccaggcugaagugcagugguaagaucacagcucacuguagccgcuuugaccuccugggcucaguugauccucccaccuacaccuuccaaguagcugggacuacacaggcacagaccaccacgcccagcuaaucucuguacuuuuuguagagcugggguuucgccauauuucccaggcuggucucaaacuccugggcucaagugauccaacugccucagccucccaaaaugcuagaauuacaggugugagccauuacgccuggcaauuuuuauuuuuuauuuuuagagacaaggucuugcuauguggcccaggcuagacucaagcuccugagcuuaagcauuucuccugccucagccucuugaguagcugacacgcaccacugugccuggcuccaaauuugcuacaauuuauaagcaaaucugcugauuauaagaucccagagggcaaggugcagguaugccugguuuccuuggcagagaacccaauagagcaucauaaagaguuuauaauuucuuaagaggcuucagugauagcagcuuuuugguauccccugaaugcccucagauauacauaauucagauuauaugucuaacaggugccaugcaaaguuugcaacacugaacauuuuaagacaauagacagggcaaugcuaagaauuguagggugaggccuuuacaugcucuggugauuguggccaagucaggagucagccuuggagagguuaguucgggucugguggaaacgguguuagacuaucaguccaaagaucugggcuauuuacuaaugauguggccucucuaagccuuagccaaccugagcuuauuucccugucuaugagaauggggacaauuucauuugcuuucugggccuugcggaaauguuggggaaaauugaaggagaaaacagacguaaaagcacucugucaaauguguaacacauauaagggguuaacagacugauccuauguucugcuucucauuacuuggaccauuuaaaggauccagggagagaauuauacuuuccccuggacaauucaggccugccuggagccaaagcacugucacggcuugcuuacagaugucaacaauauggaccaagcgcccaugagacagcccugaacugggcaccaagagaggugggcaauguauuaauaccuacaacucccugaucucuggaagcuccuaucaauaguuuuagaaauagguacauaauguauccugaaaacaacugcaaaacaguacggaaagaaauuccaaagagaugggaagauuagaagcaggcuuuuuuuuuuuuuuuuuuugagacagagucucacucuguugcccaggcugcagugaaguggcacaaucuuagcucacugcaaccuccgccccccaggcucaagcaauucuccugccucagccucucaaguagcugggauuacaggcaccccccaccaccggcuaauuuuuguauuuuuaggagagaugggguuucaccacauuggccaggcuggucuugaacuccugaccucaggugauccaccugccucagccucccaaagugcugggauuacaggcaugaaccaccgcacccagccauaaguggguauuucuaagauuccauaucaagcucuccagggcaaguagucuagucauuccuaugauguacaguucaaacucuuuuggauccugguaucccacagaugcuccugugacacagaagaacagagcaccucuuccacacucccuacuuuaccugaaccauaggcaagacucaccuuugcuaccagugaugacuggcacauuacguggucgagaacggcagucaaagauaauugguuucuguacccacgggaugagaaaaugagucccuuccccuaccacaauguccugcacuccacggaaucggucaaagaugacagcucugugcccagcauccacuaggaagaaaggacaaugacaugucauaaaaauccucucauccuuuaaacaaaaggaucaugucuuugaaagagcccuggugcuuucuguucacuuauuaagucuccccucuucucucugucuuccccaacuccuggucucuagagacuucuaacuagcugcaaaacuaagcagucacuuccuguuccacauguccccaaggauugguaauaggaccuguuccuuagcauccuuucuccuugagggaacuggcuguugauuuucugaaugaccauucuaucccugaacucccaccaacauauuuccaggaaucaucuaccaaaacuucuaaaacucagugaggucuucccaguuaccacauauccaucgggcuccaauuuaaccuagugcucccagaaguagcacccucauuaugggaauccuacauuucgaagagccuacucuuucuuccuaauagcucuguuucgcuaaaguuuuaagggguuauagagcugucuuggcacagagagaaauuuaugauggcaauuucugucuaguugcagauguggccaaaaggaucacaguacugcuaagaugugucauauaagccaagcaggcuuuucuaaucagcugccucucugaacuuuaucauugguccaaauaucuucacucugaaaguaaagcuccucuugucagccagccacacaccggaugggucaaucuauugcugcuuugcagcaugugaaagugucagaaugucagaauuaaaggagguccuacagauaaagucaggucaaauccauugcuugaccaaugaggaagcuuccacaguaaaguggaagaaaagccagcuuaaccucccuccuacacuguuaaaagcugggcaaugcaucucaaagauacuuucucugaaacuacccgaauucagcacagcaaaaguuccuguucaggacaaggucacccaaacagaucugcagccuuugcuguuauuccacaugcaagcagaggagaacaaaugagaucuccauuucagauagccagggaaauccagacacugugcggcagcauuuggguggugcggcuucacuucaccuugacagaagccacuggacacauccaacuaggaagugggcugggaagcucuuuuugaauacaggcucugagagaaccuaugacugaaaggucaggggcucugauaacaaugcaguccugugguaugaaauggcaggaggugagcccucuuggccacaaacacauucacugacggcagcuaccaucaagagugucacaugggcuaugcagaccaacagaaaacuccuaggaaagugcagugacccacugucccuccaugccucaccauuauauaaggcagaguucaccacgccuccugcaacagcuaaggccaggccaaacuugccaauggacucaaacacuuuggcagccauguuuccuucugcuggacccucucacaccuaaggggauaaaaacaaaauacaaucaaacuugaugccaaauccucagagaaggcccucucugacacacaacagucacuuuucaaccuggcuauuuauuuccccauuccugaaagugcuaaaucauccauugaaggauaccuaauaaauaaugcuuuauagcuuggaaaguguacuaucaauucuucugcuuuuuuuuuuuuucaguuucuuuucuuuccuuuuuuuuuuuuuggagacagggucuugcucugucacccaggcuggagugcaguggugcaaucucagcucacugaagccucgaccucccaggcucaagcgaucuucucaccucaaccucccaaguagcugggaccacagaagugugccaccaugcccggcuaauuuuguucauuuuuugcagagauggggucuugcuacguugccccagguggucucaaacuccugggcucaagugaucccccugccucggccucccaaguguugggauuacaggcaugagccaucaugccuggcugauuucucuuuuuuucucaaccauuuaaaguaaggugucugggacacuugguucaauaaugaaaacaaugcaugggcuugaaauccacagagaacuuagcaccacacuaaaccacccucucauuuccuggacaaguaggcccccaaaaagaggcugugagguuagauuggugcaauuaugguuugaaaaaaauaacuuaaaaaaugugcuacauguugaugccaacaaaaaaaguaaccguaacagcuaacacuuauaucagguagccuaauaaaagcaauuuauuuacuucucacaauuacccuaugaagcauauuacuacagaggaaacagaggcacacagagagguuacaugagaagccgagauugcaguuauuaagugguagaaccagaauuagaacccagaggucuaaugcuagcagacacagcuuaccuccucaccauacugcuugucaacaucguguauuaagaacgacaugcuucuuauggaagcaggagcuggaugacauccuggggccaagauaacugaagaacccauuugggagaaaggcucuaacuagcugcacagggacagugagcucuggaauaacugggaggguggggcugaggcggggugggcauaagcacaguugaccuaacuagaaaucacgccagcauguaacuuucuaacgcuccgccccaccgucguugcccgcuccagucucaaauccucccucccuacuucccagaccucaacuccugagacuacccugaucucguccagugcauuuaaaucuuccuucucugaggcugggacacccggcccuuuacauuuguaauagcuucuggauuauuccucacccugccuccauggacaccucccuuacucugagcaaccccuggcucgucccgggcucagccccuucuccccucccucacaagucggacucacgcacgcacucuccucgcccaaagugcacaucauggagcagaggaggacugcagagaugcccagaaacgagccuuugccgcccccuccauucucaccugcuuccacucugaccuccacaugaauuccccaaccacacauacugcgcaugagcuccucugccccgcccg

SEQ ID NO: 16780 - RNA, 1638 nt, Homo sapiens
gcuugcaguugauaauaagcuuuacgcucugguggagcaaauccucccacgucucauggcuagguauuuuugaggcugggauugcucauacacacagauccauucaaccauuuagggagacuguggggugggguggggagaacgggugcucaggggagaggugggagagcagcgggaggauccucuguguuuccauggcauccucccaaggggcgggaacauauaaccacagugccaaucacccuguggggagaucauaaaugcgucagcggacucccuuguuacuuauccuagagggacaggcaccucucaaaaccgagaugcugauccaaagaagcugcuucacgcaggucucucccauacaauccuaaagguacgcccuuuccugcaaagcacgugccccugcucggcacccuaaacacggauccuggacagauucgcccagagagacgcgcucaauccgucugaagacucgcuuaagacgcccuggcgggcugaagaaccggucccuuagccaagggacuguuuuucuuuuucuucuuucuuucucuucucuuccccuccccccccucacccucucucucucucucuuucuccccucuucucucucugucucucucccucuccuuuccucuuucaccagcuacagcaucuaagggacuguuuucuuucuuucuuucuuucuuuuaaucucuucucucuuucaccaacuacagcaucuagggacuguuuuuuuguuuguuuuuuguuuuuuuguuuuuuuguuuuuuuuuuuuuuugagaugacgucuuucucugucucccaggcuggaguacacaggcacgaucucggcucacugcaaccuccacuucccggguucaagccauucuccugccucagccuccccaguagcugagauuacaggggcgcgucaccacgcccggcuaauucuuguauucuuaguugagacgaggguucaccauguuggccaggcuggucucgaacuccugacuucaggugauccgcccgccucggccucccaaagugcugggauuacaggcgugagccaccgcauacagccuaagggccuguuuucugacugacagacacagacaaccucacugagcaccggacaaccaagacaaacacacuagggugcguuccagaccccaaaaacacaccccucuggggagcgcagccucguuauuguucgugaccaauuggagucccgcaggcgccguuuccccgccccuugguucugucgcgccacuucauuggcggcucaggcagcaguaacguaucgcgcuugcucaguagccaauaagaagcaugacggcacccucggcaaccugggaccuccuagaccggccgaccuagcuaugccccgcccgaagcagcauccuccugauccuucggguucuuucggaagcugcccuccagggugaagucgcguucgcucucccaucaacacauuuauuuuucugcccgacucucgcgcgugcgcacugacacccccagaacggcccugaaaugaaaacaucuugagagagggggagggaccccaagccgcuguaggccaggucagugaggcuacccacacagcccgagguggcugcugccggaagcggucuccaaaacaggaauuguaggaccaaaaa

SEQ ID NO: 16781 - RNA, 1638 nt, Homo sapiens
uuuuugguccuacaauuccuguuuuggagaccgcuuccggcagcagccaccucgggcuguguggguagccucacugaccuggccuacagcggcuuggggucccucccccucucucaagauguuuucauuucagggccguucugggggugucagugcgcacgcgcgagagucgggcagaaaaauaaauguguugaugggagagcgaacgcgacuucacccuggagggcagcuuccgaaagaacccgaaggaucaggaggaugcugcuucgggcggggcauagcuaggucggccggucuaggaggucccagguugccgagggugccgucaugcuucuuauuggcuacugagcaagcgcgauacguuacugcugccugagccgccaaugaaguggcgcgacagaaccaaggggcggggaaacggcgccugcgggacuccaauuggucacgaacaauaacgaggcugcgcuccccagagggguguguuuuuggggucuggaacgcacccuaguguguuugucuugguuguccggugcucagugagguugucugugucugucagucagaaaacaggcccuuaggcuguaugcgguggcucacgccuguaaucccagcacuuugggaggccgaggcgggcggaucaccugaagucaggaguucgagaccagccuggccaacauggugaacccucgucucaacuaagaauacaagaauuagccgggcguggugacgcgccccuguaaucucagcuacuggggaggcugaggcaggagaauggcuugaacccgggaaguggagguugcagugagccgagaucgugccuguguacuccagccugggagacagagaaagacgucaucucaaaaaaaaaaaaaaacaaaaaaacaaaaaaacaaaaaacaaacaaaaaaacagucccuagaugcuguaguuggugaaagagagaagagauuaaaagaaagaaagaaagaaagaaaacagucccuuagaugcuguagcuggugaaagaggaaaggagagggagagagacagagagagaagaggggagaaagagagagagagagagggugaggggggggaggggaagagaagagaaagaaagaagaaaaagaaaaacagucccuuggcuaagggaccgguucuucagcccgccagggcgucuuaagcgagucuucagacggauugagcgcgucucucugggcgaaucuguccaggauccguguuuagggugccgagcaggggcacgugcuuugcaggaaagggcguaccuuuaggauuguaugggagagaccugcgugaagcagcuucuuuggaucagcaucucgguuuugagaggugccugucccucuaggauaaguaacaagggaguccgcugacgcauuuaugaucuccccacagggugauuggcacugugguuauauguucccgccccuugggaggaugccauggaaacacagaggauccucccgcugcucucccaccucuccccugagcacccguucuccccaccccaccccacagucucccuaaaugguugaauggaucuguguguaugagcaaucccagccucaaaaauaccuagccaugagacgugggaggauuugcuccaccagagcguaaagcuuauuaucaacugcaagc

SEQ ID NO: 16782 - RNA, 1025 nt, Homo sapiens
uacgguuauuuuucauucguuuuggggggcgggguugcucaccccuccccgguuaacugcuagcgacugacaggcgggggacggccgagacagacaaagagaagccgaagacucuggggucuucaggagagggucgcacgagcuggugauuuaaaaagaaaggaaccuuuucccuagauguuuaaauggggggggucuccgccuuccccacgccagccccacgaaacucccccgccuccggggaugcaggaccgggggacccugcgagcgcgggacuggaaagcugggaacgggguaucccaguggagaacgaggaagccgcaggaaauaauguuuugagauccccacgggagaaagggugguucgcacccgggguccggcuguuaaaugauaacguuucgggguccugaggggaacacgcggaacuggccggagaugacuccaggagacaggaacggugggagacaaggaagaggagugauagcuagggcuaaccggagcgaacugaagggggaggucuuagggagggagugaccggguggagauuugaaugguccccuuuucccucccagagucggggacagacagguggaguuuccagagccugcaccacccgggacacugcuggcagcucucuaggcccuagguucgggucucggaacuuuguuuggggugcaggauuccgauccuggcgggaaggcgggagagggacggagggcggggggcuaagcgggaagccccgcccacguccccaggucagacccgcggggggaggggguaauuuccgcuccgcgcacggggaagcgaggggcgggagcuuaggggagggggcggcggccacuccccuccuccucccgccguuccuggggagggggaagcggauccgccugggucccuucccucggcuuugaccaacucauuccggauccuccggcucccggagcccgagggaaggacccgacugggcaaggggcgacacgugggcggucgcaccccgucugggcggugggggagggggcugcucg

SEQ ID NO: 16783 - RNA, 22314 nt, Homo sapiens
uuucuuucuucccucauucuuuuauuuuugaaaagugccuucacguugcauuuuuauuggaggaaaaccucgcucguucaguaagcauaaucugauuaacacagagaacggcaagcacauauaaaaugauuuuuguaggucaucugcaaguucauggaagagcugggccuagaauguggguuguuuccuggccugucuagucuuuguagcugugagacauagauuacagccuaugcuaauucaaaccuuuuaaauaaaauguuccuuaucucaaacuagcugguccuaauggaccaguaaauaauauucacuuucagucucuucuggcuuccucuguagaggcucuagguuaugacagaguuagcugugaguaugaaggaaauagaagucaauguccaaucguggcuaaauuggaggaaagaaaacaauggaaucugaggggaaucaaacaauaguuagggaauguucuauuuucuuaaauucccuacuagcuuucucacccuccuguagugauugccaggucccucuagccucaguagugggaaagggagucauuuacugaacaccuacccugugccauuuuacauacagcucacuuaaauuucaccaaguaggcagccuucaacaucacaggugauucaaucaaaguaauuugccaggggccgccagcuucagccgagcuaaagcuggugccuaggccuauuaacccgagcccaugccuucauguaucacugcauaguacagaauggcagcacauacuguguguagacauuuuucuacacacguggucagccaagaguaaaagccucugcaucagaaagcaagaaucuccuauagcaaguagaaguggugaugagggaagaggccagaguuguuuaaggcucccaaaguccuuauggucuaaaggcuaagauccuaaaagugcuaguuuaguacuggaaaucugaaaacucaaugguuuuuccauacugagacccuuccuuuagcaggauauagccugggcccaucucuuccucugccuauccuuguaggacaugcucacuccaagcucuggaauaggucugucuuuggaaaccacucaaacuaagaugucacugacugccagagcauggaccccauuuccaaugagaaaacuuguccugcucuccccacccagcccugcccuuccaccauguuaugcaagucuucgguuuccagacaauucauggcacuuuccuucucccuaacaguuccaggccuaggugaggugugguugacaagaugaucccauucguccuuuacacaagcccucccacacccacaggcacuuccuccuucugccaaaacaaacuuuauugcaccaaaaaggaaaacaaaaaaaacaaaaaaacuucauuuauauacagucagauauaaagacaucucuuugacuccugugcauauauuuccucaacucaagauuagggcauaaaagucaggcugcuaugccagacaugcucugcccuauggcagggccaaggagaggauugucacuugaaagugggaacacuuaaauggaugacagacaacacuggacccacagaccaagagcauucuucuaagcccuggaguagcucgaggaauggaagagggaaauuggaagcagggucccuuuucgaucuucaugugaagagacccagccucuucaaggguauccaagauaaacuuccguuccccaagcccaccaaucccuguccaguuccuuugcuuccugcccucccaaauaggacauucuccuuugugcccagccccccuuugcacagauccuccaaggggagucccaugauccacaaggcagagaccuucauagcagagggcagggcagguacacacuauccucucccuuaugcauggcuggacacugacugaggcccugcaucacaagaaucgccaauacccacugggagccauaacaauaaaucuggaaguacggggagaacauaucaaaaaggggaaggauggauucccuugaugcccaggauuacagggcaccuaaagcacauuuuuuuuuuucugagccaaccagcuaaaggaucacugcagcuaaauacagauagagaagcaacaaagccaggcaaauacccaucagagacagugacaagagcagcugggggcacgggggaggcggaaggaagagaaagaaggggaggagccuccagagucccagccccaacccccucugccauuggcuacccuugcuccccaaaaaucccugggguugaagugaggaggacuacaggcuggggugaaaauacacaaggacagcccaacaaaauacaacaaggacuagcaucagucucccccuuacuccacccccaagaaaaauacccuuauugugacuaguauuuaugaaaaucuguaagagacuauucuauguaguggcucuaaucccauauacacagcagcugccuguguugggaacuuuucaaaucagugauugcgggaacaaacaguauuuucagcuucuuacggugccaugcaggcuuuaccaagaccuugguuaagucccagucacauuuacuuucugucuuacaucuagaaaagggugaggaaagaggggaggggagaaaggugcucaggugcuagguaaagcuuacugaucagcagccuagacuccaccacuguuccuucucuuuggucugucuagaacagugacuauaaauuaggaaaaacaaaauuaugcuggccugugggaaauaaugggggaaggaaggcagggaggaaaagggcauugggaagcccugcuucaagacugaagacagacaaauagacaaccacccagacugcuuaagugucacagacagcccccaccccaagcucccuuccagguauccccauaaaucauuugggcacacucccucuuggaauugcaauuuccaucuuccacuuaucccuaaggagcuggcccuguggagagguguguugguuguuuuguuuuugccaaaggcccucgcucuaggugcuccuguaaagguaccuuggccccugauacgggaugaauggaugaacgaagccccagaugcuccagugccaaggaggucagaccgggaacaggcccccacucccacacccugggaucggagcuugcuugguucuugccaucuugcaggaugacuucgagucuggagggagauacacagugccucuccaucccugggguggggggaagggauucugcugggacucuugagugggggaaggggagaugggagcagggucuaaacccucaggcucccaugaaggucugucucugucccagaugaacugcuaucagaguccauuucugcauucucauuauggagccucuccagcacuuucugacguaucagucccaggcgcaucaagagggacugguagucaaaguggccccgcuucucuccaaaaggguccuguggggaaaggagacaaggggauggaagauucaagucuggguggcugauccuagagaaagcaacuucgggcccaugugaaaugaaagcucaacuucugagccaugggagcaggaaggccuaacagcacaggcagucccaaacagcaggcaaaauaaccuuugcuuaaaaauaugacaccugggccaggcgcgguggcucacaccuguaaucccagcacuuugggcggccgaggcgggcggaucaccugagguugggaguuugagaccagccugaccaacauggugaaacccugucucuacuaaaaaugcaaaauuagccgggugucguggcgcaugccuguaaucccagcuacucgggaggcugaggcaggagaaucacuugaacccgggaggcggagguugcagucagcugagaucgagaucgcaccauuacacuccagccugggcaacaagaguaaaacuuggucucaaaaaaaaaaaaaaaaaagacacucuuaccgccccaaauagguguagcuugggcuagagugaaaauguauugguauuccucaaaagcaaaccaauauccggaagaagggacaauaagggugagauagauaggaaugagaaauucaagaccagaauuauaauuguuaaguaugccuauguuuuuaauuaaccucauaaaaaccacagaagguaaaaguugcucuuuauucucuguacucaaaaaugguaaucugcuuuucuaaggucagaagcaggucuagaauucaagaguucugacuuucagauaagcaccuguacuccuccccagggacucgucacuccauucccauccagguuucugggcauugcuccagggccacccagccucgaucuuaguccuucuuguucuagaucaaagaucccuaaacguuguacagaaagguuuaauuguccccaaagucucaaaaacaacuaguugaguggaugguauaaaaaagaguuuaaaauacuauauagggacuuaggcagcaaagcagugcaacagcccccaaaagguacacaacuuucccucucacauuguuugcuucucucacaaaaacuccuuccauacuucugcccacacauuacccucauccugagugggauggcaguggaugcuagucacugucacugggacuacagccugcacuucuccuucaugagaguuaacucccucaagacugagcuccacauuuacuacuauggagcugucaauucugcaaaucuuguuucuuucauccguggcuccagcuccucuaaugcuccuccugcccagaugcuguacucccucccaucccucaucaccaguuguuuuuccuuuacacacugauauugcuaaugcuguuggauaccagcaauuagaauuccugauggggaacaaacuaggacauaugucauugauauacucucaaaaaggguuuaggagacaacuuaguccugagccagcccugcccuuugugcuuaaaugagacagguggguggaaaguccuugaaagaaggaagggaaaacuaccauuuauaaguagcacuggagggcauaagucaucuccuccuacgcuguugguguuggggugggugaacagacauaguacgagagcuggagagagccuuaagaaaucuuagucaauuauccaagucucccauuucuuuuucuuucuuuuuuuuuuuuuuuuugagguggagucuggcuccaucgccaaggcuagagugcaacgugaucucgggucacugcaaccuucaccucccagguucaagcaaaauucuugugccucagucuccuaaguagcugggaccacaggcacgcaccacuacaucuggcuaauuuuuguauuuuuaguagaggcaggauuucacuguguuggccaggcuggucucaaacuccugaucucaagugaucugucugccucggccuaccaaaguacugggaucacaggcaugagccauugcgccaggccccacgaguaucccauuucuaagcaagaccaccaguaagaugauccaaacacccaagaacugauucuccaggacaggagaauucucauucucuuaccaaccaggugguuuacauuagucuaucuauaauuuuugucuuuuuuuuuuuuuuuuuuuugagacagaaucuuguucuguugcccaggcuggagugcaguagugcaaucucaguuuacugcaaccucugccucccagguucaagcauuucucaucccucagcuucccaaguagcugagauuacaggcaugagccaucaugccuggcuaauuuuuguauuuuuaguagagaugggguuucaccauguuggccaggcuggucuuggacuccuggccucaagagaucuguccaccucugccucccaaagugcugggauuauaggcauaagccaccgcaccuggcugucuaucuacaauuuggucaaugauagccuccuuccuuaaaacaagccuaaauuuugaguucuuaugggaagcaaaagcacacuuuucccaguagaggcaaagaaugaacaaugguuaucaucuuugaauaggaaucuuucaacaugugacacuacagguauguuguuucucuaagcuacuguuucugugaucaacccucagggcugggaacagaauuuaaauagaggauucauauaaucccuaagauucugggagggcugaacgcaucuuagcuucaaaacacuaugggcugggugcaguggcucacaccuguaauaaucucagccucccaguuuggaggcuaagggaggaggaucaccugaacccaggaguugccugggcaauagagugggacccuaucucuacaaccaaacaaaacaaaacagggccuguaaucccagcacuuugggaggccgagggagguagaucacuugaggugaggaguucaagacuagccuggccaacauggugaaaccccgucucuacuaaaaacacaaaaaauuagcugggcaugauggcguaugccuguaaucccaacuacuugggaggcugaaguugcaaugagcugagauugcucuagccugagcaacagagcaagacucugucucaaaaaacaaaacaaaacaaaaacuagcugugguggugcacaccuguaagucccagcuugggaggcugaggugggaggacugcuugagcuugggaguuuggaguugcagugagcugugacccagcuacugcacuccagccugaguaacagagugagaaccugccuuuaaaaaaaaaaaaaaaagaggcuacugaccaaggaaaguaaagaguucccuaugacuucaugaaaaucagucuccucucuggcucucagucccucaaaugauauagguugcuuuuagcuuuuuuuuuugagaccgaguuucgcucuuguugcccagacuggagugcacucagcucacugcaaccucggccucccagguucaagcgauucuccugccucagccucccaaguagccgggauuauaggcacaugcuaccacgcugagccaauuuuuuguguuuuuaguagaggcgggguuucaucauguuggccaggcuggucucacacucccgaccucaggugaucugcccaccucagccucccaaagugcugggauuacaggcgugagccaccgcgccuggcuauuuuuuuuuuuuuuuuuuuuuuuuuuugagacagagucucggucuguuguccaggcugaagugcaguggcacaauuucagcucacugcaacuucugccuccuggguucaagugauucuccugccucagccuccugaguagaugggacuacagguacacgccacgaugcccggcuaauuuuuuguauuuuuaguagagacgggguuucaccguguuagccaggauggucucaauuucccgaccucgugauccgcccgccuuggccucccaaagugcugggauuacaggcaugagccacugaacccaggcuuagcugugucauucuaugacagcugucgaugccacgcuuguggggggcuuuuacauggccagcuguagggcuucugcaauuagcagcagggguuguauuaccugcauaguuuggccuugaaggugcaggcgaucuuugcaggccaccucguagaagucguaauacuccagaaaggacuucuccaucaccccucuggaaaacaagcagaaaaguguaagugagaaacccagggguacaggucaccccuuccuuaccuaaccuuuuuuuuuuuucagauggagucuugcucuguagcccauguuggagugcaguggugcaaccucagcucacugugaccucugccucccggauucaugcaauucuccugccucagccuccugagaagcugggauuacaggcauaugccaccacgccuggcuaauuuuuguuuuuaguagagacgggguuucaccauguugcccaggcuggucaggaacuccugaccucaacugaucugccugcgucggccucccaaagugcuaggacuacaggcgcaagccaccacaccuggccucuuuaccuaaccuuaaugccaaauuaaauaccuaccauucccaaguccagaucuguuuucuacaaagaucuuuucauuuuauuuauuuuuuauuuuuuugagacugagucucgcucuuuugcccaggcuggaauacaguggcgcaaucucggcucacugcaaccuccgccucccagguucaagugauucucaugcuucagccuccugaguagcugggauuacaggugcgugccaccacacccggguaauuuuuguauuuuuaguaaagaugugguuucaccauguuggucaggcuggucuugaacuccugaccuggugaucugccuuccuuggccucccaaagugcugggauuacaguuccuuuuggaaaaaggaacaccuaacugcccgugguugacuuccccuacacaucaggaauuaugagugugacuguaauauucaccauuaguuuucuuuuugaggcagggucuugcuguguuacccaggcuggagugcaguggugucaucacagcucacugcagccucaaccucuuaggcucaagcaauccucccaccucagccuccugacuggcugugacugcaggagcgugccaucacaccuggcuaauuuuaaaauuucuguagagauggggucucccuguguugcccaggcuggucucgaacucuugggcucaagugauccucccgccucagccucccaaaguacuaggauuacaggcgugagccaccaccaagccaauacucaccauuugaaucccaacuucaacucaugacuugcuccaccuccauugcuuuucaucagccauccccaaucccaaaccuuacucaaaauucuccuagaaguuuauuuauuuaacccugacguugcucauccaguuuuggcacuuaaaaauaacuucagcacuaagaaaugagucuuauuaugaaguacucuacacauuuggcuggaaaaaaguacguccaagccuucaucaaacuggaagcucccugagcguguggacugccucucccaaaggcauggcauucuccaacaacagaguagcucucugaacuuccucuuggguaacccucagccacuuguucuuuaaaagcaggaaccacaucuuuccuucuucucuaucucccucugguacccaacacuguacucugccccaaagaugccaacuacccaaaugcccgaaaggaauaccaagcaagcccgcuugacacauaccguagggguucaggacagggacacuuuccuuccaucaugucacagacugcaacucugauggucucgugccggauacauucauuauaguuuuugcugucuccuggaugucucuccuauaauguaacagaugccagaguauuccaaaaauuaagcaaaaagaaaaccaaugggaagggacuucaagauuaguaugggguaugucagccagucacacaaacuaaaaagauaccuuucccacuguauggcagauccaugaagagcaaccacaccuuuauuuuugacaccauucaccuccaccacccuccaaauauaccaacagguuacaggucauuuggccuaucaccagcaaacuagauccaucauauuuuccugaaugugaagugaaaggucuaucaaguaaagauuaugugggaaauaaccaaacauaagaaugaugguaggguugcuaagccugguggcauaaacuaauagucccagcuacucaggaagccaaggugugaggaucacuugagcccaagaguuuggguucagccuagacaacaaaguaaguuccuguuuuuucaguuuuucuuuuuggagacagggucuuugcuguugcccaggcuggagugcagcggcaccaucacagcuaacugcagccuugacuuccugggcuccagcaauccucaaacuccugggcucuagcgauccucccaccucagccuccugaguagcugggacuaaagacauucgucaccauggugggccccgaguuuuuauuuuuuauuauuuauuuguuuuuuugaguuuugcucgucacccaggcuggagugcaauggcacgaucucagcucacugcaaccuccgccuccuggguucaagcgauucuccugucucaagccuuccaaguagcugggauuacaggcgccugucaccacgcccagcuaguuuuuguauuuuuuaguagagacaguguuucaccacguuggccaggcugguccugaacgccugaccucagguaauccaccugccucagccuuccaaagcgcugggauuacaggcaugagccaccgcacccggcuugucuuuuauuuaaaaaauuuuuaagaggcaggcucuugcuuugucauccaggcuggagagugguggcaugaucagagguuacugcugccucgaauuccugggcucaagcgaugcuccucuccucagcuucccaaguagcugggacucaaggcacaugucacaaugcccagcuauuuuuuuaaaaaaguuuuucgguagagacaaggucucacuacguugcccaggcugggaaacacuugucucuuuagggggagaaaaaaaaaagacagaaagaaugauggugggacaaaaagguauaaaugaagugaagagucucaguguagaaaaccuucaggcaucaacaaguaaaggaugcuuccugguuaaccccuuuaccuguuauaugucucuagggucccaccaucauugaaccaauuauuauaaaucagaaguagggcugggcccgauggcucaugccuguacucccgacacuuugggaagccgaugcaggcggaucgcuugaguucaggaguucaggaucagcauuggcaacauggugagaucccgucucuauaaaaaauacaaaaauuagcugggcauugguggugugcaccugucgucccagcuacucagaaggcugaggugagaggauggcuaaagcccaggaguucgaggcuucagugagcuaugacugugccacuguacuccagccugggugacaaagcaagacuuugucucaaagaaauaguacaauuagaaauaaaucuaucagaagcuucgaaagauaaacuucaacuuuggucuagaaagccaauauaaacagggucucacuauggugugaauagaaggggaguauggccucuacuccuuuaauuuuuccugugcucuucuccucuuaccaccaaccccagucaauuagagcccuggccucugauaaaaauagcugaugggccaggcgcgguagcucacaccuguaaucccagcacuuugggaggccgaggcagguggaucauaaggucaggagguggagaccagccuggccaaaacagugaaaccccgucucuacuaaaaauacaaaaaucagcugggugugguggugugugccuguaaauaaauaaaaaauaaauaaauaaauaaaauaaaaacaacugcaagucauucuggaaguaaaaaauaaaaaacacaaggcugggcaugguggcucacaccuguaaucccagcacuuugggaggcggacgugggcagacugcuugaggccauauguucaagacaagccuggccaacagggcgaaaccccaucucuacuacaaauacaaaaauuagccaggcgucauggugugugccuguaaucccagcuacuugggaggcugagguacuagaaucgcuugaaccugggaggcagagguugcagugagcugagaucacaccacugcacuccagccugggugacagagugagagucugccuccaaaaaaaaaaaaaaaaagacaagaccuaaaaaucagcuccugcuaaugaggucuauuucaauuagacucuccuccugaaaugaauguuuggagaaaggauggguuaggaaauaauuuuuguuaacuuuugaggccagacucuguggcucacaccugugauccuaccacuuugugaggccgaggcaggcugaucaccuaaggucaggaguucaagaccagcuggccaacauggugaaacgccaccucuacuaaaaauacaaaaauuagccaggcgugguggugugcgccuguagucccagcuacucaggaggcugaggcaggagaauugcuugacccugggagguggaggcugcagugagccgagaucacaccacugcacuccagccugagugauggagugagacucugucucaaaaaaaauuuuuauuuuucauuuuugaaaggcauuuuauuauccuuuguucaggucuauagaggaagaaucaaaguuggugucauauguaauaguuuaaaaauaaauuaaguuggccaggcaugguugcucacgccuguaaucccagcacuuucagaggccaaggcgaguggaucaccugagguccgaaauucgaaaccagccuggccaagauggugaaaccccuucucuacuaaaaauacaaaaaauuagccaggugugguggugcgugcccguaaucccagcuacucgggaggcugaggcagaggaaucacuugaaccugggaggcagaaguugcugugagccgagauugugccauuacacuccagccuggguaacaauagugaaacucugucucaaaaaauaaauaaauuaauuaagcuguucuaaucaccuauccggaaucauuuucuuuugggacuaucacuggaacuuuuucccgugcucaugaguaauucaggaaggcacaucggaagagugggagaaguugggcuccaauguaagucugggguccuauccugaucugugugucuuugugaaaguuaauuaaccucucugaggcaacauuauuucacuugaaaaugggaauaaccauauuuaaccucacauaguaugaagguuaaacaagaaauuauauauaaaaacuugguaguguccagcacagagcaugcucuuggaaaaaugugaguuuucuccaccuucucguuggcacuguuaacucaaaaagucuugcccgggacuccuaaugacuagcuccuuugacucugcagguaacaguccuucauaaccccagaagaacagcuggcuggguaguagucccuacagagcaacuuuaggggaugcugagaauauaggcacauagaacccacuggaugccacaacccccaaagcaggucagaauuaauuuccaaaggaguccauugacuuccaugcuauaaaggaauccaagucacauacuuauuguaacucucacaaauaaaaaaauucauuauuauuauuauuuuuuuaagacggugucucgcucugucgcucaggcuggaaugcaauggcccaaucuuggcucacuguaagcuccaccaccuggguucacgccauucuccugucucagccuccgaguagcugggacuacaggcgccugccaccacacccagcuaauuuuuuguauuuuuaguacagacuggguuucacuguguuagccaggaugaucucaaacuucugaccuugugaucugcccgccucggccucccaaagugcugggauuacaggugugagccaccgcgccuggccauuauuauuuuuuuggggguggggggaccgaguuucgcuccuuacccaggcuggaguguaauggcgugaucucagcucacugcaaccucugccuccaggguucaagugaucacacccagcuaauuucuuuuauuuuuaguagagacagguuuucaccauguuggccaggcuggucucaaacuucugaccaguuaauuuuuaguagagaugggguuuuaccagguuggccaggcuggucucaaacuccugaccucaggugauccaccugccugccucagccucccaaagugcugggauuacaggugugagccacaguggucggcaaaaaauuucauuacuaaaaaacacgugucaauucccuuuuuuucccuauaccaacaaauguaguacauggggcugugcuagguccaaaacaaaacaaaacaaaacaaaacaaaaaaaaccucccaagcagaucucuuaaaacacuauucuggcugggcgcgguggcucacgccuguaaucccagcacucugggaggccgaggcaggcggaucaccaggucaggagcuggagaccagccuggccaauauggugaaaccccaucucuacuaaaaauauaaaaauuagccaggcauggugguacacgccuguagucccagcuacuugggaggcugagacagaauggcuugaacccgggaggcggagguugcaguaagcugagauugcaccacugcacuacagccuaggugacagaggaagacucugucucaaaaaaaaaaaaaaacaaaaaaaccaaccaaccaaacaaacaaaaacaauagucuacaccccagagccaggcccaucuggccuuaccuguucaaagccgggcucauugugauagggguucucagucaucagggacuggauagagaugagcacugaggagaugcucugggcugggcuccaggcagguccaguccauguacuguaaacacaucagaaggaauggagggugaggcagagaaagaauagggaacaaguacccuggggcccggcaacaccaccauaagugacucaccauaaguuucucuuucacuauuaauacucuggaauuucccagccucugucucaugcucauguucugauuucaccagaaaucagucaauugccuaauccucaaaucaaggggggggggcaaaagaacagguaauagcaagcuauguaacuuugaagggauuuucuuuguacuagaaacaguuacgacaaucaaaacaaaagaaauuagguaagcaauuagcuccaaaguugucuaaauguuaaucuccguggaucucaaagagcuuguuuauggguggugauggaguuagugaggggagagggaaguugagcauaaagggacacaggugacugaagccaucugguuagaggccaugugguggggcuauuggggauccaguucuguaucaaacccccaaggagugucaaauucucuuaagacuacacaacucuuccaaagaacaggaagagaauaaggggugcuuccagacaguggaaggucugaaaauaauauauggaaaacgucaaauaccaaaauugcuccucucuuucauaaacccaaccaaguauuagggggaggggacagcuuggauguuaaugacauuuauuuuuagcucaauuaauugaagagauggcaccggagcuggaagccgaacacaaccuaagccaggacuggcuuguucaaguugacugccugcuucuguuucccugcuguacuugaggaaagcccaagucaguaaugccuaauaguaacuucacuggggacugcucuuaagugccucuaucuuuucagcuuugcucccccaggaacucuagaccuacugcucucugaagcuuuacaacagagucaacucucguuaaauuucuuuugucaguaagucagcccaacauuguuuucuagguaaagaggaaaaaaaaaacauggcugauaaagcuaauacagucaacuaggaacaccuaagaauuuucuuuucuuucuuuuuugagacaaagucucccucugucacccaggcuggagugcaguggcgugaucuuggcucacugcaaccucugccucccagguucaagcaauucuugugccucagccucccgaguagcugggacuagaggcaugcgccaccaugccuggcuaauuuuuguauuuuuaguagagacgggguuucgccaggcuaggcuggucucgaacuccugaccucaggugauccacccgccucggccucccaaagugcugggauuacaggugugagccaccgcacccggcugaaauuuucuacucugugauucuuuauggcaaauuuucaauuucagggcagcuucuccuuuucuaccuaacacacuucuacuacuuuuaccccacuguccuguggcugguaucucaaaagaguuuuauauugacccaaugagggagagccuacuuugagacacgcuuucgcgaacaaauuucauacagaagcaacgacuaaauuucuuuaucaucauggguuuuagccuaccagcaaagacaauuaauuaaguacccuaacgagaugaaguacuucuuuaaggacaaccuccuuuaaaagacuucuucacugccaaaaucacagcagaacauaucccugggucugagcaaguccuagaaaaaugaaucaugucucuaaguuuauuucaaaugcugcucuucccucacacaaaccuggaaacauguuggauagcaggaaaacagaauaaucaguuuggggguacuuucucaacuucaaccugcacguguucucugucccagagaaguucagaccacuauaaaaacaccaauccaaaauaugcgagaagauguccacacugaguuuucagcccccaaaggcaacuaaaaugggaacucuaugaagcaaaaccucagaagcauccagaaagaagaugcacuagaaacucauuucauaucuaaugugauuuccaaucucagacauuugucauuauuaaaauauuauaaucaggucaggcauggaggcucaugccuguaaccccagugcuuugggagccacaagaggacgacugcuugaggacaagaauucaagaccagccugggcaacauagugagauaccugccucuaccaacaaaacaaaacaaaacaaaaacaaacaaaacaaaacaaaaaugaaaccauaaugaucaccaccaccaccaccgccacugccuucaaagcaacuuauugcaagacucaaauuaagacaccccaaaucuugaauggcacagaccugcagccuuucucaaccuguucaggagagaaaauaaggccuuaacaccccaagagagugguucugaaacugcaguaugcaccacaaucaucuggagagcuuguaaaaaacagauuucugggccgggcacgguggcucaugccucuaaucccagcacuuugggaggccaaggugaguggaugaugaggucaagagaucgagaccauccuggccaacauggugaaacuccgucucuacuaaagauacaaaaauuagcuaggugugguggugcacgccuguagccccagcuacuugggagacugaggcaggagaaucgcuugaaucugggaggcagagguugcagugagccaagaucgugccacugcacuccagccuggcgacagagcaagacuccgucucaaaacaaacaaaaaacaacaaccaaaaaaaccagauuuuuggccccaaccccagaguuucuuuuguaggucuaagauagggccccagaaacugcucggcuacaaguucccagaugcucagggccacacucuuaagagaaccacuucucaaagguuaccacuguaauaaauuaacuucuccccucugcaucuagaaugauacuagucacauaccauccugaggagauuugagaagagucacucaaucauuuucuguguucuguaguucagaugagggacuccgguugauaaaggcugaccuagaguaauuaucugcuaacaaccgacuuggcuacuuaaaagucuccucuuacccuagaauacucaagcagacuuucccauugcgguagaaguugggguuaaaccucacuguguuauugcccguugucaucaguuugacccgagguggguggaugggauagucgggcggacaccgaaacacgaacaggaagaaacccccuucauaaggagugucaaaugggccugugaucaaugcaugaaucugcaaaauaaaaccccaucucaaaauugugaggugaugacccaccccaagcccuccuggcuacccuccaccuacuacccacaccagaagcagaguccauaaucugguacacauguucuauauccucaccaugcagaaggaacauccuguauucacucauacuaauacguagguuuggaauuuuaagaaaucucauuacaguggaaugacaucuuacucagggguuacuucuaaaguuagagcccaaggcgaaaacugaaucuagucaaaaucacucuugaguauccccuaaaacucucuuaaagcauuuuuuuuuuuugugcagaccucccugaucaguguuacauauaauggauaaaacaccacuguggaaaaauauaauaugcuuaucuauaaaauauaacccuagcguuuuuaauuuugagaaaucgacacagauuuugacugaauauauguuuggauuugcccaggccaaacaugcauaugaugcaaccccacccuacauuuauguggcacgaagggaaaguaugaugaaaggagacgaagaaagggauuggaggccacagcccagugccaguaacacagcaggguuagggggugugauggaugccuaggguaucugcuugcuuccucugcagaggaucaaaccuauuguggaggauguggcucaggcagcacaucaugacugaaaauggggaagacucaggguccacucagagccauuagaccagucccagaacuuuccccaauacuguuuaaaaaaaaaaaaaaaaaaaaaaucagccguccugaaaacgacacuaaauucucuucccccucaagccauaauucuucaacaggauuucccccccugaagggaggaaaaccugaacugacucaguuauauuucuucuuccacaaaggcuccuaggcauuuaggucugcuaagcauuugaacagcaaaaggaaagggacguggcaauccaaugccuaagucuauaguucccaccuugcccuccuggcaagacccuacgucauauucuggcucucagucauuuggaauaguaaacucaacuggucucaacauggcaucaacucugggaccccagguacuaggcuauuaacacugguacuugacugaggacgagauguccuaggaaaaacauuucuaacuacauaaaaaaaaaauaugaagggaaaucuauucaaaacaacaaaaaaagauacaccaacaauacaaaaucugaauuuuuacuguaagaaauuuacuguaagaaaacuauguguuucacuuaaacagcauuagguuuaggaaauaugauuucuuucuaacaucaguuuaagugcaacugcacuucuguggguagagcauucagugacagagaaaccuagguaucuaugccagagaaaugugacauuauguauuaagcuuucucucugagaggaggacaagagagguauagucuuugggguggaagggauacuuaaacgcaaccaguaaggacaggauccugagcaaaguccuuuaaccacaaacacuucagucaagcuugcccuauucccaaccuucccuacaucugauuuauaguaccauagcauaguuaaugucaagaguaacgggaugggggaagagcuggguaguacaauggauagggugaccauauaauuuauuauccaaacaggagcauuuuugagagugaaagaaugcccuauaaauagucaagcugcgacaacagacaugaacugggauuuuccaagccaaucaguaccuaugggguacacuaauaacagacaccucuucaaagugcugcuccaccucacuaugugaccuuggacaagccacuuacucuccuggggucuugauuucuucaucuguguaaucggagaggugagcugaauaaucucuuuuaggcuuuugcaaccuuauggcccccaauuucccaaaaccccccaaacccccaucaaguuacauaccuuagucaugucaacaguaucagguacaacgaacauuccuggaggaggcuccuuauaaauggacaugauaucccuguauaacaccaagaggaggugggggaaggagugaggaagagggggaaagggggaaucccuugagcaggacaguuguuaucaccucaaugaggccaggguuugagaaaguggugcuugguaccgcaaguguuuguacugucuuguuggcugagaaaucucagcugaguacuugucaggcaggcagagagcaaauuauuaucaaaagggcauuguuuccucagggggaggggagggagagaggaaaaaaaucagagaucccaauggcaucaaaugucagccuggaaaagccacuuuccacuuacucucacuuccucccacauggcaauucauucacuccccaccuccaugauucccagguacuacgacugaaugcuaaaugaagauuuuuuaguaacuggaaaggcaucaucaacuccacuaaaaaacuaauucuauaaacuauacaguggaccuuuauugguaaggggauuguaugaagcaagccagccagcagagaguaagacuaucaugguggccuucuugcccaggggugucucaggguagagaucucuucaggcuggggagggauccucagaaauugcuaagaaucucccaucuggaagaugacauguggacuuccauaggagauaagauuucugacucauaucucaccaacuggaauggaucaguugagagcaaggggcuaaagaacauucuagguggcgaaaagccuagggacuugcuaggguggguagggacauaaaaagggcaaauaggcgacaaagcagaggaaagcauuggccaaacucaaagguaugucagaauuggaugacugaaauggcuggaggaggaaaagaguugagugcugaguuucaguuagagguggcaaucccuccacaguugaccuccugugucaggcacugugccagguacuuuacacacauuauauuaauuuuuauuacaaccuugaaaaguagacacagagacaucugaaaggacguggaacauggggaauaagaacuaaacgaagaugcuugugaugggggcauggggagaagucaaacagguuucaggauuaauagcuaaagagcacugcccuuuucuuaugcgauagguacuauucuaugugcuucuggaaaacaucaucuacuaaaugauaggaucuaagaucagucacccaagaaauaagcacagaaaggacuuaggccuuuguuccuauauuugaugaguauauuugcuucauagaaguaaaacagacgacccggggagggugggggguggggggagggaaauuacaagaaagaagcuccugagugggauauuacaauccagaguggcacuggggaauuggggggagguagccuguguuucuggaagaggcguaagaguggacagcuuugggacacuggaaaagggguucaaggaaagauuggggcgagggaagcgaucuagaccugggaaaagacuguguggagggaaucugagaaaaacggaggauaaaaagaaagguuggcucgagucagaggcauggcaaaggaagcugaguucgucuguguuaggaacggggcuccagaggagaagagaggggaccgauggguggggccugcgggcagcaucuagcaagguugggguggggaaggggaaauaggggcggcgccgaaggcgggagggggcguuacugaagcgcuaaagggucggguuuccacccggaggugggaggugugggggaggguggccggaauggagacggagggcucacgggagguugucgaggggcggggucggaucugggcacacgaggcggggguuggugcuugcgggucugaggguggggggagaagggaguuggaucccgacgcccggagcuggcaagauuugggccguggaggugggccgccgcgagggcagcgcaguggguggggggugaguuguagugggagaggguggggggcggggaaggucgagccccggagcucggggcugggggaggaaaaaccccggcucaccgcuugauccggaguagacacugcggcgcggugcgcucgccgucccagucggagcugagcguggggucccaguggcuaagcagcgcggccccgugggcagcggcugagggcgggagcccgggcagcggagccaggccgcuccccgggcccccggccccgcccgcugccgccgccgccgcccacacauccggcaggaaaggcggcccgaacccgccgccgcugccgcuaacgccaacaacaccagcaacgcugcucgccccggggcccgccgccccggcgcccgccguugccgccuccucagucggacucuccgccaucgcugcuucgcuuccgggacuacucggcagcacguccgccgaccagagcggccgcugcucccgcccgcucccgcaccaccgagaaccgggccagaguguccccacccccuccgcuuccacagcccagacggugcuggcuccgcccacccccgccccaaccagcgagaggcgcucugcaagagcguccaccuacgguccuccaggacgggaggggugggaacuagcaggccgugaugguucugggcucguguggguccugcgcugugcggaaguagcggagagcccaauucaaguguugaaaggggagaagagaggagggagugggggaggaagggccauaucauucccguuaauggcggcgacccucagacgucugcaugguuaggauuggggauccagcauccucaugggaagcucaguagagaaguugacucgcuuugggccccu

SEQ ID NO: 16784 - RNA, 625 nt, Homo sapiens
uuuuuugcauccaaaaucauuuuaauaagagaguaggauccaggguuaguuuuuguagccucagcuggcccgucagccucuggcgcgcucgaacuuccggcccuuggaguggacguaggguuugguguggcugugcgggguucccggggccuugccaaaaugcccguacaccuuucggcccuugagaggaccggagagcaggacggugcugcagcccuugcgggaguccacggccagcuggucgaaaagugaggaucuugcccccugcccugaggacgcggcugcgggccagguuggucacacucagcacacacaccuucaguuugggcaccuccugaacccgcacgucaucuguuaugcuccccacaaucacggccguuuuguuuucccggacaggaagcuucacucuucuggaucaucugggaaagggacagagguggccgguugguacgacucauaaacaaccucuucagcacaaccugguugaauguggagucgguucgucuggccagaaaacugcacagcuugaccaacagccucagguagauauccuggcucuugggcuccuugcgccgaaccuuucgguccuuguuguggcagaugucagcucccaugauggcgucuc

SEQ ID NO: 16785 - RNA, 5324 nt, Homo sapiens
caaucauuuugcaaggagagcugagacgggcugcuccacuguacuuuguuggcugagaaguugagcagggggugggggugggaggguggggggcugggggggucgcguccgaaagcccucacaccgguccgggugccaccucucccugcuugggcgccgccgcgcgagcgcuucccuucccccugcaagcgcccggauaaugucugagaauguccauuucugggacgcuuagcagcuauuaugucgacucgaucauaagucacgagagugaggacgcgccuccagccaaguuuccuucuggccaguacgcgagcucgcggcagccgggccacgcggagcaccuggaguuccccucgugcagcuuccagcccaaagcgccgguguucggcgccuccugggcgccgcugagcccgcacgcguccgggagccugccguccgucuaccacccuuacauccagccccagggcgucccgccggccgagagcagguaccuccgcaccuggcuggagccggcgccgcgcggcgaagcggccccggggcagggccaggcggcggugaaggcggagccgcugcugggcgcgccuggggagcugcucaaacagggcacgcccgaguacaguuuggaaacuucggcgggcagggaggccgugcugucuaaucaaagacccggcuacggggacaauaaaauuugcgaaggaagcgaggacaaagagaggccggaucaaaguaaguuauaaaaagugaggaaauacccaggccgaaggccaggaggggggcggggaggggaaaggcaauaaacugcggacaaugugaagggaaacugcggcgguggccggagagcgggccgggaggaggaggggagaggaaggaaagacggagggaaggggaaagcugcgugcucuagaaggggagacugaggccgccagaggagcgcugcccccacuucuccaaguccugcggggaacaggggcucggggaucgacuugcagcucucucggcccucuuucccccucucucccggaggccccagcugaaagcccggccagagaccggcgacggccgggagaggagcuggcgggggccggggccagcggccagcgaggccgagagccggcgagggcaagggccggagcgcacugggcugcccggggccgugcggcuggcagagcuccccgcgccacgcgcagaccguaaaagccggccaaggggaagggggagggagcucauuaggauuuuauuugcgaugcaacagcuuggcggaggauuguuccuagcagaucucgcgcuguagccgcgcagaguccgcaaccggcgacaggaggggcgggggaagcccaggacgcggugacugagcccccuccccggaugcgccggccccuccccgggagccuucccuccgguggccccucuccuccucggcguccucgcaggggcuaccgcuuccuuuucugcggucccccgcugcucucugcggggcucccgagccccagcccgggcuguccgccucuuggggagucggggaaucgcuuccgaauaucggggcaucucgaagggaccccggggagaggagggguggggggaagagagaguugcagagaggcggagaacuuuacccuuuguggguaguuucccgucaccucccacuccucaaaagcaccccggccagaacgccaagucuggcugauuuucaggaggugcuacuagaugagaagagaggguucuccuauuauuuauuuuuaagguugagaagggcucaucggugagggaacucagccucaaacaaugacucgcaggcugguggaucagguccucguuucuuacucuuuuugggaaguagggauguuuuagucucuccuugcccugcuagauuucccauugacggaguggccccagggcccuuuagagcauccuugccugcuggagaguaaagagcagccccauuccuugcaggguccugucaccuccaaccugccagguggaauccuaagagcuggcauuuagggaacacauucuuccccaacccuccccgcacacucccaaacagaucccccacccuaaacccccaaauucugccugaaaagcccauuauggcaaggcagccauuuggcuaggaucaauuauuaacaguuuuuucccucuuucauauuuaaugcggcugcgggucccaucccaggcaaucacauuaaggaaauagcgcugcaaauugguaagacacgguacuuaguguaggaugaaccaaauuuuuuauauaaaaaaauccaguguuuuucacuuggggagaaggaagcuaguagcugguggcuguuauuuuuaauuggcuuagcuuuauuuggcaacuuuuuugaguuccagaguagggggagagaagguaagaagagaagccuguauauauuuuuguuuccucucuuccacucgguuacccucuucuccccuccagcccccacauaggaucaauuaaggcuaggugugcugugaagggcuuccuuuuaccuccacaucaccccuggcuccccaccuugggacuggagcaauuuuauucccuaauuucccugcacuugcguuaaccaaacugugagcugagcaggagcugaaaaggagagagacuauugcaaccauaaguuaucugugagcccccagugcuccccuguccauaagcuggaguugauaaaugguugcaauugcauugcgugugaauuggagugugcuggcuguuuguggcucuaagugcagacccauauucgugguguguggugguggcagggggggagauuucuacgcagacacacaugccugcugccauguggucuagagacacaagcuuguuugugaucaaggcaggggauauugggacuggacugaagggcugagaggucucuuggggugaagugacaccccaaaugcagugacugaacagacaucucacuuccccacccaacuccuccucucaccuccuagagccaggacccuucaggucagccacccaccccuagucagccugggagugcugcuggugggacuucaaccaugcugaacucugaccugaguccuaagcaguuuggacccaaguagagaaaaauugagagggaacuugauguaggcagagcuuuggaagugcugaggaagccugggcccacguuuggcuccauccuuuccacacagccucucaccuggaggugucuauagcaauggcuggcccaucugugacacccuuccugggagcuugaagacccagguggccucuucuccagugcaagauggggaguggagaccaagggagugcccucuugaucuggggcccuucacccccuuccuuucuuugauucuaucgcugcuucucuuucagccaaccccuccgccaacuggcugcacgcucgcucuucccggaaaaagcgcugucccuacaccaaauaccagacgcuggagcuagagaaggaguuucuguucaauauguaccucaccagggaccguaggcacgaaguggccagacuccucaaucugagugagagacaagucaaaaucugguuucagaaccggcggaugaaaaugaagaaaaugaauaaggagcagggcaaagaguaaagauuaaagauuacccccaguccucccuagcucuuccccaucucacucuuaguuaugugacgacugcaaagccagugcugucugggauguauucaagugaauggggaagggagucucucuuccaaguccuuuaucugcaccuagaaccucccuccuuuccuuugcccuuaccugucucucucuucucucuaggugucaggagaaaguuuuguugauuuagaagauagaaauaguugguuccuaagaaugugaugggccacaaggaaagagagaccccagucaagcuccuaguaugcccuguaauuuuucugggaaguccuagccccucacuuccagcuugccuguuucuucucuacacccacccaaaagucacccagggacacuccaacucuacacagcucagcagacauccacacacaguaauggggugagcucacaaccaccauucagucaagugaggugacacuccaguugcagaccaucgcacaccaaauuuggcaaaacagcccucagacugucaggcaagcccggguucuaccccuaaugcaaauacccaccagggagaugucuagaggcagacuccugagugagguguugcagcccaaaggcugcagcauugccauaccauucccauggaguugccaacuauucucaggccaagggccauggggaagauggagcaaaccuagcccccaagccggugggcuagaaaguacaagaaaaggcagcacgugguuuuaugaagcuaucuuagguggagcuacuccccaccucccaccaacauauacauuuuguugcaggaaauguuuaauuccgcaugauguuucccucuccuuccaacaaaagaaggucaaacugugggucguagagccuugacaauguuguccuccuguucaucugugcaccacuugacagacuguagcuucucuugcucucgaccggcccugcauucuuccgcacccucccuagcucugaaaucaacucucuucggucguauccaccuugcacccgcaagucaagccgccccuuguagaaaaaucccuccaccuuccguuccccgcuaggucaaccccacuguagacaggaaagccaggccaggagaguccgaaugagaauuuauugugaaucgauucccaagcucccuuccgggacaaguggucugggacagggaggagcaacggccccagcgcgcaacgcucugcgcguuccuccgaaucccgucggcuucucgacccacgcagagaagccccgggcuuggcggcucuagccccagcgccaaaggagacccgccccagggccgggcuuggccuccugcuucaugggccuggaugcagaucugcguggcuggugcgugcgcgcgcuucugggaaacagucccgcgugcaaaggaaaggggcaaaauggcaccuaagcaucagauggaagcuuacucucugcuuccguuccucccccugcuccccuacuucucaguccccuucaauuuguagacucuugcuccugcuucuccugauccugcaaggggacauuccaguagaaguuuuuugcuuugucgguggcugucgugaaauugugcuuguguuucgugauuucuuugggggugauugucucgcuuguuuucaguugucgauuauaugggaggguucugggugggaguggggagggcgaggggccuagagcucuaauuguuuguuuuggaagaaaaaaagaaaaagaacaaaaaauauauaucacucuagaaaauaaau

SEQ ID NO: 16786 - RNA, 8703 nt, Homo sapiens
aaagcuuuaaauaugacuaccucguuuguuugaaaauacguuuaggagaggaagcuguaugauuugauaacuuguauuaaaauaccaauuacauuuauaggaccuuuuaaaacucggcgcaauuaaaccguguucuuuuacauuuuuccgaagcgacccugacauuuagaaagacuccaauugccucguuaaaaucgcgaaauuaacagcgugccuacgccuggcgcguuguguaugugugugugcguguuuuuuuccgugacucccccacaucagucuuuggggguggucugcgaagguauuugauuuguugugaggcgagagauaucucauuaauguagguaguuaaacagauuuaauccguauucauucucucucacccccucucccucucccccucucucucccccucucccccucucucucccuggguguuuuuuucuuccccuccuuuuuuuuuuuccgcucucuccucacucccuggcgcucucucgcucuagcucucucucucgcucgcucucucucgcucucacccucgcucugcguucuguccgggaggaguacgaagaagccaauaggaugcggggucucuaauggaugcaaaugaucaugaaaagacagugcaaaauaugaaacaacucauuugcagggaaguaaaucaccgaaaacuguuuaugaacuggcaucccuucuucgaaauguaaagcgaggaccucuuuaaguggugguauauuuuuguuuggggggugggggguggggggagggcgagcgagccgcggcugccaugcaagcuuagacuuuuggaggcuucucuguccuuuucuauuccuggaaaccacaaaaagugugucggcuucgagaucuucuucgccuuuucuuucuuuucuuuuuuucccuccucucuuucccucuccuuuccuggcgagggugacuaggagccggcgaauccgcguuuuuuucucucucucccucccuuucccccuccccacccccuccccaacagcccccaacuauagccuccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccgucgcaaauccaggaguucuaccacgggccgucgucgcuguccacggcucccuaccagcagaacccgugcgccguggcgugccacggggaccccggcaauuucuacggcuacgacccgcugcaacgccagagccuauucggugcgcaggauccagaccuggugcaguacgcagacugcaagcuugccgccgccagcggccugggcgaggaggccgagggcuccgagcagagcccgucgcccacacagcucuuccccuggaugcgcccgcaaggugagcucgccucggggccgacaagggcaggagggggccggaagggcccaaggccuggcaggccggggcgcauuuccuccagcuucuggaagacuugccggcuccguuccgaucgccugccgcuuuuccccuuucuuucuuaucuuucuuucuucuuucuuuuuucuuucccuugaagggggucgcuuagaaacauuuccugaaucuauaaaccccucauccugccuuacuuuucuucuucuucuccuccuuuuuuuccccuuuuacuguuuuaugggggguagugaagagaggguggugggagugggggcgcucaacuuuugcacuucucaauugcuuuauaguuuaauuacccugaagaaacuuuucuucuggggcagaggcucugggggcuuuucaagguggguccauucguccccacccggcuuuuuuauucuuauuuuccccccuccuucacauccuuccuccuaaaguuuauggcacuucuaauagaucugaaccaccuccuacacaacucuggugcugguuaccgggggagggggcuccccuuucuggcucccuuagauucacuugugucuaaucccccucgccccuccuccuccgccgaccgcggccuucuugcgccccccccgcccccgcacgggguagaagguccccugcccuuauuauaauggucucccaggcucguucacgaaucuuccaaccuucuccgucccugcccccucccccacccuccccuccccucugucucgcccuuucccccauucccagcagccgccggacgcaggcgaggccgacagaccuacagccgcuaccagacccuggagcuggagaaggaguuccuauuuaaucccuaucugacucguaagcggcgaaucgagguaucgcacgcccugggacugacagagagacaggucaaaaucugguuccagaaccggaggaugaaguggaaaaaagagaacaacaaagacaaguuccccagcagcaaaugcgagcaggaggagcuggagaaacagaagcuggagcgggccccagaggcggcggacgagggcgacgcgcagaagggcgacaagaaguaggcuucagcugggacugccagggccgcggccgcccgcacguccgcgggucccggccgcgccgccgccgcgcgccccugcccgagagagcucuggccccgcuagcggggccaggagccgggccucccaccgcagcgucccccgccgcgccaguccccgcuagugguaguaucucguaauagcuucugugugugagcuaccguggaucuccuucccuucucuugggggccggggggaaagaaaaggauuuaagcaaaggcucccucgcccugugagggcgagcggcaaaggcccggcugagccccccaugccccuccccuccccguguaaaaagccuccuugugcaauugucuuuuuuuuccuuugaacgugcuucuuuguaaugaccaagguaccgauuucugcuaaguucucccaacaacaugaaacugccuauucacgccguaauucuuucugucucccuucucucucucucucucgcucgcucgcucucgcucucgcucucucucgcugcguccucauuuccccucccaauccucucuccccucugcaaccccccagcucgcuggcuuucucucuggcuucucucuuuuccuccuccacccacccccuuugguuugacaauuuugucuuaaguguuucucaaaagagguuacuuuaguuagcaugcgcgcugugggcaauuguuacaaguguucuuagguuuacugugaagagaauguauucuguauccgugaauugcuuuaugggggggagggagggcuaauuauauauuuuguuguuccucuauacuuuguucuguugucugcgccugaaaagggcggaagaguuacaauaaaguuuacaagcgagaacccgagacuggcccggccagcgcuccucauuugcucccgggugccuugcagagccgguggggagccugucaccgggcuccugcgccugcugaggcuaggcugcagagaggagggggcgggggcuggaggcagguggugcgagucccucggcccaggggcgcugggggugagggaggcggcugagccugauuggaggagagaaaaacgagggaggggagccaagagaaacccccuccucucgcguuccgaggcugcccggccagggaggccagggcgcccaggccacgcuggagaccugcggcugggcugguggcugugucccccgccaccucccucuuuguuuugcuguguguccucccaagaugugugucgggaggugggguggggggcaggcauaaagguggagugcaggccugcugagcauacuuuuuuucccucggacuguuguuguugggggagcaggaggagaagggagaccgcucuucccugccucucccucucagggacuuggccaccuucgcucuguucugaggccauggcucucugccuuccuuccuucgcugccucugcuucucugguagucacgcuccacugaggcauccgccuccgggaaccgggagagcagcgcgcccgggccaaccuccacccuuccuuucucuccccacccucccaacccccuuuuucuuuuacuuucaaaccuuuuuuuuucuuuuucuuucuuucuuucuuuuuuuuuuugccaccagaaacggcagcguccaaggcccgugggcuggauccugugcccuaggagcaccuaggaagacuugcuccaucuccgcccgcauaucuggggcaccaagagagacagagucgugagccaggcucgccucauuccucgucuugggagaaccggaccaacuuccccaaaaggccuugccgugcagaauuggccugguuuaauaaagaacagaccugccccaagcacccacccacccaguugcgugcauucaaucccugcguuugucucucgcucgguaacgggcugaagaggauggguggagggugacacggaucgccccgagguuauuuauuuucccuuccacucaaucucuuccuccccaaaucucgccugcaagcggccuccagcccgcgggagucggcagcggcccuugagcccccagccccaauccacagggcucggcuuucccauucauuauugaucauauuuuauaaauccaacgccacacaauuuuuuccacauuaccgggagccguggggagacggcccggccauuggcggaggggacgucacgugggcggggucacgugguccggagaggaaaaaggggguccuuuuugguguaaaucuggacucuaauucuguaauauaucaaggaaucucguaaaaccgacacuaaaacgucccugccuacaaaucauccggccaaauuaugaguucauuguauuaugcgaauacuuuauuuucuaaauauccagccucaaguucgguuuucgcuaccggagccuucccagaacaaacuucuugugcguuugcuuccaacccccagcgcccgggcuauggagcggguucgggcgcuuccuucgccgccucgaugcagggcuuguaccccggcggggggggcauggcgggccagagcgcggccggcgucuacgcggccggcuaugggcucgagccgaguuccuucaacaugcacugcgcgcccuuugagcagaaccucuccggggugugucccggcgacuccgccaaggcggcgggcgccaaggagcagagggacucggacuuggcggccgagaguaacuuccggaucuaccccuggaugcgaagcucagguaacgccgcgcaccgagcuguccugagccccaggggccggggcacauuacccugaaggcgccuccuucccggcugggcgccccuuuccgcguccagagugcucccagccggaggucggcccuggaaggcugcacccacugggccgcgacccagcaggccauccccgcccccauauuugcucggugcucucaggcucgcucugcuucccggcggaucucucuucgccggcaccacggcgcugcgagcccccagcccgcccccacccuuccucucggccuuuuagcuuuaaauauuuaucagcagcgccggcacgggcuggagacgaggccguuugucuugcggaggaaggccgguguuugcagagaauagccauuagggucucccccuucuccccccuucccagcuaaggaucucagcccugggugugucccccugccccacucggauaagguaugggggagggggccauagcgcuaagcaauucuccccucccccuuccucuccagccaaccccgcucccccauuauucccaucaggacaauuagaggugggcucuagaggccuggcgggaggagaaaaggacccagccagggacacagagcuagagaggcagguggagggagggggcugaggccaaaggagaugauccuccugaucccagugaaccugggugggggaguggaacaggagaacuagaaaggggcagaggcuucaugggagugcagcuggcuuccugaggugcucuuccuagggcuccuaggaaccccuaaagaacuggccaaguuuggaggugucauuccagauaagugacccuuuucuugggggaggggcuaggacucucuggagccaauucaaaaauuagagagugcaguucaccuagccagcugcugcagaaccccaagaggcugagguuccauggggucccugccgagucugacccagacauccuuuucugcacuguuccaaagcagacgaacuuaggggcuagccccaaaguccagaagacccaagacucauggucagaggcacccaacccagcaauggucaggggccagaagcagcccagcucucauaccaucaguauuagugguuauaggucccauuaccugcuccauaguuuaacugccuuuccaguugauuuaucaaagccccauuuuuucugcucaucagcauuucagcuuggcuuuuaucugacuugaaacuagggccccuagccccuccucccuugucuccuucccaggagggcugacaucagcaccucuuuaaagucuccucagguucugguccuaaugcagaaguuccccucuacccuucaguccccaccacccagauacuccauguuccauccuaucccaggcugcugucucuccuuuuccccugugcauuccuggaggcccaaggauugcuuuagagagcugggcugucuaggcaagcaggcaagcaggacagccuggcccuggcugaagcuuagccacucacuggaaaagaaucaucagagggucacugcugucagaccaacucuuugcuccaaggaaaucugcaaauucuuaccuucucauuccacaacaugcuggggaugaguuggggggacugggccuuugaggccccuuugucuccuuuucuucuugggaaacguucuuaagcuaggccuggcgccccacuccagggucacuugcaugguuucucuuggucucuacuggaaagaccaucagaucagcauucagaaaaggggguuuaggguccuugaccccagagagugaaaggaggauuaaccuccccucaucccacuugcaccccuuaggugcagagccuuuaagagccagcagauuacuuuccuggguucagaagcuccaggcuaaaaaagacuucuuggaugaaaaaugggaauguuugcuuugagaagccuguagaaaguucagcaauuaggggaguuugcagcuggaguaagggcugggguaugaaaagccagaauuugguuuagugggaaaaugggcuucuuugcccaucgcccauugacuucaaaucacauacacgguauaagagggagguggccacucucuuggcguuuccuuuuuuuuuuuuuuuuuuuuuuuugagacggagucucacuuugucgcccagacuggagugcaguggcgcaaucucggcucacugcaagcucugccucccggguucacgccauucuucugccucagccuccugaguaguugggacuacaggcgcccgccaccacgcccagcuaauuuuuuuguauuuuuaguagagacgggguuucacuguguuagccagguuggucucgaucuccugaccucgugauccgcccgccucggucucccaaagugcugggauuacagguuugagcccaccgcgcccggccggcguuuucuuuacucacugauuuuccucugaauacugugugcaggaacugaccgcaaacgaggccgccagaccuacacccgcuaccagacccuggagcuggagaaagaauuucacuacaaucgcuaccugacgcggcggcggcgcaucgagaucgcgcacacgcucugccucacggaaagacagaucaagauuugguuucagaaccggcgcaugaaguggaaaaaggagaacaagaccgcgggcccggggaccaccggccaagacagggcugaagcagaggaggaagaggaagagugagggauggagaaagggcagaggaagagacaugagaaagggagaggaagagaagcccagcucugggaacugaaucaggaaacucaaaucgaauagggaaguaaaaaaacaaaacaaaaaacaaaaaaaacaaaaaaaaaacccuauuuaaaugaaaggaguuuaaaaacauuuuuuaaggagggagaaaggagaaauuuugguuuuucaacacugaaaaaauacuaccuauaggaaagucugucagguuugguuuuuuuguacaauaugaaaaggauauuaucuaccuguucuguagcuuucuggaauuuaccuccccuuuucuauguugcuauuguaaggucuuuguaaaaucuugcaguuuuguaagcccucuuuaaugcugucuuuguggacugugggucuggacuaacccugugguugccugcccuccugagccuccgccuucccagcagcggcaccaaggggccuuagggagccccaaaaccuaccacucgcguguuccccaagcgccuggcugcugcuucuugcuucccgucccccagccccaugcucccuuuuacauucuguguguaucuaaaggauggaaaaauaaaacgcaauuaaaaauaaacagaugcccuauuuucugugucuuccuaaagcugggaagggguucaggguuagagaugagugggcaucccagagcuccuuggcucugacuucugaugcagcuucauuucugugcugaguuuguucuuuuucuuggugccuccugcucuggggggcugccaaguagugaaccccgauauu

SEQ ID NO: 16787 - RNA, 8703 nt, Homo sapiens
aauaucgggguucacuacuuggcagccccccagagcaggaggcaccaagaaaaagaacaaacucagcacagaaaugaagcugcaucagaagucagagccaaggagcucugggaugcccacucaucucuaacccugaaccccuucccagcuuuaggaagacacagaaaauagggcaucuguuuauuuuuaauugcguuuuauuuuuccauccuuuagauacacacagaauguaaaagggagcauggggcugggggacgggaagcaagaagcagcagccaggcgcuuggggaacacgcgagugguagguuuuggggcucccuaaggccccuuggugccgcugcugggaaggcggaggcucaggagggcaggcaaccacaggguuaguccagacccacaguccacaaagacagcauuaaagagggcuuacaaaacugcaagauuuuacaaagaccuuacaauagcaacauagaaaaggggagguaaauuccagaaagcuacagaacagguagauaauauccuuuucauauuguacaaaaaaaccaaaccugacagacuuuccuauagguaguauuuuuucaguguugaaaaaccaaaauuucuccuuucucccuccuuaaaaaauguuuuuaaacuccuuucauuuaaauaggguuuuuuuuuuguuuuuuuuguuuuuuguuuuguuuuuuuacuucccuauucgauuugaguuuccugauucaguucccagagcugggcuucucuuccucucccuuucucaugucucuuccucugcccuuucuccaucccucacucuuccucuuccuccucugcuucagcccugucuuggccggugguccccgggcccgcggucuuguucuccuuuuuccacuucaugcgccgguucugaaaccaaaucuugaucugucuuuccgugaggcagagcgugugcgcgaucucgaugcgccgccgccgcgucagguagcgauuguagugaaauucuuucuccagcuccagggucugguagcggguguaggucuggcggccucguuugcggucaguuccugcacacaguauucagaggaaaaucagugaguaaagaaaacgccggccgggcgcggugggcucaaaccuguaaucccagcacuuugggagaccgaggcgggcggaucacgaggucaggagaucgagaccaaccuggcuaacacagugaaaccccgucucuacuaaaaauacaaaaaaauuagcugggcgugguggcgggcgccuguagucccaacuacucaggaggcugaggcagaagaauggcgugaacccgggaggcagagcuugcagugagccgagauugcgccacugcacuccagucugggcgacaaagugagacuccgucucaaaaaaaaaaaaaaaaaaaaaaaaggaaacgccaagagaguggccaccucccucuuauaccguguaugugauuugaagucaaugggcgaugggcaaagaagcccauuuucccacuaaaccaaauucuggcuuuucauaccccagcccuuacuccagcugcaaacuccccuaauugcugaacuuucuacaggcuucucaaagcaaacauucccauuuuucauccaagaagucuuuuuuagccuggagcuucugaacccaggaaaguaaucugcuggcucuuaaaggcucugcaccuaaggggugcaagugggaugaggggagguuaauccuccuuucacucucuggggucaaggacccuaaacccccuuuucugaaugcugaucugauggucuuuccaguagagaccaagagaaaccaugcaagugacccuggaguggggcgccaggccuagcuuaagaacguuucccaagaagaaaaggagacaaaggggccucaaaggcccaguccccccaacucauccccagcauguuguggaaugagaagguaagaauuugcagauuuccuuggagcaaagaguuggucugacagcagugacccucugaugauucuuuuccagugaguggcuaagcuucagccagggccaggcuguccugcuugccugcuugccuagacagcccagcucucuaaagcaauccuugggccuccaggaaugcacaggggaaaaggagagacagcagccugggauaggauggaacauggaguaucugggugguggggacugaaggguagaggggaacuucugcauuaggaccagaaccugaggagacuuuaaagaggugcugaugucagcccuccugggaaggagacaagggaggaggggcuaggggcccuaguuucaagucagauaaaagccaagcugaaaugcugaugagcagaaaaaauggggcuuugauaaaucaacuggaaaggcaguuaaacuauggagcagguaaugggaccuauaaccacuaauacugaugguaugagagcugggcugcuucuggccccugaccauugcuggguugggugccucugaccaugagucuugggucuucuggacuuuggggcuagccccuaaguucgucugcuuuggaacagugcagaaaaggaugucugggucagacucggcagggaccccauggaaccucagccucuugggguucugcagcagcuggcuaggugaacugcacucucuaauuuuugaauuggcuccagagaguccuagccccucccccaagaaaagggucacuuaucuggaaugacaccuccaaacuuggccaguucuuuagggguuccuaggagcccuaggaagagcaccucaggaagccagcugcacucccaugaagccucugccccuuucuaguucuccuguuccacucccccacccagguucacugggaucaggaggaucaucuccuuuggccucagcccccucccuccaccugccucucuagcucugugucccuggcuggguccuuuucuccucccgccaggccucuagagcccaccucuaauuguccugaugggaauaaugggggagcgggguuggcuggagaggaagggggaggggagaauugcuuagcgcuauggcccccucccccauaccuuauccgaguggggcagggggacacacccagggcugagauccuuagcugggaaggggggagaagggggagacccuaauggcuauucucugcaaacaccggccuuccuccgcaagacaaacggccucgucuccagcccgugccggcgcugcugauaaauauuuaaagcuaaaaggccgagaggaagggugggggcgggcugggggcucgcagcgccguggugccggcgaagagagauccgccgggaagcagagcgagccugagagcaccgagcaaauaugggggcggggauggccugcugggucgcggcccagugggugcagccuuccagggccgaccuccggcugggagcacucuggacgcggaaaggggcgcccagccgggaaggaggcgccuucaggguaaugugccccggccccuggggcucaggacagcucggugcgcggcguuaccugagcuucgcauccagggguagauccggaaguuacucucggccgccaaguccgagucccucugcuccuuggcgcccgccgccuuggcggagucgccgggacacaccccggagagguucugcucaaagggcgcgcagugcauguugaaggaacucggcucgagcccauagccggccgcguagacgccggccgcgcucuggcccgccaugccccccccgccgggguacaagcccugcaucgaggcggcgaaggaagcgcccgaacccgcuccauagcccgggcgcuggggguuggaagcaaacgcacaagaaguuuguucugggaaggcuccgguagcgaaaaccgaacuugaggcuggauauuuagaaaauaaaguauucgcauaauacaaugaacucauaauuuggccggaugauuuguaggcagggacguuuuagugucgguuuuacgagauuccuugauauauuacagaauuagaguccagauuuacaccaaaaaggacccccuuuuuccucuccggaccacgugaccccgcccacgugacguccccuccgccaauggccgggccgucuccccacggcucccgguaauguggaaaaaauuguguggcguuggauuuauaaaauaugaucaauaaugaaugggaaagccgagcccuguggauuggggcugggggcucaagggccgcugccgacucccgcgggcuggaggccgcuugcaggcgagauuuggggaggaagagauugaguggaagggaaaauaaauaaccucggggcgauccgugucacccuccacccauccucuucagcccguuaccgagcgagagacaaacgcagggauugaaugcacgcaacugggugggugggugcuuggggcaggucuguucuuuauuaaaccaggccaauucugcacggcaaggccuuuuggggaaguugguccgguucucccaagacgaggaaugaggcgagccuggcucacgacucugucucucuuggugccccagauaugcgggcggagauggagcaagucuuccuaggugcuccuagggcacaggauccagcccacgggccuuggacgcugccguuucugguggcaaaaaaaaaaagaaagaaagaaagaaaaagaaaaaaaaagguuugaaaguaaaagaaaaaggggguugggaggguggggagagaaaggaaggguggagguuggcccgggcgcgcugcucucccgguucccggaggcggaugccucaguggagcgugacuaccagagaagcagaggcagcgaaggaaggaaggcagagagccauggccucagaacagagcgaagguggccaagucccugagagggagaggcagggaagagcggucucccuucuccuccugcucccccaacaacaacaguccgagggaaaaaaaguaugcucagcaggccugcacuccaccuuuaugccugccccccaccccaccucccgacacacaucuugggaggacacacagcaaaacaaagagggagguggcgggggacacagccaccagcccagccgcaggucuccagcguggccugggcgcccuggccucccuggccgggcagccucggaacgcgagaggaggggguuucucuuggcuccccucccucguuuuucucuccuccaaucaggcucagccgccucccucacccccagcgccccugggccgagggacucgcaccaccugccuccagcccccgcccccuccucucugcagccuagccucagcaggcgcaggagcccggugacaggcuccccaccggcucugcaaggcacccgggagcaaaugaggagcgcuggccgggccagucucggguucucgcuuguaaacuuuauuguaacucuuccgcccuuuucaggcgcagacaacagaacaaaguauagaggaacaacaaaauauauaauuagcccucccucccccccauaaagcaauucacggauacagaauacauucucuucacaguaaaccuaagaacacuuguaacaauugcccacagcgcgcaugcuaacuaaaguaaccucuuuugagaaacacuuaagacaaaauugucaaaccaaaggggguggguggaggaggaaaagagagaagccagagagaaagccagcgagcugggggguugcagaggggagagaggauugggaggggaaaugaggacgcagcgagagagagcgagagcgagagcgagcgagcgagagagagagagagaagggagacagaaagaauuacggcgugaauaggcaguuucauguuguugggagaacuuagcagaaaucgguaccuuggucauuacaaagaagcacguucaaaggaaaaaaaagacaauugcacaaggaggcuuuuuacacggggaggggaggggcauggggggcucagccgggccuuugccgcucgcccucacagggcgagggagccuuugcuuaaauccuuuucuuuccccccggcccccaagagaagggaaggagauccacgguagcucacacacagaagcuauuacgagauacuaccacuagcggggacuggcgcggcgggggacgcugcggugggaggcccggcuccuggccccgcuagcggggccagagcucucucgggcaggggcgcgcggcggcggcgcggccgggacccgcggacgugcgggcggccgcggcccuggcagucccagcugaagccuacuucuugucgcccuucugcgcgucgcccucguccgccgccucuggggcccgcuccagcuucuguuucuccagcuccuccugcucgcauuugcugcuggggaacuugucuuuguuguucucuuuuuuccacuucauccuccgguucuggaaccagauuuugaccugucucucugucagucccagggcgugcgauaccucgauucgccgcuuacgagucagauagggauuaaauaggaacuccuucuccagcuccagggucugguagcggcuguaggucugucggccucgccugcguccggcggcugcugggaaugggggaaagggcgagacagaggggaggggagggugggggagggggcagggacggagaagguuggaagauucgugaacgagccugggagaccauuauaauaagggcaggggaccuucuaccccgugcgggggcggggggggcgcaagaaggccgcggucggcggaggaggaggggcgagggggauuagacacaagugaaucuaagggagccagaaaggggagcccccucccccgguaaccagcaccagaguuguguaggaggugguucagaucuauuagaagugccauaaacuuuaggaggaaggaugugaaggaggggggaaaauaagaauaaaaaagccggguggggacgaauggacccaccuugaaaagcccccagagccucugccccagaagaaaaguuucuucaggguaauuaaacuauaaagcaauugagaagugcaaaaguugagcgcccccacucccaccacccucucuucacuaccccccauaaaacaguaaaaggggaaaaaaaggaggagaagaagaagaaaaguaaggcaggaugagggguuuauagauucaggaaauguuucuaagcgacccccuucaagggaaagaaaaaagaaagaagaaagaaagauaagaaagaaaggggaaaagcggcaggcgaucggaacggagccggcaagucuuccagaagcuggaggaaaugcgccccggccugccaggccuugggcccuuccggcccccuccugcccuugucggccccgaggcgagcucaccuugcgggcgcauccaggggaagagcugugugggcgacgggcucugcucggagcccucggccuccucgcccaggccgcuggcggcggcaagcuugcagucugcguacugcaccaggucuggauccugcgcaccgaauaggcucuggcguugcagcgggucguagccguagaaauugccgggguccccguggcacgccacggcgcacggguucugcugguagggagccguggacagcgacgacggcccgugguagaacuccuggauuugcgacgggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggaggcuauaguugggggcuguuggggaggggguggggagggggaaagggagggagagagagaaaaaaacgcggauucgccggcuccuagucacccucgccaggaaaggagagggaaagagaggagggaaaaaaagaaaagaaagaaaaggcgaagaagaucucgaagccgacacacuuuuugugguuuccaggaauagaaaaggacagagaagccuccaaaagucuaagcuugcauggcagccgcggcucgcucgcccuccccccaccccccaccccccaaacaaaaauauaccaccacuuaaagagguccucgcuuuacauuucgaagaagggaugccaguucauaaacaguuuucggugauuuacuucccugcaaaugaguuguuucauauuuugcacugucuuuucaugaucauuugcauccauuagagaccccgcauccuauuggcuucuucguacuccucccggacagaacgcagagcgagggugagagcgagagagagcgagcgagagagagagcuagagcgagagagcgccagggagugaggagagagcggaaaaaaaaaaaggaggggaagaaaaaaacacccagggagagagagggggagagggggagagagagggggagagggagagggggugagagagaaugaauacggauuaaaucuguuuaacuaccuacauuaaugagauaucucucgccucacaacaaaucaaauaccuucgcagaccacccccaaagacugaugugggggagucacggaaaaaaacacgcacacacacauacacaacgcgccaggcguaggcacgcuguuaauuucgcgauuuuaacgaggcaauuggagucuuucuaaaugucagggucgcuucggaaaaauguaaaagaacacgguuuaauugcgccgaguuuuaaaagguccuauaaauguaauugguauuuuaauacaaguuaucaaaucauacagcuuccucuccuaaacguauuuucaaacaaacgagguagucauauuuaaagcuuu

SEQ ID NO: 16788 - RNA, 16025 nt, Homo sapiens
auuuucgccaagagcuauuccuauauuuuauuucgauuuauuuuacuuucuuugucuuaauuuaucucguucuaaauugauacagacgacccaaauaaaacuuuaaaauaggggguggggaagggaaugaguccgggagcaagauccuaagaggugcgaguuuaccaggccgguguggccgcaucccggccgcucucggagccugaccacgccacgcccggggcuuccuccgagccucucuucccgcucucugcgccgccgccggcagccuggaaccuucuccgcugcacagagagagaggggggaaaauguugggggagguuauuucguuuccagaauucgggcauugguaggucaacuugaaauacgggguuauuucaggggaccugaaaaaccugggcugaauuuuuauuuuauuuuuugcuuccaaacauccgcugauugcaggaccaaaacuuggaggauggugucuaugcggcuagacccgcugaauugauuuuuagcauuuauucgauuauaaacucuggauuguuuaaauuuaaacagacuuuggauagaaagagggaagaggguugguuuuaggauaaucuguugaauuugaauuuguauguaaaaugcuuuuaaaccugcaguuucccccauuaaugaccacguaacgcccuggagagcgcauggagcugucauaggaaaccuggacuugccugcauuugggcgggagaagccaggauccggcuuuacccucccccaguuucuggguuccggaggcgagaaucagguugucagacuaucugccuuggcccccauccaggccacuuuuccuccuggggcaaaaacuaagcccuagggaaucuaaggcccccacgccugcaaugcugcaagccucacagguggggguccugcugucuacagggcuaggaaugagggggccaguucagagggggagaggggacacugaagcuuucauuuugcccuuaugcagguggcaacucuagacaccguuuccugcuccugccucaccccaaaauugucucagaacagucccuaugcagaggauuugggguagaccuuuacuagaagagggagcagagcuccuguggagaguggggagguucggaaaagaacccccuucccagcuguaccguuauggcuuuugcacucugauuuccugcccccccaaaucucaccccuucucagauugggguuuccccaaaaagagagaaggagaagaaaagaagauggcgacugagaaaaggguugcugguggagcagccaugaagaaaugcaauaaauuccuuguuguuuuaugaaaauuuacaacuuugugauagaaguuuaugagugguugaauccagcgauuggccggcgccggucauguggccgggcgaucgugaacaugaacuuuuuaucauuucccuggugguuauaaugcagcauucuuuuggacaccacaccuaggucggagcacugucguccuucagggcuccagccucuugauauuuuuguacuucaguaucagcucgauagagcaaaagagagagaggacgagagaggggggugaggagaaaagagagagagcgcgagagggagagggagagaaggaggggugggaauuacacaaagagagaaccaaaaauaauuuugauuccuaaguuaauuugcucacugaucugggauuuuagucaccauggaggguaaauggacaaucugcccaggacugcagcccgauacuauuuuucaaagccagaacuuacuccauuuucuaugcaaaugucagaaaaaugaaacacccucucucccaagucagagaaggggaagcaacggcucucacguugggacaauauuaucuggaagcugaagaagaaacugaauacuccuuccuuccuccccacccauuccuuuaaauccggagggggaaaaaaucccaaggucugcaaagguaagggagauucuacaauuuucuucuuguucuuuugcaucgcuuuuguaggguggggguggggcuuggguuuuucucccuccucccccguuccaagacggggcugaaccccaccucugggcgcugcagggagaagcuucccaggaaauucagugguggagauauggguggcugcuuccuggagggggagccaaggcagggaaagcgggaagaggaaucaaaagagggccaggagaccagcucuaagucgccuuuuuaagcuuggaggagagacucaagcaaggggggugcgaaagagaggaugggggguaucugggcuucaguggcacccaaagaagccagugguucuggccuccgcgggcuugccccucccccuccugccaucccucccuugucucggccucuggcuauugccccagcgcaguucucuugccuggugcggauaucgcuggguucccggcagcacuggcaugugaggcgguggcgcuaagggacguccugguuucuauagggccuggaaucuccgccgaggccggcgagggagaggaaacggcuagagaaacacagaaaagacaauuuacagagaaauguuuacuaucucccuucggagacauuuuugaaauuaaagggcuguggguggaaacaccaaaaaugagggagacuccccccucaccaggaagccugcccgagaaugcccaaguaucucgccacucccgcaggagggagccucgcucuacagggagacaguuuugugguuuuaaugcgguagguuacagcuguugguuucugcgugauacugauucuauuacuugcguuguauugguaugggauguguggauuucgguggaggaaaaaauugccaugugugugucugauaugauaacauuucaaacuuuccuggguccagacauggugauugugaagaagcuguuaagugccuuuuuguuuuaggcuuguaaauaaaaauaaaagagaaagaaaugaaagaagaaaauaaaaagaaaauccaauuaugggaccuagcggcgucuaaacugaaaagcuaacuggcacugagcucagacagucccgucccucggguguccaauuuuaucccucagucaggccuucuaggggguggggagggcggagaacauugggcaggugacagagauuccuaaaguagcucgugggguggaaguaggugccagccuugaggcaaggacuuaaaaaugggguaagggagcuucuggggaagcuuccagccaagagauaagugauguuggcuguggagggcaggagaaauugugauuuuuagucugguuugcacgaacaugugauugcuuuucucuuucuuaagaccagaugcaggacauucagccucgggccucugguugccccggaguuacagggucuggggcguuuuggaaguggggauauauuuauuaucucaguccuaagcuaggagagggacgacgcugccacuuguggcgcggaagaggcggcucuguggccccagguagaugcccuagguucaggcccggccugggcgccuggagggaccgcugggcuucguagcuagaguucuccgccagcacccacggcacucggggacuauucucaagggaaaaauuucccaaacccacccauacuaaaggucuuuuucuccuguagucuuggaggguuauaaauccucccuuagacaguucgcugugacccaaauuaugcggucugcugccaucuaccguccguucggagacacgcggcuucggcgccgcaagccccgcgacacuguccagaggugcccgacgccuggagccccggccucgcaggguccacgggauucgggggauuucgggcccacaccgacgcucucagcuagaucuugguuccccggugugaguuagagaacagaagucucuccuccacccaucauccccaauuucccacugcccccguccccgcccauccuagccccaaaccuggcggcuggcaagggaagcggcuuccucuagggcauauauaaaaaggucuaauucugcuuccagcgggcaggggcccugaaucaaaggguggagggaucagagccgacacccccaccgccauccccacccccaccccaccaaggcgcgggagaggaugaggccgcuugagacauccgaagccaaggcuguucaagguuuauuugguuuucuucucagccaagggaggggacccgcagggcaggcgccggccccgucaguuccacucgguugucaaaagacaaaccgggucuguguucuccugguugguuaguggguuuugccagcuccuugguugguggguccguggugaaggaauugaaccgaauuuucuggaaacuguugaugucugcaagugagugccgauccccuccuccauucucgaucuuuucaagcgaagucuaccuaaauaugauuugggaaaaauuugguagugggacuggggccaaauccuuaaggaaccacaccgucguaauuuccguuccuguuggacccuccacaccggcuuaacucgaccuccuucccaagaggggguggccagggcuaggcuaugcgccucugcugcagcguuugaauauuggccccugucucacggguuacugauuagcuugggcuuucaagccguaggaggaagcucuggcaguuccuuuaaaggugcugugguccccguuccugggugggggugggguuccaggaaauugccugcggugccaggcaaaccaagguguugccagagucuggccgagggcuagaggagcugacgagguuaaggggccugguggugcuggggacaaacacuguggcugcagcccucacccucuuucggcgccucuggagcagcucuuuauagcuuuccugcggcgaggugacuuucugguggcuauaaggcccgacucaaggagcugcucuauaggaggcccugagggagccagcccuagaagguccuuggccccucugagauuuugcuuuugggcaauccaaaggacauguagagaagucaagcugguacaugguauugaaacacuucagggcccucagguuguccccuggaccugcggguaggaaaccgggagaguggguucagcacuacugcucacuccccuaaagaucaaagaggaugccgcuccuuugcauaaugaaaaugaagucuuuguacuuugauuuggaggggccgauuuuagggcaaagugucucaucuaaacagccucccucaaccuaugggagugaucacucaguaccccugggaacauuuauuuauguuccccaaacccagagaaacagaguccaggacgagaauugaguugaaauauuuucaucccaccccaccccagccaaaguuggggguggugggagaaggugcucaucaccucaaagagcugagggagagggcuuuauagcuuagaggaaauuggaagccuggacaaugucucagcacccucccacacacaccacaccacaccacacacacacacacacacacacacacacgcaaauaucccuccugagguuaccuaucaagaauuuuacucccgaacugaacacaacuuaggaaacauuuuccugggagcuggaauguguuagcuugcccacaggacugcagacucacagcauagaaaauuacaauuauaaauccugccugugggguaucuguacaaucccucuguuauguacucaagaauugguacacacuucuauccaucucucugaacacacacuuccucauugaggcagggagagacaccccagacuggcggauggcugagcccgcuguguauuuacauauucccccaaggagacagacagagggcgguggaccgaaccacagacagauucguagggaucuggcuccagaaaggagucggucucuggccugcccugcccgccugcucuuuuucccaaacaaacggaucagacgaauaaacgcucauaaauaccucugggcuuagauaagagcgaugaggcgcuauuuucuuucaugcccgacuccaggcgcccaggcccgccuguaguggcuccaucuccagacaagcaaccugcagaggugagguuaauuugggggcugugacucuaaagauaaggcaauuauuucccugcuucugacacagggaaaugcucccuuccucaccagaucuuauuuuguucagacuucacugagaaaaccacacuauuuagugcuaggauggagacauugugggcagggaggaggcagggaaggcugaggcccagggcucagccucagcaguaggcagggaggugcaugcagguacucucucccacuuuucucccccuguucaaauggccccuaguccucucuagaagcaagcccagccauaccuagauauggaauauuuauccuucuucauuaucaggggguuuaaauuuguuuucuuaaaugcuuaucaaacacucccacagagucagguuaggaaguaauuggaggccaucuagggauggcuauuuugccauuaagguacagccaagaaguugcccugaguuuagagagccuuggagaccacguugcaaccaaauaaguucccacccuuggugauccaagcucaguccccugccaccuucccuagugucuuguaccaucuucagugggcagaacuuggccagaaaaaggagcccaaaggaaggacaaggcagaggagggucagccuggccugacaucugacuuuguuccaugcccuggccccuucuuguccccaggugugaagguugucacccuucacuacuuggccuguguauguauauuagaauguugggaaugcacuguggcccugucucccagccugggcucaaugcuuauuuuccuuggaugaaagagccagagacauacauucucugacacaccuaaauuuguaaggcggcaaagcugaugauacaaacacggggugugggagggaauuguagcgaugcugagauacagacagaagggagaggggaugcuggcugauggcuggaagcagccugcugaguccccaagagaacgcaaacgaccuucucucccuaucaaacuaaagcaaaaaccaagucuugggaaagaauuaauuuuaaaaagaacuggcagcuccuacagagacuuagaagaggagugaggaugcauuucuucccaguggucucugacugccucaacuaucaggaggguucaaagcccacaacuggaagaagaaugauuucuuccuugugcccagauuuacugggacaucccugauuccugaaaauccuauagcccaggcuauucuuaagucuuuugggauuguagaggguacuggagugaggguugcaggcaggauagggaucagacaaauaaagccaccuaggcugagggauaccccucacuccuucacuccauaucaccaagugaggagagggcuagucccuuuccccagugccccuuccccugccaagggugagcagcugcauacuagaaccaggcagaauguuuugggcagccacccucgucgccgccuuccaagaagcuccuagucuagccacagagucagaaggggaagcuugggcucagucccuccugccagcuccuccucuucugggucuucuaggcagugggaucuggccugcccccucagaccagaaggguuguggagaagcaggaacaauaagccgaggcuuggaggagacagagcagaucugauaaacaggaaaaacgauguucaaaaccuggggaggaggguguuucuucuuugcuuaucuuagcggagaacucuucucaccuucuaccgacacaaaacccuagaaacaaaccuucuuuaguucucucucaaggcgauucggagacauuuacccaacccuccccggagagaaggggucgaagcaacgcagggguuaacuuuucugaaaacacaauuaacuuuuuccaauccugcguggggugggggagagacauauuuauuuaaucacccgggagugggguggucucaaucuaaacguucccuccucccucaaaggcacugagccuguuucacagauccuacguagguggaacaggacgcguuguguuguuggggggagagaggagaaaggcgaaggagaaggaggaaaaaaaaaaagguugauagguuugugcgcgggucccucgugcgggcugcgcuccuccugggugcuauuugacaauuccugccucugccauuggucaguguuggaucagaugguuguauuuccuucuggcccucacuggcaccucgccauccccccucagcuaaaacccaaucucggauauacuacuaauaggcgcggcgcucggacuauaaaacacaacaaaucauaaacccggcggagcagcagcggccgcgcgcgccuccccucccaaugaguuccuauuucgugaacuccaccuuccccgucacucuggccagcgggcaggaguccuuccugggccagcuaccgcucuauucgucgggcuaugcggacccgcugagacauuaccccgcgcccuacgggccagggccgggccaggacaagggcuuugccacuuccuccuauuacccgccggcgggcgguggcuacggccgagcggcgcccugcgacuacgggccggcgccggccuucuaccgcgagaaagagucggccugcgcacucuccggcgccgacgagcagcccccguuccaccccgagccgcggaagucggacugcgcgcaggacaagagcguguucggcgagacagaagagcagaagugcuccacuccggucuacccguggaugcagcggaugaauucgugcaacagugagugagacuucccgucgccgucgccccggcuccccugggcgcccaccccgggacacagaacuagugagcgcccccugccccaaucucccacagggugcugggugggcaucucaguuaggagauagaagaagauugggcgccggccgggggucucucgcuguguccccuauuaggcaggaguuacaaaguuugcaaagucccagccgcacugggagccauggggagcaagugugcucuccuggggcgccuggccagagccgggguuccaggacagggaagggagcaggagccugcagucacuggcuuggcuuuacuuugagcccccaaccccccucucccagcccugguaggguuccccaaccaaagacggcuccauuaaaaacggagugcgucaugcaaggggguagggggugacgcugaagagaaagaguugagucugucugggacuguguuucccuguggguggggagcuggggcaagaugaggcaccaggaaaggggugguagucagaggagggaggaggaauaaggggaaggaagagagagggagcaggcggagcgagagagggagaaacaggcgcggggucucagguuggauuauuuguuggccuuaagucccaacugauguccauuagccggacucgaaagugaggagccguuaauguggacuauggaucgaucuacgucauuacggauuaacggccuggauuuaucauuggguuggggggaugacggggggugggaacaagauggauggaaagggagggaaagacaagaugcaacuaggaagagacacaccugaccagccccuccccccaggcucaggugggaguucaaacugcuccuccccucccccaucuagagucuagacagacggcacaggccuaggagacuaggagggaaucuggagggggcgcuggaggagugcgaaacgggggaagggagccggcagaauagagggcaucccgguacuggcuggagucuguguucgagggucgacuaggggaggggguccugggcccggugaccgcaggccucagcaucuccacucugcguaacagguuccuccuuugggcccagcggccggcgaggccgccagacauacacacguuaccagacgcuggagcuggagaaggaguuucacuacaaucgcuaccugacgcggcggcggcgcaucgagaucgcgcacgcccugugccugacggagaggcagaucaagauaugguuccagaaccgacgcaugaaguggaaaaaggagagcaaacugcucagcgcgucucagcucagugccgaggaggaggaagaaaaacaggccgagugaaggugcuggaaagggagggaggacgcgaggggaaaggccuguggggagccgagggcgucagagagacccgggaaggaaggcucucgggugggggagccaggagaccugcucuccggcgcagacaggcggggcccagcgcucuccuggacgcccccgcccgcacagcucccggcgggugcucugaggccucacuacucgagcccacccagcaucccgcgcgcccuuccuucccgaggaacucgccucagccugaucaggcuuccuggugagaacugaggagcggacucacuugauguuuccuggaagcagagcaaaaugcucuugucccugucgcgucucauuuuguccaugucccccgugcacgguucaaugguagauucgcuguccccucagcgggggccuugaagacucccugaucccagaccugucgucucucccacccccuccccaaagccacuggaaggagcacauacuaccuagaaguaagaagaggagccucagaagaaaacaaaguucuauuuuauuaauuuucuauguguuguguuuguagucuugucuuagcucuggacgugaaauacuucgaugaugaugaugaugaugaugaugauaauaauaauaauaauaacaacaacaacaacaauaauaaagaugugaaaacucgacgcucggucaccuccaauccuccccugccauuuuuuccucucuccucaacccccagccucuccaucuuuccugagccagaauucuucagcaaaggcgagagcccuggcccgccgaagcgagcccuguucgacugggaaguuacagcugagauaaaggcuggagcgaucaguccugcccaggccccagcgcugcguuucccuggugcugaggcucacagccgcuucuccccgugcagacuugggggauggagaggugcugugucccucucauucucuagccuuuccucguguauacacagcacuaagggagccacugaggccccuaaagcucucuggcggagacggagccauagucugggggccucugcagcgcuuuucuguccucaccuucgcagcgaccccuggucuuuggcccguccacauggccagguuuuuucgccagccuuggcccuccgcuccuggccuguggcucuggagacugaaaaauggggccacuggguaucucucacccugcagcugaaggcuccaggugccccuucccaccucaaguagcagaucagccucaaguaggagaucagccucaaguaggggaauguaaagccaccagccaggcacaggccgaaggccacaacuuucccuugcuccuuggagaccccagggcaggaggccaggugauggggcuuuuagugucauccucucaacccagaauggcucauucucucucugcuugcaccggcacccagaaggcaagcugcggucacuguuuuccuuuauuccuccgcccucucgcuuccuuucuuauuuuuaaagaaaauaguccccuccuaauaggagaccagcugcggcggucucuggccgcccagcgugcucagcaaagcaugcggguccuuggaaccccuuuuccgggaaggcggcugccaccaggcaaauucucaaacugccuagcugcgagugagggaccuguaguggggccuccgaaugcaauagccgaggaggaggggaagggaucccgcuuuacaaacucucagacacauguuacuacucaaacuaagcagcagacgcgguggccgcugcagucuuuucggcaacuaggccgcuuagccccagcugugcucgguuucuggggucccuguccugcucugucacuccccacgccugggcuaaggaccaccaaggagguccggaaggggauuucgaacuuccaaguggcccaggagaagugaacgcuucuccuucuuuuucaagccucccgcccagcccugccggcucggccugggcgcuguggaccgguaacagcaguuccaccaggaugcaggccggacuaagcuccuggggaaaacccguugcaauaauuguuuuucacacacaacuuccaacccuucccccauuuccgccuccaauucggagacuugcaaagcccaagaaagggaaaagcaacucuaucuuugaucuucucauccaaaguuaaaauaauaacgacaaugaugauguagggagaaagaaccaaauagagaggcuaaccccacccacaagaaaguggguaaaaagcccaaccccugcucuaaaaggcucaacccuguggcugagccuuggccggguuucuuucucucccggcgacugcagggagccugcagggagccagcagggaggcagccgcccgccgccauggcggucucacgcccgcgcucccgucggucgccgggagguggcgcgcucugcucagaggccaaagccaaccuucucucuguuucucccccuucuccuuuuuucccccucucucggaggcucgcauugaaucggcccuaacgauucucggaucgucauuauuuguaaccauagagcaugaauuaccucuugaggucaucagcgagaauuuacgacuggucaacaaaagcacgugauucccuaacgccccccaccccccuuccaaccccccccccauauuuggccgcauacauagcaaaacgaaguacagugcaucgcuauaauucauuaauacaucauaaaucgugaagcacaggguuauaacgaccacgauccacaaaucaagcccuccaaaaucacccaaaugagcucguacuuuguaaacuccuucucggggcguuauccaaauggcccggacuaucaguugcuaaauuauggcaguggcagcucucugagcggcucuuacagggaucccgcugccaugcacaccggcucuuacggcuacaauuacaaugggauggaccucagcgucaaccgcuccucggccuccuccagccacuuuggggcggugggcgagagcucgcgcgccuuccccgcgcccgcccaggagccccgcuucaggcaagcggcuucgagcugcucccuguccucgcccgagucccugcccugcaccaacggcgacagccacggcgccaagcccucugcuucgucccccuccgaccaggcgaccucagccagcuccagcgccaauuucaccgaaauagacgaggccagcgcguccucggagccugaggaagcggcaagccagcuaagcagccccagccuagcucgggcgcagccagagcccauggccaccuccacagccgcgcccgaggggcagacuccgcaaauauuccccuggaugaggaagcuucacaucagccaugguaauucucucucucuuuuuugucuucucggcuuuccuucucugcguuuuggggugggaucggggggacaaggagagcuuggcuuuacccuaaauauagauucauuuuucuaagggggagaaguaucuaagaggggccucauagcuucguagacagagccaaaaagggucucucuguuaagagggggguauuuuuaauaauuuguuuccagcuucggcuuagguuuuuauuagcgcagcugaaccagcuuuaggauaaaggaugggguucauauaauguggggaaggguccugcuuaccccugaaauuuugagacugucgcuagcaaagaaggggugaacaguaaaaggagcuuuccggggcaaaagugcaaccgcucuccucccucccggggcgagcggccgccugagcccagccaagggugaggcacuaggagcgagcaagagacaaagccgggcgcacuggcugccugcagaagugggggaugcaguagaaaggggugcagaaaucgagcuugaaugugggcaucuggaguagagaggauuggagcuguggugagcugggugccgggacgccuggguccugcucccccgcccccucccacccagugcccccucccuuaaccggaauaauguugccuugcggcuuuccucuaucugcuccagauaugaccgggccggacgggaaaagggcccggaccgcguauacccgcuaccagacccuggagcuggaaaaggaguuccacuucaaccgcuaccugacccggcgacggcgcaucgagaucgcccacgcacucugccuguccgagcgccagaucaagaucugguuccagaaccggcgcaugaaguggaagaaggacaacaaauugaaaaguaugagccuggcuacagcuggcagcgccuuccagcccugagcccgcccagaggagcccagcggcccaagagcccgugccacccccagcccuggccccuccaauccuccccgcucugccgccgcccgcuggggaccgguucccacaagccugccucgccuuguguuacgauauuucguuuggucuuaggucuuccuguggcucccucucuccuggacugguuaucuuguuauuauuguuaauaauaauuauuauuauuauuuuccuuccaugcucccaacucccuucugcuugucccaaauccgccaguguuucugaauguuugugucugugguugcagucuuucccccaggaaaaaaaaaaaaagaaauucgcauguuuaaugugaacucuccccuccccaucuguguucuaacuuauuuauaaaaagaugaucgcuguauuuugaguuucagcuggaaacuucuguaaggggcagcaguugaggugggguagugccgcaguggggucaagcugagcuggcuucggagauggagucccuuuucauucuccuccuccucccuccucacucccuaggcccaagucuccuaggggcuugguccuagggugggaaggggcuagggaggaccaaagggaugguauugagaagagagaaagaagauagugagauuuaaguuccugcugccuggguaggccccacaaggccuggucugggaguauacggaaacaaaaaugauccucagugcaaaaugucuuguguauuucucugugaauccaugggucuggcuagagggcccaaagcuuguaaauauggggauagucugggucagacccaucucucccuuacccaucuugcuuccaagaccauuuguagugagcgaguggaugcugugcuacgugugaaaucugucuuugcggggccugucucagugauucgcuuuugguauuuguuuguagcuuuccuggaagucaaauaaauguuucccccacuccauugcccuuccacuugucuuuucuccgaggggucugccucucccaucccgggcacacccugcaccauucucaauagaucuggggugcagggaagaaaaaguaggcugcuccccaacaacucuucucagccauguaagucacuggcuuggucaacagugcuugggccagggaacagaccuucaugccugggggacuccaaggcccagaaaccccauguggggcuggggcagaggaaaggcugagcuagacuucauccuggucuuccacuagcuggccaaggaagccucuggaaaacucuucugggaaaguaauuugggccuaaguccucagcaggaggcuccuggccuuuugggagugguagaggccugcccagcccccugucuccuacuccaagucccaauucagcucugccaccaacuaaagcaaaaaaaaaaaaaaaaaaaauucagcuggauuucaaaggauuucucucacccucagccuucccuacccuuaucaagggcuccuucucuccaagggcccaacugaucuucccucuugauuaggaguuaggguccuuucagaaagaccccugguucccuuucagccuggcccagggcuagggcccagucuaccuccauccaagucagccuccacccugagcacaagagucaagucuggacacuuacccggucaaucccuuccagcuuggcccaacuucuuacuggacuuggagggagggggagcuggugaggaggaagccgagggucguggaggcucuacuuggcccuccuuucccuucaccccuugacuuugucucccuuugucgauagcaaacuaucccaaaagucgcuaugacauuuagaugucaaauggauagggguuuua

SEQ ID NO: 16789 - RNA, 2633 nt, Homo sapiens
ugcgcuccuccugggugcuauuugacaauuccugccucugccauuggucaguguuggaucagaugguuguauuuccuucuggcccucacuggcaccucgccauccccccucagcuaaaacccaaucucggauauacuacuaauaggcgcggcgcucggacuauaaaacacaacaaaucauaaacccggcggagcagcagcggccgcgcgcgccuccccucccaaugaguuccuauuucgugaacuccaccuuccccgucacucuggccagcgggcaggaguccuuccugggccagcuaccgcucuauucgucgggcuaugcggacccgcugagacauuaccccgcgcccuacgggccagggccgggccaggacaagggcuuugccacuuccuccuauuacccgccggcgggcgguggcuacggccgagcggcgcccugcgacuacgggccggcgccggccuucuaccgcgagaaagagucggccugcgcacucuccggcgccgacgagcagcccccguuccaccccgagccgcggaagucggacugcgcgcaggacaagagcguguucggcgagacagaagagcagaagugcuccacuccggucuacccguggaugcagcggaugaauucgugcaacagugagugagacuucccgucgccgucgccccggcuccccugggcgcccaccccgggacacagaacuagugagcgcccccugccccaaucucccacagggugcugggugggcaucucaguuaggagauagaagaagauugggcgccggccgggggucucucgcuguguccccuauuaggcaggaguuacaaaguuugcaaagucccagccgcacugggagccauggggagcaagugugcucuccuggggcgccuggccagagccgggguuccaggacagggaagggagcaggagccugcagucacuggcuuggcuuuacuuugagcccccaaccccccucucccagcccugguaggguuccccaaccaaagacggcuccauuaaaaacggagugcgucaugcaaggggguagggggugacgcugaagagaaagaguugagucugucugggacuguguuucccuguggguggggagcuggggcaagaugaggcaccaggaaaggggugguagucagaggagggaggaggaauaaggggaaggaagagagagggagcaggcggagcgagagagggagaaacaggcgcggggucucagguuggauuauuuguuggccuuaagucccaacugauguccauuagccggacucgaaagugaggagccguuaauguggacuauggaucgaucuacgucauuacggauuaacggccuggauuuaucauuggguuggggggaugacggggggugggaacaagauggauggaaagggagggaaagacaagaugcaacuaggaagagacacaccugaccagccccuccccccaggcucaggugggaguucaaacugcuccuccccucccccaucuagagucuagacagacggcacaggccuaggagacuaggagggaaucuggagggggcgcuggaggagugcgaaacgggggaagggagccggcagaauagagggcaucccgguacuggcuggagucuguguucgagggucgacuaggggaggggguccugggcccggugaccgcaggccucagcaucuccacucugcguaacagguuccuccuuugggcccagcggccggcgaggccgccagacauacacacguuaccagacgcuggagcuggagaaggaguuucacuacaaucgcuaccugacgcggcggcggcgcaucgagaucgcgcacgcccugugccugacggagaggcagaucaagauaugguuccagaaccgacgcaugaaguggaaaaaggagagcaaacugcucagcgcgucucagcucagugccgaggaggaggaagaaaaacaggccgagugaaggugcuggaaagggagggaggacgcgaggggaaaggccuguggggagccgagggcgucagagagacccgggaaggaaggcucucgggugggggagccaggagaccugcucuccggcgcagacaggcggggcccagcgcucuccuggacgcccccgcccgcacagcucccggcgggugcucugaggccucacuacucgagcccacccagcaucccgcgcgcccuuccuucccgaggaacucgccucagccugaucaggcuuccuggugagaacugaggagcggacucacuugauguuuccuggaagcagagcaaaaugcucuugucccugucgcgucucauuuuguccaugucccccgugcacgguucaaugguagauucgcuguccccucagcgggggccuugaagacucccugaucccagaccugucgucucucccacccccuccccaaagccacuggaaggagcacauacuaccuagaaguaagaagaggagccucagaagaaaacaaaguucuauuuuauuaauuuucuauguguuguguuuguagucuugucuuagcucuggacgugaaauacuucgaugaugaugaugaugaugaugaugauaauaauaauaauaauaacaacaacaacaacaauaauaaagaugugaaaacucgacgcucgguca

SEQ ID NO: 16790 - RNA, 3486 nt, Homo sapiens
aauggagugggggaaacauuuauuugacuuccaggaaagcuacaaacaaauaccaaaagcgaaucacugagacaggccccgcaaagacagauuucacacguagcacagcauccacucgcucacuacaaauggucuuggaagcaagauggguaagggagagaugggucugacccagacuauccccauauuuacaagcuuugggcccucuagccagacccauggauucacagagaaauacacaagacauuuugcacugaggaucauuuuuguuuccguauacucccagaccaggccuuguggggccuacccaggcagcaggaacuuaaaucucacuaucuucuuucucucuucucaauaccaucccuuugguccucccuagccccuucccacccuaggaccaagccccuaggagacuugggccuagggagugaggagggaggaggaggagaaugaaaagggacuccaucuccgaagccagcucagcuugaccccacugcggcacuaccccaccucaacugcugccccuuacagaaguuuccagcugaaacucaaaauacagcgaucaucuuuuuauaaauaaguuagaacacagauggggaggggagaguucacauuaaacaugcgaauuucuuuuuuuuuuuuuccugggggaaagacugcaaccacagacacaaacauucagaaacacuggcggauuugggacaagcagaagggaguugggagcauggaaggaaaauaauaauaauaauuauuauuaacaauaauaacaagauaaccaguccaggagagagggagccacaggaagaccuaagaccaaacgaaauaucguaacacaaggcgaggcaggcuugugggaaccgguccccagcgggcggcggcagagcggggaggauuggaggggccagggcuggggguggcacgggcucuugggccgcugggcuccucugggcgggcucagggcuggaaggcgcugccagcuguagccaggcucauacuuuucaauuuguuguccuucuuccacuucaugcgccgguucuggaaccagaucuugaucuggcgcucggacaggcagagugcgugggcgaucucgaugcgccgucgccgggucagguagcgguugaaguggaacuccuuuuccagcuccagggucugguagcggguauacgcgguccgggcccuuuucccguccggcccggucauaucuggagcagauagaggaaagccgcaaggcaacauuauuccgguuaagggagggggcacugggugggagggggcgggggagcaggacccaggcgucccggcacccagcucaccacagcuccaauccucucuacuccagaugcccacauucaagcucgauuucugcaccccuuucuacugcaucccccacuucugcaggcagccagugcgcccggcuuugucucuugcucgcuccuagugccucacccuuggcugggcucaggcggccgcucgccccgggagggaggagagcgguugcacuuuugccccggaaagcuccuuuuacuguucaccccuucuuugcuagcgacagucucaaaauuucagggguaagcaggacccuuccccacauuauaugaaccccauccuuuauccuaaagcugguucagcugcgcuaauaaaaaccuaagccgaagcuggaaacaaauuauuaaaaauaccccccucuuaacagagagacccuuuuuggcucugucuacgaagcuaugaggccccucuuagauacuucucccccuuagaaaaaugaaucuauauuuaggguaaagccaagcucuccuuguccccccgaucccaccccaaaacgcagagaaggaaagccgagaagacaaaaaagagagagagaauuaccauggcugaugugaagcuuccucauccaggggaauauuugcggagucugccccucgggcgcggcuguggagguggccaugggcucuggcugcgcccgagcuaggcuggggcugcuuagcuggcuugccgcuuccucaggcuccgaggacgcgcuggccucgucuauuucggugaaauuggcgcuggagcuggcugaggucgccuggucggagggggacgaagcagagggcuuggcgccguggcugucgccguuggugcagggcagggacucgggcgaggacagggagcagcucgaagccgcuugccugaagcggggcuccugggcgggcgcggggaaggcgcgcgagcucucgcccaccgccccaaaguggcuggaggaggccgaggagcgguugacgcugagguccaucccauuguaauuguagccguaagagccggugugcauggcagcgggaucccuguaagagccgcucagagagcugccacugccauaauuuagcaacugauaguccgggccauuuggauaacgccccgagaaggaguuuacaaaguacgagcucauuugggugauuuuggagggcuugauuuguggaucguggucguuauaacccugugcuucacgauuuaugauguauuaaugaauuauagcgaugcacuguacuucguuuugcuauguaugcggccaaauaugggggggggguuggaagggggguggggggcguuagggaaucacgugcuuuuguugaccagucguaaauucucgcugaugaccucaagagguaauucaugcucuaugguuacaaauaaugacgauccgagaaucguuagggccgauucaaugcgagccuccgagagagggggaaaaaaggagaagggggagaaacagagagaagguuggcuuuggccucugagcagagcgcgccaccucccggcgaccgacgggagcgcgggcgugagaccgccauggcggcgggcggcugccucccugcuggcucccugcaggcucccugcagucgccgggagagaaagaaacccggccaaggcucagccacaggguugagccuuuuagagcagggguugggcuuuuuacccacuuucuugugggugggguuagccucucuauuugguucuuucucccuacaucaucauugucguuauuauuuuaacuuuggaugagaagaucaaagauagaguugcuuuucccuuucuugggcuuugcaagucuccgaauuggaggcggaaaugggggaaggguuggaaguugugugugaaaaacaauuauugcaacggguuuuccccaggagcuuaguccggccugcauccugguggaacugcuguuaccgguccacagcgcccaggccgagccggcagggcugggcgggaggcuugaaaaagaaggagaagcguucacuucuccugggccacuuggaaguucgaaauccccuuccggaccuccuuggugguccuuagcccaggcguggggagugacagagcaggacagggaccccagaaaccgagcacagcuggggcuaagcggccuaguugccgaaaagacugcagcggccaccgcgucugcugcuuaguuugaguaguaacaugugucugagaguuuguaaagcg

SEQ ID NO: 16791 - RNA, 2462 nt, Homo sapiens
cugugacauacugccgaaagguuguagggcaagagggugucucccccaaacgggccgacccuccugcggccuugacgcauggacuauaauaggaugaacuccuucuuagaguacccacucuguaaccggggacccagcgccuacagcgcccacagcgccccaaccuccuuucccccaagcucggcucaggcgguugacagcuaugcaagcgagggccgcuacgguggggggcuguccagcccugcguuucagcagaacuccggcuaucccgcccagcagccgccuucgacccugggggugcccuuccccagcuccgcgcccucgggguaugcuccugccgccugcagccccagcuacgggccuucucaguacuacccucugggucaaucagaaggagacggaggcuauuuucaucccucgagcuacggggcccagcuagggggcuuguccgauggcuacggagcagguggagccgguccggggccauauccuccgcagcaucccccuuaugggaacgagcagaccgcgagcuuugcaccggccuaugcugaucuccucuccgaggacaaggaaacacccugcccuucagaaccuaacacccccacggcccggaccuucgacuggaugaagguuaagagaaacccacccaagacagguagggcucagauguggccaccccuucuccggggcccaaagcaucucugcuuccccugcagugacauguccugggucugggcuggguucuucucuuucagcggcucugguagacacagguaagagcacaaccuacgucucaggucaggugaggucuccccacccaguauguaaccggucaccccaggaguaaguuuccauacacaccccacuuccugaucugugcacccagcacagacccaggaccuggugugcaugggggauggaaguauggggaaggcugcuccagacuuggugaucaccauggggguaccugguggucccugggaacuuugacaacuguacuugggcagaauggcaaauggagguccagagccagccccgggaggagggaagcggaaggagaaagaggugagagaauugaccuggccuuucucccugccccgccccuagcgaaggugucagagccaggccugggcucgcccaguggccuccgcaccaacuucaccacaaggcagcugacagaacuggaaaaggaguuccauuucaacaaguaccugagccgggcccggaggguggagauugccgccacccuggagcucaaugaaacacaggucaagauuugguuccagaaccgacgaaugaagcagaagaagcgcgagcgagaggaaggucggguccccccagccccaccaggcugccccaaggaggcagcuggagaugccucagaccagucgacaugcaccuccccggaagccucacccagcucugucaccuccugaacugaaccuagccaccaauggggcuuccaggcacuggagcgccccaguccagcccuaucccaggcucuccccaaccccaggccugggcuucacuggccuggggauccucucuagggcugaaaugccaguuuagagcugccugggggugggaggggggauggggaaacauuuuucucagaccuggguggcugggggcccuacaggaccagaggccugggaggcauggaaccugucaaauguagagggaagggcuucugccuuugaucuggggaucagcucagugucaacauguggugggggugggggccagccucauccuccuggauucauccuccuuucccuuccaacuuggguuuauucgguucagugccuucgagcuuugaggagucuccucacgcacucuuauccuaacucccccuucuaggccugacacagaaccuuaaauuuucuugugugggagguguuugggugcagccauauuauuaucaaugcuuaauccagucaccacagaccuuacaauagcaccagcugccuugugacagaccaaaaagccccccgcccccaucuaaccccauuagcccucuccuggcauauuuauauugcacuaaugcagccuucagagguuguuuucugagaccugccuccucacaccagcgaccucaucacuaugucaccaaaguguuuuggaacuugguauuccagagacuucuggaacgccgugcaaggccugcccccagcaagccacaaccaggaaggugcaggcacgcccccacuagcuccuccccuauuuauugccuccuggaaaacccaggacccucuuccccaucuccaccccuaccccugggggcagcccagggagagccaggcacaaugagggcucccaacagcugcaaggauuuaucugaaccuuugagaaagaggaggagccaucuaaguuucuggaaaccugagccccaagugagcccggguucucucuguaccugcaacuaccucauuucaauaaagucuguguuuucccuucuuccu

SEQ ID NO: 16792 - RNA, 629 nt, Homo sapiens
agcagccugagguaaucugugaaaaugguucgcuacucacuugacccggagaaccccacgaaaucaugcaaaucaagagguuccaaucuucguguucacuuuaagaacacucgugaaacugcucaggccaucaaggguaugcauauacaaaaagccacgaaguaucugaaagaugucacuuuacagaaacaguguguaccauuccgacguuacaaugguggaguuggcaggugugcgcaggccaagcaguggggcuggacacaaggucgguggcccaaaaagagugcugaauuuuugcugcacaugcuuaaaaacacagagaguaaugcugaacuuaaggguuuagauguagauucucuggucauugagcauauccaagugaacaaagcaccuaagaugcgccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaaaggaaaaauaaaaaauaaaaau

SEQ ID NO: 16793 - RNA, 629 nt, Homo sapiens
auuuuuauuuuuuauuuuuccuuuuaauuacauuuauuuuaaugcugaauuuacucccgugccauaaguuuuuguuucuucaguuucuucugggauaucuuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuuaaguucagcauuacucucuguguuuuuaagcaugugcagcaaaaauucagcacucuuuuugggccaccgaccuuguguccagccccacugcuuggccugcgcacaccugccaacuccaccauuguaacgucggaaugguacacacuguuucuguaaagugacaucuuucagauacuucguggcuuuuuguauaugcauacccuugauggccugagcaguuucacgaguguucuuaaagugaacacgaagauuggaaccucuugauuugcaugauuucgugggguucuccgggucaagugaguagcgaaccauuuucacagauuaccucaggcugcu

SEQ ID NO: 16794 - RNA, 1482 nt, Homo sapiens
gggcuuccgccaccagcgucucugcuguguugcgcagugcaguggggugcaagggcuuuguuucugccugccugaaagagagggcucuggggauggagaugagaaacaacacgcucuccuucagacaaugaggcauucuguccuccugcugccauucuucaucuccacugagagccagagcugguaggagccgagugccacaggcauucugcauugcucuacucuuagguuugugugugugauccuuccccucccugucgcccacuccucccuccucuggcuauccuacccugucugugggcucuuuuacuaccagccuaugcugugggacugucauggcauuuaguucagaguggaggggcuuuggccugaaauaaaaugcaaguauuuaagauuguuguugcaauuugugucuaacaagcuguagcagagaaggagggagugagcgcuggcaguauuuccuuucauaaaucaugaauuuaucaguguggaaauaaugcuucagaacugugcucuguagcccuccugcauugugugugcagcucaaguucaccacuggaggaaggauugucuuccaaagagcugggauccaacucuucucacaguucugggcgugaaccuuguuagguauaauuuaccugaugcugcuuccauccucgcagucugucugaggugccaggugcugaaagagaaauaaaguuugucaacaggcagaugcaaagcccuggcugguauucaucccucuuuccugcccgccuccccugggucucuccuuuauaugaugcagcagagcaaggcgaggauagaaaaccuacagaggcaaauccaaaaugucagaagaaguucauuuaaaaggggaaaaaaacuccaugugcaacccucacaaaaacccgacagaugcuaagcuaauggcauccgcucugccgauugguggggauggcucaugaauauuaaugagcccaaugcuccaaauggugcagcugugaacccagcugugccugaagcucucugaucucgaaacuuccagacaggagcuggagguggucugugucaauucccuacucagccaaaaaaacagcaagcuggguuggccuucuucuguuugcuccuuuucuuccuggaguuggugcucagcagcuaguucugccagccggcuaggcugcugggacagcaggagccauucaaagacauggaugugauuuuucugacucccagcuuuuuuaaugauccauuagcagcaugcauacaacagcaccucaguuaaucuaaggccaggcaccaucucuuuucagucucucucuuaacugaguauaggccuuggaaggagaaguccuaggaaggaaagcacuuuucuaauaauacaagccuagggucauccgaaaaauagcgcacaugaguuuuccucuccauccagauagugccauaggccccucuucuguuuugcucugucccugcgugugcccaggucuagccacuguggcc

SEQ ID NO: 16795 - RNA, 13279 nt, Homo sapiens
caguucuccacccaucuucccaugugagcucugccuuagccacgcaauggccaguccucccuacaaugaguccauuuccuuuauucucaauuuaaauucaaaguggggaaaaagugcacuuaagaaugaaucauccauuuuauuuuauuuugucaugugcucaacagcaucucucucucucuccccucucccuggcaggucacagagauaaauuaaaaauaaaaucuacaaggaaaauaauuuauaaaagcacucccagguucacaccuucuaucccuacugcucaguuaggcacccccuaacugggaaucagugcuuccccccacccccauuucacucccacuugucuggggcagacgguacuccagagccgggcaggggugagggcagcaguggcaaacaguuaaaaauaaagacauuguaguccuggaaccaucuggccaccuuggcacucccaugucugccucccccaggcagcccuccaggagccugugcgaagcuggggcuguggagaagcugccuguggcugagagcuuguguguuuggggaggugcucucagccugucauaugcacuucucaaucuucuagaaagaaacccaaaaaagaaagcagacgacgaccucgggacagaggagaaaaaucccaaguguucacacaguuacacggagucuuuauggcaaagagaacauuuagcagcuuugaauauugggcaucuccuuuuuacucaacacaagcauucuagacccuauaagugaaacagggcacaagcccuaaaaaaaucaaagcgcaagaaauucuaagaggacuaguucuuuuguuguugcuggguuguguaauuuuuuguguuuucccagugauaagcccaguuguugguaggcagaggcccgagggaagggugacuccccaguguugugcugaauccugccuggaggcugcuacacuagauucuccaucauuccucugccucacagcagucccagaagaggaaggcugcaggcccaguucccggagcacugccaucacccuaccccagcuuacagaagagcucaggcagucugugagggguggggaacacaaacaccggaccaggggaggacggcauacacaugcaggcucugauggagacaaugggagccucagcucagggguggcuggagcacggagggagauggaguggcaaggcagugaaugacaugcgugauguuggggcuguugcaacaugggaccacgugacccuuuccuguucacucuacccuuugacucuaaaucucaaagccaguguuggggcccaguggcuccauucgauugaaacauggccaaugauauccaagagcuccccuucagggaugucaaaaugcaaggagcagaaagaguuaacaccgucccuccccacccccacccugugucuguguaccccaccccccccggggugaaaauugggguuuaucacaccagugaucuaggcccaccagucacuccaaccugcugccuggaauccuggccagagccaaccuuaaccuucccucugauuuucuucccgcuuugauuuuuuuuucggggggggggggguuccuuccuuccuuccuucuaucccuccuuccugaaaugagacuuucugccaccuucccuuccucucacagguccauuccuuccccucugucggccuuugcuccacauagcuccucuaccuccagcaacuccaccaccaccccugccucacaggaaagggguagggugaggacccuguccgucuaaauggucuggccacuuccacuccacccgaguggagcugagccagccagugccugccucuuccuguacacugacccgcagucaucccaucugagaagauauauuggauaagaaggcauuuaaguccccgcuguagguccagguccagguccagguccagcccuucuccaguuucggucuuggugggcuucaaacccccuucuuccccaggcucacuuucuccgguccuuuggcuuccucuccugccgccgggccugcuggucggccaucgugcgggggaugaggaggacacugccguccccggcguacuggagcgcauacugacugggcgaguagggucguccguucucaucucgcagccgcccaaacaccuccugguacaggcucuggaccuucugcuucaucugucgcagggagcgcaggaacuccacuuucucccgcagcagccgggcuuugucacgcugcagguccuccacaucacgcuccagauucaggaugguguccagcuugcgcuugcggcaguucugcgccgccaucuuguucuugccccggcgccggaugucucggaugaggcucagcugggcuucacucaacugguauuuggacagcaguucauugaacuccuccacaggcagguugaugauuuugucauuggugaaagggaucuucauggcucgggcucggugcucaucccggcucaucugcuuguccaggaagucagccugcuucuccuugcugccuuucuugagggcacugggugguggcaggucggcugaguccagggcacugggugccauguuguaugugugguuguggcccacgugcuccagguagggcaggcaugagagcugagcuggauccugguagcucaugcggcagaacuuggaauacucaggcugguagcccacagcacccucggccucuuccagauccagggucucagagucagagcuguagccaaccgcaccuuccucagaaaaggaggaagaggcagaggaagaagcagaggaagaagaggaagaggaggaggaagaagaggaagaacugccuucagagcugcuuagggaagaagggcuauggcucgagucuaaggaaaggccugagucagagucaaauuccuccuccagcugggaggccugcacaggguuaaagccuucuucaauggccagguccauaaggcugaucucauccaacauagcuucaucuaacagaccccccaaagggucaggcagcucugggccugcugugucauuggcugugccauugagcugggguggaaagaagagcccugucagguugguggagccgaagguggaguugaggcugguagaauugcugggggccaacgggagcagcguggagcuacuggccacaggcaggcuuuccaccucggggcugaagaguaagaaguccuggcugcagccccccagggacgccugaugcaggcugacauucugauugaugggaguguugggggcaaggcuguaguuggugcucagugggucuccaggaggggcacuguacaggauuucacuugcugauguguucacuuccauggccugggaggggagaagagcaccacuguucacuaggaacugacucccuccccuggggcucacacacugcaggcacccaacagaggcacagcugcauggguguaaaggcaaaauacuauaaaccaaagcccacagugucagcuccugacccagcuucguccaccaggccuggcagagauggguucuuccauguaggcuccacccuaauauaggacugaucagcuuuuccucauguuuggccagacucccccaucuuggagggagaggaagaaaacacuaccuuguuacugcaaaaucagcacagugaaaagaacacccagacuuaagucagaaaaccuagcugcaccacuugcugugugacgaugggcacaucauuuaaccucugagcuucaauuuccucaccuuugagauaaaggcugacuagaugacugugagggccaagugagcgaacgauggcugugaagcaccaugugaaugucagcuauuauuaacgcacaaccuuggaagcauucagccaagugccuaucugccugaaggaaaggaagaaggcacacccaggaggcaggcccugauuuggaaggcugaguccugaguuuuauuuaacccaaacccuaccugucuccagcucccauugccccaaggacacaccuggacagguuucuucucauuguccccacuucucuaugauucagggaaaguauuacacuuucucuccuuggagauggaaaagcaacugagugcuaagacaaucugugcaaaauccaauagguuugugcccgguuccgacaauccuaccugcauuuccaugauggacaugagaucuugccacugcuguuccaaaucaaauggugacucugucccggucagaagaggagacaagagguuguuuugaagagcagggggcucacucucacuaggcacugcuucuguuaugcuggaaaugucugcuggaaacuagggcaaaacacagaggcuuuaacaagggggaaggaaaaaccuugugcuuuccucccagagauuaccaccuggaccuguuucuguucuuccuuccucugcauuuacccccagcagccagaauaaggccagaaccaacagcuggccccucagccauggagggacacaccagguacaggcugcccugcucacuugguggacucucacuggaguccugcucaccucagcauucuccccaaaggggcagguggcuuccagcagccuaaggcacucuuccagggacagggccgucugguccuccccacuaggcaccuguggcaacaggaacuguaagucugauugaccugggccuuggcugccuggggcugaagcuucuuucccagaauggcugaagcccugcagucucccucccauucccaggcuaauggcuggccccgagucccaaacucccagaaacaacagaagagagugaaagaguccugaagcaagcaggaagaugcuacaugcucugccucccuugcacugucuguugccacggccuggccauucugcaucugcugcuuuccacuccccccuuccaaggcucagccacugugacuuacagaccccaacccaaaacagaaauucagguccaccccacacaccaccugucuucucuaaaggaaguuucuggaagaacuccagccugguuugugucaggguaguagggacaagaagagagcccagugagcaggggcgaugguaccugugcagggaagcucuccccagucucuccauccacuagcagguuccgugccagagcuuccgcgcccucgccugcccagguguccugcucgccuccaucucgcagcuccuucuccacauccugcuccuucuggcggugacuauagucaaaaaccucacgcccagcccccagaucaauauccugucgccaaaggaugucaaucagaucuauguccugaaagacagaucacaugacuuuagcucuaagaucccaaggucccuuccuuguccugccccucagaguucccuccuagugucaccccaguuaguccuggguggggccccucccagcucuucaccugccagccuuuacccccuggucccugcaccagcaaguguucauucaucuacuuccagacacuauccccuucccacaaaaaaaaagagccacuagcaaaaccauuagugugacuaucaccauaagggugcaaaggauuaggaucuggaccaagacacacccagacaaaaggcagggccgccuccccccuacauaagaaagaaggggaacaucaggagacaccucuagcuuuggggauuggaccccuuaaaacuugguuuggaggaagcuggccauggcaagcaagagcgaauugucaugcagaauuacuuagcaguggccaggcuugcaucagccugugguaccauuucauuugcauaaagggguggggugggcuagagaggaaaaucccugcauuuccaaccaccugaugcaaccaaugacaacgccaugcugucuccagcccuuccuauagccauuccccauuccccagcuggcagcaagaguaaggcugaacacccacaacuccucaagcccaggcucaccucaagacucauccccgccagaauucccucucagcugauccuagcugcugccuccauuccagggaggcucaggcagucagaugauccccaggggugcaccccacccccugcucgggccagccucacuguguccccuacaccagugcucucauucccucaccauaccccaggacucaccaaauccccaucagucaacccccucaaggacauaaaccccaucacugcucagcuacaacugccaccuugggcaccaaaaaugcuucccucccgcucuacccugguggcucgugaacaguugcugcaccaacugccacccccacuaacagcauauaaccccaauaaauagagcuauuugggcuuccuauacauggcaccccccuguagucgagcccucccuacaagccugaagaaacccuaaaguguugccuuccauccagggguuaaaaugcagacauacacuuuccagaaagcaauuuccuuagaucagacccuccucccuaccucuaagucgguauucuucucccauuaacccccccugacccuaagaccucccagacguacuacuuuagucuccccacauacaccaaccugaacagaagcccuggacccaggagcagaggcgggcugggccacccggugaccagccagcaaagaguuaaggggccggcugccuuuggcauggcccccaccacugugagagcugcgguccaggcgggucauggucugcgagaugagccccagggcagccggugccgggaagccggacagggggcugcaaggagcucuuggcuuucagggagcacaccaggcuggaaggguggccccuugcuagcuccgaggggccugaggagggugccccgcccgugcugcugccugggcggcccagccagcccccuuccuccauccuugagcagcccccucccaccucacaaccccaguuccacucaggcgcccagcugcccccacccugagcucaccgcagaggcugcagugagaugggacucccaccccaugcuccgugcucaagcugcagaggaaagcaagcucccuccugggccuauccucccgcuccucccccccacgccccccaaacuuguuaccuaggcugcagcagggagccaauccccacccccucccaccccgcaggucacugcugaggcugcagagagccaauccccucccccaggucagcagcugggcugcgcaaagagccaauccccucccacugucguuaccuaggcugcgccgagagccaaucuccucccccaagucuccgcuggagaugcggaaggagccaauccccucccaccgccuguuaccuagcugcagacgggagccaaucucugcaucagggcagcuggagaagcugccgcaaggaaccagcccaucccugggccgccuccgucuccuugaggagaugcgcccaggggcgggcagccccacccagcccagucagucagcugggguggcgcagugagagcccugggggaaggggugccacucuccucccuccugucgcaucuugcucauccagcccacucaggacugggcagacacuucucccgcagauucucugggaaucuaaauuauuugcuggaaguggaaagaguuaucccauuccucaggaaggcaguggccaguucucaaggccagggaucacgagccaggcugggcaggaacccagggcacccaggcccaccauaagccguaaguuuugucaccccaaaauaggccagacuagagaaaaggggaaggccauuuugcccacgugcagcaaugucacagugcuggccaagccuagccccaagcaagaggaggggagacacaacccugaagccccauacuuagggagacaggugcucugcauucuccuggccacaaauguccccccuccccuuucaccccggcuuuauucaagagcauucucugccugauuccuggcccauaucucauccaagcaggaaagaagccccucacagacucaguaucacaauucagacucccuggauugguuucucgaggggaaauuuagcucccuccccacugcugcuccccuggagccuaaggucaggucagagagacaguauguucucucuggucacagucagcuccuagccuggaaagagcuguaaacaggccaccccccugcucugggcagaaugccaaucucaaggggaauccuaucccugacaacagccuaggcuauggcuguccauagagcaggccuggcagcgggggaguacugccaccccagggauaauaccgguuccagcagugccugucacaugcucuggaccuggguauuuuuaucccugaguugcugaggaaauguuguucuagacacauaauaauccucccuucccccauacccagccugggccccuaaugcugacccaccccaccucccaaagggaguuauaaaggccugagaugaggaaaagcacaaccuucacgagggccaagaaacagaggaaagcagggucaaagucccaucccauucggccccaacccacccaauaauauccaaaauaucccaucccaucccagcaggaacagauaugcagcuacccugcaggguuuccaggagcaaacccaguuacacccaccccugggggagcuacccugggggaggagcauagagcagagacugggaagcacacuucagaacacugugccaagauuagagcccacuugaaggaaaggggaagcagaagagaggugaaguuccaaguggcccuguaagaagcuaaauuaacaggcccugaaagguaagaaauguuccuggcuccugcgcucagauaauccuagucucucucaaagcagguccaguaugagccauuugagcacagagccgagugucucaaucccugcacuacugacacuuggggucagacaaaucuguuguuugaagguguucugugccauucaagauguuaaccagcauccuuggccccuacccacuaggugccaguagcaaccccgccccaagaugugacaaccaaaacuguuucacgauauugccaccugcacccucggggacaaaaucacccccaguugaggaccacuggccuagaacaagccauacucuuugacagucacuaacagucagagaacuaagcucaggaaaagacuacagagcagggaaggagggaaaacguggucugaccuggcaggcagagaagcccauuucuguaacaucuguaaaacuuuuuacauuccuucacaugccaccuccaaaaacccaaucgggcuuucuccuucccuaauggccaggggagugcagugggccucuuucccggcuacuuaaggcuggauggcaagcgagagccauacaaacccagagcucaaagcaaucuuauguuggugaggcaggggcagcagcagccauucacaucuugaaaggcaaagaacugcaucgcuuucugcccagaacaguaugucagccaugugacaagagcuaaggaucucuucugacagcucaaagcaaguugacuugggcagcagaaugcaguuucucuuucuagcucccagacuucucuucccuacucccugcagugggccuuuugcaaagauuggaagccuuggcccucuccuggccaagaauaacuauccaaaucuacccuuuggcucaggcccaggaggucugaauuaucaggacaauacaacaacaggccucgccacaaaggagaacuucaggguaugucuguguucugauguggggggagguacaaaacaagaguccaaaaaguauuugugucuuagcaacagauguacacugcaucaaagcccaucacaacaugacuccucccccaccccaggccuccagcagucacgcugaaauccaagcaguaaacacccuggcauguguaggaaccucccacugcccugacaguacauuuagagguaggucaaugguucaacacagggaaaugcucccagcccccaauccuaaagucagaaaguucagcccaucccuacccaagaacagugccugaggcccugcugaaaccugucuggcucuuuacagggcucaguguucugaccacaauccuuugggaccagcccacccccaagccccaggccccacacacccaccacagguccacuaaccucuuugguuaagucuccacugacugggggggcuacagcccccaaauccuccaaaucuucaccgaaucccugcuccguuucgcuuucucgcaccccguugucugggccugucacaucuuggaggccacuggaacucucgagggcgaggccugaguugggcugacugccagagacagaccccucugggucucggugaaccagccaggcauuuaccucagugguuggcaccuggaaccuguccagggcccucaccugacugaggagccgccgggcagugaaguaauuguccaggucuaugcucuugggguggauaccauagccauccaagguauuccucagguuguggaacugggucugaguauaggcagaacugggccccaggaugaucucccggagugggggaagcugugaggucagguaaguauccacguccacccguaccccaaucaaacucagcagaauggugaacuggagaaguccuuccguuaaguauuucuucagagaaagcauugcugaaggaccagaauguuuaugcuuuuugguuuuuaaaaucuuccaaaagacaaaucaaggccacugcucugccgcuccagccagcagguuacccuccucagugucaaaccccguaccccacccuggcagaacacaagggaugagcucccugacggccccagaggaaagcacacccuguggagccaaggccaaggacacacuccagaccacauucacuuucccuucucgacaccucaccucugaaaguacaacuguuccuaacccaguccagguccucaagggcccacgugacuuacuuucuccacaguccacauacagucacuuccucacucacauuaguuguccucucuguagauuccaaugcaggcuguucucaggaacagcugauggauuuuuuuuuuccuucucccuccuaagguuuauuuucuuuggcuggagcuacaggccuuucgucuugggucagagugucccgccuccuccacacuuaccagggggguuuccagagaaaccugaaaugggaaucacaaaagcaacaggauaagauuccauacuuuucacaucaugaucaggguaggaaaaccuucacaguagaagguagaaaacacauucaaaggacacuuucacuuuuuuuuuuuuugagacagagucucacucugucgcccaggcuagagugcaguggcgugaucugugcucacugcaaccuccaccuucugcauucaagcgauucuccugccucagccucccaaguaucugggauuacaggcgccugccaccacgcccugcuaauuuuuguauuuuuaguagagaugggguuucacuauguuggccaggcuggucucaagcuccugaccucaggugaucugcccgccucggccccccaaagugcugggaucacaggcgugagccacugugccuggccuaaaggccacuuuuacaggaagaaaggacuacuuacacucucagaaaaaaaacccaaaauauagcaaccgaucauagaagaacuaucaaagaaagcuacugaucacgaaugaucucaguuacugaauauuaaaugugcaauauccuaaaauguagcuugguuugaauaagcagacaauaaccaggucauccaaaauaucuuacaccuuuguuuuauuuaccagcccuccucccccacuacaggcgcauuacccagcuucuauuuucacaugagaagcccauuuccugucuuaaaaguaaagcuggauuuucaccccucgggagaaaaccacccauaacaguugucuuuucucaguucaaaaaggcaagauuauuaaacagugagaguguggaaggacaaaaggacaauguucaggccaccacuucacccagaagaagaaugccuuuuguuuucugaacuuugaaaucugauuucccuuuccuauccucacaacuuacaaaagaaaaaaaaggaaaagggccgacgccuguaaucccagcacuucgggaggccgaggagggcggaucacccgaggucgggaguuugagaccagccugaacaacauggagaaaccccaucucaacuaaaaauacaaaaauuagccgggcgugguggcgcaugccuguaaucccagcuacucgggaggcugagacaggagaaucgcuugaacccaggaaacggagguuguggugggccgauaucgcgccacugcacuccagccugggcaacaagagcaaaacuccgucucaaaaaaagaaaaaaaagaaagaaaagaaaaggaaagaaaaaaaggagagggauggugggggcccuacuacgcaggacuauuccguccagaauuugcauaggcagguuuuauuuucauucauaugaccuucugagccaaagcagaaggauauggccacguucucuagccagacugcccagugcagaggaaguaaaucuguuucuggucuccacuuuugagcuuccauuaaugucacaaaccaagacauaccgccucuccucuccugcguugugacccaucuaccaacuucauucuacagggggagagcgagcuauacguacacacacgaacgugcgcacacacacacacucacacucccucucucuggucagaguaaacacaauugcgacccagaauuccugcuuacgcuacccucccguucucacgcaauuuauuacuaaaaccucccaggagccaauuaaguucgaggaaccggacaaagucccuuaaaaaucaaguaggugcagggcccauagccugaggcuggucccacccugcccggauacccgaguccggcugagaccaagucgccaugcccacucucggcgccggagcuucuagccuccaggggcggccagcgaacaagugcuacuucccuggccuugacccacccuuacagcaaaccccaccccgcccuccgucccgauggccccaccccacucccaaguccaggccucacaccacgccuucucgugcccucaacccugcccaguccaucccaccccggagccagcuuuccucucggccccgcgcggggccccucccugucaggcccagggccgggcucuggcgggaaccccgcucggcccccgccuccugcaccucagcaccaucccgucgccccauaagccucggccccgcggcgcugcaacccucccuucugggaaaggaaugugcccgauacccacugcuuagcucggcguccgccgcugccuccacagcaggcccuaagcccgagucccggccucgccgccgccaccgccggccggccuagagcucggagccuccgcuuaccuccccgcccccuccugcuaccgcacucg

SEQ ID NO: 16796 - RNA, 11663 nt, Homo sapiens
cggcggcggcgggcaggcggcgggcggcgcugucagugcgaggcggcgagcggaaugcagcggcccgaggcuggccacguccgcacccgggggagggggccgcggcggcaggccgggggccggcgccgccugcucgagccggggagcccucggggcugcggguacggagcgggcgggcgcggggaucccgggcggcgggagcugggcagggacagagcaggguuagggggagcagccaacucagaacucgcgcgcccggcggcugggaacuuugugucaccccugacuggccccaggacccgggaggaaaaguucgucccagcgccgaccggagaggaggccuguccugaguccgucggcgcggggcugaaguucuggguccguuuggaguggggguggcgggugaguugcgauuccgcggggaggguaaggaguggccuguccgucccagacucggcucccaucaccggugggugaugggcaugcuucuggagucuacccgggccagggccugggggcgcgcugauagcgcagguccagcccggccagggaucagcuggaagaaggaggcucggcccgcugucccccccggcccagguucugugauacacuccgacucgggcucuggagcagucagugcaugacagaacuugggcccggaaggaccuucugcacccaacgggcacagcgcccacucggggccugcaguggaacaucugccugggaguggagugggcaccuggguuggcccauguggcacagggcugggcagaaccagcuguggaccuugaggacugggguugcuggggccugaggauguauccuagggccagcagaucccauagacacaggguguccaccucgagucaggggccaaacggaacucuccucuccggugucaguugcaggaaccuucccucuacaccaucaaggcuguuuucauccuagauaaugacgggcgccggcugcuggccaagguaaccucugaccccacccaugagggacacaguucccacucagcugacacuccugucucaggagaaacuccacugugaucucugugacucagggcagcucagcuuagaccccuccagagguccuucucauccuccugccuugucaaggugcugcucccugaaaugaggggucuccucuauuucuacucauguucccugaaauguuuccuuaucauccugcuacuggccaguuggaccugggcaugggaagguucugccuaaugggucaguggaguguugagccugggacccaggagucuuaguccccaaacccccacacaaguucuuuuguucuuugggguuugucucuaaaccuccacuuuuguucuacagcuugguaaacacuaacgauuuagucuaaggagucuaaggauuuagaaccagaugggauuuuagaaacuguauaauccaacucuuuaauuucguagaugaagaaaaugagggguagagaagcuaagugaguugccugaggucacaaguauuaauauccuaacagauccaaacucaaauuuuauuuauuuacuuauuuaauuuuuucacuucucccauuucacagguuucacaggcaaacucggguuuuuugacaugaagcucaaggugguuuucacuguacccccauucaauuagcuguuaucuauccuagcaaacauggccugagcgaaccaaacuaaaauaauccaaaaauaaauuucugcugucaacacaauuaauuguaggggagcuauagcaucugcauuagcuaugaaaugcauuauaaggccaggugugauggcucaugccuguaaucccagcacuuugggaggccaaggcgggcagaucacuugaggucaggaguucgaaaccagccuggacaacauggugaaacccugucucuacuaaaaauacaaagaauuagccaggcaugguggugggcgccuguaaucccagcuacucgagaggcugaggcaggagaauugcuugaaccugggaggcagagguugcagugagccgagaucacaccauugcacuccagccugggcaacaagagcgaaacucugucucaaaaaaaaaaaaaaaaagaaaagaaaaagaaaagaaauguguuguaaggccaggcgcaguggcugaugccuguaaucccaguacuuugggaggccgaggcggguggacugcuugagcccaggagugccagaccagccugggcaacauggcacaccccaucucuacaaaaaacaaaacaaaacaaaaacaaaaaacaaaaaaacgaaaauuagccgggcgugguggugugugccuguagucccaccuacucgggaggcugaagugggaggauugccugagcccgagagguugaggcugcagugagccaugaucgagcuacugcacuccaaucuggguuauagagugagaccccaucccaaaaaauagauuuucuguuuguuuauuuggaacugaaaguuuuuuguuuuuaugaaauucaaauaagcagcggccacuagggagauggcuaaucugccugcggauugaguauuaaguggcaaaauccacauccagaaaauugaaaacugagcugaccacaccuugccccagcagauggucagagguggaucagcaaggccaaaggcuuuuccucccuacagauuaagaaacugagucagagagagaggcucaccauucccaaacaaaaaacauuaauuuaguuaugggauaugugugaggaauuguuucuuagauauuuaaucuucacuauaacccugucugcagucagaccguccuuaguggucaaacccagcuuuggccucacaacugugagauguuggggaaguuaccugacuucuuuuuuuuuugagacggagucucccucugcugcccacgcugaaguucaguggcgcgaucucagcucacugcaaccuccgccucccggguucaagcgauucuccugccucacccucccaaguagcugggauuacaggcacccgccaccaugcccagcuaauuuauuuuguauaauuaguagagaugggguuucaccauguuggcaaagcuggucuggaacgccugaccucaggugauccacccgccucggccucccaaagugcugagauuacaggcaugagccaccaugccaggccauuaccugacuucuugaugccucgguuuccccauccguguaauggggauaauaaaguagcuguuguuauuaucauuauuauuguuuaagaaggacuccugguuuugccgucuuuccuguagagacucagggugcuguagaauuagugugcccucgugaccaugccaauccuuagcacccugcacaucugcugaauguacaagauccuccaagaaaccaggaggggacuccaaaagcaggccucaauaucccucuacuuuuugggacuuucuuugcucagaauuuguuuuggagggggccaagcacaguggcucaugccuguaaucccagcacuuugggaggccaaggugggcagaucaccugaggucgggaguucgagaccagccugaccaacauggagaaacccugucuacuaaaaauacaaaauuagcugggcgugguggcgcaugccuguaaucccagcuacucaggaggcugaggcaggagaauugcuugaacccgggagguggagguuguggugagccgagaucgugccacugcacuccagccugugcaguaagagcaaaacuccaucuaaaaaagaauaauuuguuuuggaggaaguaaugagccugcaggccuagggugcaguaauggagagauggggcagggaagcaggaucccgcuugcccagcgccuacucuuuccugccccccaaucuagggaggauccaggcuguguggaaagcuaugguccuuucuccuucccuuucucauaguauuaugaugacacauuccccuccaugaaggagcagaugguuuucgagaaaaaugucuucaacaagaccagccggacugagaguaagugucccccucuuccuccagcagacuaucagaugcacacugucaucuucuccaucuggacacaucuguccccaucagccuugcacacccacaggccauuucccuuucuucagaggcuuuuuguccucuccuucccugcuguucuccacucccuuccuccagggaaccuccacucccugucacucuccaguucccccaacuacccaaccccccagcauccccaggccucucucuagcugaggaggccaacuguguuguggucccaaccuggaucuggucccaaggugcugcacagggugggagcgugggcaggagguaaacgggucaacaacugggcuuguugacuccuuggccugaggcagucccuagaaauagaguagcagauaaggggaaggacacggggcugccugaugguagugucccuagugcuggucuuuccaaggguucuccagaaaggggagaaggaaauaggagagucacagagucauacaugaggaggaggggcuaggcuaggaccaggcaagguggccaggacugaaagcucccuccacuucuaggugagauugcauuuuuuggggguaugaccaucgucuacaagaacagcauugaccucuuccuauacguggugggcucauccuacgagaaugaggugaauucaggagguuggggcaguaagaagggucugucuauggggaaauguuguuauuuggaaucugggcuugaggcugggaccuggaggcucaccauuggaccccuucuuuuaggcuccaugggguagaggagggcagccagaaggguucuuucugggacaauguguaucuucgaugccccuuaguuuccuugggaaccaggaaugaaguaaucacuucaucuucaagggaggcuuuguccuucuuaaacauaacuagagaaggauacacucaaugucucccaguggagaacuccaguuucccagcccagacacauggaaguucccucuaaugucacaccgcagucagucuccagcccaggccucugaaacucuccauugcugcccgcacaggugggcuccaagugcuucuuuugaccuucucaaucucaaacucuccuuuuccuccucccguaucugcccaucccagcugaugcucaugucuguucucaccugccuguuugagucucugaaccacauguuaaggugagugagguucucugcccuccgaggccccaucccccuggcccugauaugucacaggacccuuccucccuguuuuucuccugaaguccccacaagacuaagauaauccaaaaagaaaaguucacagucgacacaaugaacgaaaguagggcugugcuauagcaucuaaccuaguugugaaacgcaucugggguccuguggugggugccagggugucaaggcccaaaguaugggagguuggacaagguaggguguaaggaagcagaacugcccuuugcucagaaaugccuugcaugggcucugugcucacugcccuucacauucuccuucccaguccuuguuuggugaggggugaaugaggcagucuuuggagaguggggucagccucaccuaggcagggacucaguuccucccagccacagggaggcucaggagcuuguguccaccuucaggaagaacguggagaagcgcugguugcuggagaacauggacggagccuucuuggugcuggacgagauuguggauggcgggugaggaggggacagucagggacacucacagcaggagugccuuugauaaucaucagccccagauggcacccagcauggcuagaacucugaccaacuucucacucccuucccccagcauauucccagggaucccauuccccuagcccuuccccuuacuagcgccccacucaugaagauagaaguugauuucaauguuagccaaagucaagccaaacaagagacuaaccugaugucaaacuaugggagacuguugaauaggcaggguuuggggaaaauccaguuuggucuccaaugcccaggggaagcacuggcacagaugcuggcccucucuggaaggacuucagacagucccaccagccccacauguccugcucuuagggcucaauuccaacacaagcuagaugcgugaccugggucaauuacugacccuccccgaggcuuacuuucuccaucuuuaggauggagguaauaagggauuguggggauuaaauacaugugugagaagauacaugugaagcuugugguucucauucaauagauguugccuccuauugguaugcuaguauauucuuaggaagcuaggagcucuuuugagaaaaguuggcuugugaauuuccaucaggggaucaauauucagagagaaaaagaaguucuggcucuggggcaaaggauaauaaaaauuucuuuuuuuuuuuuuuuugagacagagucucgcucugucacccaggcuggugugcaguaaguggcgugaucucggcucacugcaagcuccaccucccggguucacaccauucuccugcuucagccuccugaguagcugggacuacaggcacccaccaccacaccaagcuaauuuuuuguauuuuuaguagagacgggguuucaccauguuagccaggauggucucgaucuccugaccucgugauccgcccaccucagccucccaaagugcugggauuacaggugugagccaccauccccggccaauagaaauuucuugagcuccuuaaaaacauacaucccucuaucauuacaucauuuuauacauuaggaaacaggcucaaaguuucaagugacacgccggaggucucucacacagcuagggaguggcagggccaagaucuaaaaccaugugaauaguuccagaggccaugcuguuucuauggcacuguacuggacugccuggggcacuaaggaaugccuccugcagauuucugggacccaaaagggagugggguaacgccagguuuuggggagccagaagcauauacaauuuggugaacccucuugaaggaaaacuuuacacaaacacacacaaaacuauaaaugcaaaacaagaugcagggcucuggauggcugugcaaaggaggaugccugagguguaagcuucacaagcuucccgucucugccucugaggaacucaguuuccugccaagaaaaacuggggaagcgccagucgggaggcaacgccuaaacuggagccuuggccugggaugcucuuucuuuauggauuacaggaccccugguuagggagcuugggacagggggugcucagcccaaggauggggacuggaagaggcucccaagaaauguuugucauuuccagugauuuaguaacaaagagaaacaaagcuucugccuuggaggagucucaguggguaaggagguacacucagauccugucaucuuuguccugccgcagugacaggcccucacgcccauguacccuguacauaaccccaaggccucacgaaggagcgccugcucucugagaaaagcuacaauauuugggucuaucaaaagggaauuuuuuuguuuguuucuuuguguguguguguguguguguguguguguguguguguguguuuugagauggagucucacucugucgcccaggcuggagugcaguggcgugaucuuggcucacugcaaccucugccuccuggguucaagcaauucuccugccucagccucccgaguagcugggauuauaggcgugcgccaccauuaccggcuaauuuuuuuuguauuuucaguaaagacgggguuucaccauauuggccaggcuggucucgaacucuucaccuugugauccucccaccuuagccucccaaagugcuaggauugcaggcgugagccacugugccuggccuaaaagggaagauuuaaaaaaaaaauuuuuuuuuuuuagacagagucucacugugaugcccaggcuggagugcaguggcgcaaucuuggcucacugcaaccucugccucccggguugaagcgauucuccugccucacccucccaauuagcuggaauuacaaugugugccaccaugccuggcugauuuuuguacuuuuacuagagacaggguuucgccauguuggccaggcuggucuggaacuccugaccucaggugauccacccgccucggccucccaaagugcugggauuacaggcaugagccaccgugcccagccuuaaaaaaaaaaaaaaagggaggaaguaggggagaagguagaugcugauuuuuggaguuucauuucuuuuaugcagggcaugaccccaugccauaaaauaacagugcaacaagauaagaacccccagggccucucuuccuaacucuuuucacagggaauccaauccuauacccagaaagugaagugaacuuucaagagcucugaguuuugagagucccugcuuuugacaaccugaucauccuagaccagacuguucuuauccaguuucaaagauuuugcccagggaugacaaagcauguggaccacuggguugaagcaucaaagaaucagagcugagggcucuccaugcugagggagaguucugacuugagggcuaucagugggaagggaccuggaagguggagauguugcaggaugccuucggagagggaagaggcuuggcaaggagaaggggcggaggggaggauugugccacugauuugccuccugguuuuuccucucaucuuguagugugauucuggagagugacccccagcaagugauccagaaggugaauuuuaggguaagagucuuccuggacaccuccucuuuuaggcugcccuuccuguccucccugggaauagggcugcuagggccuagaugguagaagcccaagcuccucuagcagaagccaaccacugggcugacacacuuguuaggggugagaugagcagcaguuucugggugggaugccaguuaauggaagaaaucuuccuguccucuccccggcuaggagcacaaguaccucaccucuuuccugguaggaaguauagacuggggaaauaaauacaucuucaaagaggcacuagguggcugccuuggccuugagguugggggucagggguauggauagaaccucccugccuuguuuggcuuucucaugucuggaugaaaccuuucuucccaucuuucuucccaucuucccucacccuccacgcaccauagcacaaucccagagguccuggcuuccaaaugacaggcugcaggacuucuauuaaccagugacacaggugcagcucugaaucacccuaaccacugcaccaccucacccauacccccaagccccuuuccuucaccucccugacccaggacccucaugcuggcccuaccccaccccuugacucugcuuccuuacaggcagaugauggcggcuugacugaacagaguguggcccagguaggccccccugcaucugccuuggcuagaaauggucuagagagauacggggagcagagcauccuagagcauccuagggggacccagugaaguuaucaagucugaaaaaucaggggugagaagggaagggaugaggcagugacaggucauaucuuggaaagacucacuggaggccuccgggcucuccaacucaggggagcuggguacuaauggauggaugggcauguuaccaucagcccaccucaucuccuggcuugguuuaguuggauugaaacuaggaugagcugccuaccuuggagauggcugggucacuugugcaccccaaaaaucugggaacucaggccucugaugcgcccucuaccgaaaccuggaaaggguaccaaauaggaguuuggcucuuaaccccuguccuugccacuuagggugcacacugggauuguuaagggacucucaaacccaugauaggaucugacuuuccccacucaucacuugucaccuuaccccugagugaccuggcuauggaagaaccugccacaacccugcauggucuuaucuggaggugcuugcagagcguaaggccagggggagguuccuggcucugaagccugaucaguuccccagcugcacaaacuuccugcuaguucaggacgacugucuugaccucucuucuguccaccugcaggucucucugcucagacuaauccugcuuguauggaacuucccgcccuggcgcuaacuccucgugcugugguggcccuaccgagaugagccugugcugucucguguggagucccagguguggcgcccauuuuccugcacugcccuuagcgcucacucugcuucgcccuccccucugauuccccauguuuccucauaccaugcuggaaugaaugcagcugcaaggcaauuuuuagaguggaaagaggguagggaguaauaagcagagcagauaagaacacaggugcucaugggagucaucccaggguacguguucuaccuuaccaccuaaagcugggugaccuagggcaaguuacucaaccucucugggccucacauaauaacaggacccucuucauggaguuaugagaauucaaugagccaaugcgugacaagcucuuaguagggcuccaagccaguuaacacaugcugaauaaccaucaguauuucuccaaagggagaaagaaugaaaacauagcauuuuugauggaauucuugaguaaaaacaaaggaagcuacagguagccaaugggggauaaaaugaggacaaaguuagauucuggcuaggagaaucaggggaacccuaagccacuguccccaagagaggagggagacugugcaggaggaggagacacagcguucccuccuucucuagaggggaauaaggcugaguggcuggagggacaaucugagggacacaccugaguccugucccccucuccugcuuugguauugugcaugcacgugugcacuuauauggauuuguguaagcacugggcugagacuuuccaccaggcaucccaccgcagggucuggcuggccacccuuugccagcuaugccacaucagcaguggguugcggugggguguugaggacacauugccagccauggccagagcuagggguuugcugaggcgucugagcacagggagugucaggccugggccccgucuccgccuggacguggcacugugggcgggaacucucauggcaugacagcggggagacaggcugcugccacacccacgcugcagaugcaggagccagaggucugggcaggcuugggccugaggugggagcuggcugcagccgguuuggucugcgcuuucugacuuggaggguuggccgcguuuaagccaaguggagacaagcugcugccaccuagugaccggugguugcaggggcgcuucggcaaggugggcuguggaccuccccaugacuguguauggaggcauuugacauucucaauucucucucaaccucccccaccccaccccagguucuucagucugccaaggaacaaauuaaauggucguuauugaaaugaaggcuguggauucaaggcucccugccccccagaucauuuccccaauccuggcaaaagcccaaagaucccagggucaggagagaccccucuguauccccaggucccucccagaacugacuccuaaggucuccagccagggcuucugagaugcaaagguuuggccucaggagagucaccuuuucucacggcccuggccuuaacucauaucuuaggcauuccuggccccagggcccuaauaaaccugcuuuugucuucugccaagg

SEQ ID NO: 16797 - RNA, 11663 nt, Homo sapiens
ccuuggcagaagacaaaagcagguuuauuagggcccuggggccaggaaugccuaagauaugaguuaaggccagggccgugagaaaaggugacucuccugaggccaaaccuuugcaucucagaagcccuggcuggagaccuuaggagucaguucugggagggaccuggggauacagaggggucucuccugacccugggaucuuugggcuuuugccaggauuggggaaaugaucuggggggcagggagccuugaauccacagccuucauuucaauaacgaccauuuaauuuguuccuuggcagacugaagaaccugggguggggugggggagguugagagagaauugagaaugucaaaugccuccauacacagucauggggagguccacagcccaccuugccgaagcgccccugcaaccaccggucacuagguggcagcagcuugucuccacuuggcuuaaacgcggccaacccuccaagucagaaagcgcagaccaaaccggcugcagccagcucccaccucaggcccaagccugcccagaccucuggcuccugcaucugcagcguggguguggcagcagccugucuccccgcugucaugccaugagaguucccgcccacagugccacguccaggcggagacggggcccaggccugacacucccugugcucagacgccucagcaaaccccuagcucuggccauggcuggcaauguguccucaacaccccaccgcaacccacugcugauguggcauagcuggcaaaggguggccagccagacccugcggugggaugccugguggaaagucucagcccagugcuuacacaaauccauauaagugcacacgugcaugcacaauaccaaagcaggagagggggacaggacucaggugugucccucagauugucccuccagccacucagccuuauuccccucuagagaaggagggaacgcugugucuccuccuccugcacagucucccuccucucuuggggacaguggcuuaggguuccccugauucuccuagccagaaucuaacuuuguccucauuuuaucccccauuggcuaccuguagcuuccuuuguuuuuacucaagaauuccaucaaaaaugcuauguuuucauucuuucucccuuuggagaaauacugaugguuauucagcauguguuaacuggcuuggagcccuacuaagagcuugucacgcauuggcucauugaauucucauaacuccaugaagaggguccuguuauuaugugaggcccagagagguugaguaacuugcccuaggucacccagcuuuaggugguaagguagaacacguacccugggaugacucccaugagcaccuguguucuuaucugcucugcuuauuacucccuacccucuuuccacucuaaaaauugccuugcagcugcauucauuccagcaugguaugaggaaacauggggaaucagaggggagggcgaagcagagugagcgcuaagggcagugcaggaaaaugggcgccacaccugggacuccacacgagacagcacaggcucaucucgguagggccaccacagcacgaggaguuagcgccagggcgggaaguuccauacaagcaggauuagucugagcagagagaccugcagguggacagaagagaggucaagacagucguccugaacuagcaggaaguuugugcagcuggggaacugaucaggcuucagagccaggaaccucccccuggccuuacgcucugcaagcaccuccagauaagaccaugcaggguuguggcagguucuuccauagccaggucacucagggguaaggugacaagugaugaguggggaaagucagauccuaucauggguuugagagucccuuaacaaucccagugugcacccuaaguggcaaggacagggguuaagagccaaacuccuauuugguacccuuuccagguuucgguagagggcgcaucagaggccugaguucccagauuuuuggggugcacaagugacccagccaucuccaagguaggcagcucauccuaguuucaauccaacuaaaccaagccaggagaugaggugggcugaugguaacaugcccauccauccauuaguacccagcuccccugaguuggagagcccggaggccuccagugagucuuuccaagauaugaccugucacugccucaucccuucccuucucaccccugauuuuucagacuugauaacuucacugggucccccuaggaugcucuaggaugcucugcuccccguaucucucuagaccauuucuagccaaggcagaugcaggggggccuaccugggccacacucuguucagucaagccgccaucaucugccuguaaggaagcagagucaaggggugggguagggccagcaugaggguccugggucagggaggugaaggaaaggggcuuggggguaugggugagguggugcagugguuagggugauucagagcugcaccugugucacugguuaauagaaguccugcagccugucauuuggaagccaggaccucugggauugugcuauggugcguggagggugagggaagaugggaagaaagaugggaagaaagguuucauccagacaugagaaagccaaacaaggcagggagguucuauccauaccccugacccccaaccucaaggccaaggcagccaccuagugccucuuugaagauguauuuauuuccccagucuauacuuccuaccaggaaagaggugagguacuugugcuccuagccggggagaggacaggaagauuucuuccauuaacuggcaucccacccagaaacugcugcucaucucaccccuaacaagugugucagcccagugguuggcuucugcuagaggagcuugggcuucuaccaucuaggcccuagcagcccuauucccagggaggacaggaagggcagccuaaaagaggagguguccaggaagacucuuacccuaaaauucaccuucuggaucacuugcugggggucacucuccagaaucacacuacaagaugagaggaaaaaccaggaggcaaaucaguggcacaauccuccccuccgccccuucuccuugccaagccucuucccucuccgaaggcauccugcaacaucuccaccuuccaggucccuucccacugauagcccucaagucagaacucucccucagcauggagagcccucagcucugauucuuugaugcuucaacccagugguccacaugcuuugucaucccugggcaaaaucuuugaaacuggauaagaacagucuggucuaggaugaucagguugucaaaagcagggacucucaaaacucagagcucuugaaaguucacuucacuuucuggguauaggauuggauucccugugaaaagaguuaggaagagaggcccuggggguucuuaucuuguugcacuguuauuuuauggcauggggucaugcccugcauaaaagaaaugaaacuccaaaaaucagcaucuaccuucuccccuacuuccucccuuuuuuuuuuuuuuuaaggcugggcacgguggcucaugccuguaaucccagcacuuugggaggccgaggcggguggaucaccugaggucaggaguuccagaccagccuggccaacauggcgaaacccugucucuaguaaaaguacaaaaaucagccaggcaugguggcacacauuguaauuccagcuaauugggagggugaggcaggagaaucgcuucaacccgggaggcagagguugcagugagccaagauugcgccacugcacuccagccugggcaucacagugagacucugucuaaaaaaaaaaaauuuuuuuuuuaaaucuucccuuuuaggccaggcacaguggcucacgccugcaauccuagcacuuugggaggcuaaggugggaggaucacaaggugaagaguucgagaccagccuggccaauauggugaaaccccgucuuuacugaaaauacaaaaaaaauuagccgguaaugguggcgcacgccuauaaucccagcuacucgggaggcugaggcaggagaauugcuugaacccaggaggcagagguugcagugagccaagaucacgccacugcacuccagccugggcgacagagugagacuccaucucaaaacacacacacacacacacacacacacacacacacacacacaaagaaacaaacaaaaaaauucccuuuugauagacccaaauauuguagcuuuucucagagagcaggcgcuccuucgugaggccuugggguuauguacaggguacaugggcgugagggccugucacugcggcaggacaaagaugacaggaucugaguguaccuccuuacccacugagacuccuccaaggcagaagcuuuguuucucuuuguuacuaaaucacuggaaaugacaaacauuucuugggagccucuuccaguccccauccuugggcugagcacccccugucccaagcucccuaaccagggguccuguaauccauaaagaaagagcaucccaggccaaggcuccaguuuaggcguugccucccgacuggcgcuuccccaguuuuucuuggcaggaaacugaguuccucagaggcagagacgggaagcuugugaagcuuacaccucaggcauccuccuuugcacagccauccagagcccugcaucuuguuuugcauuuauaguuuuguguguguuuguguaaaguuuuccuucaagaggguucaccaaauuguauaugcuucuggcuccccaaaaccuggcguuaccccacucccuuuugggucccagaaaucugcaggaggcauuccuuagugccccaggcaguccaguacagugccauagaaacagcauggccucuggaacuauucacaugguuuuagaucuuggcccugccacucccuagcugugugagagaccuccggcgugucacuugaaacuuugagccuguuuccuaauguauaaaaugauguaaugauagagggauguauguuuuuaaggagcucaagaaauuucuauuggccggggaugguggcucacaccuguaaucccagcacuuugggaggcugaggugggcggaucacgaggucaggagaucgagaccauccuggcuaacauggugaaaccccgucucuacuaaaaauacaaaaaauuagcuuggugugguggugggugccuguagucccagcuacucaggaggcugaagcaggagaauggugugaacccgggagguggagcuugcagugagccgagaucacgccacuuacugcacaccagccugggugacagagcgagacucugucucaaaaaaaaaaaaaaaagaaauuuuuauuauccuuugccccagagccagaacuucuuuuucucucugaauauugauccccugauggaaauucacaagccaacuuuucucaaaagagcuccuagcuuccuaagaauauacuagcauaccaauaggaggcaacaucuauugaaugagaaccacaagcuucacauguaucuucucacacauguauuuaauccccacaaucccuuauuaccuccauccuaaagauggagaaaguaagccucggggagggucaguaauugacccaggucacgcaucuagcuuguguuggaauugagcccuaagagcaggacauguggggcuggugggacugucugaaguccuuccagagagggccagcaucugugccagugcuuccccugggcauuggagaccaaacuggauuuuccccaaacccugccuauucaacagucucccauaguuugacaucagguuagucucuuguuuggcuugacuuuggcuaacauugaaaucaacuucuaucuucaugaguggggcgcuaguaaggggaagggcuaggggaaugggaucccugggaauaugcugggggaagggagugagaaguuggucagaguucuagccaugcugggugccaucuggggcugaugauuaucaaaggcacuccugcugugagugucccugacuguccccuccucacccgccauccacaaucucguccagcaccaagaaggcuccguccauguucuccagcaaccagcgcuucuccacguucuuccugaagguggacacaagcuccugagccucccuguggcugggaggaacugagucccugccuaggugaggcugaccccacucuccaaagacugccucauucaccccucaccaaacaaggacugggaaggagaaugugaagggcagugagcacagagcccaugcaaggcauuucugagcaaagggcaguucugcuuccuuacacccuaccuuguccaaccucccauacuuugggccuugacacccuggcacccaccacaggaccccagaugcguuucacaacuagguuagaugcuauagcacagcccuacuuucguucauugugucgacugugaacuuuucuuuuuggauuaucuuagucuuguggggacuucaggagaaaaacagggaggaaggguccugugacauaucagggccagggggauggggccucggagggcagagaaccucacucaccuuaacaugugguucagagacucaaacaggcaggugagaacagacaugagcaucagcugggaugggcagauacgggaggaggaaaaggagaguuugagauugagaaggucaaaagaagcacuuggagcccaccugugcgggcagcaauggagaguuucagaggccugggcuggagacugacugcggugugacauuagagggaacuuccaugugucugggcugggaaacuggaguucuccacugggagacauugaguguauccuucucuaguuauguuuaagaaggacaaagccucccuugaagaugaagugauuacuucauuccugguucccaaggaaacuaaggggcaucgaagauacacauugucccagaaagaacccuucuggcugcccuccucuaccccauggagccuaaaagaagggguccaauggugagccuccaggucccagccucaagcccagauuccaaauaacaacauuuccccauagacagacccuucuuacugccccaaccuccugaauucaccucauucucguaggaugagcccaccacguauaggaagaggucaaugcuguucuuguagacgauggucauacccccaaaaaaugcaaucucaccuagaaguggagggagcuuucaguccuggccaccuugccugguccuagccuagccccuccuccucauguaugacucugugacucuccuauuuccuucuccccuuucuggagaacccuuggaaagaccagcacuagggacacuaccaucaggcagccccguguccuuccccuuaucugcuacucuauuucuagggacugccucaggccaaggagucaacaagcccaguuguugacccguuuaccuccugcccacgcucccacccugugcagcaccuugggaccagauccagguugggaccacaacacaguuggccuccucagcuagagagaggccuggggaugcugggggguuggguaguugggggaacuggagagugacagggaguggagguucccuggaggaagggaguggagaacagcagggaaggagaggacaaaaagccucugaagaaagggaaauggccugugggugugcaaggcugauggggacagauguguccagauggagaagaugacagugugcaucugauagucugcuggaggaagagggggacacuuacucucaguccggcuggucuuguugaagacauuuuucucgaaaaccaucugcuccuucauggaggggaaugugucaucauaauacuaugagaaagggaaggagaaaggaccauagcuuuccacacagccuggauccucccuagauuggggggcaggaaagaguaggcgcugggcaagcgggauccugcuucccugccccaucucuccauuacugcacccuaggccugcaggcucauuacuuccuccaaaacaaauuauucuuuuuuagauggaguuuugcucuuacugcacaggcuggagugcaguggcacgaucucggcucaccacaaccuccaccucccggguucaagcaauucuccugccucagccuccugaguagcugggauuacaggcaugcgccaccacgcccagcuaauuuuguauuuuuaguagacaggguuucuccauguuggucaggcuggucucgaacucccgaccucaggugaucugcccaccuuggccucccaaagugcugggauuacaggcaugagccacugugcuuggcccccuccaaaacaaauucugagcaaagaaagucccaaaaaguagagggauauugaggccugcuuuuggaguccccuccugguuucuuggaggaucuuguacauucagcagaugugcagggugcuaaggauuggcauggucacgagggcacacuaauucuacagcacccugagucucuacaggaaagacggcaaaaccaggaguccuucuuaaacaauaauaaugauaauaacaacagcuacuuuauuauccccauuacacggauggggaaaccgaggcaucaagaagucagguaauggccuggcaugguggcucaugccuguaaucucagcacuuugggaggccgaggcggguggaucaccugaggucaggcguuccagaccagcuuugccaacauggugaaaccccaucucuacuaauuauacaaaauaaauuagcugggcaugguggcgggugccuguaaucccagcuacuugggagggugaggcaggagaaucgcuugaacccgggaggcggagguugcagugagcugagaucgcgccacugaacuucagcgugggcagcagagggagacuccgucucaaaaaaaaaagaagucagguaacuuccccaacaucucacaguugugaggccaaagcuggguuugaccacuaaggacggucugacugcagacaggguuauagugaagauuaaauaucuaagaaacaauuccucacacauaucccauaacuaaauuaauguuuuuuguuugggaauggugagccucucucucugacucaguuucuuaaucuguagggaggaaaagccuuuggccuugcugauccaccucugaccaucugcuggggcaagguguggucagcucaguuuucaauuuucuggauguggauuuugccacuuaauacucaauccgcaggcagauuagccaucucccuaguggccgcugcuuauuugaauuucauaaaaacaaaaaacuuucaguuccaaauaaacaaacagaaaaucuauuuuuugggauggggucucacucuauaacccagauuggagugcaguagcucgaucauggcucacugcagccucaaccucucgggcucaggcaauccucccacuucagccucccgaguaggugggacuacaggcacacaccaccacgcccggcuaauuuucguuuuuuuguuuuuuguuuuuguuuuguuuuguuuuuuguagagauggggugugccauguugcccaggcuggucuggcacuccugggcucaagcaguccacccgccucggccucccaaaguacugggauuacaggcaucagccacugcgccuggccuuacaacacauuucuuuucuuuuucuuuucuuuuuuuuuuuuuuuuugagacagaguuucgcucuuguugcccaggcuggagugcaauggugugaucucggcucacugcaaccucugccucccagguucaagcaauucuccugccucagccucucgaguagcugggauuacaggcgcccaccaccaugccuggcuaauucuuuguauuuuuaguagagacaggguuucaccauguuguccaggcugguuucgaacuccugaccucaagugaucugcccgccuuggccucccaaagugcugggauuacaggcaugagccaucacaccuggccuuauaaugcauuucauagcuaaugcagaugcuauagcuccccuacaauuaauuguguugacagcagaaauuuauuuuuggauuauuuuaguuugguucgcucaggccauguuugcuaggauagauaacagcuaauugaauggggguacagugaaaaccaccuugagcuucaugucaaaaaacccgaguuugccugugaaaccugugaaaugggagaagugaaaaaauuaaauaaguaaauaaauaaaauuugaguuuggaucuguuaggauauuaauacuugugaccucaggcaacucacuuagcuucucuaccccucauuuucuucaucuacgaaauuaaagaguuggauuauacaguuucuaaaaucccaucugguucuaaauccuuagacuccuuagacuaaaucguuaguguuuaccaagcuguagaacaaaaguggagguuuagagacaaaccccaaagaacaaaagaacuuguguggggguuuggggacuaagacuccugggucccaggcucaacacuccacugacccauuaggcagaaccuucccaugcccagguccaacuggccaguagcaggaugauaaggaaacauuucagggaacaugaguagaaauagaggagaccccucauuucagggagcagcaccuugacaaggcaggaggaugagaaggaccucuggaggggucuaagcugagcugcccugagucacagagaucacaguggaguuucuccugagacaggagugucagcugagugggaacugugucccucauggguggggucagagguuaccuuggccagcagccggcgcccgucauuaucuaggaugaaaacagccuugaugguguagagggaagguuccugcaacugacaccggagaggagaguuccguuuggccccugacucgagguggacacccugugucuaugggaucugcuggcccuaggauacauccucaggccccagcaaccccaguccucaagguccacagcugguucugcccagcccugugccacaugggccaacccaggugcccacuccacucccaggcagauguuccacugcaggccccgagugggcgcugugcccguugggugcagaagguccuuccgggcccaaguucugucaugcacugacugcuccagagcccgagucggaguguaucacagaaccugggccgggggggacagcgggccgagccuccuucuuccagcugaucccuggccgggcuggaccugcgcuaucagcgcgcccccaggcccuggcccggguagacuccagaagcaugcccaucacccaccggugaugggagccgagucugggacggacaggccacuccuuacccuccccgcggaaucgcaacucacccgccacccccacuccaaacggacccagaacuucagccccgcgccgacggacucaggacaggccuccucuccggucggcgcugggacgaacuuuuccucccggguccuggggccagucaggggugacacaaaguucccagccgccgggcgcgcgaguucugaguuggcugcucccccuaacccugcucugucccugcccagcucccgccgcccgggauccccgcgcccgcccgcuccguacccgcagccccgagggcuccccggcucgagcaggcggcgccggcccccggccugccgccgcggcccccucccccgggugcggacguggccagccucgggccgcugcauuccgcucgccgccucgcacugacagcgccgcccgccgccugcccgccgccgccg

SEQ ID NO: 16798 - RNA, 11175 nt, Homo sapiens
guacggaaggcggcgacguggccgaaggaugcccguuugugucuaaacggaggcucggccacaacgccacuggauuggugguagggcggggcgggccacagucuccagccugaagcggaaguggaggaaagauggagguguggggacaggagcugggugugcuggggacuggccgcggaccccuaaccugugucuccggucucccuccggaagcggcucaacccagcccaucgcucuggccccguucuggcccugcaggguggugguugggacguugaaaugagcgcgcgagugguacguccucucuccgcgcucacgccccccuccucaccguguuucccgccaggaccaucagcacgugcccaucgacauccagaccagcaagcugcucgguaggagggggcgccaccgcgcagcuggcugucggggggaggccugugcguugcccccuguguccaauagccgggagcucugaccccugaaagccugagucgagaugcugaccacuggccucguucuaugccccaucuguggccagaccugcuucccugauagcagcgggaacgaaccauauguacagucuguuugaccugcguuuucuccuuuaauaacauauguuaucguaucauucagggacaggauaaaugacucgcuuuaaaaacagucaaccacugccgggcgcgguggcucaugccuguaaucccagcacuuugggaggccgaggugggcgaaucaccugaggucaggaguucgagaccagccugaccaacauggagaaaccuugucuccaugucuccaugacuaaaaauacaaaaaaauaaaaauaaaaaguagccgggcaugggagcacaugccuguaaucccagcuacucgggaggcugaggugggagaauugcuugaaccccggaggcagagguugcggugagcagagaucucacuauugcacuccagccugggcaacgagagcgaaacuccaucucaaaaagaagacaaaaaacagucaaccacuaaguggcacaucugaauuggaacuuaagucugucugacccacuguccaugccuuuugcauuaugccaggaaaaaaaaaaaaaaccucauuuaaaaagcuuccaccucccccuugauuuuaggaggaagagggaccuaagacccaguugcaaaugaaaaccuuuuaguguccaggccaucuccagguugucuguauggggcuuacauacuuccuccccaguucauagucagggaaggccucuucaucugaucacacagcuccuggcauuuuaaaaugcuuauuggauucauggauuugaugccaaucuuguccuuaagauggugucuguuugacuaccccaguccguugcuucuaguucugugacaucaacagaauuuuucuuucugaaaacuuuacaggaauauagcagagagaguauaacugauacuagugugggaccccagcguuugaccgguuggcagaguucaaguucugaauucaccacucuguagugccauuuagucaguccugcuugguggucacgggggaagcuucuuuagccucccuucagauuuguacuggcccuucagcccaugugcagucuuggugugugagcuuguucuuggucaugaaaaggaccaauaaaaugaccaccauucauugaggguuuuuuuuuguaccaggugcuguuuuaggcacuugacaugauaaaaaugaucacugucauuuuuugaguccuugccgugucucaggcacacuguucaguguuuuaccugcauucccuuuucuagucagugucuuauuauuccccauuuuacaugugggaaaacugaggcacagaauaguagacuugcucaagaaacuugauaacgagaacccaggaccaucugaccacaaagcucagcucuuagcucucacugaggaaauaugcauggcucugaagccacaaaucugggcccagacuuugagaggucagucccauugguauucacauguacagggugguacuucacuguucacaacagagucauguuaucuaguccuuagggcgcuguagguauuaggggcuuugcagcuguucauucauccaguacuuggcauaaccaucuuguauuuuccauugucaugguuaaccccagcccugaggaaauggaaguugagcagcauccucuugucaggaagaaagauauaauuacccauagaagcaaaaauauuauggggaauugagaauggucaaaaguggcacuuucaggaccaauuuaaacuuuuuguuaucccuguguugaggcaauugcucuauaaaaaucacacugcuaaugaagucagauugucagagccugguuuagccccaggcaucucuuugggcuugucuuuauucccaucuucccaugacccccauacuuuaaccaauguaaagaaaacuuuuagacuaauuucaguguauuucacucgaauuagugauggaauuuuggugaugugaaugggaaugcucuaauuugggugcuucucauguagauuggcugguggacagaaggcacugcagccugaaauggcagagucuggugcugacgauccgcgagaagaucaaugcugccauccaggacaugccagagagcgaagagaucgcccagcugcugucuggguccugugagugcuuaggggcugucacuggaguccccucuuugcugagguaguauguaucagcugagcuacucucuuguuauuuagccaccagggcuggccuuuagagagggagcgauuuuuauuugagguauagaugcuggcuucuuccacuaugaaaugauuuagggaaaagcuacacacuaaaguuacuggcaguauauuauacaugaaucagccaccugcagugcccagaguaggugaagaagauacuuuaguucucgaaaucccgucucuugcuuucuagacauucacuacuuucacugccuaagaauccuggaccuucucaaaggcacagaggccuccacgaagaauauuuuuggccgauacucuucacagcggaugaaggcaagugugggccaagggccgguaguaugugguuggggacauccaauccgaggagucauagccucuguggucucucugaggcuccaguggggaugccuacauagaauauuuccugaacuuucacucugucucuauaguuuacuccaaaaguggauccuaucccugaguuuaauuuucaaacccacugcuuuagggauugccugcacucuuaaagugggugguccagccagcagaguugaaagaaggacaaggaguuuguguuugaugugauguaaaggcugggagaacuuacccuguuuagggauugagcugggauguggcugucgagugcuuuucuggcuuaacauuguuuuucuguucuuacucaggauuggcaggagauuauagcucuguaugagaaggacaacaccuacuuagguaaaguggcccggccugggagcccugguauccauggggaagcccacucucagaguucugagauaccaggcuuauaggaggcacagucugugagugggaagagacuggaguguagauguugcccauuuguaggugguaaaaucaauuguuuuugauggaauugauuuucccugaguggagugcugggggaaggaggagguccaggccgguaguggccauucgccgugccucagcgagcagguguguguggguccuccaccacucaccucuugguuagcgggagugugcugcccccacccccacccccgcacccccauucuacacaaggcagaagaggcacggguuuuucugggagcgaauaucaagugccugagagcaacuacaggacuaacuguguuuggguuggguguaguauaaauaauaauaauggcuaauauuuccugagcaucuacuaaaugcaaggaauugugcuuggugugucauguggauucucucuugcaucuucaugauaaauguuauugucgcuguuuuaccgaugaggguuggauuagagggguuaaacaacuugucuuaggcuccacagcugggaacaaguggggcugggaagcugacuucgugcucuucaccaccacaaaggaugugugugcauccuggggcaugccugccucauguggggguguccugggcugaauuuccugggcacuucucaguggaacucucuagccuccugguucggaaugucaacuaugagauccccucacugaagaagcagauugccaagugccagcagcugcagcaagaauacagccgcaaggaggaggagugccaggcaggggcugccgagaugcgggagcaguucuaccacuccugcaagcaguauggcaucacggugagcggcggcagccucuucgcagccagaggacaccugggccccugcuugucuuccucugaccccgucugaccccucagccugguugcacccccuuugggccagugucuuacuuuucuucggucuuuggauguuuucuucaaucuguuggacuccaccucuucuccccucucuagggcgaaaauguccgaggagaacugcuggcccuggugaaggaccugccgagucagcuggcugagauuggggcagcggcucagcagucccugggggaagccauugacguguaccaggcgucugugggguuugugugugagagguagagaggccucagcuucuccuggugggggugcuuugccuguguuccccagcucaugacccuucuccaguugucuuguucccauauaacauuugaacucuuuacacaccugaaccugugggggccuugcccauuugaccauguggcccaggccaaagcccaguguuggccuuacgcauggucggcaggagagucaguugugugcucuguugaagccccacagagcagguguugccaaugcugcgguucgugcagaagcggggaaacucaacgguguacgaguggaggacagggacagagcccucugugguggaacgaccccaccucgaggagcuuccugagcagguggcagaagaugcgguaagaugggccuugugaugagcuguaggaguggagugggagcugcuuguccccuccccacccccaacagcccaacccaagacccagagagaagaagggaggauuucugugagagugacuguagguagaagggcccaggaggcccuacuccuuuauuuuucugaguauaggugagugagugccacagaggcuuugcaaggugguucgcuuugaacucggaaccuccaucaugugagcucucugaagaugggcuuucuuugggguagcuuagaggccacugcauuugaacagugugcucucuacagaagcagcugaggccugugggaaggcagccccacccuccuuuuuaaauuaauuuauuuuugagacugggccuugcucuguugcccaggcuggagugcaguggcaugauccuugcugacugcaaccucugccucucagccucaagcgauccucccaagucagccuccaagauagcugggauuacagguuugcaccaccacuccuagcuaauuuuuuauuaacaucuuuguagggacaggauuuugccauauugcccaggcuggucucaaacuccugggcucaagcaauccacuauccucggccucccaaaguacugggguuacagacaugagccaccaugcccggcccuuuuuaaauccaucuuccaugagcuaacacucucuuucccuuuccagauugacuggggcgacuuugggguagaggcagugucugaggggacugacucuggcaucucugccgaggcugcuggaaucgacuggggcaucuucccggaaucagauucaaaggugaggaggccuucucagucugucucucucugaucacuacucuaaccauaagaaaagugucauuugugucuguaacggcaucacuugaaguucauagcucuaagaccagguauaguccaagggaggcagaguuucacacgucacaugucagaguuuuguuuuguuuuuugagacagagucucauucugucgcccaggcuggagugcaguggugcaaucucggcucacugcaacuuccgccucccagguucaagugauucuccugccucagccucccaaguagcugugauuauaggcgcccaccaccacaccccucuaauuuuuuauuuuguuuguuuguuuguugagacagagucucacucugucgcccaggcuggagugcaguggcaucaucuuggcucacugcaaccucugccucccggguucacgccauucuccugccucagccuccugaguagcugggacuacaggcgcccgccaccacgcccggcuaauuguuuuguauuuuuaguagagaugggguuucaccauguuagccagauggucucgaucuccugaccucgugauccgcccgccucagccucccaaagugcugggauuacaggcgugagccaccgcgcccggcuaauuuuuguauuuuuaauagagacaggguuucgccguguuggccaugcugguaacuccugaccucaggugauccaccugccucggccuccugaggugcugggauuacaagcgugagccacugcgcccagcccaugugagaguuaaauuuugauguccuuuuucuugguguuugguacaggguguagggguaaaggcaggugggaacacuacagagcagggaugaugggccauacugccauuuuuggcaccuaagucagggcugcaaauccuuaauagaguuggaaugugcagccauugaccucaucaagggcuuugguuuauucuggcuccuuggcucaggaaaauucuccccccauugcugugguucuuugcucuccuuccaggauccuggaggugaugggauagacuggggagacgaugcuguugcuuugcagaucacagugcuggaagcaggaacccaggguaagugcaccauccccugcagcccuggcaaaaguggggugcucaagggcccccacgugucuagaaacaaaaaaugcagcgcuaagaugaggcuucuugcacauuuaacuguuucucaaaaccuugaugaggaugugagcugagggggaccaagagagguuuuuuuuuuuuuuuuggagacggaguuucgcucuuguugcccaggcuggagugcaauggcaugaucucagcucgcugcaaccuccaccuccuggguucaagcuauucuccugccucagccucccgaguagcugggauuacaggcaugcaccaccacgcacagcuaauuuuauauuuuuuuaguagaguugggguuucuccauguuggucaggcuggucucgaacucuugaccucaggugauccaccugccucggccucccaaaugcugggauuauaggugugagccaccgugccuggcccaagagagguucuuaaaaguugagaguuuagaaacucucaacuuuuuagagaccacaugugggccagcuguuaugguaggagggcucuagggggaucggggcccuggagugugacaugacccccgccccaacagcagagaagacguaguggugucugagccacuagagggcggugcaggaugaaacuuuaccuccugcgguccaccagagcagagagccggccuuucuaccccucugaacccagcucugguccuccucucagucugggaguuggaaagugguaccugauuagagcugagacaccugggacaagguagccuucccccuuggauuagaacaagaaguggcuuuagcacagugagucuguccguauuaauccuccagggcuucucacacuugagggucuuuuccuucuccaguccucugauccuuuaucacuucucugucucuuccuggcagcuccagaagguguugccaggggcccagaugcccugacacugcuugaauacacugagacccggaaucaguuccuugaugagcucauggagguacugucaucucuggaagaugcaggggggaggcauggcaccagcacagguggcuucacuccagaugccugaccugaccccuccuguuugugugaagggugugagugcuauuuguguccuacagcaggagccucacguauuagaugccuccuauucauccaguuacuuaucagguaccuccuaggcaccuggcacuaccuuaggcaccagaacuuggguggugaauaagacagucaaaguccuugaccucauggagcuuauauucuaauggggaaugcagacuggaaagaagauaaauaaauaaaauaugcaggaugcuagauggcaccaaaugccacggagaaagagaaaguaggggaggaugacgaggauguuggaaagggcuaugguuuuguaucugguggucagggaaggccucauugagaaggugaccuguaaucaagacugcaggcggugcagagagaaccaugcagaugucuggcagaagggcuucccaggcagagagagcaagugcagaggucccgaggugggagcagaccuugcacaguugaccagcaacauggaggcugguguggcugaggagagagagcugguggggaguagaagagcucagagauguagcgucugaaccuugguuugccucugagugaacugggaagcuguuggagguuucgagcagguuaggaacaugaucucauuuguguuuaaggacgaucccuguggcuaagguguugagcagcccagcguaaggagccagcguucuuggaccuuuguuguaaggcugggaggacgggguccugucuuuguuaaucucuguaucugcucccuucccaguagccugcugguucggagagccuccugaaaguucuguccucacccaguucucuccucuuucugcccagaggcuccucccagccucaaggggagaggacaaaagauaucugugaaguuuuaacggcagaauaggauugauaaguuaauauggcuggcucuuguauucuuuucagccuugccuuaauccagugcuucucaaacauguauuucuguucccugaaucucauuccucccauggagacaaaauaaauaccuucccugggcagagagaacccuuugagucucuguauucucaguuaucugaucccaggcuggggagaaaggacagaggucugggguuaggaugagauaggagguggggacugaagggugacaguagucucuccuagcgcuuacaguguucagaggaaacuccuuacccagagucuagcccucaugucucauuuuugcauuucgaguaguccgagggcuuagauucugaguucuucucucaguuugaaccaauuuaucuucuuuuuuucuuucuuccuuuuuuuuuaaaaagaguuucucugucgcccagucuggagugcagugcagcaaucauagcucacuauaaccucaaacuccugggcucaagugauccucccgccucagccuccugaguagcugggacuacaggcauacaccaccauguuuggcuaauuuuaaacauuucuguagagacagggucucaucguuucccaggcuggucuugaacuccuggccucaagcgauccuccugccuuggccucccacagugcuggaauugcaagugugagccaucauguacagccugaaccaaucuuucuucuguccucagcuugagaucuucuuagcccagagagcaguggaguugagugaggaggcagauguccugucugugagccaguuccagcuggcuccagccauccugcagggccagaccaaagagaagaugguuaccauggugucagugcuggaggaucugauuggcaagcuuaccagucuucagcugcaacaccuguuuaugauccuggccucaccaaggucuggcuuccccuugaugcaaggcucugccaucuugagcagcucugccuccuuguauuccuccucuuguuccaugaccccuuaaaccccaucccugccuccuggccauugccauccacuggggauagggguucucuuugggacaagagggggagguuucacauauacaggaagaaucugcuugcuuccugaguaggacaggggaacugggaguggguuuuccuuaaaaggaaaggguuuaaggaugugaggguaagcggccaguuggggguuugguuucccgagccucucaccuccccagcagcugaaugggaaugcucaggaugcacagcuaacccagcacucaccugagugccccgcacagguauguggaccgagugacugaauuccuccagcaaaagcugaagcagucccagcugcuggcuuugaagaaagagcugauggugcagaagcagcaggaggcacuugaggagcaggcggcucuggagccuaagcuggaccugcuacuggagaagaccaaggagcugcagaagcuggugagaugggaaagggaggccugccagugggaggacucccagucugugcaaaaugaggcccugagcaccccugcuucugcccacuugguaucacucuuucagauugaagcugacaucuccaagagguacagcgggcgcccugugaaccugaugggaaccucucugugacacccuccguguucuugccugcccaucuucuccgcuuuugggaugaagaugauagccagggcuguuguuuuggggcccuucaaggcaaaagaccaggcugacuggaagauggaaagccacaggaaggaagcggcaccugauggugaucuuggcacucuccauguucucuacaagaagcuguggugauuggcccuguggucuaucaggcgaaaaccacagauucuccuucuaguuaguauagcggacuuaauaaaagaggaaaaaacucuugcuucaguacugacaguuccuuaugcugcuucucugagccugcaguugaggcuucgcaccuguuuucgugggguucuugauccaggugggcucccugauccaggugggcuccccaggccaucagcugucacuguggagccccaaguugaggacuuuuccccuuugcuucuggugauaaagaggaccccacaucuacaaaugguucaguaaggggcucugggauggcuacgugugggccccuuuccauaaccaggcccaggccgcccgacucaggccagaagcccugggggagcggucaagcagcagccuuguuggagccagcaaagcugcauuuuccuuuuaaucacagcuuaccuccaggcagagggaaaaugcgguuuggggaggaagggucugauaaacaagguggagacaggag

SEQ ID NO: 16799 - RNA, 7800 nt, Homo sapiens
guugaacaucaauaaagugcacggcugauaggcuuuuauuacagacugggggcgguaacggcuggacagagaacggaaaaggaacaucugagaccaggcucaaagcuaggggguuacacaaccuccaauaacacaaggugagugcagcacuucuagacacacacacagacacacaucacuuacucauaaacggcacagccuacgguacaagaaaaagggcaagguagguaagggcacccaacacccuccugccugcagggggccacaggguuaaugugccuuccugcacgcaggcuuaagagggauaaacaaggagagggcugcccuuggagaaggccugcggauaauagugacugaggcacagguccaugcaggggaaggaagcacaguucacagaguggcaagcucagugccagccagugcaagcaacaggcaguucuuugauccuggcuuagucacagcaaacauuuacccagccuggcucuucuccauagccagcagguugcuugcucauccagucugucccugguuagcgggcaugugcucaaggagaacaaacacaguucagcacaggacucagcugagggucacuaaaggaucauagacugugagggugggaggucuugguuuagagguugagucuagugcagcugaucaccuggggucuagugaaaaugcagggucagauucagugggucuggggucugaaucucuaaggcgcugccaagugaugcugaugcuccuggcuuguggaccacccuguguauagcaaagcucuagacuaggaggucucaaccuuggcugcacagaauuaucuggggaguuuuuaaauuucccagugcccaggcugcauucauaucauaguagagacaggguuuugccaugcuggccaggcugguucaaucaucucugagggugggacccaggcaucaggguuuuuuaagcuccccagguaauuccagugugggggaaaaaccaaugaacuaggaauuaucagcagagguggggaguaagaaaagcagauacgugaguagucugaaaaacauaaucucuauaaucauuuaauuuuucuuuuuggaaaauguauguauacauacacacaguuuccauaaaaaaacauagauaguaaagcugauuaaaaucuuccuguccuauugguaccagcacaugaagcccuucuacaaaauuccugacggacugggaauaaaaauuccuagugacagcccacuccuucucaggcaggugugauuguuugaaaucucucccaauauugagaugaaaccugcuucccuguaacuucccuguaauucugugggucccuuguagccacagagaaggcagcaaucaguaggggaagugcuauaaaaauauacuaucccggccaagcgugguggcucaugucuguaaucccagcacuuugggaggccaaggcgggcagaucacuuuaggucaggaguuggagaccagccuggccaacauaaugaaaccccgucucgcugggugugguggcucaugccuguaaucccagcacuuugggaggcugagguggguggaucacaaggucaagagauggagacaauccuggccaacauggugaaaccccaucucuacuaaaaauacaaaaauuaguugggugugguggcgugugccuguagucccagcuacuugggaggcugaggcaggagaauugcuugaaccugggaggcagagguugcagugagccaagaucacaccacugcacuccagccugggugacagagugagacuccaucucaaaaaaaaaaaagaaaagaaaaaagaaaaaaagaaaaaaaaaaguccuauccguaaaugaguuaguuaaguuguaaucaacagaaauagauucuagcuagauuaaguaaaaaaaaaaaaaagagagagagagacuuuacagagauagugggguguuuuaaggcagggggaggaacugcacagcccagaccugggagggagggauccagggaaggagagauccugggaauugcaauagcagcaggcagaggcuuuugguuccuauuguuuccuggcugcuaugaaugacuuggcuuuaaugacucccaagguucuggaucucuccaguucaaauuucaaauuauugacaaaacaaucugauuggccagguuggcucaggugcauaugcuaggacuaagcuuuggccaguaugacucacaugguaacagacagggcugcuggggcccugucugucaccagaaagggagucacaccggcugcuaccccuagagggagcuauccuaaucaaucauaggcaaggucaaaaaaauaauuauggaauuauuuuccauuugugauucucuacgccaccauuacacuccacuugaccagcuaacugagaaccaacugaguacagagaacuuagaggauuagcucugaagaguccugaagauaagggguagggagggaaauggguugaguuuagaaagaagggccugggucccaaucccacacccucucuugacaccuagcccuagcuccacucugggccagcaggucccagaguuaaggugcaagucucucauagagccagucuuccuccccgcggugggucaugggccccaaaggggaaucuccuguggguaggccccgccgaaagacuauccggucaugcaggcgguugguuugaccuugccagaacuccaucaccugaggguacaggacauagccaccccuauaaggagaagcagagguuucagugcucuguggaguuuucuagccaggucacucucccacccucaccccucaucccagggccucuugaaggaaguugcugggaugcaucugacaaggguggccagggaggaggagaucugugauuccccaggcagguggcuucaaguaaacacaggggccuggugucccuuucuagaggacuaccagaugucacucaccaggauuuuggcuugggcaccucuugauccugguagagcuguuccaguuccucauuuuucuuucucagauacuguccagggggaagaguuagaagaagggccaggcccagucaaugauucauuaacaaggacuuccuggggauaugugcuggggacaugggugagcagagcagacuggccucuguccuccaggagcagucaacaggauggccagauggacagaggaggccuauuuccccucucccuacccccacuuucccuucucacuguccuuuucacuguuuucacugggcuggagagagaggacaucuccuggggacaucuccuggcaucuccuggggacagcuucuggggauaagccaaagccuccaccaccuggaggacuacagcggagcuccacucaccucccgaucagggaucacagaacucugguggcugaccacagccccaaucuggcugcucuuggggcgggaguggaaguagcacucagccuccuccucaggcaguuucuucacagggccuuccacacgcaccugcucagggauggcucugggugaauggcauuaaaugccaccugcccucccuaccagcacaggccccguuccucucuguucgaucggcugccccaccacucuuggcuccaacuaacugagggcuauuuuagaggcagagugcccagcugggauguuugcccagucuggggaccuucgcuagacguagccauaaacucaggcccugccaacccagcccaucccaggcuguccugggaaaauucacucaccugacgguuaaguggcucccaguagaagacaagggaagcaaagggauuagaguccuagaaguaaaagagaauccacagccagccaucaggacagggagaggaggccuccggcaugcagggaaaaggcaggagagcuguagugcgcaggcccacagcagaugcacccaccguaagagcucauuuaaacccucaaaaguaggccuauugucacagacacagagacaggcuaagucacgugcccaaguuccugcaggaagugguggagcuaaguuuaagccagucggacuccaaagugagacugggugauuucucucacccacagauuugugagucuugagaaaugcaugcuuggcuggcauggacucagggagguuuacucauuuuggauucauucauugaaugcacgcgaagugcccacucugggucugacaacaggagacgugcgggggauacagcagagauaaaacagagcagccuccacuccuacagagcuuacuguugagcagaggagacaaauaucaguuacauaaucacccaaacaaaugcucaguuacaaacugaagaagaagacaaaaaagaaaguugcaaguuauaauggcagcaaacagcaugaggggcugagucugagugagagucaaggaaggccuuccugaggagguaacaugugggcugagaucugaaggaacaggucauggcugauggggugaggcugguuagaaagugcauucauucauuuauggcaaagagcacagcaagugccaaggccucauggcaggagggcaccugcacacagagagcaaguagacugggggggugggguggcauaagaaggugacugaggaagcaagagccaaacccugcaggcccugggaaagauuacuagcucuuuucacccaccagcucuuuuccuuuucgacucucgaaguuagugaagaagcggaagccaucuuucccgaagcccuucagcagcaacaugcgagcagaggguuuuccaucucuaggagcaaagagcagagcacuguggucagagucugcuucaauguucuggcuauagucccucuccccaaaggaugucucagcacccccuccagcugcacccccuuuauugggcugucaggcuaccccgucccaugugcuccuggggauuuguccuagagguaugacaccacagccuggggcccuguuaugggcugaauugugucaccccaaaccccuauguuaaagccuuaaaccccaaugugacuguauuuggagaaggggaccuuauggagguaauuaagguuaaguaaggucauagggguggggcccuaauccaguaggacuggugucacuguaagagaagagacacuucagaaccaccucccuugcccuccacaacacacacacacacacacacacacacacacacacacgaaaggcagugugaggacaugguaaaaaguagcugucugcaaaccccaagcagaggccucaucagaaaccaccccugauggcaccuugaucuuggacuuccagccaccagaacuauaaggaaauaaacuccuguuguuuaagcuauccagucuacaguauuuuguuaagacagcccuagcaaauucauaagacccuaagggcagggacuaacaauaaugcaaucauccaaugcuucgggaucacaguggugcuaugagaucagccccucugcucagagcucugggagauauccacucgcacaguacaagagcacuggcuacaaggccuuacacuuuaucgaggagaauugaauaacaggcuaauacaagugaugucucaaagggcauaugauugucaaaggaaugauauagucaagcacugugcuagauuucgagagagagacagagcuucaccaggagaaguagcuccugaauggcagacggggcuuggguagauggggagaugagggaggcaagggguuguguguggauguaucaagggcagaaaugaacaaggcacugcauuuuuaucacugaaauguaauuuuguggccuggucuuugguuuauagguaaggacacaggcccagagaggacaaguaucuugccuaaagccacagagcauguuaauaacagagcuggaaccauaaaauuggcauccagaguagagagcuucauaagcuuccuaguucauauguauccacccaaagaggggcccacagccaugcccaccuggugcagguagccagacacauggcauuggcuuccccuaugucaggacacugaacagccuccucaaaccaggcagcaaacuguuucacugggucaagggaggucagaugagucuccucaaaugccuaggaaaggagauuuauuucauuuaauaaacauauauagugcuuacuauggaccuggcacuguucuagucacuuuucaaaaaucaacucauuuaguccucaugacaaugaccuuaaaauaagaaauaguaugcaguaagaagauucugugccccauuuuacaggugaggaaacaggcauaaaaacucagacaacuugcugucccacagcuagugauggauaaaucaggguuacaugucaugggugucaaaacugucugugcaucagaaucaccuggggagcauaaaaaaaacuuucugggcuccacccccaaaauuucucauucagcaggucugaggcuucaucaaaaacugcauuuuuauuuauuuauuuauuuauuuuagacagggucucacucugucaccuaggcuggagugcgguggugugaucucggcuuacugcagucucaacuuccugagcucaagcaauccuccaaccucauccucccaaguagcuggaauuacaggcacgcuccaacaugcucgacuaauuuuaauuuuuuguagagacagggucucacuauguugcccaggcuggaaaaacugcauuuuaaacaagcguuucuagaaaugcccacaugcaaccagauuuggcaaccagggcccuggaccccaauuccuaaaagguucucuugguuccccuccugaggagcgaaaaggaaaagaacuucccaguggucagcagaaaguacugaaggcaguaagcuaagagcuuucuccuccccuccuccccgagcuaguccccuucccccauauuccacuuacuuuuuugucaaacaguuuguaagcuguuugucacuguacccaccuaaagaggggcccaugaccaugcccaccuggcacaaggagguuugggugacccccaaaucuccuugccccaggggguggccccagaagcccugaggggcuguuuccuccuacuccccuccccccaguagaugacuccgaggaccccucuucccccgcccuugagggaggcccagcacaguccugacauccaucacaugaaaccccgauucauucaucacuagcugugggacugagcaaguuauuugaccuugcuaccugucgaguagcaggguucuaagcacuuuacaaacaucuuagaccauaacauccccgugaggcagauacuaucacuucccagaugaggaaacugaggcccagauacauuaaacauuccaacccaggcaggcuccaaaguucgagcucuuacccauuacgaaaggcugccuuuugaacccaucuucauuugcguuuccccggaacuccuccccuggugggaugucuuugaagcccccuuuucccacggggggugauccucaaaccuccuugccccaccggguggccccagaagccccgaggggcuccuacuacuccccuccccgcuguagaugacuccggggaccccuuuucccccgccccugcaggaggccuggcccuagcggcggcaccucucgguccccgcgguaacucuugcgcaugggucccagguccauggcagcacugcgaccacacaggugacugagguagccuggccacucggcaggucgcccgaacgucgccgugacgccccgcagccagcacgucauggggggccgccggccacgugacccggcuguggcccggcacuggguuccuuugaguucggaaccaauuucucacccuggacuucuaccccggggaaggaaggauuugccagucgcccaaccaagcuaacagguccuaaguccucggagccaaugag

SEQ ID NO: 16800 - RNA, 7800 nt, Homo sapiens
cucauuggcuccgaggacuuaggaccuguuagcuugguugggcgacuggcaaauccuuccuuccccgggguagaaguccagggugagaaauugguuccgaacucaaaggaacccagugccgggccacagccgggucacguggccggcggccccccaugacgugcuggcugcggggcgucacggcgacguucgggcgaccugccgaguggccaggcuaccucagucaccuguguggucgcagugcugccauggaccugggacccaugcgcaagaguuaccgcggggaccgagaggugccgccgcuagggccaggccuccugcaggggcgggggaaaagggguccccggagucaucuacagcggggaggggaguaguaggagccccucggggcuucuggggccacccgguggggcaaggagguuugaggaucaccccccgugggaaaagggggcuucaaagacaucccaccaggggaggaguuccggggaaacgcaaaugaagauggguucaaaaggcagccuuucguaauggguaagagcucgaacuuuggagccugccuggguuggaauguuuaauguaucugggccucaguuuccucaucugggaagugauaguaucugccucacggggauguuauggucuaagauguuuguaaagugcuuagaacccugcuacucgacagguagcaaggucaaauaacuugcucagucccacagcuagugaugaaugaaucgggguuucaugugauggaugucaggacugugcugggccucccucaagggcgggggaagagggguccucggagucaucuacuggggggaggggaguaggaggaaacagccccucagggcuucuggggccacccccuggggcaaggagauuugggggucacccaaaccuccuugugccaggugggcauggucaugggccccucuuuagguggguacagugacaaacagcuuacaaacuguuugacaaaaaaguaaguggaauaugggggaaggggacuagcucggggaggaggggaggagaaagcucuuagcuuacugccuucaguacuuucugcugaccacugggaaguucuuuuccuuuucgcuccucaggaggggaaccaagagaaccuuuuaggaauugggguccagggcccugguugccaaaucugguugcaugugggcauuucuagaaacgcuuguuuaaaaugcaguuuuuccagccugggcaacauagugagacccugucucuacaaaaaauuaaaauuagucgagcauguuggagcgugccuguaauuccagcuacuugggaggaugagguuggaggauugcuugagcucaggaaguugagacugcaguaagccgagaucacaccaccgcacuccagccuaggugacagagugagacccugucuaaaauaaauaaauaaauaaauaaaaaugcaguuuuugaugaagccucagaccugcugaaugagaaauuuuggggguggagcccagaaaguuuuuuuuaugcuccccaggugauucugaugcacagacaguuuugacacccaugacauguaacccugauuuauccaucacuagcugugggacagcaaguugucugaguuuuuaugccuguuuccucaccuguaaaauggggcacagaaucuucuuacugcauacuauuucuuauuuuaaggucauugucaugaggacuaaaugaguugauuuuugaaaagugacuagaacagugccagguccauaguaagcacuauauauguuuauuaaaugaaauaaaucuccuuuccuaggcauuugaggagacucaucugaccucccuugacccagugaaacaguuugcugccugguuugaggaggcuguucaguguccugacauaggggaagccaaugccaugugucuggcuaccugcaccaggugggcauggcugugggccccucuuuggguggauacauaugaacuaggaagcuuaugaagcucucuacucuggaugccaauuuuaugguuccagcucuguuauuaacaugcucuguggcuuuaggcaagauacuuguccucucugggccuguguccuuaccuauaaaccaaagaccaggccacaaaauuacauuucagugauaaaaaugcagugccuuguucauuucugcccuugauacauccacacacaaccccuugccucccucaucuccccaucuacccaagccccgucugccauucaggagcuacuucuccuggugaagcucugucucucucucgaaaucuagcacagugcuugacuauaucauuccuuugacaaucauaugcccuuugagacaucacuuguauuagccuguuauucaauucuccucgauaaaguguaaggccuuguagccagugcucuuguacugugcgaguggauaucucccagagcucugagcagaggggcugaucucauagcaccacugugaucccgaagcauuggaugauugcauuauuguuagucccugcccuuagggucuuaugaauuugcuagggcugucuuaacaaaauacuguagacuggauagcuuaaacaacaggaguuuauuuccuuauaguucugguggcuggaaguccaagaucaaggugccaucaggggugguuucugaugaggccucugcuugggguuugcagacagcuacuuuuuaccauguccucacacugccuuucguguguguguguguguguguguguguguguguguguuguggagggcaagggaggugguucugaagugucucuucucuuacagugacaccaguccuacuggauuagggccccaccccuaugaccuuacuuaaccuuaauuaccuccauaagguccccuucuccaaauacagucacauugggguuuaaggcuuuaacauagggguuuggggugacacaauucagcccauaacagggccccaggcuguggugucauaccucuaggacaaauccccaggagcacaugggacgggguagccugacagcccaauaaagggggugcagcuggagggggugcugagacauccuuuggggagagggacuauagccagaacauugaagcagacucugaccacagugcucugcucuuugcuccuagagauggaaaacccucugcucgcauguugcugcugaagggcuucgggaaagauggcuuccgcuucuucacuaacuucgagagucgaaaaggaaaagagcuggugggugaaaagagcuaguaaucuuucccagggccugcaggguuuggcucuugcuuccucagucaccuucuuaugccaccccacccccccagucuacuugcucucugugugcaggugcccuccugccaugaggccuuggcacuugcugugcucuuugccauaaaugaaugaaugcacuuucuaaccagccucaccccaucagccaugaccuguuccuucagaucucagcccacauguuaccuccucaggaaggccuuccuugacucucacucagacucagccccucaugcuguuugcugccauuauaacuugcaacuuucuuuuuugucuucuucuucaguuuguaacugagcauuuguuugggugauuauguaacugauauuugucuccucugcucaacaguaagcucuguaggaguggaggcugcucuguuuuaucucugcuguaucccccgcacgucuccuguugucagacccagagugggcacuucgcgugcauucaaugaaugaauccaaaaugaguaaaccucccugaguccaugccagccaagcaugcauuucucaagacucacaaaucugugggugagagaaaucacccagucucacuuuggaguccgacuggcuuaaacuuagcuccaccacuuccugcaggaacuugggcacgugacuuagccugucucugugucugugacaauaggccuacuuuugaggguuuaaaugagcucuuacggugggugcaucugcugugggccugcgcacuacagcucuccugccuuuucccugcaugccggaggccuccucucccuguccugauggcuggcuguggauucucuuuuacuucuaggacucuaaucccuuugcuucccuugucuucuacugggagccacuuaaccgucaggugagugaauuuucccaggacagccugggaugggcuggguuggcagggccugaguuuauggcuacgucuagcgaagguccccagacugggcaaacaucccagcugggcacucugccucuaaaauagcccucaguuaguuggagccaagagugguggggcagccgaucgaacagagaggaacggggccugugcugguagggagggcagguggcauuuaaugccauucacccagagccaucccugagcaggugcguguggaaggcccugugaagaaacugccugaggaggaggcugagugcuacuuccacucccgccccaagagcagccagauuggggcuguggucagccaccagaguucugugaucccugaucgggaggugaguggagcuccgcuguaguccuccaggugguggaggcuuuggcuuauccccagaagcuguccccaggagaugccaggagauguccccaggagauguccucucucuccagcccagugaaaacagugaaaaggacagugagaagggaaaguggggguagggagaggggaaauaggccuccucuguccaucuggccauccuguugacugcuccuggaggacagaggccagucugcucugcucacccauguccccagcacauauccccaggaaguccuuguuaaugaaucauugacugggccuggcccuucuucuaacucuucccccuggacaguaucugagaaagaaaaaugaggaacuggaacagcucuaccaggaucaagaggugcccaagccaaaauccuggugagugacaucugguaguccucuagaaagggacaccaggccccuguguuuacuugaagccaccugccuggggaaucacagaucuccuccucccuggccacccuugucagaugcaucccagcaacuuccuucaagaggcccugggaugaggggugagggugggagagugaccuggcuagaaaacuccacagagcacugaaaccucugcuucuccuuauagggguggcuauguccuguacccucaggugauggaguucuggcaaggucaaaccaaccgccugcaugaccggauagucuuucggcggggccuacccacaggagauuccccuuuggggcccaugacccaccgcggggaggaagacuggcucuaugagagacuugcaccuuaacucugggaccugcuggcccagaguggagcuagggcuaggugucaagagagggugugggauugggacccaggcccuucuuucuaaacucaacccauuucccucccuaccccuuaucuucaggacucuucagagcuaauccucuaaguucucuguacucaguugguucucaguuagcuggucaaguggaguguaaugguggcguagagaaucacaaauggaaaauaauuccauaauuauuuuuuugaccuugccuaugauugauuaggauagcucccucuagggguagcagccggugugacucccuuucuggugacagacagggccccagcagcccugucuguuaccaugugagucauacuggccaaagcuuaguccuagcauaugcaccugagccaaccuggccaaucagauuguuuugucaauaauuugaaauuugaacuggagagauccagaaccuugggagucauuaaagccaagucauucauagcagccaggaaacaauaggaaccaaaagccucugccugcugcuauugcaauucccaggaucucuccuucccuggaucccucccucccaggucugggcugugcaguuccucccccugccuuaaaacaccccacuaucucuguaaagucucucucucucuuuuuuuuuuuuuuacuuaaucuagcuagaaucuauuucuguugauuacaacuuaacuaacucauuuacggauaggacuuuuuuuuuucuuuuuuucuuuuuucuuuucuuuuuuuuuuuugagauggagucucacucugucacccaggcuggagugcaguggugugaucuuggcucacugcaaccucugccucccagguucaagcaauucuccugccucagccucccaaguagcugggacuacaggcacacgccaccacacccaacuaauuuuuguauuuuuaguagagaugggguuucaccauguuggccaggauugucuccaucucuugaccuugugauccacccaccucagccucccaaagugcugggauuacaggcaugagccaccacacccagcgagacgggguuucauuauguuggccaggcuggucuccaacuccugaccuaaagugaucugcccgccuuggccucccaaagugcugggauuacagacaugagccaccacgcuuggccgggauaguauauuuuuauagcacuuccccuacugauugcugccuucucuguggcuacaagggacccacagaauuacagggaaguuacagggaagcagguuucaucucaauauugggagagauuucaaacaaucacaccugccugagaaggagugggcugucacuaggaauuuuuauucccaguccgucaggaauuuuguagaagggcuucaugugcugguaccaauaggacaggaagauuuuaaucagcuuuacuaucuauguuuuuuuauggaaacuguguguauguauacauacauuuuccaaaaagaaaaauuaaaugauuauagagauuauguuuuucagacuacucacguaucugcuuuucuuacuccccaccucugcugauaauuccuaguucauugguuuuucccccacacuggaauuaccuggggagcuuaaaaaacccugaugccugggucccacccucagagaugauugaaccagccuggccagcauggcaaaacccugucucuacuaugauaugaaugcagccugggcacugggaaauuuaaaaacuccccagauaauucugugcagccaagguugagaccuccuagucuagagcuuugcuauacacagggugguccacaagccaggagcaucagcaucacuuggcagcgccuuagagauucagaccccagacccacugaaucugacccugcauuuucacuagaccccaggugaucagcugcacuagacucaaccucuaaaccaagaccucccacccucacagucuaugauccuuuagugacccucagcugaguccugugcugaacuguguuuguucuccuugagcacaugcccgcuaaccagggacagacuggaugagcaagcaaccugcuggcuauggagaagagccaggcuggguaaauguuugcugugacuaagccaggaucaaagaacugccuguugcuugcacuggcuggcacugagcuugccacucugugaacugugcuuccuuccccugcauggaccugugccucagucacuauuauccgcaggccuucuccaagggcagcccucuccuuguuuaucccucuuaagccugcgugcaggaaggcacauuaacccuguggcccccugcaggcaggaggguguugggugcccuuaccuaccuugcccuuuuucuuguaccguaggcugugccguuuaugaguaagugaugugugucugugugugugucuagaagugcugcacucaccuuguguuauuggagguuguguaacccccuagcuuugagccuggucucagauguuccuuuuccguucucuguccagccguuaccgcccccagucuguaauaaaagccuaucagccgugcacuuuauugauguucaac

SEQ ID NO: 16801 - RNA, 39912 nt, Homo sapiens
cucgccagggacauucucagccucccuuugucccuggggacaauucuagucugcagugggcagcugggacuuacgagaagcagacugggcaccacauggagcuguggucaauggggucgggaaagguggggagcaggggagugcaggggaggggcagaggcagagagaagaugcugcuacccggggagguaagaggagcugguugguaggaaaccaauuccuugaagaggcaaauguguguguuuguuuguuuuuguuuucagacagggagacaggguuuugcuuugucacccagggcagagugcagugucgcaaacacagcucacuacagccucaaauuccuaggcucaagggauccuccugccucagccucccaaguagcugggacuacaguugagagccaccaagccuggcuaauuuuuaaauuuuuuuguagagaugggggucuccuuaaguuguccaggcuagucucuaacuccugggcucaagaagcaauccuccugcccuaggccuccccaaguacugggauuacaggcaugagccaccaugcccggcccaaauggcuuuuuuuuuguuguuuugucuuuuuuuuuuuuuuuuuugagaugaagucccacucugucgcccaggcuggagugcaguggcaagaucuuggcucacugcaaccuccgccucccagauucaagcgauucuccuaccucagccucccaaguagcugggacuacaggcaugcaccaccacgacuggcuaauuuuuguauuuuuagcagagaugggguaucgccauguuggccaggccggucuugaauuccugaccucaggugauccacccaccuuggccucucaaauugcugggauuacagggguaagccacugcacccgggcccaaauggcucuuuuuaaggagucucuuuguagaggcuggaacccacucucagucuccgaaugaagcaggccccauuccuggggaauagcaggcacucaauagcugcuuguuaaacugcaucucccuguccgcccuguguuacuguaaggugaacgcugggcagcugcuuuggaaaugccuugggcgcccccugguggugacacacaaaggcugaggaggcaccccugccuuccaccuuaaagggcuccuuuuaccuggggcccugcccuuucuuccugaggcuccacagaucccaccccagggagacuggggguagaaagaaggagcaaagaaggaagaacccuguggggaaggaugaguggaauguccuugcuggaagauuccauggcaguugguggggagccaucggccuggacaggggaaccaggggcagaggaaguugacgaguuagggcaggggucaggaguggcauccccggcagugaagacagagaugugucuguaugugugcaccaggggugugguguaacagggagauacaucuuauagccucugucaauguuucauguucacagaagacugaggaaaccuagaucccugaaaucauugauggacccuaggaggaaaaaaaaaauuacccaaauucauccaagcuagguguuugucccaucagauauuuuugugggucugcauaugagagaguccggguuagaagucugcaacucugggccgggagaagucgcucacgccucuaaucccagcacuuugggaggucgaggcggguggaucaccugaggucaggaguucgagacaagccuggcgaaaauggugaaacccugccucuacuaaaaauacaaaaauuagcugggcuuggugaugcgcaccuguaaacccagcuacucaggaggcugaggcaagagaauugguugaaccugggaggcggagguugcagugagccgagaucgcaucauuguacuccagccugggcgacagagcaagacacuaccucaaaaaaaaaaaaaaaaaagaagaagucugcaauuuugauuuccccauaaguagaaagggaagagaugagaaaauagaaaaucauaggaggggaaaaggggagaagcagagguuacugggaaauccuuaaggcaaaacaagcagucuuuagaaggcugggucggcuguaacucuucaaagguaaacaccaacaauaaagcuuggguuguagcuaugagugaggaccaacagagagucaagggggcuggccugauauucuucuaguuucuggaccaacagcaccaguuaugccacgugguuucauaggaggcuccaggagggaucugaagcuuuuuuuuuuuuuaauuauacuuuaaguucuaggguacacgugcacaacaugcagauuuguuacauagguauacaugugccauguugguuugcugcacccaucaacuugucauuuacauuagguauuuccccuaaugcuaucccucccccagcccuccacccccccgacagacagcccugguaugugauguucccugcccagaucugagcuucuugagagcagaggcuguaguuccacauccuucccuccaggacccucccucagcauccugggggagagauguucacugucugguacugacggauuagaugaggacaacccugugcaaaaaaggacaaagagaaugucaggaagcaggaaaagcacaggaaagugaagaaagaaggggauucagagguagacauggaaggagaaguaaaguggaaguggaagaagcugggccugaaagagaagggguaagucccugagaaguguuaaaaggauauagucauucggucagucaguaaacauuuacugugcaccuacuauaaucaagcagugugcugggaauggaaggugccaugguagacaagacaagcaugggguuuuuagugguggagaauguguagcuuugcaaguuagaaauggagagaaagugacaauguagaguagaaagaaacugaaagcaguuggagacaaaagggaaauaucacugagagaaccugccuccagacacaccagggaggagaugucgccccugguuaagguugacagacacagccagaaccacccacuggcccuggcucugcgaagauggcagcagguaggguaggaagaggagaaauucagaaaggcgagggacaggaguggguggggguggagggcacagacuuuuccuuguuuuuacuugggcacccccagugggaagguaucuuugggcuaaggaguccuucuccacauuuggcugcccauuggaaucaccugaggaacuccuuaaugcugaugccccccagagauucuaauuuccuaggaugggacccagacuucagaauuuacuaaaagcucuuuuagugagucucacguguggccauggccgggugcaguggcucacgccuguaacccuagcacuuugggaggcugaggugggaggaucgcuagagcucaggaguuugagacuagccugggcaacauagggagaccccagcucuacaaaaaauuuaaaaauuaggugggcaugguggcgcgcaccuguagucccagcuacuugagaggcugaggcgggaggaucacuugggcccaggagguugaggcugcagagacccugucucaaaaauaauaauaaaaauaaaggcggggcacaguggcucacaccuguaaucccagcacuucgggaggccgaggcgggcagaucgugaggucaggaguuugagaccagccagaccaacacagugaaaccccgucucuacuaaaaauacaaaaaauagccgggcguaguggcgcgcgucuguaaucccagcuacucaggaaacugaggcaggagaaucgcuugaacccgggaggaagagguugcagugagcugagauagugccccuguacuccagccugggcgacggagcaagucuccgucucuaaauaaauaaauaaauaaaguguggccgggagagcacaagcauuuccaagccgcugccugaccuucuccgucucuguugaagacaggggccaucuugaaagaaaaaaucucugaggaguuguguggucacugggggagcggggguguuugugaaggaagcucuaagacuccaaugggccugacaaaaguauaacggggucuucuucuuagaaaguguccccuuccuccgggugcaguggcucacaccugcaaucccagcacuuuaggagacugagguggguggaucacuugaggucaggaguuucagaccagccuggccaacauggugaaacccugucucuacuaaaaauacaaaaauuagccgggagugguggugcgugucuguaaucccagcuacucaggaggcugaggcaugagaaucgcuugaaccugggaggcggagguugcagugagccgagaucacgccacagcacugcagccugggugacagagcaagacuccaucucggggaaaaaaaaaaaaaagaaagaaagaaacaaaaaaaaacaacaaaaaaaaacaaaggguucccuucuuuggcugugucucuaguaagaagagucagacagccuagaaacaaacaaaacaaggauaaggugaccuuuaaaagggcaaaaccaaucaaauaauucaaaacuacugcagaauucuuccaaguauucacacccuguccuccgccccgugugcgcacacuuuuuuuuuuucaccucugcggucuucaugauggggccuccaggauaggagaagcauagcuaccccguuuuucucccagaagagguuugacaguggcccagcaggauauucaaccccaccuaccuccccccaaaaccccugcacccuaauacaggugagucauggaacccggguggaguccuugguuugacagugaagcaaucuaaacuugaaaaauggccugggaacagaauguauggacuauacaaacaagucaugcaggugucauuguaugcaaauauucauucuuuaacucaccuuacauuuccugcugauccuccucugugcuggccucaauccuucuaccacagcucagucuagcaggagaguaagaagugagaauaaaaguguggaaauagugugugagagagaagcucuuuugcaugugccagggcagcacagaggaggaagaagcuauggcugggcaggagugagguaugcagacuuugagcagggucuugaaggaugcauaggaguuuauuuauuuuucugagagacagggucucgcucugucacccaggcuggagugcaguggugugaucauagcucauuuuaaguucaaacucccaggcucaagugauccacccaccucagcuucccagguagcuagaacuaaaagugcgcaccaccacaugcagcuaauuuuuuuuguagagaugggguuuugccauguugcccaagcugggucucgaaauccugggcucaagugauccgccugccucuggcuucccaaagcacuaggaauacaggugugagccaacacauccggccauggaugcauagggguuuaccagaagggaagggucacauaggaagucaacuaguggaaaaaagcguaaguguuuaggaaccuggaaucuuuccuggagggaaaaggguaggauuuguaggaagggaacggggguagagggaggagauaaagcaugaaagauacaccaguaagaguguguccucugguggaugcugagguuaagaagaaaaaagagugggaggacuuugccuagaaaggaguuugggcuuuaucuaggagauacggaucccaugaaggaucuuuacuagaggaguauuauugucuaaagucuuguuuuucaaaggcuaacacugagaggagaagacuggaagaggcuauuaacauuuauucagcaauuacuguguacccgguauucugcucugcauuuuguauuaucacaccaaccuuuucuagcaguguuuuucaaacugccagucaugaucaacaagaaggagaauaagauaggauaggauaagcauagaaacuaucagugcgucacaaguaguaagcauuguuuucggaaacuuuaugacacucucauacaaauagcaguguacuggucuguaugcaaaauguauuucucuugauggacuauguuuuuuuuuguuuguuuuuuuuuuuuuuuuuuuuaagccaucgcgcuaagguguaggugugauuaaccucguuuuacugaugaggacaugaagcucagggaguuucgguacccugccuaaguuagugggauguguagguuucaaacccagacuggucugaagccagaauggauucccucacuaagcuaggcagccuucccaaguucucggaagagacuugggagcaaagauaaaccuacccgccuagugccuaccaagugcuuuaccucaucucaagaagguaaggguaaguggggcagaggccaagcaguacuucucaaacucaagcgugcaauucuguccacgcgaggcccuugcuaaaaugcagauucuaggcacgccccgugaaguaccgagucggauuaggagaggcggccaggggagccugccuuuagaaagagcuucggaugauucagaugcacacguuugggaccgugggcuaugggggucgccgcaauaaccaugugaggauuaacgggggcuuaaccgauugugaaaauccccuuagaagugucgcguaaacaaccccaacucccacuauggugccggaccccagugccucacuguacaaagucgccccuccccaggcgacaacgagagagggacuaaauaaaagguugauggcuuuccacucaccaggcaugggguugaguggcagccggcuacugccgaagagcagguaaaagcuccugccacaccugggcgagacuggacuuagggcgcaauguauaugcuauuucuggggcauuugugggccucacccuaaggacuucugauuggcuucagggcagaucuaucauucauccucuggguuagagguggguggaaggucaaccucgaccaauacaaaagcacucuucggcuaagccccuccccuuccagcuuccuguugcuguacaucaaccacccagcgggcgggacuuugccucccuccaauuggcugaugcacaugucacucauuauucaauuggcuuucgguuggugcgcucuaccguccaucagugacauugcacagaccuauuggucaaaucaacgucgcucuagacgccucugguugauugguuaauagugcugucgguccccaauguuccaagcgcuuauuggugaaggcugccgucgcucgggcgguggcgggcuccgggauuggcgguugcuuggcgggcggugucaggcucucgguggcggcggaggcggcggaggccagggaggaagaugucguaaugagcggugggucccggccgcugccggcggggucuucccggcccccaagggucaggaagacgggcagaggccgcggggagagggagccgaggccggggguuccccccuggggcugggucuggcgucggggcccggcuucaggaggggcgggggagggaggauucccgcccggaggaggagcggggcuggccagccgggcggaggcacccggaagggggcguucgacuccccgcccccucggagcccgccgggcgggagggcggcgcuuccgggggccggcgagaggagcgggcaccgggguggccuggcaccccucggacgggugccgacccacuucaacgccgcucucccgccugggcgaacuaugccugggucggcucugaggaggcagccaacagcccuuguguucgccccgugucugagaggccuuccugcacucuuaacuguagaugcccaccagcgauucagggcuccccggagaacagagaggggcgagggaacgcuugagacccggacgcugccaaccagaugggcacugcucggcaucgacgacagcccgguuacugauauauccccagucgggcgauggugucaggacacgagagcacucccugggcagaugaccucucaccggggagugggcaaaaaccuuccuuuaauguuuuuacuuggauccuugaucuuccagcuagauaucugcaagcucuuagcagaauugugagaaguuugagaacuucuugccagagcucccagccuguuacuugacgccccguaggggagacuacugcagucccaaagcucaggcgcaaacaaucuuaaggaauuacagaagaaauaaaacaaaauagauacucgcucucuuccuguacccaccuccauccccauugcugacuuacgguuuucagccucuuauccaugcuucuuauguuuccuugccagcggcuuucuaauuuuaguucagaaggaacuauguuuucuccucugggcaacugagaaaccuguccucacugcauuccuugguuuugauugcaauauccugucauguuuguuucuuaauuaacuucauccaaggggacucagucuggccuuucucagugcauucucccaaaguucuuucuucuucugagguuacuucuuguucacuuauuguuuccuagagaaagguaugagccaguagaucugcuuuaaacaaugaauuggcccaaguuucccguuuacagauuucauuacagauggacacuguuucaaggugcacuggcaugcacugucuaaaacgguuucaugcuguaccccagaaggcauucaguuucacaguggagggcuguauugaguugguauucuggaugauacaauuuuuagggcuagaaaguuuagaguguuggcuggcucacaggcugcaaaggaaauaaugguggaguccagaccacagcaguaauuucaauuacuaacacaaagaaacccauugucugcaauaaugaauauaacugcagugucuuguuuuguuuuaaauucuugugugcgaugaagggggcgaaucuaucagacaaccuaucaauugggcugaugaugucaguguuccaguggcuucuaacaggcguuaauaccuguuggaaauggauuaucauuggcugggacgauugguaaguuuucuaauucuaguucuuccucuugguuguacagaggcuuaaccucuuugguuaaaagcaacuacaagaaaaaaagcgagucugacauaauuaugaaccccccugagcuaggcugcugaagccagaaacucuuugccaaggagacccaaguagaguuuguuaauaaucggauccucaccugacugcccaacggggagaacuggcuccgggagaaagaguuuggcaucacucuggacagcagauagacuggccacuuuuuucucucagauucuauuaaaguuugggccucuggagaggccugucagagaggagaaaagaaauuauaagauuugggcaaaugucugggguaaagaagcuuuauggcauuucagcaaguagagugguugguucauuuggauauuuuggccuugaacuucuuauuucuucuggugguuaauaccagcuuuuuggagaaguugaacaguccuuugcuauaggucuguggcagaucccaaguacugucagcaaguauaguauugcccaaccagggcccuuaugaagacauuuuaaacuuguugcagccaaccaguagaccuuaguauuggcuugguuucagccaucuucuaaaccuugcccacucauuucugugauagauauguauaacauguuuuuuuucuaauacuuauuuuuucacacacaccccccuuuucuguauacacaaaaauuggaaacccugcuuccaaacacugaaaaacuuaggauauuuuggaucagguggacaauggcuauggaaugaaagaugcagagaaacacugcuuuaaagaguauguagagaguuacagaguuuagggaugcaguagcgugaacacuucugaguuuacaagauuuaaccucauggccccaucuuaaaucuugcgggcugcaaaccuggaguaaaaucuguucagggaagcucauaugcuuucuuacaaguucauugggugauaugucuggaguuuucccuuuuugcaacugacuuggauuugucggaauuucuucccagcaccuacaggcugaacuaaaccaguauccaguacauuucugggcugauaaauggacaucauuuuggaaugcauuuguugcuuuuuugcuuguuuuugccuugcuuuuguuuuggauaugcgugcaacuccuuguaugacguugucuagaccuguuguaggaggaaaaaaaguucuuucucuuuauuucuucccuuguagagccaacacuuagaucuuuauguuucugaaauguaguugagugucuuuuuaaagaugcucuuccucaauuaucagcagaucuuuuuuuggcuagcagcauucucuuaggagaccuugggguggaggaggucucacuuuucugucagcaaucuauuggagcaagguggaaagaugagugaagaggguaaaaauaugugacauuucuuuuuuuaaaauaauagaggcauagucucucuaugucaggcuggucucaaaacuccuggccucaagcaauccucccaccucagccucccaaagugcugggauuacaggcaugagccacugugccuagccaacaugggacauuucuaacucgaggguauugucaggccauguaggaaagggagcagagauugcccuugaggagaugcucccagguggcagauuuguccuacuugauagauuccaaaauggaaaacggauuuuucugcugccucuggggacacugaaaaaagaaccuccacaugaguucagaggcagcaccggcagcuuaggggaagucauggcuuccacugcgugucuaggaagcgcucuuucaggaugcucugaggcugccacuggcacaggggaauacugugcuucucaucagacugggcugcgggcugaugugcucuugggagaugagcucugcucaggagcaagagguugugaaagggcugauguuucuuaggcucccccaaugagcagcuccaagcagugcugagaugucuaggccguuugugucacaggacaagcacacuugcagacccaacuguuggaauccuucauuggcauaucauucccauugcugcuguuugucuccacaucagaauugcuugcuauacuuagccagaagcccugccacauugcagugcagaggcuuagcuuucuuguuuuuguugcugagugcucugagauaccaguuugucccuuuguggugauuuaggcaguuagguggccuuugaucucauucacagaguaaaaauggcucaggaggagccagcagacacuagcguacacauuuccaaaugucaucuuucuagagccuucucuuugggguugucaccucuccuauagaauuugguagaaucacaaaguggucuccaagagagugugaauaggaaguaagagugagcaggcaggccauguaauuggaaguggaauaucucugcucucaauugauaauuaggaaucuucuuagaucagccuagaagaaaacagaccaagacauuucccagccuccaaaaaaguaaaugguaagccagcccugucuucucaggggaaaugaaaucaccacucauuucagaagcugauucuggccuggggccgggcugggugaucacgccuguaaucccagcacuuugggaggcugaggcaggcagaucacuuaaggucaggaguucgagaccagccuggcuaacauggcaaaaccccaucucuacuaaaaauacaaaaauuagccaugugugguggcacacgccuguagucccagcuacugcagaggcugaggcacgggaaucacuugaacccaggaggcggagauugcagugagccgagagcgcaccacugcaccccagccuggguaacagagcaagacuccaucucaaacaaaaacaaaacacugaucauggcccaggauaaauguggggagugacucacaaauaaaugugccaaagcacauaaagagauucuuuaggggaaaaaguauaucuugcuucuuuuuuuucuccuguucucuaaaauucugaggcccaguauucuuugacaaaaaaacuugaugcuguuucuugggccugcuuugaucagguucucuucacccuaugcugcccccacccccacacacuuccagagucccuuccaguacaaugggaugugacgcagucaggaugcaaacuagcaaaugacagucacguuuuggaaagaagaauuaaggguggagacagauaggcgguauucaaauucaagugccuucguuaucuuuuuuuuuuuuuucuugagacggagucucgcucugucaccaggcugaagugcaauggcgcaaucuuggcucacugcaaccucugccucccggguucaagcgauucuccugucucagccuccagaguagcugggacuacaggcacgugccaccacacccagcuaauuuuguauuuuuagaagagacgggguuucacuguguuggccaggauggucuccaacucuugaccucgugauccauccgccucagccucccaaagugcuaggauuacaggcgugagccaccgugccuggcuuuguuuuuuuuguuuuuuguuuugguuuuuuuugagacagagucucgcucugucaccaggcuggagugcaguggugcuaucccggcucugccaaugcaugucaauggagagaagcauuaauaaugcauaucaguugagagaagcauugaaaugcaguaguaccugguguguggugaugagaggcgugcgcuuugaaguuuuuggccaggagcaggacuggacugcacuggcccacaugugaggugacuggugggguugaggguuccaccagggucugggucagcuaaacccagcuguggaguggauccugaccuagugccaggauaugcaaaucugcagcuuuucuccuuugguuccuaaacucgcuuuaggcccuccugcucuaaagccuccaggauuuauucauucacuuauucaacaaauauagauuauuaagcaccuaccaugugccagggacugggauacaucagugaguaaggcagagaagucccugccuuuaggaagcuuacaucuuagugggagacaauuaauaacuaauagauauuuguuagacagugagaagugcuaaggaggcaaaaugaggauaagguaaaaaaagggggguggcaauuuacauagggugaucagggaaggucucaaugauaaggugacauccgaguaaaacccugaaggaguggggaggagauugagccuuuuucuaucuggggugaggggaggagggugagaacucagcagagagaagagcaaugcaaagacccucagcaggggccauacuugguauguucaggaacagcagggagccagcauggcuaaagcagugagagagggagagugacagggcaggugaaagagguuaggucacacaggggccuuuugugucacaauggagauuuuggcuuuuacuuugagugggagaugggaugguauugggggccucugagcagagaaauaacaugguuucauuuaagugugaugggucuuacucuggauguguugagaauagacugauggggucaaggucagaagcacagcuaggagguuaauccgugggagacaugauagaaaccuggaccuaggugaugacagaggaggugguagaagcagucagauugggcauauauuuugaagauagaguguuugcugucaaguguaggguguggaaaaaagauaaggauaacucccaagguuuuaaggcugaggagcuggaaagaugaaguuacuauucauucacugcaguggcgaauuuugaaggagucacaggauuaggacaauaucgggagcacuguuuggggcuaguuagauuuuuguuuuguuuuguuuuguuuuuugagauguuguuuugcuccugucacgcaggcuggagugcaguggcacaaucuuggcucacugcaaccuccaccucccggguucaagcgauucuccuuccucagccucccaaggagcugggauuacaggcgggcaccaccacgcccggcuaauuuuuguauuuuuaguagagacgagguuucgccauguuggccaggcuggucuccaacuccugaccucaggugauccaccugccucggccgcccaaagugcugggauuacaggcgugagccacagcgcccagcuggggcuaguuagauuuacgaugccuauuaauacauccaaguggagcuaucaguaggcaguuggauauaccagucgagauagaaaugugagaguuaaaauuauauagaaucuguaucuuacugguuucuaaacccacgagacuagacaaaaucagcuaggaaacagguguagacagaagaaagguccugagacagaguccuggggcaacccaaucauuuagaauuugagaggagaggaagaaccagcaaaggagauaugggagaaguuagccagagacuagcaaguguguccuagaggccaaguaaagaaaguguuucaaggaagaagaggccaggcgcgguggcucacgccuguaaucccagcacuuugggaggccgaggcgggcagaucacuugagguuaggaguucgagaccagccuggcgaacauggugaaaccccaacucuauuaaaaauacaaaaaauuagccgggcguggugucaggcccguguaaucccagcuaccugggaggcugaggcagcagaaucacuugaaccggggggcggagguugcagcgagccaagaccaaaaggaagagcaaucaacugucagagcaacacggaugacgugguuuaagaaguagccauggccggcgcgguggcucacgccuguaaucccagcacuuugggaggccgagguggucggaucacgaagucaggagauugagaccauccuggccaacauggugaaacccugucugucucuacuaaaauacaaaaaaucagucgggcgugguggcacacgccuguauucccagcuacucaggaggcuaaggcaggggaaucacuugaacccgggagacggagguugcagugagcugagauugugccacugcacuccagccuggcaacagagcgagacuuugucucaaaaaaaaaaaagaaguaggccaggugcaguggcucaugccuguaauccuagcacuuugggaggcugagacuggcggaucacgaggucaggagaucgagaccauccuggcuaacacagugaaacccugucucuacuaaaaauacaaaaauaaauuagccaggugugguggcgggcaccuguagucccagcuacucgggaggcugagguaggagaauggcgugaacccgggaggcggagcuugcagugagcugagauuguggcacugcacuccagccugggugacagugagacucugucccaaaaaaaaaaaaaaaaaagaaguagaaguagccauuagguuuuuagcaacauggaggugucugguggugugaacaguuuucguggcaugcaugaggagggugcagccugguuggagcagguuuaagaaaagcuagcgggagagaaauuaaggacaguaaguauagguaacuccugcaaggaguuuugcuugaagagaaggggagacauaauggaucuuagcugaugagggaaauuuuaacuucuugaugaaauuguagacauaccuaagggucauugccugaggcugggggucugagauggcggaguggggggagaugggaggcucaguaaaggguuaauguggagacaagaucuccauuccuuacucaccuucuugcuuacuucggccuguggcauuagcaagccacggcccagaguuguucucauugaaaugaaagccauugaaauuuguuuuacuguuaaugggcucuuuuaccaugguuuuaauuuauuuguuuauuuaaaauuuuuauuauuauuuuuuaaagacagggucucacucugucauucaggccagagcacaguggugcaaucauggcucacugcagccucgacuuccuggacucaagcaauccucucgccuuggccuccuaaggagcugggacugcaggcacacaccaccacacccagcuaguuuguaaacauuuuuuguagagauggcaucuugcuguauugcccaggcuagucuugaaccccuggccucaagugauccuccugucucggccucccaaagugcugguauuacaggcaugagccaccgugcccaccuuauaauaguuauuaugauugcugagguuugccucucauugaaauauucagcacaauuuggagucuuucacuaccaagguugcugcuuucuucauccaaauggauucucauaccccauuugugagcuuucuuugagguccaacuuuguucucuaaaaccagccagggcaugcuuuucccucaccagcucugaauucuuccaggcuaggcaacuggaaaagccugggcuuagaaacugcuuuguuggcuuacggcccagcugagcugaccaaaauagccaagagaaagacuguuugcacagugugaaauuccuccaggggaaauaccauagcaaaaagccaagaaagccagacccacgauggcaggaacccacaggcaaaaaaagccgaguuacccccaaggccuggguuguggagauggagccuaguucucuccagaagaaaaagcuuccuaaagccuacuguugugguauuucuguaggcgcguuuucucauuugcugggucucaagaguagcauucucagugaaaggaacagucgaacagccugcagccugguggccagggcucagaggucucucuuccuguuacgugcucuccccaagucaggccuagaaagaccgugggacagggacacacucccagcucuguguugaugggacagugccgaagggugccuggaguaugcacuggcagguagcagggucaccugccccagauuugaggugggaggaggucaggaaaggcuuucgcugagugagaguauaaaugagcucuaaaggacaggagcuggccgggcaaaugggagagagugugcuucaggcuccaagugagacaggguggcguguuuuaauuccagaaaugaaaaacugaaguguguguugggagaguuggaagggaaagaggucaggagggaggaccagggagggacagguuguucuggccuuuauaaguuuaucacaagagcaucagggaacaauugaggggguuaauuaggagaguagcuggaugggauuugcacuuuaaaaagagccuucuaaccaaauuguggaggcugacuaagggggaggccagaggccaggaagcaguuuuagaggccguaggcaguaucucagguggaucauggugaugaggauggggagccuggguacacuauagggagauuugucuaugagguggaaucaugaggacuugaugauugguuggcagugagggggauacucagguuuuguccugauuggagauaccagaagagaggcugcuuuaacccaggauauucauacagcccauaggcacugaagguguccgugagccaugugccaggccuuggugucugcaguucagugguguaaacagacauggcccacccuggggagcccucgcauacauugggcucaugauuaguuaaugaguggugaguguucccaaaggaguuagccucaucucagggguccagaaaggccucucugaggaaauggcaugccuguuacauaauggcucuuaaauuaugcugggaaagucaaacagccagagaccugaagggugaggucuuagcuagugaagagaacagaaagagcuguaagcaaggaaagacagcugcagacacugaaguuuuucaaggaucuggaagaaggccugugguggcugagggugagaaggcuggacaaagaaugggcaaagcugucgcucagugccccaggugucuguggccagcccuaauggaagacccacagagggcuggauguacaggucuaacacguggagcagagaucugggccagacacaggccuaugaguuggcagccuguggaagguauguaaagccgugcgaguaggcauggucacccagggaaagggugcugggugaggagaaaggacagauguuggggaacaucaguauuuaaggguggcaaaggaagaggagcccacaaggggaagagguggcaggagaggugggagaaaauccaugggaauuuugaggaagaggcacuggucagaggggcuauuggauugagcagcaaggaggucgcuggugaccugggcaggugcagcaugagcgcagugccaggguggauguccuaaugcugccgggaaaugagugaguagggaaggagggaggggacggcagggugccagcaguuuuucuaccaaguuuggccaaagggguaggaagagaaggcugugcuggaggggacaggagguagaggcggaugaucaguaguacaucaagagucuagaaacucaggggaugcuuuucugcugguuuuggaauuaaauugguuuccaauaugggaaaggaauguuguguguggucccaucgggcaccugcaaccccaucccuaugccaugcugccuucaaacuuuguuugaugccccuggaguuuuccauggaaccuaagagagguacuauugcuuguauaguaaauaauuguaaaacuucaccagcuuggggacuguugggaaaguuuuagccaaccuaacuuaaugaaaagucugaaugauauaacuuugaaagcaaugcagcuuuuucuuucaagaauaugcacuaaucccacuuaccuauguuguuaaguguugguuucagugaccggauguaaacuacuguuaaaaccaaguggcacuauuaaaauggcggaagugguauaaaacaauuauucugacuaagggucccuuugcaaucuucgaacaccauuuaggcucgcuuuaaauaguaugaaagaaaaguuaagcauaauuuauguccaaauuguauauuuuaaauauaaaguuccaaauuaaugagguucuaaagugccuuugaucauagucuuacaguuagguaucuaugcuaccucuucuuaaccacuuuucauuuccaaacaucagugggaaaugccucucuuuuccuuuucgugguuaauucuguaguggcagggagaucggucucucuuuugguugcccaggucugcagccuguggccauaaagcucugagugacgcuaggaaagauacuugcaaacauugguuugagaucuauaggaguauuucaggaaccagcuggggaggaaaaugaaaccaagcugaaauggugcaacguccagcacuagcagucugcagcuugcuucaguagauucugcuuuaaccuccuaacugaagagucacucagaacccagcccaguguccaaacaguuugaguccaggguaauaaggacugcagagagggagaugaugaagaaacgcuaggccaguuuuuauuucgucucauuucauuuacacucugcgcggauccuaugucucuuguuuuauaauagaggaugucuaagagagucauucacuaauuuuagcuaagcaaaccugagcccugggggagccuccugggagagccauugccuuccuuugcaguucugccagcaacaaacucaucuuguauuuuuaucagcaacauggucugagaaguauaaaaaucuuuuuuuuaacuuauuuuaaaucacugcacuuucuuccagugaauaaaaaucuuuuuuuuuugagauggagucuugcucuugucgcccaggcuggaguacaguggcacgaucuuggcucauugcaaaauccgccucccggguucaagcgauucuccugccucagccuccugaguaguugggauuacaggugcgcaccaccacacccagcuaauuuuuguaguuuuaguagagaugggguuuccccauguuggccaggcuggucucgaauuccugagcucaagugaucugcccgccucggccucccaaagugcugggauuauaggugugauccaccgcgcccggccaugaauaaaaaucuuaaagaucauuugguccaacuucccaccccaucucaacauccugacuccagcagggacacauguccugccucugguuaagugauuccagagaagggagaacauaguaccucagaaggcaacugauuuucaucuuuucaaaguucucucuuguguuaacuaaaaucugccucaaaauguccacacaggagucuugguucuacccuuugaacccauguccccacucuggcacccugaccacaaccauugcugcugucuucugaacaagcuccagcugaaaaucccccuuuuaaaaugucccucagaacagaaccugaugcuccagauguggcccaaguguguaaacuacaggaggauauuauuuuuuuguucuaugacugaacuuuuagaaaugcaauccaaaauugcaguagccuuuuuggcagccauaucuagauugugcuggcccccauucagcuuaaagucaaaaccucuggggcuuuuccacauggcacuauuaggcucuuucugcccuauaugcaugugauugguuuuuuaaccuaaguggaggacuuauuuuuuuuaauauacagacaagguuucaccauguugcccaggcugggcucaaacaccugagcucaagugaucugcucacauugcccuuccaaagugcugggauuacaggcuugagccacugcaccuggccaggacuuauuaaacuuuaaagccauauaugccuuuaaacccucgaugcagugauauaaauuauuagagccucacagaaauccuagaaggaugacauuaccuuuguuuuacagagggcacuaggaggaggcuaagagggaccaucccacuaaugaaccacacagucagaaucucauuuagguauggagccugauguucuuaaacauuguaccuaccaguuuuuuaagauguccuugaacucuaauacuaauacccauuguguuuccaauccuucucacuuuugugacaucugcaagguuuuuuuguuuguuuuuugauaccgagucuugcucuguuacccaggcuggagugcaguggcaccaucucggcucacugcaagcucugccuccaaaguucaaacaauucuccugcuucagccucccaaguagcugggaguacaggcaugcgccaccacacccggcuaauuuuuuuguauuuuuaguagagacaggauuucaccauguuggccaggcugguaugaacuccugauacaccugccucaaccucccaaagugcugggauuacaggcgugagccaccacgccuggccaacaucugcaaguuuuacuugucgucuagaucuuugccaaacuuggguggugaauaccauucuaaagccuaaguuuuccagccuguagggcacaaaaccaauuuagugggucacagccagcauuuaaaaaaacaaaacagaauagaaaaauaucacgguccgucacauguaauaagggaguuuuguuucaggaaacuuucauugcaugagcaugggacagaaaugugugguguauguaugcauauggugggucuugaugcaaauuguuucuguaacugugguucguggucugauaguuugaacacuaccacucuaaaggaaaaaugguuuggguuggcuuagauuauuuucauuauaauauuacaacuuaauuuuauaugaacaugaaucugugugucagcucauugaucuagcuccuauaaaguucacacauguaacuacaaaaaaagccaguaaaauucaaauuaucagcaucauucugagagggugauguuugacugaacccaaaucauugcuuuuccuuguaagcauggcacagacuugacacuuaggcuccuugaguucugcacacccauccuguagcgugucagucagaguaauacagucuuuccacugcuucuaaaguuaugucaucuuucacuuugcacagauguaucgugaacuaaaugugcagaaugaaguuguccuaauuagcccacacagugcacuuguaaacacacacacaggcccugaaaugugcaggacuugguuaugcagcaguuaccuggugaucuaugguauauguucauuuuuaaaaagaugauugggcuggguguggugguucaugccuguaaucccagcacuuuuggagguggaagcaaugggauugcuugagcccaggaguucgagaaaaggcaggguaacauggcgaaaccccgucucuagaaaauacauaaaaauuagccgggugugguggugugcaccaguggucccagcuacuuggggggcugaggugggaggaucacaugagcccaggaggcagagguugcggugagccgagaucacgccacugcucuccagccagggugauagagcaagaccuuguuucuaaauaaauaaacaaacaaauaaaucuuuguuuuggcuggucauggugauucaugccuguaaucccagcgcuuugggaggccaagguggguggaucacuugaggucaggaguuugagaccagccugguuaacaaggcaaaaccccgucucuacuaaaaauacaaaaaaaauuagccggauguaguggugggugccuguaaucccagcuacuugggaggcagagguugcagugaaccaagaucaugcaccccagccugggcaacagagugagacuacaucucaaaaaaaaaaaaaaaagauuggccgggcacaguggcucacgccuguaaucccagcacuuugggaggccaaggcaggcggaucacgaggucaggagcucgagaccauucuggcuaacaugaaacccccucucuuacuaaaaauacaaaaaauuagccgggcgugguggcgggcaucuguagucccacuacuugggaggcugaggcaggagaauggcgugaacccgggaggcggagcuugcagugagcagagaucgugucaccgcacuccaaccugggcgacagagcgagacuccgucucaaaaaaaaaaaaaaaaaucacagugaaaacacacaagaaaagaauaaaaaggccucugcggagaugccugugaacccugguccugagacccaccccaguucgagacacuuugcagcagcagacuucucagcacuuagguggaggcaugcucagcuuagccccagacaaacuagacuaucauauugcccaaguuuccuccuuguuuguucacaagaauauuaugaaaaugucagccagaugccuguugaaauaaaauaccugguguauaccaugcucuugauguauccauccaaaacccuacaaaaaagaaacagauuuguucagcaugaccuguucuucuauauuauaaugcuauuccuuguggucacuccuuccuuuccucaguaguuaacaguacuauucaaucauuuguccuaggauuuugccaagaaucagugccuguaauauuacgggaucugcauauauaauuuugcccagagcugcccuccagcuccauacacauuugcaggugugucugcaaagucuccccuccucuggaguauaguuuguguggacuucaggccugguaaccauuuaaggcacuggugugcuuucuuaccagcucaucaccuauccagggcuucaguuuccacuucaccuuuuuuuuuuuuuuuuuauggagaugggaucuugcuccaucacccaggcuggagugcaguggugugaucacgacucacuguagccuugaccucucagguucaagcgauccucccaccucagccuuccaaguaacugggaccauaggcaugugccaccauguccagcuaauuuuuaaauuuuuuguacagauggggucucccuauguugcccaggcuggucucaaauuccuggccucaagcaauccucccacuucaccuucccgaaguguuggaauuauaggcacgagucacugcaucccgugccuucaccuuuucuuuacuuuuccccauuuaagaauuguucuuccaaacagagaagccugaggccagccaaaaugugaacgguucugcuuucccaauauguauccuuuuguuuguuuguuuguuuguuuguuuuugagacacagucucacucuugcccaggcuggagugcagugguacgaucucagcucacugcaaccuccaccuccuggguucaaaugauucuccugccucagccuccuguguagcugggauuacgggcaccugccaccacgcccugcuaauuuuuugucuuuuuaguagagaugggguuucaccauguugcccaggcuggucucuaacuccugagcucaggcaaucugccugccucagccucccaaagugcuaggauuacaggcgugaaccaccacacccagcccaauaucuauccucuuuuugccaaauuccuuacaaggacucaaccccugcgccuuuuuguuuguuuuuuuuuuaagagauggggucuugcuauguugcccaggcaggaguguuuuggcuauucacaggugugauaauagggcacugcagccucaaauuccuggccucaagugauccuuccaucucagccuuccaagcagaaugcauccugagccuuuuugucucuuuuagucuuuaaaguaauaccccucuuauuucuguacuuacugaaaucugcuuuccagagguccaggauugaagucugacucugccugguguucuuuuccuuagugauuuaugcacuuuaagaugguauagauucuuucuccuaaaauucucaugacuuucguuuuccugauacuguguuucuuucuuuuuaaaaaauuuuuauuagggacggggucuaacuguguugcuuaggcuggucuugaacuccuggguucaagcgaucuucccaccucggcuucccaaaguguuaggauuacaugcaugagcuacuguaccuagccucuuuuggaugacuuaagugcacaguagagagucccuucauuacuuccucaaccuuauuuuucuuuauuuaagaaaaaaaguacaguagaauauauuuaucaugggaaaaugaaaaaguacagaaaaccaaggugcaaaauaaguuuaagucaaacaaaacucaaccgcuaggagauaauggcuuaagacuuuuuccuauuugauuauauucauauauagaaauauauacacauuuaaacaaaaauagaauuuacucuguuuucauucuccuuguuauauccaguuagucauuagcucuacugagucuugguugaugccuguggggccgugccuauuguacuauguaaaagcguaaauucaaguaaagaauugacccaugaggccagggaugguggcucacgccuguaaucccaacacuuugggagacugaggcagguggaucaccugaggucaggaguuugagaacagccugaccaacauggugaaacccugucucuacuaaaaauacaaaaauuagcugggcauggugguacaugccuguaauccuagcuacucaggaggcugagacaggagaaucacuugaaccugggagguggagguugcaaugagccaggaucgugccauugcacuccagccugggcaacaagagugaaacuccuucucaaaaaaaaaaaaaaagaauugacccaugugcuguauaugcugccuggggacaacggccuuuguggugaaggcugagcauaaaacacccaagacuuggcaguggagcagguguguccuccuugucagaaaucuuggcugagcgauacuucccucccaguuuuggcaucugucuacagcaggagugaacaggaggcuugaguuugagcuagaggauuagcuggggagcuccccccugcccaccauagaggaguuccaguuuagcuauggagagccagcagugcccagcagagagggcauagcugaguuacagaagagaguccugguauaaucuugguuauuuuuguguuaucucagacucugugguggcuggagggggcaguccaacgacagcaggaccagcuguccucacagccucagauggcugagucugaggagaggagaggagaaaguaaucuacugaaauagauguaaggcuaucaacccaggguggguaagucuggggaaaagucauuaacuucccuuggagaagcagcaacaaauagaggcaaaaagaaaaucuggcugggugcaauggcuuaugucuguaaucccagcacuuugggaagccaaggcggguggaucaccugaagacaggaauucgagaucagucuggacaacauugugaaaccucugucucuacuaaaaauacaaaaauuagcugggcaugguggcagcgccuguaaucccagcuacucagaaggcugaggcaggagaauugcuugaacuuggaagggggagguugccgugagccuagaucaugccacuacacuccagccugggcaacaagagcaaaaauuccgucucaaaaaaaaaaaaauagaaaaaaagaaaaucugaggcaagugggcuugcguucuuuuugggcauuuuauacauuacuccaucucuuuucuuccaacagauccacagaccagcauggcugccacugcugcugugagucccagugacuaccugcagccugccgccuccaccacccaggcgaguaggcagugggcuccgagggcuuggggcugcagcauccuggacagacucaccgaaaacacucucucuucacugucucacuauaaauacccuagguuaugagacuggggaagguucaguuagccacauuuucuuuacugagaaacuauggccauuuaccuaaggugccgcaguugggccagggggaaaaacaaggauuaaacucuguguuccuuccaccagaccucacuaaaaaaggaaaaggaaaacagaggcuuucucauugucucgaaaguguagcccuccccagucuauaaaguuacauguuccgaguacuaaaaagcacuuuacugaaguauuuauuccuccuguugccccuccauuuuuuccucccuccuuuccucaguugagcaaucagggaccccucagucccuggggugggcuaacaaacuccaucugagagccaaacaugcuucacuguccuuagaaacaaggccagcggagaguaggaagucagcucgugcuguuaguuuacccugucuguggggugcugccagggguuccuuccugagaaagacauugcccaccuuuucucccucacuuaauggagaaaccaguagagaaggggagacagcagccaagcaggggaggguacuggcaacaugccugccccggagguggggaagacuggcguggaaugccgccaggaggagaggaucauggacagaggcggccgggcagcgggccuuccugucucacuccuuuucucugcuguuuuuuugcaggacucccagccaucucccuuagcccugcuugcugcaacauguagcaaaauuggcccuccagcaguugaagcugcugugacaccuccugcucccccacagcccacaccgcggaaacuugucccuaucaaaccugccccucucccucucagccccggcaagaauagcuuuggaaucuuguccuccaaaggaaauauacuucagauucaggggucacaacugagcgccuccuauccuggagggcagcugguguucgcuauccagaaucccaccaugaucaacaaagggacccgaucaaaugccaauauccaguaccaggcggucccucagauucaggcaagcaauucccaaaccauccaaguacagcccaaucucaccaaccagauccagaucaucccuggcaccaaccaagccaucaucacccccucaccguccagucacaagccuguccccaucaagccagcccccauccagaagucgaguacgaccaccacccccgugcagagcggggccaauguggugaagcugacaggugggggcggcaaugugacgcucacucugcccgucaacaaccuugugaacgccagugacaccggggccccuacucagcuccucacugaaagccccccaaccccgcugucuaagacuaacaagaaagcaaggaagaagagccuuccugccucccagcccccuguggcuguggcugagcagguggagacggugcugaucgagaccaccgcggacaacaucauccaggcaggaaauaaccugcucauuguucagagcccuggugggggccagccagcugugguccagcagguccagguggugccccccaaggccgagcagcagcaggugguacagaucccccagcaggcucugcggguggugcaggcggcaucugccacccuccccacuguaccccagaagcccucccagaacuuucagauccaggcagcugagccgacaccuacucagguaccacacucccuguacuguccuccuucuccuccucugguuaucucuuuuuggcuugcuuugaagaugaugcuggucaucucccagcuugaucugaccuugagagucaguaucuuuuggggugggcaguaaguggccguuucuaccugacaaaugggcucucuuuaguucauagggccaaguacuucuuaucuuuagaaauugaugaaacauagggauauuuuggcaccuuuuccuuauagguuguuuuuuuucaggggauggugaggggauagauacauacuuguuaauaacuuauuuuugauuauagaauuacucaaaacauuagcaagaaugaaaacauuccaguucauagaauuuuauguaaaguaagaaaauuaaugagaaaaaugcugaucauuauuaaugacaagaaaaaaacaggaagagcagccuagcuuuauagcaggaauauuuaggcuagauucaucuggaauguuuguuuguuuuaggguguuuuuuuuuuuuuugagauagggucauacucuguuguccgggcuggagugcagugaugcggucacuacagucuuaaucuccugggcucaagcaauccucccaccucagccugaguagccaggacuacagguguaugucaccaugccaggcugagccacugcuuccugccaaacugggaugcugaauucaacaagaauguucuuauuuuuggcauuuauuaaugugcucuaauacucuggaaucucuuuggcucugugaggcaaguuuuauucuuuguucaugccugcuaagugccaguaauugugcccauguugcagauggauaacccagaacucagauaauuuaugaaguauccaagaucaaauagggcauaaaugacaggaaccaggagucaauugagauuuguaacuucagaccccacacucuuccaucuuccaccuugacucuugugucuuauguguagcaggugcuaccauuaaaauugaggaguuuuuuuuuuuuuaauauaaaaaacaguuccugccaucgaggaauguaugaccuaguugucuauagaggaagaaccgaaugacugagagugggaaguuguguaauuuccuggguggagaagagagccuuugaauuugaacuguggacauagaaaucacacaggaauucacccuucuggcauauuuaauguugccagguauuuuuuauaagucauuuaucacaauaucugugaauucccaugaucagaccuacccuacaggugauauuuuauguugccaggugauuuuuuauaagucaucuaucacaaauaucugugaauucccaugaucagaccuaccuuacaggugaagaauuguggcaccugcucaggagcacauccucggcauugccuccccucccuuccaugaggucccauuucuugagguugauggagacaggacuaaaacccaggucuucccuaaggaaauaaugauacauaugcagaaagauuuagcuacaguauuauuuuuucaugacuacacagcuuuauaacaucccaacaugcugauuauuauacaacugauaccuuguuaacuguauauaucuaggcuguuuccaaucuuacagcuaaauaaaucccugaaagugggucaaggacacguacauuuuuaaaaaauuuguauucuauauuagagguuugcagucugugaccaacuuugaagccaaaucuagcccaccugccuguuuuuguaaauaaaguuuaauuggagugcagacacguccauuuguguugcccuugcacuacaguaguagcacaguuaaguagcagagacaauaugccccgcaaagcuaaaauauuuacucuccggcccuuuauaaaaaaagcuugcugaaccuucagaugcaaauacacacacacacaugcaugcacgcauacacacacacacacaaaaucagacauaaaauaucagugauuugaaaaaggggcacauaucagaaaacugggaaugagauuugcauauuuacuaagaaaugggccaggugagguaguuuaugccuguaaucccagcacuuugggaggcugaggcuagagauugcuugagcccaggaauucaagaccagccugggcaagauagcaagaccccaucucuacaaaaaaauuaaaaauuagugaggcauggugcuacacaccuguagucccagcuauucaggaggcugaggugggaggaucacuugaacccaugaguucgagauugcagugaacuaugaucauucuacugcauuuuagccugggugacagagacccugucucuauuuaaaaaaaaaaaauuuuuuuuaaagagaugagauguuuguuagcuuuuaagugagaagaagcacagucauaaauaauccaggaauuaaaaauuacccaaaucaaaaucacaacaggauuuuuuuuuuacaaagaacuuuuuuccuuuugacucauuugaguguaaauugccaccaugaucccccuugucauuucugaacgcuuuaauuccuacacacaagaacauucuacauuaccacaauacaaucgucaaacccaggaaauuagcagugaaacacacugcuaauuccaagaccccacuguguuuucaccacuugccccacuaauuccuuuguggcaaaaggaucugauccaauauuacacauuacguuuaguugucuccuuagucucuuuugaucugaaacacuuugucauuccuuuuuuuuuuuuuuuuuuuuuucuguuuuuuugagacagggucucguucugucaccaggcuggagugcaguggcaaucuuggcucacugcaaccuccaacuccuggguucaagcgauucuccuguuucagccucccaaguugcugggauuacaggcgcgugccaccacgcccggcuaauuuuuuuuguauuuuuaguagagacaggguuucaccguguuggccaggaugacuuccucauucuuuacuugaccaucaugaccuugacacuuuugaaggcuaaaggucaacuuuggccauuggcagcucuuucaggucggcucuuuuuuucucuuuggccauuggcagcucuuuucaggucggcucucugcaaccuccgccucccggguucaagcgauucuccugccucagccucccgaauagcugggauuacagauacccgccucugcgcccugcuaauuuuugaauuuuuuuuuuuuuuuuggagacgaagucucacucugucacccaggcuggagugcaguggcgccaucucggcucacugcaaccucugccucccggguucaagcaauucugccucagccucccaacuagcugagacuacaggcgagcgccaccaugcccagcugauuuuuuguauuuuuaguagagaugggguuucaccauguuagccaggguagucucgaucuccugacucugugauccgcccgccucagccucccaaagugcugggauuacaggcaugagccaccgcacccggccaauuuuuguauuuuuuuaguagagacgggguuuuaccaucuuggccaggcuggucucgaacuucugaccuuaugauccacccgccucggccucccaaagugcugggauuacaggcucgagccaccacacccagccuucagguuggcucuuauaucccucugacaggcucucauucuuuuuuuuuauaaaaucagcuuuacugaaacauucacauacuaugaaacuuacccuuuuaaaguauacaauucagugauuuuuaguauauucacagaguugugcagccauuaccucuauauaauuuuagaacauuuucaucaccccaaaaagaaacucucuacccuuuagccaucacuccccauuuauuuccuccucucugcagccccugacaacuacuggucuauuuguaauguuuucaagguucauccauguuguagcaugugucuggugacuggcuuccuucacuuagcauguuucaagguucauccuguuguagcaugugucugaacuucauuccuuauauuuucccaaccucagccuuagggucaaccauuucuucucagauuccugguuccucucauugaaggaugugauugccucuuuuuaauucugucauugucuuccucccccauuuauuuauuuaugucauuauggacucacggauugcugcuuuuuuguuuuuuugagauggagucucgcucugucacccaggcuggagugcaguggcacaaucucgacucacugcaaccuccaccucccagguucaagcaguucuccugccucagccuccccaguagcugggauuacaggcgugcgccaucccucccggcuaauuuuuuuuguauuuucaguagagacgggguuucaccaaguugaccaagcugguauugaaccacugaucucaagugauccgccugccuuggccucccaaagugcugggauuacaggcgugaacuacugcacccagccagauuccuguuuuauucacuggguuauaaucuguuaagauuauuuugauguuuucauugaccuagauuuggccagugggugccccuuuaagcuggcuuguaucuuuucaaguccccaccauucuguaagcauuucuuuacuuucuggugcaaguguuccaagcuuuccuuguaccuucccugccccaacccuggaaucagcuauuucuccaaggagccuggguuccuuuuaguggagcaugugaguuacaagcuaaggccugggugcuagguaagcucauugcuacugggcauggcuggucccagcccuucucaauggacacagcuaggaaguauauauaaauagacauaccuaugcaaugucuacguagauagauguagauaaacuuauauaaggacacacacacauguauacacauacacauauacacacauuugaaucuauauuucucugucuauauauauugaaacccaugaguuuccaccaaugucucuaauucccaucuagcaccacaguguuccgucuagccuucucccuuuccauaacucccuucugugacagugagagcccucacuccuauuauccuuaacaugcuuccuuucuggauaaguccucgguaugcagccagucucccacagccauuagcucucccauagagacacccuccucagccugccaccgccauucccuacccaccacggacacccuccuccccgcuacaaaugcccuccuuguccugcucagccucuaauuugcguauuuuuaagguuuuugauacauauccccaaauuuccuuccagcaaguuuagcccacaucauacuuccacuccuaauauacaagugucuguuuccugcugucucaccaacaaugagcauauuuuauuuuccauguuugucaaucugaauuggagaaaaguuguuuuucauuaauauguggcucuuuuuuuuuuuucugauaacaaagaccagaaacuuuuuuuuuuuugagacagcguauugcucugucacccaggcuaagugcaguagaggaaucauagcuuaugaaaaccuggaauuccugggcucuaaaauguggcucuuaaaaacuaaagugaaccugugucauuuguuugauggucauucacagugcacugccuucuaaaucuccaauucugauucuuggcaauuacuuuuuccaugcuaaguaaauucaacguuugguuucaaaucaauagucaacauucgccagcuuaguauaggaugccagcagccauuugucgagcauuagcuguguauaaauguagguuugggugaauugaagagacuuuuaguggacaggcgcccccaguucucacuugggcagggacauuugaaggccccaggaaccuagucucuuccaggcacugauuuuuuuucucuggccccucccaggucuacauccgcacgccuuccggugaggugcagacaguccuuguccaggacagccccccagcaacagcugcagccaccucuaacaccaccuguagcagcccugcaucccgugcuccccaucugagugggaccagcaaaaagcacucagcugcaauucuccgaaaagagcguccccugccaaagauugccccagccgggagcaucaucagccugaaugcagcccaguuggcggcagcugcccaggcaaugcagaccaucaacaucaaugguguccagguccagggcgugccugucaccaucaccaacacaggcggugaggauggccccuguggccaggguguuggcagugguaccugcuccuagcagguggaaacuaugggcuggccccgggauuuccaguaacaauagugaggaugcuguccaucauagcuuaaggguacguccaccugcagcuucucaccuaguccuuacaauagcacucagagauaguuuaaggcacauguccccaucugacagcugaagacagagaagauagauguacucggaaaacuuuccaacugacauccaaacgcaaagacggcuucuugaaggagaaagccuugcguuaagguuggaagaaaagaagggagcccuggcagucagaauaguuugugcugcacuucaguucaguggugagauuuaugcugugaaaccagccuugcaaauaaccaaaggaaaaauuggagcaaccuagcaaaaauggcuccuuauguagggggagcucucugaauuucucuucauccuuaaugaauuuuuuuuuugagacagagccucacucugucgcccaggcuggagugcaguggugcgaucucugcuucagccucccgaguagcugggauuauagacgcccaccaccacgcccgacuaauuuuuguauuuuucguagagaugggguuucaccgucuuggccaggcuggucuugaacuccugaccuggugauccauccgccucagccucccaaaaugcugggauuacaggugugagccaccgugcccagcccauccuuaaugaauguuuagcacuuuaacacauuugcuuuucccucuugaggugacccccaagaggauaaggcauccuagaggaucugauuuuucccaaagcccauagaacuguguccucuuuuguguuuuuugguuuuuuuuuuuuuaagacauggccucagggccucgcucugucauccaggcugaagugcaguggcacgaucaugacaaugcagccucagccuccugggcucaagcaguccuccuacuucuucuuccugaguagcugggacuacaggcauguagcaccaugcccggccaauuuuuuaguuuuuuguagagaugggggucucccuauaugcccaggcuggucuugaacuccugggcccaagcaauuguccugccugccagagugcugggauuacagcuaugagccacuguaccuagccugugaccucuugucuuuuuaacagaaaucccuggagacuuuccuaaaagcagaguugguaucucacaggggccuaagguuggaggagauucaggaagaaaugucuuaagacccuucccagcugaaaucauguuggcaauauucuaaagcaaauucugccuacauaguacagugguucagggcacugacuuugaaaugggcuuccuggguucagaucuggguucuaccacuuacuagcugugugaucuugauauguuauugagccucaguuucuucaucuguaaagugcugaugauaguaccuauuuuauagggucauggagauuaaaugagucccuguacaaagguccuuaaaaugauauccaacauacagcaggcucucaaaaauagcugcugugauuaucaucuuugucaugugcagaagggcagaaggguugacucgagguuucaggcuuccucacccugaacucugccccucuuuguccccacagggcagcagcagcugacagugcagaauguuucugggaacaaccugaccaucagugggcugagccccacccagauccagcugcaaauggaacaagcccuggccggagagacccagcccggggagaagcggcgccgcauggccugcacgugucccaacugcaaggauggggagaagagguaauucaaggagaaggcccaagccacaaggcuggccuguguuccccaagccccuccuggacaguuguccagagcugcaagcuggcacagaccaggcaaggaagagcuggcagcucugugccaccuugcccccugccuccuugugcucucugaccugaccccacauccucacugcauccuguuccugccccauccucuaccgcuuuucucuccucuuccuauucccuccacuccacccucaccccaauucucaggucuggagagcagggcaagaagaagcacgugugccacauccccgacuguggcaagacguuccguaagacguccuugcugcgugcccaugugcgccugcacacuggcgagcggcccuuugucugcaacugguucuucugugggaagagguucacacggagugacgagcuccaacggcaugcucgcacccacacaggucagcccccugccuucgggacccuccacccacagaggucaaauuccugccucuccucccacccccacucuaccggcuuuagcaacauugacacuccuggaacugccacacugagcaaaagcuacagacuaucuagggacgacauaggaaauuauuuucaagccauucuguuaucacuguuguuuccccaaguaaugggaaaggaauaguugucauugcaugacacaaccugauaacuuuugccaugucagcauaguuauuuaacaaacacugacaugguaugccaagcacaguacuaagcacuuuacugauuaccucaguugauccugguaagaacuuuaugggaagauacuuuguuuaugccuuuuuuuuuuuuuuuuuuuuuuuuuuuuggagauggaguuucguucuuuugcccaggcuggagugaaguggugcgaucucagcucacugcagccuccaccccuuggguucaagcaauucuccugccucagcuucucaaguagcugggacuacaggcacccaccaccacacccagcuaauuuuuguauuuuuaguagagacgggguuucaccauguuggccaggcuggucucgaaccccugaccucagguaauccacccaccuuggccucccaaagugcuaggaauagaggcgugagccacugcgccggccuguugaugcccauuuuacugaggcauggagagcuggcccagucacacagcuagugacuggugcggccagguucacacccaggcccugccauggcuuuuuguuuuuuuuuuuuuuuaagacagggucucacucuuucacccaggcuagagugcaguggcacaaucuuggcucacuguaguguugaacuccugggcucaagugauucucccaccucaaccuccugaguagcugggacuacaggcaugcaccaccacaccuggcuaauuuuaaaauuuuuuuagagacagggucuuacuguguugcccagccuggucucaaacuccuggacucagaugauccucccucuucugccucccaaagugagauaucacaguuauaguuuuagguacuagcaaaucaaugcaaaacuauuaaaaauauugauccaagcugggcacaguggcucacaccuguaaucccagcucuuugggaggcugaggcaggugaucacuugagccuaggaguucgagaccagccagggcaauauagcgggagcccaucucuuaaaaaaaaaaaaggauuauacaucuaccaccugaaauuguccuggguauccacagugguccacacauacacuuuggcaaacagugcuauagugaaugcccacagugagcagacaccuguccuggggcuagagggcugagggaagcgugacccagagcuccggcuccuggccaguguggugggacagguccuacuccccaaaaggcagaggagucaacacuccacagaaaagcaguuggggucaacaugguuccaacugagugcucagggcuggcaaggucaggguggagggggauuuuccugugauggggaggaugcugauccagguucaaagucagagggacaaaagaagaaagcaggcagacagccuugcacaggaagacucuuaggugcagaggcuccagggacaaggaaugggaacgaaauagacuggagaggucaaauggggggucagagagaaaugagaauugauaaagagauuuagaugaguaggggccaagcaugauggcucgugccuguaaucccagcacuuuggaaggccaaggugggcggaucacuugaggucaggaguucgagaccagccuggacaacauggcgaaacccugucucuacaaaaauacaggaauuagcugggugcaguggcgggcaucuguagucccagcuauuugagaggcugaggcaggagaauugcuugaccugggagguggagguugcagugaguggagauugugccacugcacuccagccuggccagcagagugagacuccaucucaaaaaaaaaaaaaaaaaaaaagauauagaugaguaagcaccagugagcaaaugugagagcaggaggugggcagaauguggugacaaggccaugucagcuugauugggugcaccucacacgcaccccaccuuuuugggcagagacagggucugugcacagggucugugggugaugggcaucuccucuucccaggggacaaacgcuucgagugcgcccagugucagaagcgcuucaugaggagugaccaccucaccaagcauuacaagacccaccuggucacgaagaacuuguaaggccaacugcggcgggaggcccugaagaugcagucccccaccuguguccucccugggccccugguggaaaggagcccuguggcugccuugggccugcccucagccccacuccuguucugcaacuguccccacaggaaggggcucuguucccuguauuguccuccuucugaagccccuuggcucugccuuggcccuuccccucaccacgagcucccggccugcccagacuguggacacuggccgugcccaaugagacguucuaaaccaggacgcgugggaacccuuauuuccaaaggaaaaacaugcauuucacuccgucgaggagcaaagugagccccuaccccccaccccgauccccgcucccaacacugccggagucgcgucaugccaugcccccucuccugcaccucccuggcccugccggccacuguggacgcccuggggcuuggcacccaccucuggagaaacucggggccaccuccacuccaugugcccagccccgccacaaccucuccuccagcacauuccagcucuauuuaaaaaguaaagacacccaccgacuccugaucccccucuuuuucuauggagaacguugccuuauacucuacuucagaugaugaacacuguguacugugugugcuuuaaagaaguuuuauuuaauugcucccuucuuccuuuccuuguuauucaccucccugaugccugcuuucaguugaggguugggggcaaugaugagcauaugaauuuuuucucacucuagcaauucccuuuucuaaaugacacagcauuuaaacucaaaucuggauucagauaacagcaccugcacauccugcaccuccucccucucccuucaccucaccccugcccggcccaagcucuacuuguguacaguguauauuguauaauagacaauugugucuacuacauguuuaaaaacacauugcuuguuauuuuugaggcuuuuaaauuaaacaaaaauccaacuuuauuuuuaguuguaacugcuugagguauguuuuaugaauuaagugacagauuuguuauccuuuauuaacguacuuuguuggucagcacugggcugacaaaaauuuuuucuugcuaauaaauuuaguugccugaggcaaaa

SEQ ID NO: 16802 - RNA, 3628 nt, Homo sapiens
cuuccaggucaccugagagucuccgcccaauggggcggcccuggccagaagcggaggagguggcacccgggaccgagcuggggucuuggaggaagagagggugaggggaauacaguacugggggugagagaaggguuggacagaagagggucggguaucugggcaugcgcagggccgcaggacucuuggugggguagcgagggggacggucccacgacugcuccgaagggccgggacucccagugggggcgggacccccggagugcccgccugcggacucccaagccuggagccuggggagagggugggcaccuccguucccgcacacccguccauggugugugcgccgagcguccaggagccacggcggugucuuccuugcgcgucuuuuacacguguggggguaggcugcuccucggggcugagccguggccaggguuauggagaggcccgccucuccccagauggcgucgucgagcccugacuccccauguuccugcgacugcuuugucuccgugcccccggccucagccaucccggcugugaucuuugccaagaacucggaccgaccccgggacgaggugcaggaggugguguuuguccccgcaggcacucacacuccugggagccggcuccagguggguuagacuuuauggggugcugggagguguggcagaucucugcauucuuuuaagaccuucuucccugcuccccacaccugggaggcugccagaaguaguggaagagcaugagcuuuaggucuaccaaccuggaccugagcucauuauguagccucagucuaccucaguuuccucuucuguaaaaugggaaugagaccuuccucaaagggaucuauaagguaauuggcagagugccacacucgaggggccgccccucuaugaguggacgcuuccuuucuccucccucaccuccagugcaccuacauugaaguggaacaggugucgaagacgcacgcugugauucugagccguccuucuuggcuauggggggcugagaugggcgccaacgagcauggugucugcauuggcaacgaggcuguguggacgaaggagccaguuggggagggggaagcccugcugggcauggaccuacucaggugcagacccugcccuuccucaucugccugacacaccagaaaucuaggggcugaguuuugaccugggcccauccaucccucccccagccugguucacaggggccuccuccucucugcagacuuugcccuugugccuucgugaagaaggcugcagcagcagccaccuuugggccucuccuggcccagaaauagagcagugguuauuuauuuauuuucaguugaaaucuuacauagagucccaauuuauaaaaccaguaauaguggauggagcagcucuggguggagagagguuaggggcucaggacacuucucucucugaaacuguguuucaggccuuuucauggaacccucaaagcauagcacauggaaccagagcauugaaagccacuggcauaauugcauuugauacgaucagugccagcagauuugcugugugacuugggccuaucaccaaaccucuccgggccucuucuguccccuggagcuucugccaccagccauugaucccucugucacccuucugucccuuggcccucucuuuugccaggcuggcuuuggaacggagcagcucugcccaggaggccuugcaugugaucacaggguuacuggagcacuaugggcaggggggcaacugccuggaggaugcugcgccauucuccuaccauagcaccuuccugcuggcugaccgcacugaggcgugggugcuggagacagcugggaggcucugggcugcacagaggauccagggugagguguucccuuucucccagcuuugggaagugggagagaugguaggggcagggaggggcccgauccaggugcaagccugucaggacauccagggagaugggagaugagcccacuugggaauucuccuccccuucacuugguuaagucuuccgugugcuacagccuguugcuuccucugggaagccuuccuggacuucccuggguggucagguuuccugcuuauaugcaagcagguacuucuuuuucaucgcauucaacacaguugcaugcuuacauuuaucucugugauuauuuugucugccucccccaccaaaacguaggcuccaugaggguagguaguucucuucuccaccauguucucagcaccucgcccagugccuggcauagaauagaugcucaaugguaaaugaaccacuccccgaucuccuccacagagggggcccgcaacaucuccaaccagcugagcauuggcacggacaucucggcccaacacccggagcugcggacucaugcccaggccaagggcuggugggaugggcagggugccuuugacuuugcucagaucuucucccugacccagcagccugugcgcauggaggcugccaaggcccgcuuccaggcagggcgggagcugcugcggcaacggcaagguuagugaacgguggagggggcugggggccaggagggccacagcagugccagccacucuccccucccacagcuucccccucuacuccuuggcagggggcaucacggcagaggugaugaugggcauccucagagacaaggagagugguaucuguauggacucgggaggcuuucgcaccacggccagcauggugucuguccugccccaggaucccacgcagcccugcgugcacuuucuuaccgccacgccagacccauccaggugggaagaaugaggguggggaaggcuggggagaagagaggaucugauauaucuccgugcuuccaucugugccccucuaggucuguguucaaaccuuucaucuucgggauggggguggcccaggccccccaggugcugucccccacuuuuggagcacaagacccuguucggacccugccccgauuccagacucagguagaucgucggcauacccucuaccguggacaccaggcagcccuggggcugauggagagagaucagguaucccccagggaguaggggcuaccuugaggggaugauagaccucccccacucccagugggacucuggaaauaugaaggaacuagggaguggaagagauuucagagcuggggagaggaguuccucccuucaaagccagcaacugccuuuggggaaugucgggggguaucuccuuucuccugcuugugugaggugguacacaguccccccuucaccuggcgggaagccugucccggacagacucaucucagcuuucccuuggggcaggaucgggggcagcagcuccagcagaaacagcaggaucuggagcaggaaggccucgaggccacacaggggcugcuggccggcgagugggccccaccccucugggagcugggcagccucuuccaggccuucgugaagagggagagccaggcuuaugcguaagcuucauagcuucugcuggccugggguggacccaggaccccuggggccugggugcccugaguggugguaaaguggagcaaucccuucacgcuccuuggccauguucugagcggccagcuuggccuuugccuuaauaaaugugcuuuauuuucucuucagugaac

SEQ ID NO: 16803 - RNA, 3628 nt, Homo sapiens
guucacugaagagaaaauaaagcacauuuauuaaggcaaaggccaagcuggccgcucagaacauggccaaggagcgugaagggauugcuccacuuuaccaccacucagggcacccaggccccagggguccuggguccaccccaggccagcagaagcuaugaagcuuacgcauaagccuggcucucccucuucacgaaggccuggaagaggcugcccagcucccagagggguggggcccacucgccggccagcagccccuguguggccucgaggccuuccugcuccagauccugcuguuucugcuggagcugcugcccccgauccugccccaagggaaagcugagaugagucuguccgggacaggcuucccgccaggugaaggggggacuguguaccaccucacacaagcaggagaaaggagauaccccccgacauuccccaaaggcaguugcuggcuuugaagggaggaacuccucuccccagcucugaaaucucuuccacucccuaguuccuucauauuuccagagucccacugggagugggggaggucuaucauccccucaagguagccccuacucccugggggauaccugaucucucuccaucagccccagggcugccugguguccacgguagaggguaugccgacgaucuaccugagucuggaaucggggcaggguccgaacagggucuugugcuccaaaagugggggacagcaccuggggggccugggccacccccaucccgaagaugaaagguuugaacacagaccuagaggggcacagauggaagcacggagauauaucagauccucucuucuccccagccuuccccacccucauucuucccaccuggaugggucuggcguggcgguaagaaagugcacgcagggcugcgugggauccuggggcaggacagacaccaugcuggccguggugcgaaagccucccgaguccauacagauaccacucuccuugucucugaggaugcccaucaucaccucugccgugaugcccccugccaaggaguagagggggaagcugugggaggggagaguggcuggcacugcuguggcccuccuggcccccagcccccuccaccguucacuaaccuugccguugccgcagcagcucccgcccugccuggaagcgggccuuggcagccuccaugcgcacaggcugcugggucagggagaagaucugagcaaagucaaaggcacccugcccaucccaccagcccuuggccugggcaugaguccgcagcuccggguguugggccgagauguccgugccaaugcucagcugguuggagauguugcgggcccccucuguggaggagaucggggagugguucauuuaccauugagcaucuauucuaugccaggcacugggcgaggugcugagaacaugguggagaagagaacuaccuacccucauggagccuacguuuuggugggggaggcagacaaaauaaucacagagauaaauguaagcaugcaacuguguugaaugcgaugaaaaagaaguaccugcuugcauauaagcaggaaaccugaccacccagggaaguccaggaaggcuucccagaggaagcaacaggcuguagcacacggaagacuuaaccaagugaaggggaggagaauucccaagugggcucaucucccaucucccuggauguccugacaggcuugcaccuggaucgggccccucccugccccuaccaucucucccacuucccaaagcugggagaaagggaacaccucacccuggauccucugugcagcccagagccucccagcugucuccagcacccacgccucagugcggucagccagcaggaaggugcuaugguaggagaauggcgcagcauccuccaggcaguugccccccugcccauagugcuccaguaacccugugaucacaugcaaggccuccugggcagagcugcuccguuccaaagccagccuggcaaaagagagggccaagggacagaagggugacagagggaucaauggcugguggcagaagcuccaggggacagaagaggcccggagagguuuggugauaggcccaagucacacagcaaaucugcuggcacugaucguaucaaaugcaauuaugccaguggcuuucaaugcucugguuccaugugcuaugcuuugaggguuccaugaaaaggccugaaacacaguuucagagagagaaguguccugagccccuaaccucucuccacccagagcugcuccauccacuauuacugguuuuauaaauugggacucuauguaagauuucaacugaaaauaaauaaauaaccacugcucuauuucugggccaggagaggcccaaagguggcugcugcugcagccuucuucacgaaggcacaagggcaaagucugcagagaggaggaggccccugugaaccaggcugggggagggauggaugggcccaggucaaaacucagccccuagauuucuggugugucaggcagaugaggaagggcagggucugcaccugaguagguccaugcccagcagggcuucccccuccccaacuggcuccuucguccacacagccucguugccaaugcagacaccaugcucguuggcgcccaucucagccccccauagccaagaaggacggcucagaaucacagcgugcgucuucgacaccuguuccacuucaauguaggugcacuggaggugagggaggagaaaggaagcguccacucauagaggggcggccccucgaguguggcacucugccaauuaccuuauagaucccuuugaggaaggucucauucccauuuuacagaagaggaaacugagguagacugaggcuacauaaugagcucagguccagguugguagaccuaaagcucaugcucuuccacuacuucuggcagccucccagguguggggagcagggaagaaggucuuaaaagaaugcagagaucugccacaccucccagcaccccauaaagucuaacccaccuggagccggcucccaggagugugagugccugcggggacaaacaccaccuccugcaccucgucccggggucgguccgaguucuuggcaaagaucacagccgggauggcugaggccgggggcacggagacaaagcagucgcaggaacauggggagucagggcucgacgacgccaucuggggagaggcgggccucuccauaacccuggccacggcucagccccgaggagcagccuacccccacacguguaaaagacgcgcaaggaagacaccgccguggcuccuggacgcucggcgcacacaccauggacgggugugcgggaacggaggugcccacccucuccccaggcuccaggcuugggaguccgcaggcgggcacuccgggggucccgcccccacugggagucccggcccuucggagcagucgugggaccgucccccucgcuaccccaccaagaguccugcggcccugcgcaugcccagauacccgacccucuucuguccaacccuucucucacccccaguacuguauuccccucacccucucuuccuccaagaccccagcucggucccgggugccaccuccuccgcuucuggccagggccgccccauugggcggagacucucaggugaccuggaag

SEQ ID NO: 16804 - RNA, 17988 nt, Homo sapiens
ccggcggcggcgacagggcgaggagcagagcgcgguaccaggggggugggggcacuggugcccguuuggggagggagcaggcggaggggguaagcugcgauuacaagcaggaaccggcagcagcugugaguccccggcuggggcuagggcugggggaggggagcggcgcccgggcugggccccaggggucgcggggugggcaggaggaggcggcaggagggcggcuggcagccgcacgggauggcugggagggaagggguccggugucggccgcccucauccccucgcgucccccuccgccgccguuccucaggccgcgccacucccggagccccuuccccggccccgagaggguguccgggggcccagggcucggccgguugugggggagggggcugcguggucucggcccccgagaggggaggggcgacaauuucugucggccgagcgaaagggguuuaaagggcggcucuuaaaggggccgcaggaggggcccgggccgacagaggcacucaccccuuccccagccgccuuccauugcgcucacccgggcgcugggcccagagaggaaugcggaggaaggaggcauuuguggugcggccucggggacagagccccgccagcggggugggcgcagaggggcgggcgggggucugggggggugugguaagcgcuggcgcgcggagcuggggggaggggauggcgugggaaggagaggguuaaagguggggccggcccuacaaacgcgcgcacacacuccuuacucagacccagucacucgcguuucccuggcacuuagaugggccuguggguggcggagggggggggguggauugaauuggagccugcgccggagcccuuugcaccccaagcuccugcagcccgaccugggggccccgcugucugaacucacagcucccugccgagcccccucuccggggugcacauaacgcuccagcgcgcgcacacaccucggacaguccccucgcgucucacgugacacgcggcccggacgugccacccugcccacgcgcucacgcacgcgugcacacaccagccuccuggucgcugccccacuccgucccgacgccccugcgaccccgaaggcacucauugacugacacaccuacacucauucacagacgcacacuccccccauacgccaaccccagacacacauucauaaccaggcccgagagaaguacacacgcacccccucacugccuacuccugcuuucgggagccugagucauuccugcccccucguaggguuccccauuucccggugcgcgggcacccugagacagccuugggaauucguucgcguccccuuccaccuggguccccuuccccaguuugcgccccguaacacucagccaaggacuuccugugggucccaggucaggggccaagggguccuggaccgcugccacagccccggugcgcccgggggaggcgcuuccuuuuccugaacucugggauccugcgggaggaaguggggaaguugggcgggggugcagccgagggcgugccgacuguggaggggccgacccucgcgcagcucugggccuuccuuggggaggagcuggggugccagaggcccaggcugaggagcuuggcggcgagguauuuggggaaguaaggccugggguggagaagcgcggaggaaugggccgggcccggcugggaaggcagcccucucccauccacaggucucccuggguucuggcaggagccugccccugcugccggccuggcuuacuugucccuacuugucaacacccuggcagcggggucuucaccugguuccagccccuuuuccccaaggcggcagagaggauggggcugaggagucugggaaggggccaugggagucccugcugagcucggggcaggaaguuucuggguugcaucuuagccggccccagggagugcagagccagggagagggguaccagggacaaacccuagacagacggcccuguccacgguugcuccugcucuccuaggaggccccgugugggccgcggcccggcccucaccauggaguccauguucgaggacgacaucagcauccugacgcaggaggcccuggggccuagugagguguggcuggacagucccggagaccccucgcuugggggcgacaugugcuccgccucccacuuugcccucaucacugcuuacggagacaucaaggaacggcuggggggccuggagagggagaacgccacccuccgacgccgccucaaagucuacgagaucaaggucagaacuuggagaggagggcgccugauagaguguaugggauggggagggggacugggaaucugguagauaccagggauccaaaagaggggucacugugcagacucuugggaacuugagggucucccaugagagacguggcuguuccggaugcgaacugucuccuguuggcuucagaagggcuggaucugggaucuaaaacagauccggugggugggagauggcuacagacccaugggaauugggaucccacuagccaaggagaaggagggucaaaggucugaggcagguuguggguugggggcacagccaggcugaggccugggcugggcacccgggaauccacucuccugaagcuccaccccaccugcaguacccacugaucagugacuuuggagaggagcauggcuuuucucuguaugaaaucaaggauggcucccugcuggagguggagaaggucagccugcagcaacggcucaaccaguuccagcaugaggugagccuaccaggcugggcgcacccccugagcaucuugcuccagucuguuucugauacccuucccuccacaccccccagcaucuggccucugcccuuugauuagagauggccagguccucccuaagcccagcugcagcuccuccugccccuccauagggugcugggaguggggguggggaggugcagggagcucuccaacuccaaguccagugugggacugacccugugguggggcccucugggccucauccaguuacagaagaacaaggagcaggaagaacagcuuggagagaugauccaggccuacgagaaacucugcguggagaagagugacuuggagacagagcugagggagauggugaggccuggggagccggaggugcuugaggauguguagcugguugugugugugcaugugugcauuuaguucugugugugaggauuccagccugugacagugcagucccaugugucacacaucacuuguuugugcccugcuuguguucauguguaucugugagugcccgcccauuugcccuugugagggagacugcauguguuauccauguugcggugucugugugcauccuggccaugcaguggccccgugggaaccucugucucuguguguaugccuggcugucacgcuggggugacccugugccugugagcacugcccuggcucucacgcuggggugacccugugccugugagcacugcccuugggaggcugugagggugagggcagaggugaccaggagugugugacugcuaggaugggccugugcuugggugugcuuccgagucaggguauggcugugccggugagcaggucaaaaucaagagacaggccagguaugguggcucacgccuauaaucucagcacuuugggagguuaaggaguuugagaccagccugggcaacauagugaaaccccaucucuacaaaaaauacaaaaaagaaguuagccaggugugguggugcacaccuguggucccagcuacucaggaggcugaggugggaggaucgcuuuagcccaggagaucgaagcuuuggugagccaagaucaagccacugcacuccagccugggugacauagccagacccugucuccaaaaaaaaaaaaaaaaaaaaaaaaaaucaggagacauggucucagccaacccuaagcuaugaccucaguuaagucacuuagccuccaucccuccucugaaaaguggggcaaauauuaacacccucaccagguuguggugagggugauggggcauucauguauagaugcuuugccuucauaaucauagauauuuauguggcacucggggugugccaggcacuguucuuuucaccuggcauacacuagcucauuuuaauucucaaaacaacccuaagaggugagugugggacuguuauccccauuuuauggaucaggugggugaaguccagaagcucuugucauguaugcaaauggaaguucugaugcuccugaggggggcuggccuccaaacagggggcugaguguucuuuuaagugucccuguguguuaaugacagagcaggggcauuaacuugaccucgccaggggcaacagcccgcaacagcugcauugcgguggcugagaggagacuuugcacucacagccacuuggagagugggcuugggaugugugaccuggggccucugcuguagucuggggugaugacucuccagacauggggaaguccugggccugugcagacccuccccucugucucucucuccagagggcccugguggagacgcaccugcgucagaucugugguuuggagcagcagcugcggcaacagcaaggccuccaggaugcagccuucuccaaccugagcccaccgccagcccccgccccucccugcacugauuuagaccugcacuaccuggcacugagagggggaucuggcuugagucauggugagaucucagugaccccgacuuaccuccuaguccccaacccccauuucaacauuccuagacaccucgcacuuacuuaccaucccauuuguaauauaaucuauuucuccauaaucaucccauccucccuuaccugcuguccccucaccucacccacuguuacccuaauuucuccccuucuaacucggucauuccugaucaccucguugcaauuccugugccugccagcagagggcgcccccacccagaguccccccgccccgucucuggcugugacuaggagaggcccuugcagaugcucuagacuugagucuggccaguaaagccuucaagagcccaucuuauuuuuuuccuggccuccaggaaaauuagaaaugcggcucagcccaucuuuccucgcugcccuugucgcagucaucccuccuuggcuagcuguccuggcuucucucuuggaguccccaugcugcauccuccuguuucacucuggcucugggagcuggaggaggcagcugagcucgccugacguuguccuguccaccgacagcaggcuggccgggcuccacacccagugugagugaccuggagcggcggcggcuagaagaggcuuuggaggccgcgcagggagaggcccggggggcucagcuccgggaggagcagcuccaggccgagugcgagcggcugcagggggagcugaagcagcugcaggagacccgggcccagguaaaugcaggggccuggaacagcuucuggagguccagggcugggccuuccccacugugugcagacuggcccagggaacuguagacaagggcccuggcaggggugagcuugggcucugaccucuucaucuucuuccuuaggaucuggccuccaaccagucggagcgagacauggcgugggugaaaagaguuggggaugaucaguaagucacauugguaacccuggucccuccgugauguuugggagaccuccccucccagcccucagggguguggugucugggcugcuguugcucugugugcauccuucauaggaaggaggugggguucuuuuuuuuuuuuuuugagauggaguuucgcucuuguugcccaggcuggagugcaauggcgugaucuuggcucaccgcaaccucugccucucggguucaagcaauucuccugccucagccucccgaguagcugggauuacaggcaugcaccaccaugccuagcuaauuuuuuuuuuuuuuuugagacggagucuugcucugucacccaggcuugagugcaguggcgcaaucucggcucacugcaagcuccgcguccugguucacgccauucuccugccucagccuccugaguagcuaggacuacaggcgcucgccacuacgccuggcuaauuuuuuuuuguauuuuuaguagagaugggguuucacugcguuagccaggauggucucgaucuccugaccuugugauccgcccgccucggccucccaaagugcugggauuauaggagugagccacugcgcccggaccuuuuuuuuuuuuuuuuuuuuuuuuuuuggauuuuuaguagagaugggguuucuccauguuggucaggcuggucucgacuccugggaggugggguucuugaguguuugggaucugggacauucccuuugcuuuccucuggggcccaaacccaucucuucuggagaugccagggcuaagugacacuuacucggcugcuuugucgcuguguccaguguaauguccccugcugagcuuuugggccuccguagggccccauuuucuauuccagugacaaggcccggccaguuggguucacccuccccucccuagugaggaagagggaggugguguuucuugggauuuguugggccuugucugcugaucucaggagagagaagccugaggcuuagagacaggagagguuuccauggguucacacagccgugggguggggaguuagaaucugcucugcuaggguacucccuugaauccuaccaagaaaggggcagcagagagcggcaagggagcuguguugguggggggcccagugcuggggccuccaggggggcacuggacagcaagggaggggugagcagccacccggcaacaguggaaccuggugccuuucacauccgcacugaacucacccucucccacuuucugagaaauagagcucaaaccucuuuccgccuaaguccucuccccuaagaugagcuguguggcacagacucccuacucuaauuggaggagaagacugaggcccagagaggggcaggaacuaacccuccaccgcauagcauacccagcuccggggcuccggaggucuccugcccagcaggcuucuuccuuaucugccucccagcuucuggccaacuggggauaccccucgccuaccucccuaccuaagagugagggcuuggguggagcugugauagcuggggagguggugagaacccaguuugugggacuggugggugggaccccucagcuaggccuuuguggagaggguccacccuagcuuguggcuggagcuuggggcccaucauagcccaugugcccagaccuggaacacacagacacacacagacacacacacacacacacacacacucucucucucucucucucacacucuccaauccuagcuugccccagaagucaugauguagggcccuucaugggucacugaacccaguccccucuuaccagaccagcagugaaucucccugaauugguagaacuccaagggaggacauuuugguggggcuggagucuggcucuucagguuuugaaucccaggggccuuucuuuacugacuuggacucuaccucucuggauccaguuucccucacaggcucaggggccagucauugcugagagaugggagaggaaggugaggcgguggguagaagcagagaaggggcagggcucccaggggccaagguuguauugugugagugaaaggaagcccacccuauaaggggcuaggaggccguaucauccacgcugcccauucuggcaagagcagccccuucccucucucucucaaggcuccugcccuucucaggcccuuuggcuggagggagcuggccucugcuugggggcuggccccacaggcuuacuggaggccaccuccuggcuccuccccuccuucccugugauuaggcucugccuccagccucccagaucucugcaucuggagccagccaggcucugcugcccagccacacgcuuccuuucaggccgagcgagcaucucuggacagcccuaguuuggcgagcguuaauucucagaggaaguccucacuaccccgauaguuuuauuuucuuauaaacucagcuccuuuugguaauaggcugcuucccgagugcucccuccccuguccuuccacccaaggaagccucagucacuugcuuucagcuccucuucccccacuagugccccucuuucuucuguuuccaccugacuuuccaggcuggugggaauuuuacaaguaggcuuuuccgggaguggagugagugucgaggcuggaugacccagguuuggggugugauuggggugaggaggaccaggauaugaaggcugaagagggguacacccaauuccugaguccagcccacucuuaggcgggagucuucuguauggugaacucuguauguauguaugcccaccugucuuggucuagacaccuccggggcagccaguuuuauugcgggaguccucaagguuaaccgcccccacccccaucucuauuaauucccuucucuggauccuagccccagccccaggguuucccaguuccuucccucccagccccuggcccacaaguucuggccauuaacguucccacgaaaacagacacccagaccagaccgaggcagacuacuacccuccaggucugacccccugggaaacccaugguuugguuugcccagcuccuggggacagagcccagggagacaaauugccccagaggaagagccacugggggucacgcagaggccaaaggcagugaugagggaggcggugggagcagagcccacccugcuccugaggaugcacagggagguaaagacccugacccuugggggguucccagcccagguggaaggcgcagcacccacaacccccuucucucugggcccagcuccccagccugggguuccagaguggggccuuuuggaggguauggccgugcugagggggaggggaaaugcgggggggggaacuucuugaaggggaugagggcuccgaagggacagggggucugugaggggaauaagggcccgguaagggagggugggcucaucugugcgggguccaucugggagaagauggggacucaguaugggcgaugaggaaaaaacuauaggccuuucuuucuucccaacguugggggcucagcgcugcagcccgggcccuuuuccgcaccaccuccccccccaccccucucuccacccacaagccucugcgugggcugcgguuaguggugggaagaagugugaacucgagagagaggauggaaacucugcacggaggucaagggcagcguggggugggucaggacggaagucggagacccccgcauacccugagcguagccucaugccccagaaccagcaggcccagggccucccccuucacgcuucucacccucccuacuuccuuucuuucaagucuccuucggccagggcacccgcgcugcacucacaggaguuaaccccugagcacuugcagccucgggggcucccagaggcuaggugggucugagggaugugugggcuuucagccccaguccuuggugcuuugccugccagcaggguggggagcagcucaugccagcgcccccucccucgaugggaaacgcccaucuucccuccuuaaaccgaagccacuaggcugcugucuccaaaaaaaggcucaaaacaaguuuccccccuucuccaccuaucugcuaggcacuccccugaaauuuuuuuuuuuuuuuguccaugccagacacuaugcgaggugauuuaccuacaaaaucucauuucauucucacaaacgugauguagguauugucccccuuuuacagaugagcaaacugaggugcagggaagugaaguaaucugagaguucaguaagaaauucagugcagaugccaaguggguccugagcagaucgggugauggcaccucugcgguguguuucugguucagguucuucuucagguagaaagcccuuauaugaggggcaaccgugugauuuguugaccagacuggaucacuuuugaaagugaaagggggcacuauuaauaauuaugcuggggcaacuagcgugaacugggacaguccuaggcaaacugggaucucugggcaccccaccuauguaggaacccugguuuccaggccuaccccugagcugcuccaaucagcugcaucugggaagcuuucuagacccgggaugucagcucugguggauucguggcaggggcugccaugaagagccaggcucuggggaccccaccagucauagcuggucgaggagagagaaggggcucaaggcgcccgaaaggaagugguggagcacuggguuguugcaaagcaacuuccuccuccccgccggcccgcaaccucaaguccguuccacggcccggugccugugguccccuccccgagggucgggcgggaagacugaugcugggugugccugugggugguggaaaguuuggucccuaaauuaucccacaggggugagguggcuggggcagcugggggcagcuuugagcaaggauggaagggcccuggaagguuggauuucuguuuuccucccaauucugaaucagacgaugauucugaccacauggacagcucuaaaccuaacccuaauccuaacccuuuuacugcucccgucccugacucuaacccuaucccugauccugaccuucagcucuguccacaaucuuggccacgugcuacaucaaccccacuccuagucugacccuggcuccuuuaauccuguccucaaggcaguccccagcuuuaucguuuccagaagugugugagaucugugaauuauucguggaaagacugaaugaaaggaugcgaagcguggaauauuugcagcccagggggcccuccuuccugccagcucugccauuugcucucuggcuccuccgaaguugccagcuuggcaggcugaggugccaagaaccuguguuugaaucugcugugugccacugccacucugugaccuugagccagccucuuaaucgcccugauuuucuacuuccacaugugucuagcaccuuccuaucacccccagggaagggguggugauucucagggcuuccaggccacugccaagguccccaguccccuccuccucuucgucuuucccuucuguugcugccuugccuuuccucuccccuccuucccgcuucuuugggggacguuauagcaugauggucaguagccuggacuuuggagucuagggggcagagcucccaucccagcaacuccauugcuaguaggcuuuaugauuuuggucaaguaacuuaaccucuguaagccucaguuuucucaucuguaaaaugaagguaacaguggcaaugccguaggguuguuguggagaugaauaaaguucucagcagagugccuggccccggggugagcacucaaacagaucauccgauucuuuucucucugggugccucccagguuuugaaagacucagaacuuucuccugucauguaagcaauaaagcagcauccaaaugcagccaucugcugccacuuaccugacccauucuucccaagcagucaugauggugaaaaagcacucaggugugggccaggaagccaggaaauggaauguguauuucggugcacgugugcaacucuugguuguguugugaaguugagauuuuuuuuuccacugaauuggcaguguuuucagugagucauucaggucguuagcaucuucagcggcccaggccugugcaucuugagauggagagagacacccaaugaagggggaggucccaaaaggccauggggcaucaggaggaggucaagucaaucaccuugccggggacuuagcagucuuugugaggguugccugaaguucuggguggacagaacccaccugccucaggccccagguggcagagcugggagaggggcugggcauugugggccagggcuucuuccuuccauuuucagccacccugucuguuucacugugagaaggaugccaggggcugggugguagaaacugggguagcuccugacaaggggagggaggcaagcaggggagugacagggaccugggaacugaguguggcaggugaaaucucugaggcggggugugaagacgacgaccuguaucugucgccugagauacagcagugaaaauggauggugagagaagcuuuggcuauguggacagaggaccacacucugucugugcccugcccagagcccucuccuuccccugcugccaaggagauagcacgauccugcccuccaaaaaccgccagucugaugggggacacacagcuccugcccacagauguccucagucugaaggggaagccuucccuuggggaguccccaauuugacgugggacacaccuggaccucccagucugaugggggagaugccauuucuucccacagacccaugagcugaggaugagggggcacaggacacauuuaacaaaaacaagggcugagaugugaugggauggaggcugcagggucucagcagcagcuucugggacuccuuccucucugccugcccagcccugcucaccaucagauggguggcgaggacucccucccuaagaagagggcugucucccagagaccuggcccauuugcaguaauuuggcuuuggcccaaguggguuaaaaauagucuugugggaggggcaguuucugccccaggauuaguaagagacagccagugagcgacagcagggagccuagucauuaucuacccucuccaccucucuuuuccugcccucugaagcccuaaccucacgacuuccccuccucuccuuuaggguuagacuuagacacacacacacacacacacacacacacacacacacacacacgcacacaccccuacgcucauucacgccuuuccucauucaucagccuggccucacaccucucuucacacucucccauccacauguccaucacuaugggauggggacagggcccuccaggcuuaagaacuugagcccccuuguccugggacaagaccuccccugggaagagaucuguguggagugacaccugguauuuucucccagcuccaucuuccacuaaguuccccgagucccuucuggagcuggagguggggagagccaaagaaaccuaaaucucugccuucagggagauucaaggcucuguccacacucagaacagugaugaaggcagggcccaagggcauggcagagcuucccaugaggucagggagggcuccuggggccgugcaggccacagugggagaaagcagagagcaguggagugaugaccuuccaugguucuggguugcaagugaccuagagauaaaggaagugggugagguuccuugccaagucuguuccagcuccaugagggugggugcccaagaugccugaacaggaagcagggaggaagaaagggaaggagaaagaaaaauggagggagaggcucaaaugcauuauccacuuacugaacaucugcuggguuccaggcccuggacaagguggugggaauauaaauacaaugacguaauccucaccaucaagaaacuucccauaaaguucuagaacaaggcagccuuugagaagugccuggugugacuggcacucacugcaagugugcaguguacagcagcuguucacaaagaucucaguguuaaggcccugguggaguuguacagcaaggagguccugggaggggcaaagcugaaaagagcccagaggcagcuuugaggucgagccaggugcaguggacauggaauugggcuggcuugggguuaaguuuaucaguuagcaccuccaccagccaggaaaccaucuucacuuauggaacgagcuauucuaugcagcaggguccccaaccuuuucaaaggugaggacucuucauggaucccacucccaguacacagauuauaacacuuuuaguaugcauugcuugagaaaauucacagugacagaagcuacuauaaauucaguacagcuuuuugaugaaucggugcuuuaauucaucaucacagcuuuugcacagauuagaaaaacauucacacauaccuguaugagcuguguucagaccacggacagugccugaugcagggauucagggagcccuuggaaucucucugcucccugucccugcacuuaggcugggaaccacugcccuagcccagggaaugggucucaggaugcagagggagucucccuggaagagguggcuuuugagcuggaccuuaaagguagggaggauuucugcaauugggguaggagggcccugcgggugggagggagcaugguggggccagaugcugggguagagccaguucuuccuccacagcugggacgguagacccacugcccuucucgucuuucccacugcccucugacuucagggugaauuuggcgcuggccuacaccgagcugacggaggagcugggccggcuucgggaguugaguucccuacaggggagaaucuugaggacucuguugcaggaacaggcccggaguggcggugagauggggcagggcagggggaggcagccgcgggacccgggaaggagcggguagccauggcaaccaucuuggucauggggaccacccuuuauuuccuuuccuguggccuggaguuggugggcauggguccgggcaagccccuggcgcuccaguucugaggucuucucucugcaccuuuguccccccaccccgucccgguuucucuuccaggccagaggcacucgccgcugucacaacgccacuccccggccccccagugccccucccccuccccgccugcccgagcggcucccccgugccccccgugccagucccccgucccccagcgccgcucucccgugcccccgugccccucgccgcagcagcgccgcucuccggccucacccuccugcccgucgcccgucccgcagcgccgcucgccggugccgccgucgugccagucccccagcccgcagcgccguuccccggugccccccagcugcccggccccgcagccccggccaccgccgccgcccccgccgggcgagaggacgcuggccgagcgcgccuacgccaagccgcccagccaccacgugaaggccggcuuccagggccgccgcagcuacucugagcuggcggagggcgcggccuacgcgggcgccuccccgcccuggcugcaggccgaagcggccacucuccccaagccccgggccuacggcagcgagcucuacggcccuggcaggccccucagcccgcggcgcgccuucgagggcauccggcugcgcuucgagaagcagccgucggaggaggacgagugggcugugcccaccagcccgcccagcccggaggugggcaccauccgcugcgccuccuucugcgcgggcuuccccauccccgagucgcccgccgccaccgccuacgcccacgccgagcacgcgcaguccuggccguccaucaacgugaguggggcgcccgcguuccgcccaccccggaccgggccuugagauugagaccccagcgccucacccuccguugagggccuugccccuuucgggugucagcgcacaaacuauucacccuccuuggaccccgggccacagucuagguccuuucaccucccuuucccguggucuucugucaccagaaauuggggccugccccauuaagauuucguucauuuccuuggauaaggauauggauuuuggagugagugacaguucugccuuugauuccaaacuccaccgcuuaauagcugugggaccuugugcaaguuacuuauccucucugauccucaauauucucaucugcaaaauggggacaaugauuauaguaucugacuaccuuacaggguucuuaagaagcaggcagugagccuaaaguggucagcacagugccuggcucaagcaccugcuauuauauuggcuguggugaugguggcuacugaccauagcaggccaccagccaacacaggaacaggccuguuuauccagcucccuucuucaggccucagagcccuugcccuuuucugucuguccugaaagacagaagccuaucucagggcucaaucauuucacugaaauaaugaguucccugaaugucagagccacccauuguaaccuggaaagaccaaaauauacuccaaagccagacagaaaauuauuuugggguuguaccuuguuuaggaucguacauugcuuugaguuauccgggagcugucuuagucacucugggggcaugucugggucuuggcuucucucauuaccacagaugcccuggcaagcuuagcagugacucucucauaccugccuccuggggacccugucccugggcagggggguggacacugagcuggugugggggaggacggugcugaagaaaggguggcuggaccccuccugcaugccacagcccucccugcccuggguccugggacagggcaggcugggauguggggaccaugggugggggcuggggaccauaagugacuuccuucucucucgacaguugcugauggagacggugggcuccgacauccgcagcugcccccucugccagcuggguuucccugucggguacccggaugaugcccucaucaaacacauugacucccaccuggagaacagcaagaucuagggcaccagccccacccacuggcuguuucuccguccucuccuaucacccccaaacacucacuuugaaugcugcaugaaucucguggggggucccugcccuugcgacccccagauaccuccacuugcuaccgagucaacgugugugccaucuucccugguccaggcaccacucagcucuggcucuuccugggaggucagccgaggcuccccccaugcuccugguuucugcuuaggagguggggacuugggcugggauggggacggcauaccccucccaggccucucccucugccuuucuguucuuaaucaggguuggauccaagaagguguccagugcuugggccugggguggggggaagguguuagaggacuccaggagcuccugcaccccuccccaaauguccaucuuucucagacggggcucugucuggggagcacccacaggcugccuuuggggucccagagccugcucugugcacugaccccaguuccuccauccuguggccagccuagggcucauggcaugggcccccacugggggagggaggcaucuuguuucuugugguucccugcaggccaguccuguccuccuuucccuguucugcccacucuggggaauagggaggggaggagaggagaggagagggaggauccuggaggacugggaagaucuagccuaaagaggcuucucugagggccagggcccuacagcaugccccuacggccaggggacugucugccagccucccaggcccaugcccuccuggugccccuggcacugaggcacagaucgucaaggcagguacccccucaacccuucuuccacuggagccccugacaccacaggugcccuggagcccuugugugacucagccucuguuagcugggugggugucaucagccccugccucccaggccagaaccugagaacgggcccagggugcuguggagaucaacuucaaaagagcuaaccccuucccacacuccacccacccaccuacauuuccucugugaaaucuaccucagaguuguacccucagaaggacggguaagcaggaggccaggggguccccagggcugagguggggagccuucuacggcgaaagccugccaccccacaaugaauccacccugcuccacugcgcgccucucccaggucucagcucuggguggggagcaguggccgcuaccgacagcgcaugucccgcucuuauccaacucuuccaggccccaccucccugcaccccuccccucuauagagcaggggagugaagggguaugucaggcggggaaggggccaaggacacgucauuguacccugagcguccccagggaguggaaauggggaagggggccuggagaggggaggcaggggccccugugcucucugaacaaguugaaaguccaaauaaaacuuaccuguuccaucugu

SEQ ID NO: 16805 - RNA, 5363 nt, Homo sapiens
cagcccgcgggcgcggccuaacugcucgccccgcagcuugccccggggcccgagggucgcuguaccugggcggcggccuccagcuugcccucgaaggugaaguccagcaagucgggcuugaggcaaaggcugcaguugaugggggagacaucggcaggcagccgcucgaagggccucuucuccggcaucgcggcgaggcccaggcuguggaggcggcggcgagaggagcggcugaagacgagaaggaggaggggaggaggcggagggccgaggaagagcaggcggcgagcgagggagggggcggcagcugccagccacauccaccgagcgcgggcgaccgccggaggagagcgaccgggggagccuggggggcgggggagagacccagccggagcgcuagggguugggaaggaggcggugcgggcggacuggcgggcgagcugccuacggggaagggggcggaggggagggaaggggaggagggccagcaaggagggauggagagggggaagugguggcggcggcugcgugcgcggccccgccggccgggcgcgcccccguggagugcgcgcgcacgccggggcagagggcggagcggcgaggacgagggcgcggccggcggggcgggagggcguaggguugcccgcgcgagcgcagggcgggaggcgggcgcugcaccugucggcgccgcucaggacugggggcggccuuccaacuggaaggagccgggaagggcuugaucagaggaaggaaaggcauaaggggcccucgggaaacugaagccuacgcaguuggucaguucagccagggucgcaugcauaaaauaccaguuacaagcaaaaccccaaacuggauucugccuccaggucagcgaaaagcccugacuugaggcucucuggccucaguuccuguuaguagcaaauucaaaggaugauuugaaaguuuuguuauaaaaccuuuaauagccgggcgcggugucucacgccuguaaucccagcacuucgggaggccgaggcgggcggaucacgaggucaggagaucgagaccauccuggcuaacauggugaaaccccgucgcuacuaaaaguacaaaaaauuagccgggcgugguggcgggcgccuguagucccagcuacucaggaggcugaggcaggagaauggcgugaacccgggaggcggagcuugcagugagccgaaaucgcgccacugcacuccagucugggcgacagagcaagacuccgucucaaaaaaaaaaaaaaaaaaaaaaccuuuaauaaucuagguuacuucaaccaaugagaucuggacuuuugagggagugauuucaaaaacuauauuuuuguuuccaugauuuaauguuuaaaaugggauguuucgggcggucgcgguggcucacgccuguaaucccagcacuuugggaggccgaggcgggcggaucacaagguuaggaguucaacaccagccuggccaauauggugaaaccccgucucuacuaaaaauacaaaaaaaaaaaauagccgggcuugguggcgggcgccuguugucccagcuauucgggaggcugagguaggagaaucgcuugaacccgggagguggagguugcagugagccgagauugcgccacugcacuccagccugggcgacagagugagacucugucucaaaaaaaaaaaaauaaauaaauaauaaaauaaaaugggauguuucaccuuuuccccauuuucaucuuuguuucuuuuuaaacuaaaagauccuucagcaaucauggccucuuuaauggugaacuaucuguggcucucucaguucuguagauaccuugcaaauugaggagguauauauauaaaugcauauauauauauauauauauauauauauauauauaguaacugaaauuaucuuuaaaaaggggggccagggccagguacgguggcucacaccuguaaucccagcacuuugggaggcugaggcagguggaucacgaggucaggaguucgagaccagccuggccaauauggugaaacccuaucucuacuaaaaauacaaaaauuagccuggcauagugucaugugccuguagucccagcuacuagggaggcugaggcaggagaaucgcuugaacccgggaggcggagguugcagcgagccaagaucacgccacuacacuccagccugggcuacaacgagacucugucucaaaaaaaaaaaaaacagugggcccagguguggugacgugugccuaugaucccagcuacucgggaggcugagacgggaggaucacuugagcccaggagguggauggaggcugcagugagcuguaauggugccacugcacuccagaugacagagugaggcccugucucuaaaaaaauaaaaaugaaauaacaauuuaaaaaauguuauuuaaagugucaaaggcaaggagauuuauccauaaucuucauauuucuuuauagaaauuucucagauagaacccuguaauuuccaaaacugaauguaguauguuguaauggaccaguacuguccagcagaaacauacugugaaccacuagguaguauuaaaucuuacaguagccacaucacaaaaaaguaaaaaggaaacaaaugaaaacacaucuuauuuaacccaacauauccaaaauauuaucauuucaacauguaaucaauauaaaaaauauuaaugaggccgggcacgguggcucacgccuguaaucccagcacuuugggaggccaaggcaggugaauaaccugaggucaggaguucaagaccagccugaccaacauggugaaaucccgucucuacuaaaaauacaaaaauuagccaggcaugguggcgcaugccuguaauccuagccagcuacucuggaggcugaggcagaagaaucacuugaacccagaaggcggcgguugcagugagcugagaucacagcacugcacuucagccugggcaaaaagagcgaaacuccgucucaaaaaaaaaaaaaaaauuaaugagauauuuuacuuauuuucuucacaccaacuuugaaauccagcguguauuuuacauuuauagcacaucuaaauucugacuauccacauuucacgugaucaguagucacgugugguuaguggcucuuguacugggcagcacaauuuuggacucugggccuggccucuuagccucugaauccuacauacuuuucagaaaggcagauugaaaaucugcaauccuuucaaacuaaggugugagauggggccuuuucuuauauauauguaguucuaugaccacuuacuggucagagaaauaauaauuuaaauaacauauaauaauuuuuuuuuuugagcuggagucuccucugucacccaggcuggagugcaguggcgugaucuaagcucacugcaaccuccaccucauggguucaagcaauucuccugccccagccuccucaguagcugggauuacaggcgcccacgaccaugcccgacuaauuuuuguauuuuuaguacagauggaguuucaccauguuagccaggcuggucucaaacuccugaccucaggugaucugcccaccuaggccucccaaagggcugagauuacagacaugaaccauugugcccagcccauauaauaauaacuuaauuaacuguaauugaauguuuaucgagugcuuacuaaacacuuuuuuuuuuuuugagauggaguuucgcucuuguugcccaggcuggauugcaauggcaugauauuggcuccugcaaccucggccccccggguucaagcgacucuccugccccagccuccuaaguagcugggauuauaggugcccgccaccaugccuggcuaauuuuuguauuuuuaguuuuauuuguuuguuuguuuuguuuuguuuuucuuguuuauuuuuucuuuuuuucuuuuuauuucuuuuucuuuuuuuaauuuuuguauuuuuaguagagacuggguuucaccauguuggccaggcuggucucaaacuccugaccucaggugauccaccugccuaggccucccuaagggcugggauuacagucaugaaccaccacgcccagcccauauaauaauaauuuaauuaacuguaauugaauguuuaucgagugcuuacuaaacauuuuguuuuuuuuucuuuuguuuuggguuuuuuuugagaugcaguuucgcucuuguugcccaggcuggagugcaauggugugagcucggcucacugcaaccuccaccuccuggguucaagcaauucuccugccucagccacccaaguagcugggauuacaggugcccaccaccacacccgguuaauuuuuuuguauuuuuaguagagaugggauuucaccauguuggccaggcuggucucgaacuccuguccucgagugauccgcccaccucggccucccaaagugcugggauuagaagugugagccacuaugccuggccaacacuuuucauauauuaauucauuuaauuauucucaacaacucugugagguggacaccauuauccccauuucacauuugaggaaacaggcacacagaaauucaaggacuugccuaaggucauacacuaauaauugguagagccacaguuaggaccuaggcauuuuuuuuuucucuccugagaaucuugcagcagauucccuguuguucugacucuccaguuuuguuuuguuuuguuuuguuuuugagacagagucucgcucugccgcccaggcuggagugcaguggcacgaucucggcucacugcaagcuccgccucccagguucaagccauucuccuuccucagccucgcgaguagcugggacuacaggcacccgccaccaagcccagcuaauuuuucguauuuuuaguagagacaggguuucaccguguuagccaggauggucucgaucuccugacaucgugauccgcccgccucggccucccagagugcugggauuacaggcgugagccaccgcgccuggcccuaacucuccaguuguauuuuauuauaguucgucuguuucucagcuucucaaaauguuauuuucauuaugucuguuaaagcaaauuuaauucauaaccauuuaaggcucuccaugaacuguccuuaucauuuucccagacuuguuuuuucuuauccuuuaacauauauucuccagucuuaacaagcuaaccaguuuaaugcuuggcccuuacagcuugcucauucuucucuucucuaccauugcucaggcauuauugcugguaugaccuccucaucuuuuucggcaaaccggggccccucccuuccuucaacacucaccuuuuccagaaaguccucauugacuaacuccacccaacucucuuuucccaucaguucacaaguacuggcuuuugcugauuuauuuguacuuguuc

SEQ ID NO: 16806 - RNA, 24642 nt, Homo sapiens
gcucuucggauuuuuuuuuuuuuuuuugcaaaacauucuuuuauuaaaagaacaagugcuguuuacgaacugcccuucguacaaauaacauccguuauacaaagauacaagauccggguuaugcacaauuccaggcuuggagguggcaggggggcaucgccuuugggcugaggauaucaagguuuuagaaagaaugaaaaaggagccccuggguuugcaaucuguggcuuccccucccugcucccuaggaagggucugcuacauggaaacagguugggauagaaagggggcgggacgggagcaggggugaggucuccagucccaccacccaagucccaaguugagcuggagaaagugaacaaaggggaaugaaggcaccccucaguucccaacuuuucaguaggucaagacaaaguggucgggagcuagacacacucucaauccugauggacauggugggagagagccaaggcuacuugcccaccuuccuuggaauucccaguugaaguuaccucaaucccucuaggcaccucuccccaggaaaauaaguugagauaaaggagaacugggugcaagcugccuaccccuaacuggcccauugcacaccaaggaagauccuagaagcuggcagggggagccugugccuuugaaaaccugucuucauuuccaauuugggagagagaagcguggagguuacccuuucucggagcuggccccuggcuugggcuccucucauuucucuagacccuuccuaagagucuggggugagcaccucccuagaacucaguaugggggaaacaggcagggguccccucaucagccucaaggucaggacaccuugaggcagcagcagacccaggagccugagggggaaaauaccccacaaauaggaaaaacaaaccaagacaauccuuaaagugucauuguccauggagaggauccaccagcucugagcuaagacagucagugccacauagacacccucccaccccgggcacagcccugcacucacaccgugugucacacacacacagggacagccagccagccagccauguggagaccauguuguggggcaggggaaccaagggccaggaggccacaguccugagggcuuguccuggcccugucacugagccccuucuaggcuuggagcugucaucugugaugggaggagcuggcugaaaugaccccuaaagacaggucccuuuggcgcuggcaugcaccaguugugaccccacagcaggcacugccucuauaugcacccccacucacaccuccucacugagggugggaacacccaacuccacaugcucacccacucacaccuccucacugagggugggaacacacgaagcucugcucucaugcguuuccaaacucugcuuccgcucugcaaaccacauccuuccccucccccagacaaagagaucuacaaaucugggucccuucccacccuccaccauucacucucaaaaaagggacugagguuaggagacggugagaucguuacagccaucccccugcguugguauucugcuccuccugaagcuuucgagaccuuucccauugaagcucccugagaaggaaaugccacuaccucucucaugagagaugugggggggaagaggagaagagggcugcacccguucauacccagccugggccccgucuucaaaucuaaccuaaccgccacaguaguccagucuggggaaugcaagcggcuugggaaaguuggagaacagccacuuggagaugagaaccccagccuuugguuugggcugagggagggaagaaguguucuggguggggugucuugguuucaaugcacagaaucacuuggaccucucacucuucaacauggcaaccucgggguagacuuacuucucuucccauccagacaaaaguuaaguuucgcucuaagugggccagccuugggcaagggcgugggugugaaugagcaacucuucuaagaaucucugaagguuacuuuucuuuuuuuuucucuuuugagacagagucucacucucucacacaggcuggagugcaguggcacaaucuuggcucacugcagccucagccuccuggguucaagcaauucucgugccucagccucccaaguagcugggauuacaggcacgugccaccaugcccggcuaauuuuugauagagacgggguuucaccauguuggccaggcuggucuugaacuccugaccuuaagugauccgcccgccucagccucccaaaguguugggauuacaggcgugagccaccgcgccuggccugaagguuacuuuucuuuucagugguuuggggcagggaguuacacagcuuaauagauuaagaagaauaaaaugcugaaugcuaucauuucuuucuaacauauuuagcauuaauaaaaagugaguauuucugaggucaucacaacugccucccccucccccaagcccuugcaagugccuaagaaauugccuuugaaggauucccaccccccuccauuaucagcucccuaacaucuuacaaagucuuaucaacaggaauauuaauauuauuuucaguaucagaaaaaaaaaacaguugagcagcacaggcaaaaauauaucugcacuacguuucugucguugccaaaaauauacacaucuucuuuucuuuauuaaaaaaaaaaaaaaaacccaacaacaaaaacccaaacagaaacacacacagaaaaauccacacaugcaaagagacugacaaggccggagccuggggaagcuggaaaccccuacccugggcuccaaccccagugcaacugaaacagggacacaggcuucgccuugccucucgccucucuccugacuguccacucagccucugugccaaaggccugggcaggcggggacucuuugaaggugagaauugcccacucuacccuggggaaauagcuggugggugaggggacaguuguuagucagcuuaguggcuccccugguugguggggguggggugcaggaggcaagcuggcuaauucugggagggaggcuuuugcuaaaagcaguggcauuuccccccaccuuacgcccucccccaagcccuggggcuccccuugugccagagaaggaggaagcuaucagugggguagggggcccuaagggggcccugagaccauguggggucaggggagggaaggcaggauacuacccugauucaaagcccugugcccccagcgacucuccaauauuggaguacugcucugguguuuguuaaccauucaugcccccagagagggaccaaaguuggugagguggggagggugcaaauaagagcugggagguccccucucuggcgcugcuucaucugaccacugcgccuaucccugcccuuggcugcccuggguccaggaggagagagacaggcagacagacacacacacacacacacacacacacacacaugcacgcacacacacacucacacacugagacgggcagcuccaucuccccacccucggcacuccuaaguccaauagugcaaacaaagggcggggcaccaaggaaggccagagccuccccgcaccugcccucuccuccccaucacggggccccaagagguugaggaggcuggggcugagugugaugcucuccugccccuucuccagcccccaacaucugugggcuuuuacaagcucagcuugugccccugcgcuggggggagggauggcgagaaaaaguccaaggggucccuucugccaucugcccgagcugggaagaaacugcagguaaaguggguccagcccuucuuccauaaaagauuuccccgcagggacaggcccagggccucucccuccacuucuccccauucaagugcugauccauuucaugugacagguccaaccaacccccuacuucugccauggcccacucugcucucuggggggaccuccaaaacauuugcuggggauggaccuccuaggcgggcuugcagacuguccuuccucugagccucacaaagcggacagugcggaaagggaagggggccagauggagggggcuccccucucagucucaguccucgacaccaggagcucuccacacucccuggaccucagcacaggcucugggucaaggcucuccagggucugggcgcaggcgccugcuccaggcuaggaccccucaggccaggaucuguucccuccacuugggggggucaggagggguaaggguggauuuagccuuuuuccugguuggcugaggcuccuuugucagcggucuggaaagagagggagggaggccggggguguggaaagugucagguccuaacccccagauaagaacagcuuccuaggccaagaaagcugcugugggguacugaaacggggccaauggaagccucuggccugggcucugaggggugugcaccagggccgaugcgcaggggugugaaaccacccugcagaagagcaccgggcugcgugggcaugugcaagcuaaggccgugugcccucaggagagggagagggccuuucugacauuggccuacccagagggucaucuuuuucuaauuggucggaugagaaacaaaauggcuuuuucuaauugguccucccggaggaaggcuguuuucuaauugguccuuuuccucugagcccaugcucagaucggaucuuucuuggccgugcaggagggcacccaugugcaagcagaggcccuggggucugaggcaggguacuuugcugaccuagggguugcuuccuucccccugcugagguaccugaugauaagccuucugacaauccaucucuacccaucccucagaggggaggcaggaaggccccgggccccuuacucaccccuccuuuggggccaccgccacugcccucugcucccgacaggcugaggaagggguuggucugggcagugaggacuggagguccgccugcugcugcuacugcugcagcugcagcugcugcggccaugagacuuguguuguugccaagcgagggagccacuagggcuccagcgggcagcagggguggagcagacgcugugggcagcaggccagggguacccgcagacagcagcgggguggagcuuccugccagcaggcuggccaugggcagcugggagcccccagccaucugcaggcgcugcagcucccguuucugcuggaucugcuggaucaucugguagacaacagucugguguuccugcaagggggccagaccgcuuguuggccaacagucccgggggucucuucccugcugccugccugcccugccuggccaggccccaccccaucacacuggaaucaggaggcaagaggccugugagacagucaagguacugucucgcauuucccacuuagccugggucuccccaucuagacaagaaaaugguugcacgccauugguauuugccagcugcagcacugccggccaacagcaggguauuuaauaucucuggcccugcccacagaaucaccccucagcuccuaagacaaccacagacgcccccaaguugaaaaacacuaaacuaggucaauaguuuucuuuucuuuucuuuucuuuuugugagacggagucuugcucugucacccaggcuggaguacaguggugcgauauuggcugacugcaaccuccaccuccuggguucaagcgauucuccugccucagccucccagguagcuggauuacaggggccugccaccacauccggcuaauuuuuguauuuuuaguagagacgggguuucgccaaaacuacugacuaggucaauaguuuucaauucgccggacacgguggcucacgccuauaaucccagcacuuugggaggcugaggccgguggaucacuugaggucaggaguuugagaccagccuggccaacauggugaaaccccaucucuacuaaagauacaaaaauuagcugggcaugguggcaugcaccuguaaucccagcuacuugggaggcugaggcaagagaaucccuugaacccgggaggcggagguugcagugagccgauaucaugccauugcacuccagccugggcaacaagagugaaacucugucucaaaaaaaaaaaaaaaaaguuuucaauucccuuucucuuuuguuuuguuugcuucuaucauuuaagauucauuuauuuugcuuugaauaggcaaagcauucuuaaugucccagaaaccaaaauaauauaucaaaguuuaccuuaagaacuuacuccucuugcucccaucuggucccuacaggcagccagcugaauugguuuccugucuaauauuucuuuauaugaaaauguugauuuuucuuauuuuuucaacucccuguuuuguuuuugagacagggucucauucugucacccaggcuggaguguauuggcgccaucucagcucacugcagccuccaccuccccaguucaagcgauucuccugccucaggcucccaaguagcugggacuacaggcgugcaccaccacgcccagcuaauuuuuuguagagacucaguuucaccaaguugcccaggcugaucucaaacuccugagcucaagcgaucugccugccucagucuuccgugcuuggauuacagacaugagccaccacacccggcugcuucccucauuuuuaaaaaguaaaacuccuuuucuccaaagguaguuucagccgacccaacaggagacagacccaaagaagcugcugugguugaggguggugucaccugcacagccacucagacccuggaguuuccccugaaugccuuuggggcugggacugaaaugcugaauaacugaggacuugcugcccuccagagucuuucaccaggaugcgaccuggggcuauuacagcagcccuuucucaaugcccaggggauccugggcaugaucuuaucccccuuaccugccauggaugcuccacagggcccagccccagucccacaggcccagccuagagcuuccccucacucugccugcuccugcccucuccuggcuggcccugauccucugagaugugcccuuccaggcagaccaaggggcaccugaggcagggaagggaggggcauuaccggggucagcugcggggaggccaggagcugcuggaguugcuggagcugcugcucuugcugcugaaggagaugucucugcugcucuguaaggcugagguggggguggggggugggggggggacaacacacagaccaugggggagggccagggaaacacuccugcuccuaaucccaagccccuagacucccucagacccaggggaagcaaggcagggaugugcgaucuuagagcaccgugcucauagggugcagcaagagggauacaggucugauuuagaagaacugucccagaaggaaauccuagagugcaggacaggaagucaacaauucuuuugucccuggggagcuaccguccagaggacacacaugucuaacagucuguggaguccuuagaggccaagaggugacuaggauuauauacccugugagaccagaggccauuuuuccuuuuagggauuguggguguuuuggggaaaaucccucccuucccagagccagccccccacccuguuccccuucccagggcugagcucucccucaccuguugagacagccuggcagcugcagcgugggggccccgccagccuggcucaagcuugcgggguugggggcagcggccccauucaaccccccaaggagcccauugaggggcaggcccccacugccugccagcccccccaacagccccucagccaugggcauggcccccagccccgcugccccgggugcccggcccaacccguucugcggcuggggcgggaguggggcaggggccccaggcagggccaggggcagaguggcagggcucugcuggaggaggggcagcggugggggcgugcuguggaaggacagcgacgagcugcugcggcucgggcagccugaguguggguccuggggagggagggggaagggaggggucagagggccagcaugacuuuucuggccccuggcccagcacccaccagcauucucacagagcacagcaacccccacuucacccccaggcacccuggaagaagcaagguccggggaugagggcuaagaauccaaauugucuucacgaaucauguuuccugaccccuuccugggaguccagcgccccucaucauccucauuuaauaauggacaaugaugaugguggugaccaucuggugaaccagauccugggcugagggcuugaccugugcuaucuugcuauucucauuuuaugggugaagccauugauucuugcacagguuaaguaacucugcaggcaaaagcacuacagcuaaagugaaaggcucagguucaaauccuauguccacaauccaauggcuugggugaccuuggguucaaccugucuuaguuuacucacucguaagcugggggguaacaguaguaccuauuccauaggcuuacuaugaagacuaaaugaaugcuuuaaaaaauuuuugcauagggcaugacaaagggcaagugugcaauuaaugcugguuauuauuaugauuauuacugcccaagucacacaguuaauaaauggcagagagagaacaagaacccaguuuguuggauuccaguaauaaccacaacacaauagcaacugcuauucgaaccgccaccaguuacacaggaauuauuuugugugaggcgcuauaauaaacccuucacaaauacuucucaaagaggccuucccuaaccacuuucuauccacagaagcagcccucccccguucucucucucacagcccucaauuucucuccacacuaacauaucucccaguuugugauuacuccuucuuugcuugggguagccuaucuuaagaagcagcgcugugccgguuuugcucacugauugcuuagccaauggcuggcacuaagugggcaccucauaaauauuacuugauuaagggaggacugaauggaucaaucaauugcucagucagucacuucauugcccagccuccaauagcugcggggaagagaugggaccaggagagccuugagucucccccuccuuccugccccacuccucguagcgcccaccucagaagaaguggacagcgaguuguccaggccgaggcugcucuuucccggagggcucuugcuggugcucaaggagucgcugcugccggcugugggagggaugucacaggcugcagucagggccaguccggacuucagggcacgggccucucucccgggcugggcaggauccccucaccuuggggaggcaggccauagggcccagggacagggccguuggcggcaggcagggcagcaggcagggcagggaagggcacagagagcugcacguugagaaucugcagccgcuccuuuuuggccgucaggcucaggaucugcucuugcagccgcugguucuccuucugcagcgcgugcagcgccuucagcaucuccacgacugcggagagagcgaggaaccugagggaggggcgagggggcggaggcggggccaggggaccgggggcggggccuggaggggagccagugcucagcccuugaaaaggcggcgccauccuaaggagggacacaggugagcucugagaagagaggcgggacuuggggagccacaggugugaagaccuggggcggagccugaggcuggggucgaggccacacgggucaggagagaagggcggaaguugcgguuugguaaggucggggcccggaggccacgaaggccaaagguggggcgcugagggaccagggccggucguguggccuggcagggaugggaggugaggcccgggguggccgagagucaaggcuggggcggggccuaagggcggaaccuuaaagaagcuuggggaccucggggagaaaggugacuguuagggcccuagggcaggcgucccgaccggcgccaccccuccucacuguugacgccggccuccccgucgcccugcuucuccagaagcugcuccauguuagucgucccuggggccgccgggucuaacuggccgcccccacagggugcagaggcugucuggucgaagagugcggggaggcugcugaugggggaccugcggccagagggaaccuggguucagucgacccgaccacuccaggcuccucuggcccuucucccguaucccccagggguuccagcccacgccggucucuccgucccuccucccucgggugucccuccugcccccagccccuccuccaggcugccccuucccucacauggaagacagacucuccugaggggaggucccccgacaccggaagcugcaguccuccaggucuggcucuuggaagaagggaaggcugggaucagcguggaggagugguagcugccucaggguccccgcccccagauggauaugggauugggaccucaccgcagaucccuuuccccaggaauccccaaccccacacuggcaguucaaggccagcgcugagggcccuggcuuggaaacccugccccugggaggcaaaccccgggcaucugcucucuuccuccucugggcugaaggcuccacugucuggcuucuuucagauccaccgcccaauuccuuuccugggaucuucagaguuauagaaauuugaggucaagacagaccuggauugaacuuaaaccugacaucaacuuuugugaccuugggcuccuaaccagccucuccgaagugacuguuauuaagauuaaaagaagguaauaaaugugaaguguuuaccugaaggguuuagcuagcauguagcaagcccuuaaugacugcagcuauuaucauaauuagcucuguaugacuuuuuacauucaucagaucccuuaucaggaggcaaaacuaaaacucuuccuugggccacagaauccugaucugaguuuuaacaaauauaucacccuacucugucguucuuaaacguggaaucauauuuguccccuuuaaggcuuaccugagucggcagccuggcuguaggccccgccucccagccugacagguggucucccugcaccaauuagcuuucuggggcugggcugacucuccagggagagggcggggcgcuugugacccgcccccuuaacucguaaauacccggagagguugagaccuccguaagcgcugaucccaagacacacuacgaagccaaggggaagcacgcuacaccggugaaagcacugggcuuggagucaggagaacagaaucugagcuuuaggucugccauuuccugccuugagcaagucuuccaucucugccuuuuucuucugugagauggagcaguaacuucccugcccugccuucucgcuggguucuaacuugaaaguguacccugguuugcuguguguggauuuuuuuuuuuuuuaagagacagguucucccuguguugcccaggcuagucuccugaguagcugggauuacaggcgggagccacuacgcugggauuuuguuuguuuugagacggaguuuugcucuuaucgcccaggcuggagugcaauggagcgaucucggcucacugcaaccuccgccucccacguucaagcaauucuccugccucagccuccugaguagcugggauuacaggcgcccaccaccacgcccagcuacuuuuuguauuuuuaguagagacgggguuucaccauguuggccaggcuggucucaaacuccugaucucaggugauccacccgccucggccucccaaagugcugggauuacaggcgugagccaccacacccggccuguuuguuuuugcagggagggcaauggccagagggagggggcagccagaaagcucucccauucuuucuggggucacaugcaggugauggguguccgaccuuugggaagaaaggggagaggggaucagauauucacauaccuguguggcugcucucagcuugggagaggaggggauuaacggcacccauggggguuccaaagauguggguagaagggaggcuaaagguagagccagccagagaaaacaccuaagggagggagguagaauccccuggcgguuauucuuggaucuagagcacaacuguguguaccggggugcagggggccgggugugcuggggagcagagggguccagagcccggaggguggucugauggcaacucagcccaguugcuccaauucccauggaaggcugggguccucugucagucuguccccaaccugcccagggaaggaggagcccaggagucaggucucaccugagugguggagauagaagcagaagaggaggggagggugcuggugaacggggagcggcugaggcggggcagggccgaggucccugggggccccaggaggcuggaggagagaggggugcugcagacagcccgcagcaucccgccacugugggagaugggguccuuauuacugguguagaugccugcaggcacaaggacagagggaagcacgugguuacucuccaccccagacuccugcucagccagguggcugacagccccuccccagcucgagugcuccccgggaucuggcuacaugccccagucuaacccucuugcugcaaagaugucacuuccugccugggugacaucugcuugcugcgccugcuuguuaaacugcccugccgagggcuacagaauuccuagcuuuucuaaucucccucccaaaacuugguaaaaccuucugacaaucuguccccaauccuuucuacuccacgcaugcagagggggauguccugaaggugacugucuccuccgugcucuaucuuuuggagugguauccaucccauuuccuucuaagugcauguguaagcucuguuccucacuagacuggcugggcccugaaaugcccucuguccccaggggucacuaaccugccccuaguaagggggacuccaggcucaagcugggcaagcucccagaaggcccaaagguucgggaggacagaccucccaggccggagcugaccagggaaccuccagagaagggugaggcagcaguggcgguaaagccagccagcugggcacugggcaaggauggggcagcugggcccccagugcccuccuuguuccggcugcccuugggacggccuggcccauggcggcuccucuugcuggcuuugugcuucuucuccuucaggccugucucaggggucucaucagcaggcacagggguggcacucagugcgggcauccguuugugggugccugccgaggccccagaccccgugacguggggagacuuauaguccccaggggagggcgcccgggcccggccugagcuggagguggugguggagaagcgcaugaugggcccaaagccagagaagaccaccuucugcucaaaaaggucagccuuggggggcucgggagcugagggagaaggaggggcugaaggggcgggggcugugggcuuggaguacuuguccuccucuggcugcuccagcuuggggaaugcagagaagucaggggagcucugcagggacgagacugugcacagaggggaaacaguuacagcuggaccccagauccccgcacucccucccacucccgcguguacuggcgggagagagcucugguccacgaauggggaugccugguuuccugucucagcucugccacugucuguguccugggaugaguacccccgaccccuccagcuuucccaccuguaauaaaaugggggagaguaacucgcacccuacuggccucaccagaugacuguagcgauuauaggagaaaauguuaauggggguucuugaaaaauuguaccuugcagcacaaauguaggggauaaggaauacuguuaugagguuggugggguggccccugaaggggagaggagaguucugguucaagaaggaaggguuugggggcagguuuggagaggaggggauuccccaucuuuauccugaaccaauggagaaguaaaugagaugcaaaaccaauaugcaaagucccuugccagaaaagcucaggacaaaaggcuuucccugcucccagcuuccucccggaugcccacacucaccugcaggcuggaagggccccccagaggaggaggaagaggaggaggaagaagaggaggcggagguaaaacugcucacaccuuucccacugcucaguuucuucccuuuaugacucaggcuauggcuggaagacuuuuuccccuuugacucccugcugcucucagaggucuccugcgugcuggccucguggugggaggaagaggaagccgaggaggagaccugaaggagaggagagaggaagguucaacaccaggugccugggccugugcugauccugaugugggagugaagcaggagggcacaggaccuagcucaacugggagagcccacagcuaguuucaugaaggacuuccgggcagggaguggccaggagcuccuagaccagggauauggggaggcagcuguggcacuccuggguguaaggcagaggggaauucacugaacccaagaaggugucugucuuucaccuuaggcagggaagauggaagccaagagggagaugaaaacagucccagagucugaagagauuuacucauugguccauucauucacugaauacuuagggcgucuaagaaggcgggaccuaugcuggaaguggcgaggcagagaagaggacccacaggagaaugggcuucucuggugccauccuggagcccuccagcuacuaccccaaacuucggcccccuggcuuuccacccauucucugaccaccccaugcucuuccuagacaaccugauugcacacacuaagcguuugccaggacagccuauccuuacucuuccugggaaaucucucauccuuuaaaauccagcuuggaagucccucuucccugaagccucccuaaauaccucagguggaacaagacauucuguccccuuauuuccagagaacugugcacacaugaccacaugucaacagcugccacucugcacugaaauguucuguccuaucugaggcaccagaaaccaaagagagcggcaggguggugguugaaggagcgugggcucuaagucgggcagagcaagguaugagccugauggguucugcccuucaccgccauguuuuuguuuuuucuuaauuuauuuuugagauggaguuucacucuuguugcacaggcuggagugcaauggugcgaucucggcucacugcaaccuucaaucaccucccagguucaagugauucuccugccucagccucccaaguagcugggauuacaggcaccagccaccacacccggcuaauuuuguguauuuuuaauagaggcaggguuucaccauguuggccaggcugaucucgaaccccugaccucaggugauccaccugccucggacucccaaagugcugggacuacaggcgugagccaccacgccuggccucacugccauguuauacugugcaaagucucaacgucgauaagugucagugucuuuacagggagcacuaugcauauguggugaguuggaagcagcaugaugccagauacaugguauagggucaauaaaugaugagacguccaguggcagcagcugcagagacagugcugugggcaggugaagagcacaagccuucaagccagacugcauuggaaucucaggucuaccacuuuacuagcugugugcuuuuaggcaaauuacuuaaccucccugugccccaucaucuucauauauuaaaugggguuuauaaauuuccaaccuaauuggauuauuuugaguauuaaauggacuaaucuccauaugccccuccaucuccugguucuagaacacagccuggcaugccgugaguucguucgugcuucaggcugcugccagggaaggcccuuuuccuccuaguagcgaccagguauucaguuaaucgugcugaacagauaaaugcugaaugcaggcuggaccagaaacgagagccacccugcacugccccucccgggcggaguccuggucucugucuuccucuuuguucuuuucaacagcuggaguucugaagggagccagaugugguucugagagcaagggaagagaggggcuggggggaaggguagccgaagugcuggggcgaguggaggaggaugggcagaguucucuggcauguccaagggacauccaguuacuggaaaaacucccagaccccuggccauuucuugccaccugccugcaggccccuggaaaggucagagggcaugaaugacaaggucuccaggugagcccugggaagcaggggagagguuuacuggggcaguugccacagcaacaucacccuggaaaccugauaccugaaccuccugcuaaggugcccagaacucugccaaccgucugagaugggguggaggugaaugggcaauaauggugacaggagggagcaguuucuccaucuccccccacccuaccagguucuccucccauggggagggcagguuguagggagcagggagggcuguuccagcuuggauuagcaauucccuggccuaggguagggccugccuaucgcucagccagauguugcccauuucuggagacaggccugacauaccaugcccugcugggaauggugggaugagugggaguuucgggauacuguccaggggccugccccccaugccaccuuggucagaacuuucagccccuccaaccugcacagagugggauuuggguugggugacaagcuuuggguguccuccugauggggcguaggggauguccucuaccgaucucuggggacaggggcccuagaacuuggagagcaggccugagugccgucccccacucucugcagacaagagcccagggcugaggcccucuggacagaggcagaugggaguaucuggcagacagcaccccaaacucccaaucccaugguuggucggugauugguggccccuucuaggcuggaagaaggaguagaggguaugggguaggaggggaguggcauuaacuugaagcuguggggagggugcccaggucccugacucaccaaccucucgcccccgccucccucccucugccaccccagacccacacaccaucccuccugaaggugggcagcaguaccuugucagcaguggggaccacgggcggggugaggaugcuggggggcgacucaggccgcuucuugugcuucugcuuaaggcguucuuuguccuuucgacucuggagagggagaggugacuagauauugugcuggggggcugucugggcgaggacaaacaugacauguggguauggggagcugacacccccuuagggaugggguuuugugggcaccaucucucccugaggagggcuggauaaugggcugggcaggagcgauucaggcaaguuccuaugagagccaacagcccuucccccggccccgccugcuaaaaauagccugucccauuaucacgccagugcuauagagcaccacgcgcgugaacauaacaccugcaaggguguccaccugggacacagcugcacagagggacaggagcugggcacgcugugcuauguggcgcgagggaaugcaggcaugagcacuuacuaggcggcacauggcuggacugcggagacgugugcaacgugcagagccaugugucuggggccugggggacacugugaugucauggggaggacccagaggaaccacuaacacagccacagggaagccaagcucccgccucacccccccaccguuucauuucagcccccuccugcccucaguggccucagaggaaggaagaaggcagggccaagaccuuaagggcaccucaugauggcuuuuugagccauguuugugagucuccaaguccccgugugggagugauggcaggugggggaggacuucuaccuucuucuggccccucucgugguggguggggugcuucuccugcugcguggauggugaggcugaccggcuucuccucccagagaugaaaccacugccaccuccccccaugcugccaccuccuccuccagcgccuccuccgccucccccgcugcugugccgggaugucuucugcgggagagauuugagagaaauugcaaacccucuucucacgggcuuagggaacgcuuccagaagguuagaggauccugauccugggggucagccccaugugccccgucugucacuaagaggaccucauguccucuaugaugcucugcucagcagaaggguguuccccagccugaaaauccuagaguguuccagcuggcucgcccaaugugcagagucaaccacugaggcccagaagaggcaaggaugcgucugggccccagcaaggcccagguggaggugagacuggggcccgggucuuucauucucuccauggugcccucuuggcugacugagccacggcccguuucuaccuccuucccuggagcagagggcgugcaggggacccucguggggagccagugcuccccugcacuccauauccaauccucccuccagacacuuggcucagcuaucacccucuucuccuuuauccuggccccuccccuccaccaaacacagugguugcuccugucccaaaggauaugcugcccuuaacuugaagaaaggggggaaguuaaacaucaacacaacccaaacaacccacaugcugcgucuccucccagccagggccugccucccccauccccuucacuacagacccagccugauggcuccacccuccccgggguuauagcugcucccucuaaggucaccagcuaccucccaacugccaaacccaagggcuaauuucaggccuuaucugaccagugggcagcuccccaguguuggacacagcuccuaccugcagagccccauacccugcaaggcccccucuuucguggcccgccugauccauccuuguggacaaccugggauuacggccccagccuuauaagccuggagcugccacuacacccugcccaggagucugacauccaccaaaucuaaaugucuccacauggugucuccugcaaaccaagccaagcucgcuaccuuguccuaagcuaucaucaaacccugaaaccacggugaccacguaacuuaugauccaaaccuggacacuuucaaaaaugaaacaggggaacuaauaauaauuacaccagggcaacagguauaaacugggacugucuggggcaaaucaggacauguguucccccuacagaagccagcuguaccccuuguucauggcaccccccagguauucaagcuccauuuacccagugucuagagccuagauccuaaaugucacccccaacuccuacuucucagccacucccacgauuaggcaagucucccuagaaaugguucuagcauccagccucaccccuccaucccccuucuugcagcugucucccggccaccagccucagcccuucugaucuagccucacagcggcugccaggguaaucuuccuaaaaaacaaaucugaucauguuacucucccgcuuacaggccugacaagccuguggcucggggguagauccaagcugcagccaacugcuccagaauaccucacagcuucugggacacacgucucuccacaaacacagacacagaguagcacccuuuccagccucccccuggaccccugaagccuggggcagaggcaagcccagcucgggcucugcuuucucacuucaucuccugccucuuccccaccaaacaccccauucucccgcugcucacccaugcccuuccuccucucaggacuuuguccacgcuagucccucugccugggacucguuucucuguuuggcaggcuccugaggaguuuucaaauuaggcugcccguucuaaaucccaucuaccagcugcaagauaaguuauaugaccucagugagccuuaguuuacucaucuguaaaauggggaaaauauagcacaccuaguucuuaggguugguggggggaccacacaaaauaacacauggcaggaacuuuguccuaaggcggaggcguaguaaaugcugccucccacacaaauguuggcucuuacuuugauuuccaccuccacucagcuuaaaugcuaccucuuccuugaagccuccuagacucugacaggcagggucugagcuuugucuuuugggacagacugcuuggucuagcucugauccacacaccugaagcuguacuuuauuccucaucgaaugaagagcuccucuugggcagggacuggguuuuuucccucucuguccuccuagcaccaggcacuggccuggcccagagcccaugcccucuaaccaucuuaccacagcugacugacccgcucaugcgcuggucgccaggacucaccaucuugcugaagugguauuugcaguagccgcaguacuugacguuguccaccuccagcacuucuuccucacacagcaagccugccauuugggcacuaaccagagaaggcagccugagacggcugaggccacagaucacaugagccaccuuccucucacccuccuggcccccugcugaggcgaagccaagaccauccaaagcauugccaccaccaucaaagggacagcagcuaggaugagccugaucaguggccauccaggacaaacccggggggcaggggggugggacaggggucucaccaggugacguggaaagcuugucgacauccauggcgguuacaggucaugcaggcucccgaggccgccuugcucucccggcccugcuccucgcagauguaacaggucugcaggacacagcgcaaucguccccuccuccagggagccccuguucuacugaugguccuuaggccacccccuccauuccauuugcucucuacagucuuagaucagugcuaucccacagaacugucugcagugaugaaaacgcucuauggucugcgccguccaagacaaaugccaccagucacaugggcuauaagcacuugaacuauggcuagcgugacugaggaacuagauucuaaacuguauuuaauuguuguuuauuuuuauuuauuuauuugagacggagucucccucugucgcccagguuggagugcaguggcacgaucucggcucacugcaaccuccuccgccuccuggguuccagggauucuccugccucaaccucccgaguagcugggacugcaggugcccaccaccaugcccagcuaauuuuuguauuuuucuagagauggggucucaucauguugaccaggccggucucaaacuccugaccuuaggugauccaccccccucagccucccaaagucugggauuacaggugugagccaccacacccagccugcuuuuaauuuugauuaauuuauguagccacguguggccgauggcuacuaugcuggguagcacaguccuuggaugguuagcucugaaaggccaaggccuuugucugucuugcucacuagggagcuuaugcccaccucugugccucugcccaggcuuucuucugccuggaaccugggggcccuuacccuccuggaagcuggcuccuucucacgccccaggucucagccuaaaugucuccuuccuuuaccaucuggucuaaaguaagcccccaccaggucuuuauuuuagugucuuauuuucuucacagcauuuaucacaaauugcauuuacuuugccuuuuuacugauauuuauagucuucgcaugcaagaacuugcguuccauugagcgggcagcacaccugucuugaucagcaccgaacagcgugugccagcuaccuugcaccaggucuggcacauaguaggcacuuaauaaaauguguccagcgaaugaaugaaugaaguaacugcgaaggucuacccucuggcagaacuacugcaggggagccuacuauuucaccugagugccagagcaugagugugucugucaacagaagggugguucacugguagguaccuacccaccucccaaguucccuuucagugcucguuggacagaaucaaauuacaccggaugaagagagcguuggaggaacccauagaugggagggaacugguaggggacacggcggggggccgcugaccuuguugaagcgaucaugaggcacguacugcagcacgaugggcuccauggugagcacguuggcaaauugcaccucggggauguagagggcacacaccacgugugcccagccuggggcaguguggggguagccucagcugcagauggcaagccggagacuccaccccuuaugaccccacgcugcagacuguucccuccuccacagccuucccaucagauuccagcgccagccagggaaaggaaacccggccuccaccccaacucaguccauuccugccuucccagacccugcucagggggcccugcugaccucagcagaugagcccgccucaccuccauuaucaguccucuucaaugccccgucuuugugugggcacagcucacaccucugccaaugcaagagugcacagggguugggggaucugcugagcuggacccucccugaacacguucaaggggucccaggcugaaaugcuaagcucuaggguggauggauggggcuacaguggaaacaggauuggccaugaguugguaacuguugaaaaugaggaaggggacaugagauucauuauaguuuucccuuuacuuucauaugaguaggaaacuucccauaauaaaaaaguucaaacagacaaaaaccaaagccccaugccugagguggggcagagggagggaugagcgugaggcagagaugagguuggagguaggugugcaggaaacaggaagucugugugacagagcuaaaucccacccuagccucggccucagaguccccuagcucaaccugagacgcucaggugugugggaggggcaggggaguggagaggggcagucuggaacucaccacccuggcugcucgcuccugagauucacauuuccggcagaaccagggucccguuggcaccugaacgaugccauagcaagcugaggguggggaggacagucgcugagcaaagcugucagccaguggcuuuuucccaggguaacugggggaaggcggugacuccaaaggacuagagccaguuccagcagugggggcugcuccccagucuacgggucacucacucuacagcaggacugcccaaccgcccaacaccagccuucaaccacacaauuaagcacuucaaacagggcgggaagucugagucuuugaccuuaaacuucuagaagauccuccccccacgcccuuucuggacuuguuucccagcuucuuccucggaccagccaucagcaucagaaauagagaaaaccagaggggacaacagucacgaccgucaaacacguuuuguuguugugggcggggggauuucuuaaagggccagugagggacgaggcggagaaguagggggucuagggaccucaucuucuaccucuaaguauuccagaaucagguuaaaagucaaggcugagggcaggugcggugcugggaaccgagaggagcguggcgggaagagccccgggccacagcauucagggaugucccaggaagggggggcccggcugccugugccaggcaggcgggagaugccagccugcgcccucggcaagauuccucaaggaguuaacucccgaaccaugugcugcugggggaaacuccaagccucccucuucucgauuccggcccccugcacaaccucucuccuauccuuagcucuuccccggcggauuuuaggagucccuucuccccugggacccuucucuucccuuuccaaguccgcuccucccauuauccggaagcgaggggggaugacgccccccccuugaccucuuccuccaggagccgggaccaaaauaaccgggcgggaggggacaccucgcagguaaacauuccccaggcagccccgacacccgcgguguggggcguggggaguucacucauugcucccuagacucuccccaaacucccucaacuuaggguggggggcgcggaacuggaacaauaggcaagaaaacaaugccugacccggucuuccaggaccgggcggggggagcucccccuacgccucccuucccuucagguggggugggggaggggcgcgcgagccccaggaggucuccggagggcgcggccgggggcgccccgcgcacgccgcccccggggucccgccgccccccgcgggccacccccguaccuugguggacgaccacgcugcacgcgugcccaucgcaguagaccagcggguucucggcccagccccucucguccgaacauacgcagcagccuccuaccaucuccuucauacucccaugagcucccuccggggcuggggcggggggccggccggcgggggucgggggucaggggggagggagggagcggggggccgcgcgccuccucgcccccuccuccucucccuccgccgccgccgcuucuuuucuuugccuccuccuuccuccuccuccgcguccuccuccuccuccuccucgcucgcucugucuggccgccccccccgccgugcucucgcccucaugccccgacgggccccccccacaacaaugagacucgcacgccgggcucgcccccuccgcgccgcucgcccggcuccuagggccgccccgccgccgcguagcccgagcccggcgggggaggcgccgaguggcacaucgcgggcgcccgcccgccccgcgccgccccgcgccacccgcucacgcgccgcccccccggccccccugcccggccgcggcagccauggccgcgcgccuccgcucg

SEQ ID NO: 16807 - RNA, 3576 nt, Homo sapiens
gcggggcguuccaccgccaggcccgcccggcagggggcgccgggaccgaccgcucacgcccggcgugcugaggaggccgcugggcgggcgccguggucgggcuuccguaccccgcccgccccuggccuccgcccucgcagaacgccgcggcgucuuccggggccuggcgggccggggaccgagggggcggggaggugacccggcgggggcggagccagcgggcgggcgcggcgcgggaggcgaccaugcgcggcgcgggggcgauccugcggccggcggcgcguggugcccgggugagcacccccgcccugcaccagcccccgucccgaaccccagccgggccccugccagcccccacuccagccccggcccggccgagcaucccggagcucccggcccgucccgccggugucuggcuugccucagcucacaggcuuuucccgagcgccagucccugccaggaccuccgcagccagcaccuucucuugcgaccuuuuucuuacccucucauuccucccucgccccuucagcccugucaccuccuccuuccuagauggccucccguguccuucccuuuccacugauuuuauuuuuccguuuccaaaccaccgucuugugaugccugccaugcuugcguaccuugcaggaccugaacccgcggcgggacaucuccuccuggcuggugaguccccccauccuccccuccuccucgcacaagacccccaggcacggagaucucaaaggcagaaacaggaaauggagcuaggaagaguacaggccuauucccuggaguuagcccguggcucucagggagguggggcggaccagagggcacugggcagggcgccagucuucuguacugaggacagcagcaccuaaugaaccaagccccaguguggguggcccugccguaggcuggaaggaucccagcccgccuucccuagcacgcaggugggagccagcguuugagggaaggcagcuggacccugaaaccugagugccugcauggcuuugaaaucucccuguccaaagcucacgguccuaugguguccuggggaacggucuuguuggguggcaucagaucagccucuuguagaggaaaccugccacacacacaggccagugggaaacuaggaagggucgcaggccggacggugcuuccagggcuugagcuaacccugagccccucaucuucccuggccacaggcccagugguucccuagaaccccagccagguccgugguggcccugaagacccccaucaagguggagcugguggcagggaaaaccuacaggugguguguguguggccgcagcaagaagcaggugagaccccugucugccuuccuacugauaccucuggcuaggaacagccuggugucuccagugaguucccacccaggaugaucuuauucuucccacacauaccugagggacaccaagggggcuugggaacaaaaggccagugccaccagcaaccuuaagcucacugcaucuaccccuugcaaugaagccagagagacagaaacucagucacgcagccagccugguguggccaggcuuccagugggcucuucuggagcuguuuguuucucagaggugcacugcauggcgaagcucaccuggcccuucccugucuccuuccaggaagcgccugggccacagauucccaggccuugaaccccaaaagccuacagcaccugguauuuccuggcggucuuccauccaaguacuaaccaggccugacccugcuuagcuuccgagaucagaugagauugggcgcauucagggugguauggccauagacacauugggaagagauucugcucaggcucuccugccuccaaagccucccagccuuccccugugccccucucuacucuucuuccagaaaacucuuccuucucaguuuaugggacuuccuggccgcuugccacaguuugcugucuucucagcuucacugccugccccacuugcuuccccuucugcccaggagccuuucgucccagcaggaaccugcccauauuguuugccucccuggccccuuuccuuccugagcagagcucugacugguauuccuucaagcuauguggcauggugucagcagcccaggguccuugagucccacuuagguccaugcaccucaagcccucuaagacaaguugcugguuucuauuugcacgcuucucucaucuccuuuccaucccacccuaacuccaaugucaagaggccuugguucagccaggcgagguggcucaccuguaaucccagcacuuugcgaggccaaggcaggaggcucuuuugaguccaggaguucaagaacagucugggcaacaaaguugagaccccgcuucuacaaaugccucuacccccaccaaagacuagcauggaggcaggccuguguucccagccauacuggaggcugaggaaggaggaccgcuugaccccaggagguugaggcuacagugagccguguuugcaucacugcacuccagccugggcaacagagugagacccugucaaaaaaaaaggccuuggcaccagcucugccuucagcuagcaaggcaugucaccuuucugggccuguuuccauuacccagucucugcuugagcggcuucugggauggggaguacacuucugugccagccagccaguuugcuauggggcauccccuccuccuuguaaccuucacucccugucacgugcccaguuauucccuggagccaaacaaaauugcuaccacaguguacucuccagcccaaagaaguuuuaacccaggaacaugggaaguaaaugaauuucaugauccaguggagacucagagacacacacacacacacacacacacacacacucacacucuauuaguguccuggcccucugggugucccagagacuaaugcuauaaagacucuguaaauacuuaccagacacuuacuauaggcaaagugcaucacgaucauauuuuauuuccucauacaacucuacucuuaucacccccacauuacagauaagagaggucacucagugagccuuggcagucuugcucuggagccuguacccuaaccacugugcuccacucccccugagcuccugcagccugcccugcccugccccagcagguggggucaggucuuugacuccugucuuucccccaccagcccuucugugacggcucccacuucuuccaacgcacuggccuaucuccacucaaguucaaggcccaagagacccgcaugguggcacucuguaccugcaaggccacucagaggcccccguacugcgauggcacccacaggagugagcgcgugcagaaggcagaagugggcuccccacucugagggggcugcugcuguccagccacagguggccuuggcuccaggccucugacaggcacccccuucugugggaaaggaaacaggugcugagcccaagagacucugguacccacugcuggcucaugaaggaagaauuauuccuuauaaccuaaaagucuccagucuggggcaggcgggagugggcccugguucaauguuugcugauggggaagauggcaaaaacaagccugcccaacc

SEQ ID NO: 16808 - RNA, 2635 nt, Homo sapiens
aauugcaccacauguacgauaucuggcccaguguaggaaauguauaaauguuagcuucaucccucagggaagcccacugagauccacacgaaacuuuugucugugucuccccauaaugugaccuuuagaaguugccaauggcccacccaauacccaaccaugauuuuucugagauaaucugcccgaggugugugagaggaaacgcgaagaaggcagucaggaggauucacucuugggggagcuggguaggauccuaucuccuccuacauccagagcaugcaggcuccauuuagauacaaaggggugggauuggguuccuggggagaaauugagccccuuugauucugcgguucugugggucuaaaucuggcaucuccuuggcuauccacccccaggcuuugugauugguuggcugugguuggugggggggcaggaagcugcugguggagcugcagcauccuucagucucaggccccugggagggggaggggaaagaaccagggcugagcuguggagugaaggggagccauuucucuccaccgacugcaaccuccgugcucacagcucacgguucaccagaauccaggggcuuggucggccuaggaauccacaaugcuggauauuuucauccugauguucuuugccaucauaggccuggucauucuguccuacauuaucuaucugcucuaguggccuggagcugcggccggagccugcuggagaacagcucagaaggaaggauggagaugaauggccgagugcccugcuugcugacgcaccgguggauuuuugcuucugcuguuaucucggguauugauuccaaaaaaaaaagaaaagaaaaaaagaaagaguuugcuuuccuauuuuuuuucuuagaccacucugaaaagaauaagaaaugccagcuucuuucuuugggaccuaauuuaaaauaagacuuuaaaaauuacaaauaaaauccacaauguaaacgauuuuuaggcagaacggguugggaaugauggaugugguggggagggacuauuauuuccuaauuucuucuucaaguuaggugcucaaacucaaguugucuauuuucuucugguaauuaaagguaaaacacaucuuugcaugucagcauacuugcaauauaguuguuuacaacuaugcuuguauaauugcauuacuuaaugauugacucauucuuauuugagggugagacggcaaauaaauuuuacuuggggugggguuuucggggagauguccaacugugggauaugguggagaggagggaggaacuccugguacuuugcaguuguccccaucugagacuuuuuauuucuggguuucuuacagcuccuggucucuccaguccaacaagaggccucucauccacagaagcaguccuacugcccagcagaccucuuucagagccuuccagacauggcugaccccuggcaagcaaggggcuuuuugagcugagaggcacuuggcugggacuucaggaauucauggacagggcuggcagauacugcauauguuugagcuguagaugggauugagaacagaaaguugaaauggagacuuauuaaaguuaccguggagaacugcucaaaaauucauuuugaauuaaggaaacuuaaauucauuuuaaguuuccuuagaucuaaaugcaacugcacauuacacucaaauauguuccuuccuucucacacacaggacucccuugugaaacucaaggggaaguucaaguuguccaucuucaucuaugaaguagucacuuuaucacugucuuuacagauugcacagucugggguuuugugguuucucuugucucacucuccagccaggaagaacuugucauuugaguuuuuaaaauguaucauuucuuccccaccucaaaccacuuguaucccaguuucucauuuaaagggagaaaugguuauauaguccucucuuugcaccugauugaauuauaaaugauagaaacaagauggcuauacuuauuuaggaaaaaucucuuaccccaaaaugagugugugugugugugugugugugcguguguguguguguguguguuuuaaucaaagaucuuuucuggaaaaaacuuuccacauaguucucugacccauuagaguugaagaaacuauguauuuugggauucagaguagaauuggccugcaaaucugggguguuuauuccuuuuacaagucuaucauaauuguucuacauuuaauuuuccuuucuugcuuaaaaguaaacaaggagagucaggagugguggcucaugccuguaaucccagcacucugggaggccgaggcggauggaucaccugaggucaggaguuggagaccagccuggccaacacggugaaaccccgucucuacuaaaaauacaaaaauuagucaggcacaguagugcgcgccuguagucccagcuacccgggaggcugaggccgaagaauugcuugaacccgggaggcagagguuguagugagccgacaucaugucacugcacuccagccugggagacauagcgagauuccgucucaaauaaaauaaaauaaauaaauaaauaaacaaggagaaagauuaguuuuuaguaauaacauuguguccaauuuccauguuuuaaaacaaaaauugaggcauuauau

SEQ ID NO: 16809 - RNA, 6294 nt, Homo sapiens
gagucaaaaaauguggggagcacagguguggcaaaaauuaucaucaguaagcaugauggaggcuccccuagcauuaaagccaaagugacuuugcagaaaccuggggaaaguaguggagaagggcuuaggccucaaauggcuucuucuaaaaacuauggcucuccacucaucagugguuccacuccaaagcaugagcguggcucucccagccauaguaagucaccagcauauaccccccagaaucuggacagugaaagugagucaggcuccuccauagcagagaaaucuuaucagaauagucccagcucagacgaugguauccgaccacuuccagaauacagcacagagaaacauaagaagcacaaaaaggaaaagaagaaaguaaaagacaaagauagggaccgagaccgggacaaagaccgagacaagaaaaaaucucauagcaucaagccagagaguugguccaaaucacccaucucuucagaccaguccuugucuaugacaaguaacacaaucuuaucugcagacagacccucaaggcucagcccagacuuuaugauuggggaggaagaugaugaucuuauggauguggcccugauugggaauuaggaaccuuauuuccuaaaagaaacagggccagaggaaaaaaaacuauugauaaguuuauaggcaaaccaccauaaggggugagucagacaggucugauuugguuaagaauccuaaauggcauggcuuugacaucaagcugggugaauuagaaaggcauauccagacccuauuaaagaaaccacaggguuugauucugguuaccaggaagucuucuuuguuccugugccagaaagaaaguuaaaauacuugcuuaagaaagggaggggggugggagggguguagggagagggaagggagggaaacaguuuugugggaaauauucauauauauuuucuucucccuuuuuccauuuuuaggccauguuuuaaacucauuuuagugcauguauaugaagggcugggcagaaaaugaaaaagcaauacauuccuugaugcauuugcaugaagguuguucaacuuuguuugagguaguuguccguuugagucaugggcaaaugaaggacuuuggucauuuuggacacuuaaguaauguuuggugucuguuucuuaggagugacugggggagggaagauuauuuuagcuauuuauuuguaauauuuuaacccuuuaucuguuuguuuuuauacaguguuucguucuaaaucuaugagguuuaggguucaaaaugauggaaggccgaagagcaaggcuuauauggugguagggagcuuauagcuugugcuaauacuguagcaucaagcccaagcaaauuagucagagcccgccuuuagaguuaaauauaauagaaaaaccaaaaugauauuuuuauuuuaggaggguuuaaauaggguucagagaucauaggaauauuaggaguuaccucucuguggagguauugacuuguaaucucauuuuccuuucaaaaaaaaaaaaaaaagcuaagguggcuuguugggauguaaacauguuuucagaugcaguaagguuuaguguaggacagccuuccugacccaguggcaugaaaaccauuacaggauuaauaguucuccuacuuccacaaugugccaaaagucugcaucccagcauuuuguuugcaggagaacugaugccauuccuaagagcuggacucacuguuucucuucaucacaaggagaaggaguccaaacuuuaaucacuccacuguaugcucccugagauaaaacaguaaaaaauccgcagccauaguucacuuaaaacaauuucaagcucacuuuugaaguaaugggggccuggaaugcuaggugagcaugaagauaaacccuugcuacuauguagcaacccaauuggaccuuuuuggagaaauaggucugagucuggauucugggggacaucaauaagagcccuucacauaaaaauauagaaauccaggagacuguuucgagugcaacagaaguucucaguauuuggaggguccucucaaaaauucugcggccuuacuuugauauugacaccugcacugugccauuccugauuauuccauucaggaucuguaucagcgggauggggcaugguccccagcacaacucuucuggguuaaaaaaaaaaagccaggugauuccuuuguguguuaugucguaaguggagugacuucaucauauauggaagaagauuucuauauucagcuuuuucugcagguuggagucagcauagaguuggaaaaucagcuuuggcuuucuuuccugucucauuuccucuaguguucuccuuuuuauugucaucagcucucaacaacucugccacuuuugugucccaagguaauaagauguaggaaacaaaacauuguaaaguggagcaagaaaaguuaucaauuaaccacaucagagucaaaugucuugggugacacuaaggaggauaugggcaggugauaccagagugcuuuaucuugugauguugauacaguagcagccucucagacauucagccagguuggauuucucaugaguuugucaccuaguuuugaauccuaucccguugguuucugcaggaaaaaaaaaaaaauuuaugugguuuuuaaaauuuguucugaguggggagaaucuuagggggaauguacugaauaguaucaugggcucagcucccccaugcagggccaacaaauaccaaaaugaguaaacugggaagcuuuucucucuuucugucuucaucccagaucaaagaaucccgaguuaggaucuggaugaaggauaagccccugaauugucgaugggcucacccccacacugacccagcaucugaacuugcuuaacagggagccggggcuaaacugcuucacccugccugagaaccagggagcacugcauuucuccacaggguggaggagaagaggcagaauaaaccaagccugggacaccucccuccugucuagguguacucauucuucuguuucaaaagaaggcaaggacaugaagucaacuucuaccuaucuucugcugcuggugucuuauguauucucaguuugaccugauuccucuucugucuuuugacuuaacauuagggguucuuggucauaaccugcucugauguacauaaagauuucagguucaauaucaaugugucuuaaaacagaaguauuuuagcgggugggggguggggugguggggacaaacaacgcaggauauaauugccaaaaccaggcuugagguuggugacucuugaaagauuuucuuucuucaggccuagaucagaaaauuaagugcagcaauaucaugaauucucagaagcccuuucagggagccagugagucauacaguauccacaguugagucacuuaaagaugucaguauacgaaacauuauucacaauccuugggcaaucucauuuuuuuuuccuucuccccuccuccccugccccccauacauuucuauccuugaguuaguuuuggaggggcaggaaguacuuaacaucucagaagcuagauugggaaacaugcucagcuauaagaacugagcuuuaaauuuugaguuuaaaaauguacaucaggagcagcuggggagggucuuuuuuuaaaaaaaucuuucaaauuugguuuucugugcauauggccguuuuguaaauacuuugggguuuuucauuuuuuugaaaguagaugaaaucuguugugggauuuuuuucccgaaacauuacaaaauaaccuguuuauuuacaugcaaauaaacuucuuugauaaaaaguaauuugccuguguguaauaaaauuuuagccuuugaauacuuuuuucauuuguucaaaacuccagucaauuuuaaagagucagucaacaguaaaugucuucccugaguacuacuugaaaugggucaacugguaacugacggagcugugaaacuugucuucauucuauuacucuguaggccaguuuuucuacccuuugccauuuuuuuuuuuuucgagauggagucucgcugugucgcccaggcuggagugcaguggcacaaucuuggcucacuacaaccuccgccucccggguucaagcaauucugccucagccucccgaguagcugggauuagaggcgcccaccaccacgcccagcuaauuuuuguauuuuuagcagagacgggguuucaccauguuggccaggauggucucaaucuccugaccuuaugauccgcccgccuuggccucccaaagugcugggauuacaggcgugagccaccgcgcccggccaucccuuugccauuguuacucaccaaaugcaucaguuuuugcugggagaaaacagcucuuagaugagacagaaugaaaaggcuuuuuuauuccacuggcugaagucaagcaaaaacauuaaaaguaccugggacaggaggagaagacagaccuggguuugugggccugagaaugaguuucugaagcuaggucccugguuuuaggaagcccccucuaggauuaaaaaaagccgggggguggcgcgcuggucgugguggcucacaugaggccuguaaucucagcacugggaggaggcuggaggaucacuugggcccaggaauugcagacuagucugggcaacauagggagaccccgucucuacaaaagaaaaaagaucccagcacucugggaggccgaggcgggcggaucacuuguagucagguguuccugaccagccuggccaacauggcgaaaccucgucucuacuuagccaggugcggcgcggcgcgccuguaaucccagcuacuugggaggcuugaacccgggaggcagagguugcaguaaaccgagaucgugccacugcacuccagccuaagcgacagaguugaaccucugucucaaaaaaaaaaaaaaaaaaaaaaagaaaaaguuuguacagugcuuuaagaguuggguaauauguccuccagcuaaaauauaccuguucuuaaagaucugccgcacuuguugcucuuguuaauuucuuagacgcauaacaagucagucgcuaaaaccacuaauuaaaaggggugugaggaagaccaacucauaacugcuuuggaagcauacaauuagcagugcugcugcuccugccaggugugcuggaauuuauuauacaguuucuaauaguucacucuuaggacauaauuuuguaguuuguugcucauagaaggggcaacaaaacuacaaaauccuguguuauuccuucguggaaauucggucauaaauucugagaccuugaaggccagaguuguuaaaacauaauauaauaugaugacacagaucagcuucuauacaaggagcccgggagucugaugaaguguuuccaucgggaaaacgcccccgccuacucgcucacacacgcuuguuucucccgccaaagugacgucaggccgaagcucucaccaaacagcgcccugauuggcggacaggcaggcgcugcagcccauugggcgccggcggcggccgagcaaggaaaaccaaaggcucuucggucucgcccgccccacccccacggacgcgcgccccgaccccggccaaaggaaggguugcccggcuccagcccugcacccccgacccccggccucaggugcagcuccgcagccauccccggaccagggcgggcacuuggccuguugcucagcgcaaccacccucgcccucccgagccaugcacagggagacaagcguccggccccggccccccaggccucccugcagcaccccguaauguaaugcacuggggcgggggaggcgggggaggcggcggcggcggcaaccgcggaggcgcggcggcagccgcacugccccaaucuagacacauccagaagaggaggaaaauggcuccgagcagggaccgccugcugcacuuuggguucaaggcgacagugagugacaggggaagggagcuggguggccgggaaggaugcgggugccuuacaggauccuggggaacaagugacgaggggcgacgggcgcgggcagaggcugagguucugugcaggcaggugcgugccuguuugcccgcggagggaggagagggggacacggggcagaagaggggcccccgcgcagagugcgguacugcucuacucucccucgcugguccgcgagcacgcgcgcacucgcauccgccccacagacccccuuuuccacacgcacaggcacuucccugccucgccuucucccgaugggcucgucugccucggaggcgcagggggucgugccgccgccgcgcaccggcugcucccgggagcgccgucagggccgg

SEQ ID NO: 16810 - RNA, 794 nt, Homo sapiens
uuuuuuuuuuagucugaucuuaucgauuuguuauucaaaaaaucuuauuucugacuggauucagacuuagaaguagaagcuugcagacaggaaagccugcauuucuuagcaauuuguuccugacgcuucuguuuagccuccuucauucucuuggccaaaaguuaagcauauucugcagccucuuccuaauuuuucuuaguaugcugcuucuccagagcaauauggcaccauuugugcugcaggacacauggaguaauaagacgcugaauuuugggugcuuugguccuagguuucuuaccuucuuuguuuaaaggcuuucuuacaacauacugguggacaucaucuucuuuagagagauugaaaaguuuguggauucugcuagcucuuuugggccccaggugaugaggcaucguaguaucagucaauccuggaauauuuuuaucuccuuuuuuuacaauaaccaaguuagagcacuccgauuggcauccacaaugcaaccacgaacugauuuucucuuucuuucuccaguucuccuuggucuguaacaggaaugccccuuacucauuagcaggcggacacggccaugaaucaagacaccccucuucauggggaaccauuguuugucauucccaccacugauuaggaccacauaacccuuccauucuucaaccagagcaucagcagcaacuucuguggccauaugcuucucauaaaaagugcagaguuugcguuuaucauccacuucaaugaguuucuggcagccaguggcugggaaagagauguccagcuucauc

SEQ ID NO: 16811 - RNA, 495 nt, Homo sapiens
ucuagugugugacugggucugugugagggagagagugugugugguguggaggugaaacggaggcaagaaagggggcuaccucaggagcgagggacaaagggggcgugaggcaccuaggccgcggcaccccggcgacaggaagccguccugaaccgggcuaccggguaggggaagggcccgcguaguccucgcagggccccagagcuggagucggcuccacagccccgggccgucggcuucucacuuccuggaccuccccggcgcccgggccugaggacuggcucggcggagggagaagaggaaacagacuugagcagcuccccguugucucgcaacuccacugccgaggaacucucauuucuucccucgcuccuucaccccccaccucauguagaagggugcugaggcgucgggagggaggaggagccugggcuaccgucccugcccuccccacccccuucccggggcgcuuuggugggcguggaguugggguug

SEQ ID NO: 16812 - RNA, 495 nt, Homo sapiens
caaccccaacuccacgcccaccaaagcgccccgggaaggggguggggagggcagggacgguagcccaggcuccuccucccucccgacgccucagcacccuucuacaugagguggggggugaaggagcgagggaagaaaugagaguuccucggcaguggaguugcgagacaacggggagcugcucaagucuguuuccucuucucccuccgccgagccaguccucaggcccgggcgccggggagguccaggaagugagaagccgacggcccggggcuguggagccgacuccagcucuggggcccugcgaggacuacgcgggcccuuccccuacccgguagcccgguucaggacggcuuccugucgccggggugccgcggccuaggugccucacgcccccuuugucccucgcuccugagguagcccccuuucuugccuccguuucaccuccacaccacacacacucucucccucacacagacccagucacacacuaga

SEQ ID NO: 16813 - RNA, 4306 nt, Homo sapiens
uccggcuuugcaucucauuuacauaaauauuuauuaaucgucauuaaacugaacagaaacacgcaaugcacuucggguguccgacgggaguuucaucuucgcuacaagaggaagguaaaauugcgugugugugggugagugugugggugugucgccugugggauugcauuuuugcaucguguauuuggaugccugauccccugccuccggugggcagagggucuccuuuugccccuuuuugggggaaccuccaguaggagcccucagaccucuccccgcccacccaccagcuaaagccaagaggacuccuuggaccaaaaaauacucucuccagacaccggaaaucgccagguggcacccaccgaggcacaguccgggcagggguggggcugcccccaggucuccauccccaccccucaccccaggaggggacagaauggccgcggggaggaggagccggcgagcucaccuccuucugccccccggacgccggcgccgggccugcuugugcgugcgguguggugugcgugugucuuucaugcaaacccucccuccccaaaccgaccccccaacaguuugccauuccauacaaauuuggaaacagguuuuuaaaaaacagcaugacgcacaacggggacggggcgggggagggcaguggcacuggggccccaaaucuccgagucacugauuguaagaaccuggggagggggagggggcggcgcgggcccccacuucaccaaagugcacagauccgcgcucgggcggggcggcccgcaggccgggcggggcaucccggggccgggccgggccgcgaggcucaguggagccuccuugcauagauauuugugucuuugauuauugguaguagugguuuuuuuuuguuuguuuuuuuguuuuuuguuuuuuuugccuuuuauugcuucuaaaaguccuuacugcguuuucucuccgauccggacucugcguucggcuuccgucgccucuuagcuuuuuuuuuuuuuuuuuuuuuuuuuuuuuuuuuuuuuuuuguauguuuguuuguuuaaaaaaaggaaaagggaaaaacggauucuaguuacaaauugucuuggccucucucuuuccucucaauccacuuccccucccgccaaaauuaaaaucgcaaaacgcggagacuggagguugggggugagggcguuccaggcccgggcuccggcgcccuaacuucuacccucuucaagaaagagggagcgccuggcuccuuuuugccucggcagcugggugucuguuuuuaaaauaauaaugagagggggaaacgcguuccauugcucagcugcccccuuaccaacgccuugggccugcagggaggagggggaggaggaaaccucagcgaagauauugggaaugggggaggggugccuccagggagcccccggagagaggucccuggagaagcacuccuugggagagaggaggagggaaccccuuggggagagagaaggcgaguccccugggggaagcgaggccccugggacaggccacccacagguaacaggacugcgcugccccaggagagcggcaggaccgguggcccgcuccccgcgcccggcgccgggguaggaugggggugucccugcgcucugggggcuggggacaggggggcgggcaaaggcaaaagaaaaagaagggagccggcgcgaagucucaguuaugaaaaaacgcauugagcuccucguacauggggccccggucguggugaaggugcauaucguaagacaagagauucuccgaguggacgcccccgcgcacagccgacgagccgaagacuagcccguggcccgugggccgcgaaccgggcagcgccgaguagugcauagaguagugguagcuuuucucguggucgggcgaggaguccugcuugagugagaaguugccauugagacagagcggggggcugagcgggcccucguacucggagcuguuguaguccgggcucgcgccgccaccgccugccgccgcauacagcgucucguaggcggcgcaguagccguggguccgcagggcgugcgccgcgccgccgcccaggccgccggccgccuggcacugugcgcccgccaggcgcgagcacggguacggguaggggugcauggcgaacgggccgcccgagccguggaagcggccggcaccgucggcgccuugcuccgugaggaaguugcgagaguugagcugcagacagccggccaccagauugguggugggcugcgacagacccuugcacagagucugcacguaggacacuaggucuggccgcuugccggagcgcaggaucuccgagagcgcccagauauaguucuuggcuaggcgcagcgucucgaucuuggacagcuucugcgucuuggaguagcagggcaccaccuugcgcagguuguccagggcugcguucaggucgugcaugcgguugcgcucccgcgcguucgccuucugccgccgaagcuuggagcgcuccaagcgcgccuuggucaucuugcgcuucuugggcccgcgcuucuugggccgcucgcccuccgccucguccaguccuucuuccuccuccucuuccuccuccuccucuccccccagcucgccuuccuccuugaccucggccaacguggccuccguccccucuucuccacggagagggacuggcuuggccgcccgggcuggccccggagccccuggcccgggcgcaggcgguggcgguggcggcgcgucgcccuugucgcuccucggcucgucgucuucgccgucgccccagcuggcgaacuugggcacguccgagagaaggccgggcucgcugaacaggcgggucagcauggugccugagggcgccccgcgggcgggaaggggagacagacagcacaaagugaggggcgcgcugggguaccgacgcccccccacaacccuccuccacccccgagucucgugcgggcuccugccuaggcuacccuggaugcccaccuccgccgccugccccgcccagagccggcccagcccuacccggcugccggccugggaucucggcccaggcccucuccccggcgcugggccccggcuccgccccucgcuugaauggggggcugcuccccgcgccugcuucuucucagggucagggcagggaccggguggggguuuuagggaccagauaucuuugccaggggaggcggcgcgcucgcccugaaagcccguucucuccuggcgguggagagaggcuggucggccgccgguggggacagcugccccgcuccgcgcucucgcggcccgggccccccggcccagcucccucaccccucccguggcucucacccccacgcucccuaauccaauuugcaacuuggcugcgcgccgccccuugcucggcccccacccccgcacccccaauuccagaggcgggaggaucgucuccucuagccgaugcguccccagcucccggagccggcucugggcggcgaggacugaagcagcggggcguggggaggagacugagagaagcgagcccaguccguccccucugcggucagggacccccuucccccuucaagcugacucccucccacaaggcucuucagaucucguuguauuuugggauugaugggggaaaaauccaaauuuguuuguuugcuucccuuuuuucggugguggggaaagguggcaggcuuuuugggacaaccauggagggguccuccgucucggccucuucgcauaucccccuccgugauccugccuuccccccccaccgagcccaucgcaggcagagacaccuccucugcagcccccugggcugcagccccuaagggagagagaaccuggggccccuccgaugcccacccaaugaggggggcaucaucccaggaaggagguauuugaggacccuccugucggccgaagcugccgccccuccucccaaccggcgggucagaucucgcucccuuucggacaacuuaccucggagaggagucaaggggagaggggaggggagggggggagggggcaagagagagaggggggagaagagggaucuucucgcuuauuucauuguucccccaucuucagggagcgggggcagcggcuccucaaggcggcgggcgccggcgucuucagagcgccaugcgaaccgcggagcgaguguggcaucucuaccaggcgggguaccagccucuaugccaggccauaugggcuuggcacgucacgggcagcagcuaucacaugagagacggugauuggcaugcgucugcacugggggagagccggcucccccgggacccgccgccaucugucacucucuacucca

SEQ ID NO: 16814 - RNA, 10019 nt, Homo sapiens
gcaguuauuuacaaagauuuauuacagcacgggagggguucaggccuggagucagggaagaaggggaaaggggcagagcagcugggggacaaggaaaaccuggcgccccccgcugugugccccaccggggacauaaacuaggcggcauuccuggcaucaaagcacaaaacgcaacaaagaggucucugccaguccaucuuccaggcacccaggaggagcaagggugauuaagggaagauucccaaaauguugaggcuauggagaaaaacgccuuaguccuggacccugguagaagccggugagagaaguggugacuuggaauccuccauaggaaaguggguagaaaaggaucuaaggguaccucaagguucucaggaccuccuuuccccagaucuuaggguccugcccugugggucuccuguguccaggggagaggaucuggggaguagaauugugaagggcaaaucccuguucccgguuuucuggauuuuccaaugugggcugucucacaucccaccucccgcugggugaauggaggaaugacuggcaggggugggcaucaggcagcaagugcccagguucucuggguaucagccaaaggugggcaaacaagcaaacacagaccagccuuagucuucuagaagucagaagccgcagcccuagcaggcgaggggaagagcacaaaacagggugaggauagaguggguuucuggggaacagcgauguccccuccacuuccuccugggagaugcaggcugggugccuaugugccaggcucagagggggaagggcgcugagguuccuccccaggcucugaaaggcaagcagagagggacucagggccuggccccacccaccaagaucccagccccuccuccccauuucacacucccaagccuuaccacuuagugcugggucuuccacuugguccucagagccuccaucucucucggacucauccagagggggugggcgcucccagggcccuuccagacccuggccacagguugucuuuugcccagcuggggaugggaaagaagagauaagaacacaggcucugcguauccauccggcuguccuggagugugagcuaagugucugauggcugagguuaagcuuuccaggggcaucauggaagcauggagagagaacugggcuagaacagcucucccagcaacuagccauauggcuuacguaagucaguuaguaccuuucugaaggaaauagaaagggggaaauuguguagauuaccuuaaacaagauguaauagugaauacccugcccagcccagcgccagcacccaggagccacuaggagucguggugguuuauauugcuccaucauaggacuaucauuugacccggugcccuucugcauuuuuuguuuguuuguuuuuuuuuguuguuuuguuuugguuuuuuguuuuuguuuuugagauggagucucacucuguugcccaggcuggagugcaguggugcgaucucagcucacugcaacuuccaccucccagguucaggggauucuucugccucagccucccaagcagcugggauuacaggugugugccacugugccuggcuaauuuuuguauuuuuauuacagaugggguuucaccauguuggcuggacuggucuugaacuccagaccucaagugauccgcuagccuuggcaucccaaagugcuggaauuacaggcaugagccaccgcacccagccaccugcugcuuuuccugagggaacagucuccucucaccccucuuccacuguuuuggaggggucucagugaggacugauucaggucuuccagcugucucuugcccacaaagggacugaagcccagcaacagcuuuugcccccauggccaaucucuucacugccagauaugcaggcaggaggcccaaggccuuuuguuuguguggaagagcugacagcuucuaguaggggugguugacucuucaguauucccauaaauaaugagacuaaaaagguuaaugggccgggcugguucuugaauuuuaaauucuacaucuaaacacuagagggcacccucccacuccauccuaggaaggaaaaagaggagaaacagacaacaguccuggagagggcaaguaaaugaggcagcccucugcaccccagcagagaccacauccuagguucaaaaauguaggugaaaugcaggugacagggguguuggacucuccugguccuccaucccugaauguccucacgcccccuuacugccauaggugggaaguccucuuuuggcucuagccucaaaccccaaacggccuuggccuuaauucucagggaagagaggaauuauuagggaaaaccugauugggagagggacugagccaaggauggaggaaacccaugucucagguagggcugaguucggggcaccccauggagcgagaagacagggaggccccuguggugucacuacaguuugcguguaugagacacugaacuagaaggggacguccucguauacucaaggaggacccacagcuaauccacaugucacaggccccucagcuuaccagacugccugaugaccuucaggacuucagccuggcuguccucuucuucuuccucuucuucaucauccuccucuuccuccucaucuuccucucuuggauaacccagcucccgaagcucccccagcucauccuccuccucugaggccugguucucauucaaauugcugauagacugcaggugagacucagcaaugcgcugcacagcuggcacagaggagaccgaggaaagcaagggucagcuagacacagcccauggaucuggagauagccuguggccuagcccccagccuccuucccguaggccuggggcagagaauacccccucaggggcccaaguucaaaggccaaaguugacaggucagccugaugggugucagaccagggcagaggcagccagggguagauuugaucauguuuggcucuuaagcuguccuaagaugcuagcccccaggcagcucccccacaccauagggcacuaggcugggcaagaccaggcgggcacagcagcagcuuaacauucccuggcuggagagcuugauuuuccaaguacccaguacgggagacagugucucccagcuucaagcccaggcagaaggcacagggcguaggaaccagggccuggggauuugccacuuuccauuucuugggggugcccagccugcugagggcucacugcuuacccugauccuaccucccaugcgaugcauaguccccacucccuggcacugcccagucauagaugccaauccacauacuccugccccgggcuccaagggacagaacaauuccgaggcugaggacauaauagucugcagccagugcagucugugccgggggaugcggcaugcucagaugcggcccccacaaucuugacccacauccccagguucccagcucccucugcggugaccuagaaagcaacccccccagccuccaaagaccugcucagauagggcugggaagggaacagugugggcagcuggagacaaguuuccaaaagauggaaaggagcaagggguuagagaaaggggccaaggccagggguucugggggauggcagagguugaggggccacugaggagaggcugcaggagcuggcaggaucuuagaacauaugcgacacaaaguucacaggccacagacaagaugcugaggaggggcuggggguggggaauggggaguugcugcaguuccuucuuggucugccaguggccccuccccucagaaggcccagagggguagggccaggcuggaaaccuccggcacagugagcagggugcuaugcuccugccaacucggggacaggcacagagggugcuuuguaugugcccgcugccccacccagcccccagcucccagcccaguaccuccugcuggcucugggcaagcuauccaggcaauaaaagcacaauaaaucacccuacccugaccuuggggacgcggcagagcuucaucuugagccaagugugagagcuccagccuuggagcacaaccccucaagcuaagacuuagugcugugccccucucucuagggcccucgauucuucccugacaagccccaacccugccgggcaccuucccuugcccacaaaaggacugaagccuacaaaacagugcccuccugguagagaaggauccaugagggcuguggggggagguaaggcaggagagcagguggcagcccaggcagcuuccuucucccccagcgggggaggagaguucacuucgugagccacagugacaacagaaggugugugcggugcuugcgcuggugccccgugagccucccucgcuucccccaccucccucaugccuccugggcucucuggggucuccccaucacuccuuccaggcugucuccuucucugccccacucuguggggccccaaacuccccccaccacaagucuuccuucuucaguuggaagguccccagccuugccccagacuggccaccccucuccugaucccuuuccucuucccugccucuacucaccuggacucuccuaagauguggccuaaaggggcaguugagggggugcacaauuuugaccacugcacggugcaugguagcacccuggcccuaacaucuucauccuggccuguucgcccaugcuugcagucaagagccaggucuuccccucacauccacccagccucucccuacccagcccaaggugggagggagagggauuucuuaaauucucuccugagaagaugacacucugucccucaugccugcuuuggggcccuuccacacaccccucuagguggggagguccuuccaggugcugagccacacugcccacuugcugcagcucugacccuucauuuuccuguccuggggaaagcaaaauaaccccuucccuucucuccucccuucccagccucuccucucuguucccaacccuggcaagugggcugacagguauaccuguugaccuuggcuggugcugggaacuuauuaaacccucccccgaaccacuucccagcauacucuuccgguagcucucccucccaaccuccgcaggagcggagggggcuggccgggcaggaagagccccaggcaggaguugaggugggggguugguaggcaacagggcuuagucaggaagaggcccuccuauguccuucagguauaucuccccagcucccugacuagaaacgaagccuccuccagguuggcccagaagucccccucugacucgcaucucuuucucuuugcacaccuucuucccucuucuuggaccugggaugcccuugccugccuguuaaauuccuaugauccuucaaauccaagcuuaaacaucuuuguguaccuuccuugacccuuuucuuuuuuuauuuuuucccgagacaggcucucacucuguagcccagacuggagcacaguggugcgaucauagcucacugcagccucaaacuucugggcucaagcaauccuugugccuuagccucccaaguaucugggacuauaggugugcaccucuaugcuuagcucacuuuuuuuuuuuucuugagacagaguuuugcucuuuuugcccagacuggagugcaauggugcgaucucagcucaccacaaccucugccucccggguucaagugauucuccugccucagccuccugaguagcugagaugacaggcaugcgcuaccacgccuggcuaauuuuguauuuuuaauagagacaggauuucuccauguuggucaggcuggucucaaacuccugaccucaggugaucugcccgccucggccucccaaagugcugggauuacaggcgugagucacugcgcccggcccgcuuagcucacuuuguaaauuuuucauagagaugggggucucacuguauugcccaagcuggucucgaacuccuaggcucaagcaguccucccgccuuggccucccaaagugcugggauuucaggugugagccaccuuacuuggccccucccugacccuuugaggcaaagagccccaagggggcagggaccaaaucugacucaucuuauucugcccaaugcccaccaacuuggccuggcauauacuagguguugaguaagugugcaaaaggaauggcuugcuuuuccauggagaaagggaagcaggaaagaggagaccagugugcagaucugugcaaaugggaugcaaaugggaggggaggccaggggugaagcccacaggagaaggcgcccuggaugagcaggggugggaggugguccaccacaggcuggugaagaggagcugcagguggagucccuuccacgcggaugccugcugguugucuuaggccagccaucucuuuucuuucaagcccacaacccgauguuaaggcccauagcugcccauugcagccucgggacuccuguguuuugcaaggccagacugagaaaaaauuggucuuuacguuggguuguugcgccacgcugacagcgggcuauguguggcgaaacaaucccuccccacugacaaaagcuccccuagcgucugcccaguuccagggaucaggcggacagccaggaaggucgguggggguauaguaccuuucagcgaaggugguguguaggcacagggguugggucucuucgacuugagauggugccccucuccugaggcucucugccaggggaagugccagguuaaaggggcucagcagaggcccuugccuucaccaucccuccauuccaucccacccauggccacccaagcagacugauuuagccacugcuaauggguccugcaccuaggcugagccuccccacccuguggcuuuagggggggccccccauaagccauggccugguucagggcaggacucuagguccaggagguuccacccugagucugagcagaggaggaucugcugguggcacccuggcaugaggcacucucagaggacugcccauugauaugcuaauguguccucuuggguggcaccccauacugguugguugucacugcaggcacccguccaccccaccccaaggggcccaggcaucccuccuuccagcugccccaggaaacucaccugguggggggaggcuuccuccucugaggaaggccaccaaagccaaccgaaccagaaccaagcgaggaggaaaagagaagagggagagagagaaagaauccgaguuauuuuccccagggucucaaucucuggggacagggaaagugugcccucucccuccugcggcugggaggugucaugucaauaaauaaagccaauagaguuggguucccagaccuuauccacuccccagucuccagcuuugacuccuguucaugggacuuuggcagggccccuaggaaggcaucagagcuaggguggggccagggcuaagugggcagggaggggccuaccuggugaggagugcucugagagccggaacagcauggcaggcguuggucuccugcgccggaucuaaggagauggagggaggggugacuggauggacaccugcagcccucccccacccccaggcagcagggaacaaacagugcuuuggaguccccagggaaccuuugaaucaaagucugucagagccaaaaggaacucuguagcucaccuaacccccucauuuuacagaggugaaaaagcagggcucagagagauuuggcaaugugcuuaaggccacacagcacaacaaguccaaaggacgagaaaaaccccagucacugacucccagcccaugccugucccacuccauggcuacuccagaacagacaucucccuuccuaucuucucccaccaaggcccuuccucucuccaguuucugaaaacaucagaccucggaagccaaagcuggcuacagcuccagcugccacggcugggcccucuggggaagaugccccacgggccauggcacccauguggcccugcccaccuaagaucagcucaagggcuucaaacaagcuggauccagcuuuucagaaggagacugagccagcgcacugcaggcaccccccaccuccagcugaggcucagggacccaaaggggccugggggaccucucugggggccuugguuugggcuucuuuuccagucucuguaaggcugcagaacucuucacccaguccuugugagaaaugaaaaguugcccuccuugcuacgugagccaagcagcaacugaccgccccccuccccgccccgccccucagcuuggcaaucagaccaacugucaguuaauuaggucccuguugagcuccagggaaaugcacaaagagaaccaggugaguuaagcugaaacugccaccuccccagccaagcuccccaugacacccucaugacccaaagcugcuuaggcccaggacuguacccccugcccucuaucuccccccauaaugacuuggcccccucaucacugcucaguggggagccagcugcaucucagcucagcaacaagugaccccugcuccacuagggaugggaaguggagcucucugucacagcacccgccagccuuuggaagccccucaacccccaagaaggcccucaggaggacucaguagucugugggaagaggucuggcuuugugaugacuccccaccucucccuccuugggguuggggcucuggggccugacagcaggaggccagagccagguucuggagaccccagcccaggcacacacgcgggauuagagaggggcaggguaguggauucacccgguggcagccucauacuccugcccugggugacaaggucaguguccaccgcugcucacaucugaccagcucugggacagagccaggcggagcggucccggugguagccuaggagacugacuacccuuuggggacugugcugggaccaaaggacgcccccaccccacuccugggcggucuggaaucggccuguccccccacccccgcacccccagccucacugccaggaacucucuugccccgggaucaggaccaaagccgcggggaaaaguugcacgagucuccagcuaacuucacacgcggccccgcgccccguccugaccgaggcagagcccggcucuccuugcgcccccacccccaggccaguccggccggggcagcgccuugggagggcgaagaagccccgcggggugugucggguacgcugccgggguggggcacgggccccuuaccaucuccaccuggcgggggucgagcuggcuagggggcgcgggcaccgagaacuggaucuucuugcgguccuugggguccauggcgcgcggggugggcgguggggcuggggugcgcgacucggggucccggcggcggucugugcugggcucccccgcgcaggcggcgggcugugcggcgagaggaggaggagggcuguucgcgcacggauaaaaauaccgugcccgccgaggggagggcgcgggagcgggaggagggucggcgcccgggcugggcgcgcccccaggcucucgggacucggggcucgccccccgcgcucgcugagccaggucugugccucgcucccucgcgcuccccggccugggugucucugcgucucggugucucuccccuccugagugucucugcgucucggugucucuccccuccugagugucucugcgugucuccucucucugccucucccguccuucuccaccucccucccucagccucuccuccucuccgcgugugucucugccucugccgggcucacccuccggucccagcuuugggguccccagcccguccccuccgccugggacuggcgcccgggugcucggagggaggguuuaggggaaacuggccaaugagcauggagaaucguguucuccuggggcugggaggagggugggaguuagagccaaggccuggggagccagcuggggggcccccugcggucuccccagaacuugaagcugcauuauugauggaguccagcagagaggauaaagggggagggagggggagaggggcagcggggaggcaggacucuggcuuuaaccccuucgugguccugguacugggaguuucagagaggccugcga

SEQ ID NO: 16815 - RNA, 7703 nt, Homo sapiens
cuccagccccggcccugcgcagaagcggacucaaaggccggagucuaagggccuaccuaaggguaggggagugggaagaagaccagggccgucguuauuaggccacacaggccuggcacugagggaaaaaggggaauuucccgaggggaguccuguggggauggggaaaucuuuggaggaauccaguuauucgagaaggacuuccccaccccaccugccuccuucagccaucccaagcagcagcuagaacuucuguaguucuuccucugagugccccgagccugcugucugccagaaagacuccuagacuagaggauuggacaguagggucaaaacccuaacccuugguugaccaccggccuucccuaucaggacgccccauuaccucccuuuuccuccugcuuccccugaaagaggagucucagcaguuauuuacaaagauuuauuacagcacgggagggguucaggccuggagucagggaagaaggggaaaggggcagagcagcugggggacaaggaaaaccuggcgccccccgcugugugccccaccggggacauaaacuaggcggcauuccuggcaucaaagcacaaaacgcaacaaagaggucucugccaguccaucuuccaggcacccaggaggagcaagggugauuaagggaagauucccaaaauguugaggcuauggagaaaaacgccuuaguccuggacccugguagaagccggugagagaaguggugacuuggaauccuccauaggaaaguggguagaaaaggaucuaaggguaccucaagguucucaggaccuccuuuccccagaucuuaggguccugcccugugggucuccuguguccaggggagaggaucuggggaguagaauugugaagggcaaaucccuguucccgguuuucuggauuuuccaaugugggcugucucacaucccaccucccgcugggugaauggaggaaugacuggcaggggugggcaucaggcagcaagugcccagguucucuggguaucagccaaaggugggcaaacaagcaaacacagaccagccuuagucuucuagaagucagaagccgcagcccuagcaggcgaggggaagagcacaaaacagggugaggauagaguggguuucuggggaacagcgauguccccuccacuuccuccugggagaugcaggcugggugccuaugugccaggcucagagggggaagggcgcugagguuccuccccaggcucugaaaggcaagcagagagggacucagggccuggccccacccaccaagaucccagccccuccuccccauuucacacucccaagccuuaccacuuagugcugggucuuccacuugguccucagagccuccaucucucucggacucauccagagggggugggcgcucccagggcccuuccagacccuggccacagguugucuuuugcccagcuggggaugggaaagaagagauaagaacacaggcucugcguauccauccggcuguccuggagugugagcuaagugucugauggcugagguuaagcuuuccaggggcaucauggaagcauggagagagaacugggcuagaacagcucucccagcaacuagccauauggcuuacguaagucaguuaguaccuuucugaaggaaauagaaagggggaaauuguguagauuaccuuaaacaagauguaauagugaauacccugcccagcccagcgccagcacccaggagccacuaggagucguggugguuuauauugcuccaucauaggacuaucauuugacccggugcccuucugcauuuuuuguuuguuuguuuuuuuuuguuguuuuguuuugguuuuuuguuuuuguuuuugagauggagucucacucuguugcccaggcuggagugcaguggugcgaucucagcucacugcaacuuccaccucccagguucaggggauucuucugccucagccucccaagcagcugggauuacaggugugugccacugugccuggcuaauuuuuguauuuuuauuacagaugggguuucaccauguuggcuggacuggucuugaacuccagaccucaagugauccgcuagccuuggcaucccaaagugcuggaauuacaggcaugagccaccgcacccagccaccugcugcuuuuccugagggaacagucuccucucaccccucuuccacuguuuuggaggggucucagugaggacugauucaggucuuccagcugucucuugcccacaaagggacugaagcccagcaacagcuuuugcccccauggccaaucucuucacugccagauaugcaggcaggaggcccaaggccuuuuguuuguguggaagagcugacagcuucuaguaggggugguugacucuucaguauucccauaaauaaugagacuaaaaagguuaaugggccgggcugguucuugaauuuuaaauucuacaucuaaacacuagagggcacccucccacuccauccuaggaaggaaaaagaggagaaacagacaacaguccuggagagggcaaguaaaugaggcagcccucugcaccccagcagagaccacauccuagguucaaaaauguaggugaaaugcaggugacagggguguuggacucuccugguccuccaucccugaauguccucacgcccccuuacugccauaggugggaaguccucuuuuggcucuagccucaaaccccaaacggccuuggccuuaauucucagggaagagaggaauuauuagggaaaaccugauugggagagggacugagccaaggauggaggaaacccaugucucagguagggcugaguucggggcaccccauggagcgagaagacagggaggccccuguggugucacuacaguuugcguguaugagacacugaacuagaaggggacguccucguauacucaaggaggacccacagcuaauccacaugucacaggccccucagcuuaccagacugccugaugaccuucaggacuucagccuggcuguccucuucuucuuccucuucuucaucauccuccucuuccuccucaucuuccucucuuggauaacccagcucccgaagcucccccagcucauccuccuccucugaggccugguucucauucaaauugcugauagacugcaggugagacucagcaaugcgcugcacagcuggcacagaggagaccgaggaaagcaagggucagcuagacacagcccauggaucuggagauagccuguggccuagcccccagccuccuucccguaggccuggggcagagaauacccccucaggggcccaaguucaaaggccaaaguugacaggucagccugaugggugucagaccagggcagaggcagccagggguagauuugaucauguuuggcucuuaagcuguccuaagaugcuagcccccaggcagcucccccacaccauagggcacuaggcugggcaagaccaggcgggcacagcagcagcuuaacauucccuggcuggagagcuugauuuuccaaguacccaguacgggagacagugucucccagcuucaagcccaggcagaaggcacagggcguaggaaccagggccuggggauuugccacuuuccauuucuugggggugcccagccugcugagggcucacugcuuacccugauccuaccucccaugcgaugcauaguccccacucccuggcacugcccagucauagaugccaauccacauacuccugccccgggcuccaagggacagaacaauuccgaggcugaggacauaauagucugcagccagugcagucugugccgggggaugcggcaugcucagaugcggcccccacaaucuugacccacauccccagguucccagcucccucugcggugaccuagaaagcaacccccccagccuccaaagaccugcucagauagggcugggaagggaacagugugggcagcuggagacaaguuuccaaaagauggaaaggagcaagggguuagagaaaggggccaaggccagggguucugggggauggcagagguugaggggccacugaggagaggcugcaggagcuggcaggaucuuagaacauaugcgacacaaaguucacaggccacagacaagaugcugaggaggggcuggggguggggaauggggaguugcugcaguuccuucuuggucugccaguggccccuccccucagaaggcccagagggguagggccaggcuggaaaccuccggcacagugagcagggugcuaugcuccugccaacucggggacaggcacagagggugcuuuguaugugcccgcugccccacccagcccccagcucccagcccaguaccuccugcuggcucugggcaagcuauccaggcaauaaaagcacaauaaaucacccuacccugaccuuggggacgcggcagagcuucaucuugagccaagugugagagcuccagccuuggagcacaaccccucaagcuaagacuuagugcugugccccucucucuagggcccucgauucuucccugacaagccccaacccugccgggcaccuucccuugcccacaaaaggacugaagccuacaaaacagugcccuccugguagagaaggauccaugagggcuguggggggagguaaggcaggagagcagguggcagcccaggcagcuuccuucucccccagcgggggaggagaguucacuucgugagccacagugacaacagaaggugugugcggugcuugcgcuggugccccgugagccucccucgcuucccccaccucccucaugccuccugggcucucuggggucuccccaucacuccuuccaggcugucuccuucucugccccacucuguggggccccaaacuccccccaccacaagucuuccuucuucaguuggaagguccccagccuugccccagacuggccaccccucuccugaucccuuuccucuucccugccucuacucaccuggacucuccuaagauguggccuaaaggggcaguugagggggugcacaauuuugaccacugcacggugcaugguagcacccuggcccuaacaucuucauccuggccuguucgcccaugcuugcagucaagagccaggucuuccccucacauccacccagccucucccuacccagcccaaggugggagggagagggauuucuuaaauucucuccugagaagaugacacucugucccucaugccugcuuuggggcccuuccacacaccccucuagguggggagguccuuccaggugcugagccacacugcccacuugcugcagcucugacccuucauuuuccuguccuggggaaagcaaaauaaccccuucccuucucuccucccuucccagccucuccucucuguucccaacccuggcaagugggcugacagguauaccuguugaccuuggcuggugcugggaacuuauuaaacccucccccgaaccacuucccagcauacucuuccgguagcucucccucccaaccuccgcaggagcggagggggcuggccgggcaggaagagccccaggcaggaguugaggugggggguugguaggcaacagggcuuagucaggaagaggcccuccuauguccuucagguauaucuccccagcucccugacuagaaacgaagccuccuccagguuggcccagaagucccccucugacucgcaucucuuucucuuugcacaccuucuucccucuucuuggaccugggaugcccuugccugccuguuaaauuccuaugauccuucaaauccaagcuuaaacaucuuuguguaccuuccuugacccuuuucuuuuuuuauuuuuucccgagacaggcucucacucuguagcccagacuggagcacaguggugcgaucauagcucacugcagccucaaacuucugggcucaagcaauccuugugccuuagccucccaaguaucugggacuauaggugugcaccucuaugcuuagcucacuuuuuuuuuuuucuugagacagaguuuugcucuuuuugcccagacuggagugcaauggugcgaucucagcucaccacaaccucugccucccggguucaagugauucuccugccucagccuccugaguagcugagaugacaggcaugcgcuaccacgccuggcuaauuuuguauuuuuaauagagacaggauuucuccauguuggucaggcuggucucaaacuccugaccucaggugaucugcccgccucggccucccaaagugcugggauuacaggcgugagucacugcgcccggcccgcuuagcucacuuuguaaauuuuucauagagaugggggucucacuguauugcccaagcuggucucgaacuccuaggcucaagcaguccucccgccuuggccucccaaagugcugggauuucaggugugagccaccuuacuuggccccucccugacccuuugaggcaaagagccccaagggggcagggaccaaaucugacucaucuuauucugcccaaugcccaccaacuuggccuggcauauacuagguguugaguaagugugcaaaaggaauggcuugcuuuuccauggagaaagggaagcaggaaagaggagaccagugugcagaucugugcaaaugggaugcaaaugggaggggaggccaggggugaagcccacaggagaaggcgcccuggaugagcaggggugggaggugguccaccacaggcuggugaagaggagcugcagguggagucccuuccacgcggaugccugcugguugucuuaggccagccaucucuuuucuuucaagcccacaacccgauguuaaggcccauagcugcccauugcagccucgggacuccuguguuuugcaaggccagacugagaaaaaauuggucuuuacguuggguuguugcgccacgcugacagcgggcuauguguggcgaaacaaucccuccccacugacaaaagcuccccuagcgucugcccaguuccagggaucaggcggacagccaggaaggucgguggggguauaguaccuuucagcgaaggugguguguaggcacagggguugggucucuucgacuugagauggugccccucuccugaggcucucugccaggggaagugccagguuaaaggggcucagcagaggcccuugccuucaccaucccuccauuccaucccacccauggccacccaagcagacugauuuagccacugcuaauggguccugcaccuaggcugagccuccccacccuguggcuuuagggggggccccccauaagccauggccugguucagggcaggacucuagguccaggagguuccacccugagucugagcagaggaggaucugcugguggcacccuggcaugaggcacucucagaggacugcccauugauaugcuaauguguccucuuggguggcaccccauacugguugguugucacugcaggcacccguccaccccaccccaaggggcccaggcaucccuccuuccagcugccccaggaaacucaccugguggggggaggcuuccuccucugaggaaggccaccaaagccaaccgaaccagaaccaagcgaggaggaaaagagaagagggagagagagaaagaauccgaguuauuuuccccagggucucaaucucuggggacagggaaagugugcccucucccuccugcggcugggaggugucaugucaauaaauaaagccaauagaguuggguuccca

SEQ ID NO: 16816 - RNA, 1408 nt, Homo sapiens
cacuaguuagcauuaguguuuguagcgccacuuuacugccaauagcugacauugcccuggguuaggggagaauaaauaaaaucuguggcaucagacagguauuaccgaggcgaagaguggacugggcuuucgugggcacuuacccugggaaggggguaugagguggcuggagaaguguucauggagagugucucucuccugcccccaaggccacggaaucuucuauuccuucuuuguacccaaagggcaaaguggaggccagggucucuuugcuaaggagcuaaguaggggaaagaggcagggggagcucccagcaggaccaaagggagaccaagguuuggaccccagaacagagcaggaacccagaguccugugcagucacaggaugacgcagggaggacggcuguuggugaucuuuucuaggguuucuccauuacuggcucuucggauggccucaaugagcuagaggaguggaaugacaggaugaugcacuguugggguagggugaccaagagguccucccaacgcuguaaauacucacaucuuucucauagggaaagcccccauucuccagcuuggagaacaccagcuguccauuuaucucuaucucaaaggcaccugguaagaaaucaacagauaaaugguacacugagaacauaggcagaagucaggaguuccuccaaaggggucccccgccuucaagucccccaucaaucccacuggagacccauuuguagcuccuuaagcaauuccccaacccugggucaacuccagggaaccugagggaggccucgccugugugccccucgcaacacucaauaaaggacucccuccccuccaacccuacacgauugcagucuaauagguuuuuccccacaggccucugugacacccccugaccuauggaagggaacucauguuggccggacauuuuaccaugugccaggcacugcgggcacuuuacauaaagcagccaaugucagaacuagaaagcgggagagcugggauucagagcacagacugacccagcagguguucugcgagccucaccugugcccccgaggcgcgacucgaucucgaugcccggauacugcuccuucacagcacuggccagcuccagguaggucgccucgaagccgcaggguucacuggggagucaagagauggggcugggcuggggauucggggguggggccucccguggacccaccuccguccggcccgcgggaccagggugcggguccuccagccggggccgcucaccaguacuccaccacgaugcggaccccacugcccggcucgaccuccucgggagggggcgcuacggacgucugccccggcuccccgcucaucgcggccggcuccgcucgggccccugcuuccgggugugacgcgaaccgcgggcacg

SEQ ID NO: 16817 - RNA, 1408 nt, Homo sapiens
cgugcccgcgguucgcgucacacccggaagcaggggcccgagcggagccggccgcgaugagcggggagccggggcagacguccguagcgcccccucccgaggaggucgagccgggcagugggguccgcaucgugguggaguacuggugagcggccccggcuggaggacccgcacccuggucccgcgggccggacggagguggguccacgggaggccccacccccgaauccccagcccagccccaucucuugacuccccagugaacccugcggcuucgaggcgaccuaccuggagcuggccagugcugugaaggagcaguauccgggcaucgagaucgagucgcgccucgggggcacaggugaggcucgcagaacaccugcugggucagucugugcucugaaucccagcucucccgcuuucuaguucugacauuggcugcuuuauguaaagugcccgcagugccuggcacaugguaaaauguccggccaacaugaguucccuuccauaggucagggggugucacagaggccuguggggaaaaaccuauuagacugcaaucguguaggguuggaggggagggaguccuuuauugaguguugcgaggggcacacaggcgaggccucccucagguucccuggaguugacccaggguuggggaauugcuuaaggagcuacaaaugggucuccagugggauugaugggggacuugaaggcgggggaccccuuuggaggaacuccugacuucugccuauguucucaguguaccauuuaucuguugauuucuuaccaggugccuuugagauagagauaaauggacagcugguguucuccaagcuggagaaugggggcuuucccuaugagaaagaugugaguauuuacagcguugggaggaccucuuggucacccuaccccaacagugcaucauccugucauuccacuccucuagcucauugaggccauccgaagagccaguaauggagaaacccuagaaaagaucaccaacagccguccucccugcgucauccugugacugcacaggacucuggguuccugcucuguucugggguccaaaccuuggucucccuuugguccugcugggagcucccccugccucuuuccccuacuuagcuccuuagcaaagagacccuggccuccacuuugcccuuuggguacaaagaaggaauagaagauuccguggccuugggggcaggagagagacacucuccaugaacacuucuccagccaccucauacccccuucccaggguaagugcccacgaaagcccaguccacucuucgccucgguaauaccugucugaugccacagauuuuauuuauucuccccuaacccagggcaaugucagcuauuggcaguaaaguggcgcuacaaacacuaaugcuaacuagug

SEQ ID NO: 16818 - RNA, 6691 nt, Homo sapiens
aaacuacaacucccaggaggcgucgggagggccggcccggagccagcggaagaaacuacaacucccagaaggcgucgggcgugccggcgcggggcggugacguacggggaccggcgcggagcgcugauucggccggagcugccagcggggaggcugcagccgcggguuguuacagcugcuggagcagcagcggcccccgcucccgggaaccguucccgggccguugaucuucggccccacacggugagcccggaaggaaccaagaggccccagggcuacgggaggggcgggagagaaggugggggcugcuggggaggcgccccgggcuggagagacgggggcagagggagugggggguggagggagugcaucagccgagggggugcaucggcuggggagguggccaaggaauaaagugcgagcgggaggccggggguggaacgucgggaggagcgccucggcuaggggugggaggcggggagcggcucggcuucggggauaaacguuuggcugccuccagggcugggugaacgcguggagauggcuguggggucccggaccggaccggguuccgagugcgaagacccaggcuggggaacagagcgggaccccuccccccggccccgcacccgaggucucacucagaaaaccccaacaacagugaggacuccgccucuucgcuccuccucuccugugcuuagugcggguucgccugggcacucgcuuuccgcuccuaccgcccucccccagucgggguggcugggccaaaguugagagguuaucagcugugguccugcagcuuggggggugggcggaauggacauggcauugugacgugcugccccggacuccccguugggguccccauccaggccuggauguuuugugcuccucuuccagaagacaggagguuugcuguugugagggcugcucuuuccugggggagggaaugggaagggcucaccugguggcugcccugguggugcucagccuuggcuugagugucuggcauacuggcugggcccggauauuuguauguggagccaagaggguggggcgggaaggagggggaaagagcuaccagcaaaaaagugguuaacacaacagaguugcugcaggcucugguuugaggcagguuaugaaaccacaucagggcccagcacuaagcagccaccugccagcuauggcagcagaaguuuucggcucaacuccuguagaccuagucgaccucugccagccucuucucucuguuucuccccaucuaggguaggggccaguugguuguuuuacuaauggaagugauauguauccauagucacacgaaagucucaagaguguuuccucauugccagucuuuuuguuaguuuauugaucucuucuuuuucaggggucucuggugguuuccugcucucagggcaccuaguguuuaggcuucaggaagaagcuucugaggguguuggcuaggaccuaggucuaggcuuuuccuaggcucaucaaguuuuguuggcugcccugugaaagccagaaaggcguaugggguccugugaucugggauuccccaaggcuuuuggcacuccuggacaaauacuaggaaggguuaguggacuuucuauaccagcaccccuguaggugcggguuacagagaggugaugggguggcaguuucaggucagacuugggaagcucuuucccucuccuuagucagaguuaaguccuucagagcccucacuugucagccacaugccgcccuccccucucagguggaggcuuuugcguagcagcugucccaggggcugcuagaguaacugaagccccaaggcccugggaagauaaacaaucugagccagcucuggcuuucuagauacuugaauuucuguuaggcucaauuauccagccuagugggcugcgcugaugggucccaggagcaucucuucaaucagaaugcgccccaggcuggcgcacggguguuugcuuguugggauggcguguugugggucacauuuucucugaggucucuaagcuuggagcugucugagaagaggaaacuugcuccuguuauccuggaaguaaauaacuggccccugaggacucagucuccugugcagguuuggcuaggauccuagucagagauagauagcaucugggucugacgggguugcugcaggggcgugagggagguggccuucuggguacuucuagaauaucuccaucugggacucuuuucugcauucccaggaaagauggggcuguuaccauggugaugaccuuacggucuuuagcaagcaggacccuaucucagauagggaggugagccaguacacaggugccaucugucuccacuuucuccuggucacagggcccucagggaucuggggacagccaaacucuggauaaggggcagaucauuccaccccuuccuucucuacuucccucugcucacuguggguugcggccaccuccugguuccuccugcugcaggacuccuaccguuggugcugggcaggggaaggcauggugcuaauauacaccuggaaacaggugcugagaggggagacugaggugaggaugggcaggacagagaagaacgggggcaggagggaggccacagguucgagucugugcccuuaggagacauauguugagguggauuccagcucucuaugggaguuacagguguuggccacguucucuauccucgccucucuuguggggaaaagggcccuggugguuuggcaguggaguggguagcaucacaaggguuggccugaguggcugccaaauggagaaaacauccggauggguuguuuugugucacccaggaggggugccuucuaggucugggcaaagguugucccuagucuguuguuuucuccuuucuuccucccuuccucccuccccacuucccucuuucuaccugaucaguccuccuaaguugggguuuggggagauccagaauugaaaaaaucagaggaggugaguggaugcagugaccucaaaauaguucauccacugcugccuguacccacaggccucacuuccuuucccuccugaugggaagagcuuaagagcagaugucccacauuaggccuucagugagacacaguccagcagggguugugcugagugagaauucucucccuggggcuuugucggcagaggguccucaugggagugccauagggggugaggcugggggaugggccuugacuucucugcccuggggcugcgugccucuugaugaccuguccuccgaugcccugccagggcccugucccaaugggaugaugcauggggcagccuguuguuuaucccagcccagcagcaggaaaugaguagagcuaaguccacauggacuuucuccacuuuccaugcuucagaaucaaaagaguggaacugccuggaguucucagggaaacaagggccugccucccagcgggauccgagggugagagggggcagggaaagcagugugaccugucugaccugugcugcuuguuugcagaacagcagagaggggcagcaggaugaaugugggcacagcgcacagcgaggugaaccccaacacgcgggugaugaacagccguggcaucuggcucuccuacgugcuggccaucggucuccuccacaucgugcugcugagcaucccguuugugagugucccugucgucuggacccucaccaaccucauucacaacauggugagagccugucugcugccugccccugccccugccccugcccugugggcugcccuuuggcagggcugagggauaggaggagccugucgggccuggcccaggugucagggugauguacugacgacaucugccuccagagcccaggccuagcccuuaccucucugccuugcucccccuucuggguuccugcccuguguaccaugacaggaaucaaaucugcagauuuuuccacaucucuagggugggguggcuguuggccuggaagaugugcuccugagagcugaacaaagggcuccagagaguucccaggacccgagaguccuggugccuaggcugauacagaaaugccccuuucucaaguuagcuucucgaaccgucuuccacuuuugcccuucucugcucccucaccacuugcuaccuugcacucuuugucggguaagcagggcuuagucccaucgcuugccuccucccaacaggcacagggggcuaugaguggccuggaggggggcagcaucucggugccuaucuuguggccaacuuccaccgugcauucucaugccaggccuagcccgucccccagggaguccccuuguucuucuccugccauacucccagcugcuccauccugaccuccagcccauaucccccugcccagcagagggaggcuccagaucacugggaguuacuugugucugugacuggguggaggagcugggcaggggggccuuucccuuuuguauccucuaacaaagacuucuuccuccagggcauguauaucuuccugcacacggugaaggggacacccuuugagaccccggaccagggcaaggcgaggcugcuaacccacugggagcagauggauuaugggguccaguucacggccucucggaaguucuugaccaucacacccaucgugcugugagugccugggcuacaggaagacaccagcaggcagggcaaggccuggaggaccccagggcccagccaugcuuauuaacccugccguggcuccugguguagggaugaacagaggaaguuggaauauuccugggucuuacacuggacucaggcuuugggccucccuggccccaucuuuccuccauuggagcuuccuuccugcuagugagauaggccuacaggcuuggggugaagcugggaggugggggcgguacugggccaggaggggccccuuuagccugagagcucuugcuucuuacgcuggucugggaaccucuucuguaacuccuuagcuguugggauucugccuuuccccucccaggaagugagggaggaagggguccucccaacagucuuuuauaucucuccccacccuuccccucccagguacuuccucaccagcuucuacacuaaguacgaccagauccauuuugugcucaacaccgugucccugaugagcgugcuuauccccaagcugccccagcuccacggaguccggauuuuuggaaucaauaaguacugagagugcagccccuuccccugcccaggguggcaggggagggguaggguaaaaggcaugugcugcaacacugaagacagaaagaagaagccucuggacacugccagagauggggguugagccucuggccuaauuuccccccucgcuucccccaguagccaacuuggaguagcuuguagugggguugggguaggcccccugggcucugaccuuuucugaauuuuuugaucuuuuccuuuugcuuuuugaauagagacuccauggaguuggucauggaaugggcugggcuccugggcugaacauggaccacgcaguugcgacaggaggccaggggaaaaaccccugcucacuuguuugcccucaggcagccaaagcacuuuaaccccugcauagggagcagagggcgguacggcuucuggauuguuucacugugauuccuagguuuuuucgaugccacgcagugugugcuuuuguguauggaagcaagugugggaugggucuuugccuuucuggguagggagcugucuaauccaagucccaggcuuuuggcagcuucucugcaacccaccguggguccugguugggaguggggagggucagguuggggaaagaugggguagaguguagauggcuugguuccagaggugagggggccagggcugcugccauccuggccugguggagguuggggagcuguaggagagcuagugagucgagacuuagaagaauggggccacauagcagcagaggacugguguaagggagggagggguagggacagaagcuagacccaaucuccuuugggaugugggcagggagggaagcaggcuuggaggguuaauuuacccacagaaugugauaguaauaggggagggaggcugcuguggguuuaacuccuggguuggcuguuggguagacagguggggaaaaggcccgugagucauuguaagcacagguccaacuuggcccugacuccugcggggguauggggaagcugugacagaaacgaugggugcugugguccucugcaggcccucaccccuuaacuuccucauacagacuggcacugggcagggccucucauguggcagccacauguggcguugugaggccaccccauguggggucuguggugagaguccuguaggaucccugcucaagcagcacagaggaaggggcaagacguggccuguaggcacugucucagccugcagagaagaaagugaggccgggagccugagccugggcuggagccuucuccccuccccaguuggacuaggggcaguguuaauuuugaaaaggugugggucccuguguccucuuccagggguccaagggaacgggagaggucacugggccuguuuucucccuccugacccugcaucucccaccccguguaucauagggaacuuucaccuuaaaaucuuucuaagcaaagugugaauaggauuuuuacucccuuuguacaguauucugagaaacgcaaauaaaagggcaacauguuucuguuucccugu

SEQ ID NO: 16819 - RNA, 1282 nt, Homo sapiens
cucauccguccccuugucuccaucacgcgagugccaaccagacccucuggugccuaccuagcccacuuggcagccacccagguagguaggggaagaagacuuuauuccaaugagagaaaucaacacauggacagaggcagaaacuuagaaacccccagacccagaaugaccaacaaggccucacagauuaaccuucuagaaucaacagacccuaaaagaguuucaagugcaagagacccuuuacccaaaagacccuauugaggagacuuaaaucaagagagaccccaauaaggaagugaaaaagucacccaggcuugagagaagcccccagagaagaggccccagcccaaaaagacuccccagagggaccucgggaggagaaagcuggcaguggggcaugcgauucucuugacucacuccuccuuuauguggccuuuccuuccccagauccuacugcacuccaggacuaugccaauuuauggccaugcucccaacagcaggucaccuccugccccuccugcuggugauaggcacaggggguacugugcccagcccccaggugccuccccggggcuguuauguggcaaaggaagcaggugaacggacguuccgcugcagccaggcaggccucagugcugugcccuccggcauccccaaugacacccgcaagcucuaccuggaugccaaccagcuggcaucggugccugcuggugccuuccagcaccugccuguccuggaggaguuggaucugucccauaaugcccuugcccaccucucaggggcggcuuuccagggccuggagggcacauugcgccaccucgaccucucugccaaccagcuggccucagugcccguggaggccuuuguggggcuacagauccaagugaaccuauccgcaaacccauggcacugugacugcgcccuccaggaagugcuccggcaggugaggcuggugccgggcacugggacaggcaucguguguggcucaggagcccgaccggaccucguggggcaggaguuccugcugcuggcaggggaggaagagcugugugggucggggugggguggggcccggaggagcaccgauguggcccugcuggucaccauggggggcuggcugacacucaugguggcuuaucuggugcauuauguguggcagaaccgagaugagaccaggcgcucccucaagcgggccccagugcugcccgugcguuccgaggacuccuccauccucagcacaguggucugaugacccaggaugcuccuccagccacaccccaca

SEQ ID NO: 16820 - RNA, 1282 nt, Homo sapiens
ugugggguguggcuggaggagcauccugggucaucagaccacugugcugaggauggaggaguccucggaacgcacgggcagcacuggggcccgcuugagggagcgccuggucucaucucgguucugccacacauaaugcaccagauaagccaccaugagugucagccagccccccauggugaccagcagggccacaucggugcuccuccgggccccaccccaccccgacccacacagcucuuccuccccugccagcagcaggaacuccugccccacgagguccggucgggcuccugagccacacacgaugccugucccagugcccggcaccagccucaccugccggagcacuuccuggagggcgcagucacagugccauggguuugcggauagguucacuuggaucuguagccccacaaaggccuccacgggcacugaggccagcugguuggcagagaggucgagguggcgcaaugugcccuccaggcccuggaaagccgccccugagaggugggcaagggcauuaugggacagauccaacuccuccaggacaggcaggugcuggaaggcaccagcaggcaccgaugccagcugguuggcauccagguagagcuugcgggugucauuggggaugccggagggcacagcacugaggccugccuggcugcagcggaacguccguucaccugcuuccuuugccacauaacagccccggggaggcaccugggggcugggcacaguacccccugugccuaucaccagcaggaggggcaggaggugaccugcuguugggagcauggccauaaauuggcauaguccuggagugcaguaggaucuggggaaggaaaggccacauaaaggaggagugagucaagagaaucgcaugccccacugccagcuuucuccucccgaggucccucuggggagucuuuuugggcuggggccucuucucugggggcuucucucaagccugggugacuuuuucacuuccuuauuggggucucucuugauuuaagucuccucaauagggucuuuuggguaaagggucucuugcacuugaaacucuuuuagggucuguugauucuagaagguuaaucugugaggccuuguuggucauucugggucuggggguuucuaaguuucugccucuguccauguguugauuucucucauuggaauaaagucuucuuccccuaccuaccuggguggcugccaagugggcuagguaggcaccagagggucugguuggcacucgcgugauggagacaaggggacggaugag

SEQ ID NO: 16821 - RNA, 15363 nt, Homo sapiens
ucauccucucaaccuacagacccagugagcccuaggcccucaccccagacccagcugcuggauaggacccagccccgcucccagguaagaacuugaugacagcagggaaggcaggggugcucugaggacacaggaagauggguggaccaagaagggaauggaacuccccuagaguccagugggauaaguaucccgauaggccuuggggagggaagggagaggcaggccuguggacaucucucuggugaagaggaggcugcuguugcccaagcccuucccaggugcacccagguagcaccaggagguuguccugccccauccuggcccucccaggaaugagggugaaaaaaaaaaagcaccuugaagcuggcagaacagccccacgcaucugugccgugcuuccugcccccccugcugcugugaagugccugugguggaugugggaugcuuccaagccagcugguguggccucuuccacccacggggauaacuggggugugccgaucggccacccagccagagcaccuggacucaaacuucaaagacagagacuuaagauguugacccucaggucaggugcgguggcucacaccuguaaucccagcacuuugggagggugagaugggcggaucaccugaggucaggaguucaagaccagccuggccaacauggugaaacaccgucucuacuaaaaacacaaaaauuagcugggcaugguggcaggcgccuguaaucccagcuaccugggagacugaggcaggagaaucacuugaacccaggagauggagguugcagugagccgagaucaugccauugcacuccagccugggcaacaagaaugaaacuccaucucaaaaagaaaaaaaaaauguugccucucagguucccaugggccccacauucuccagggcccucucauccuagcgcacaucucucagggccacauucauugguucuuuccacacacauuugccaagcucgaacucugugccaggugugguacuugcugcugcagaggugacuaagacccauuuccugcccucugggaagucacagacgaguugcugauagggucaggugaacagaucauaacaaaggaaggugcaucagaagagcgcuuuggaaacacagauacagucaccagcugccuggaggacugagggaagagguuccaggaggugaccugaauugagcauuagcggaggacuagggagucuucagauccggaagcggguauuguaagcagagggggcaaaggugaagagcaucaaaaugccuggauccuggcugggcacagaggcucacaccuguaaucacaguacuuugggaggucaaggagggcggaucauuugaggucaggaguucgagaccagccugaccaacauggugaaacccugucuccauuaaaaauacaaaaauuagccaggcgugguggcacacaccugcagucccagcuacucgggaggcugaggcaggagaaucgcuugaaucugagagguggagacugcagggagccgagauggcaccacugcacuccacccugggcaacagaguaagacuccaucucaaaaagaaaaaaaaaagucuggauccaggcaucccccaggggcugugagaggggaguggguguacucauaccuguggcacgcaugagggaaggacagggugcagggaaguguaacccacacauggaaagggcaacuggggcaggugaacagcuuggccacccaggcucuuguugccagcagcaucuccuucccuccccugguguccuccgacucuggcuauugcuagucucuggugugagagaaagcuuuacuuccauugcuaaauaaaugcucuagaccaggcgcaguggcucacaccuguaaucccagcacuucgggaggcugaggugggaggaucacuugagccaggaguuugagaccagccugggaaacauagugagacucugucucuacaaaaaaaauuuaaaaauuagccaagugcaugacugcagucccagcuacucaggaggcugaagugggaggaucaauuaagccuuggcggucaaggcugcagugagcugugaucacgccacugcacuccaaccugggcaacagaguaagacccugucucggaagaaaagagaagaaagcaaagcaaggaaaggcgagguggagggaaggaaggaagggaaggaaggaaggaagggagagggggaagaaagaaagaggaaagaaagaaagaaggaaggaaggaagaaagggagggagggagagaaagaaagaaggaaggaaggaaggaaagaaagaaagaaagagaaauaaauaaagaaagaaagaaagaaagaaaaagaaaagaaagaaaagaagugcuccagcugggcuccguggcagugaagaaaaugagcguggagugagaaaaaugcccuugacaaagaaaagggagguguggcuuugcuggccaucugugggacuuuggggcaacucuuucaacucuccagcccuagguuccucaucauaaaaugcagacucccuugauucuuuccagcugugacaugagacaauccaggcaucucuaagagcuccuccugccucagagccggguaaacucucucugcaggggcccagccuauaucccgggcuccuuggcagccuuggcagccaccuugacacucuccugucuccccaccuccacagagacaaugaccauguuugaaaaugucacccgggcccuggccagacagcuaaacccucgaggggaccugacaccacuugacagccucaucgacuucaagcgcuuccaucccuucugccuggugcugaggaagaggaagagcacgcucuucuggggggcccgguacguccgcaccgacuacacgcugcuggaugugcuugagcccggcagcucaccuucaggucagccucaagcggggcugggaacugagggauacugagggacaggggcugggcaccuggccugcaaggaggaccucaaagcucccucuggccagaggugauuagaugucaucuagcccaaagucaucaucaggagcugaggaggcugguggucggggggauaccucucagcucagccucuuuuauuuauuuacuuguuuguuuuuguagagauggguucuugcuuuguugcccaggcugguuucaaacuccugggcucaagcaauccuuccaccuuggccucccaaaaugcugggauuacaggcaugaguuacugcacccagccagcccagccccuuuugucuuuucccuccugcagacccaacagacacugggaauuuuggcuuuaagaauaugcuggacacccgaguggagggagauguggauguaccaaagacggugaaggugaagggaacggcagggcucucgcagaacagcacucuggagguccagacacucaguguggcucccaaggcccuggagaccgugcaggagaggugagagugggcgggacugagggucucccgggauguggguggggcagugcauggaaauggugcuuggggccuugagcugaaagguaggacccuugcacugaccuuugccaauguggucaugacaggggagcucuuggaggcaacccuucuggcccauggcugcauccaggccauuuccuagucacaccucccgcugcugccaccgucuccaggaccaccuccccacugucacgcaugcacagggaagaugauguccacacuagcuugcugugugaucuuggaaaagucacuucucuugggaccucaguuuucuuuucugcaaaaugacaggauugaaugaucaucucuaaggcuccuucuaacucuaagacuaugcaauacacuagaaaaaggagggaugugucuuaacugcccccagcugagaccugagcacuguguucugcucccauaaaugaagccuccugccugaccccaauacacacuaagcacgcccucgggaaugcugccccacagcacaaaggguguggcaggugccacauugaugcugggcaccaccggauguuuggcuugacacgggaacugacuuuuaaguaguuaaguagugguugaaagaaggagguaaggacugugaaggccagaaggaaaggcugggguagucauccagcaagcauguauauaguaaagcacucuacuacgggcuggggugcgccuagaacaucuuuguccaagaaccuugcagucuaggaaggugaaaauuuuaaaaaccugugcaacaguaauuauaaucaaagccaagaagugcuaagugcuguagggaugguuugacugagucuuguggcaggucaaagggacuucuggcuggggaaauaagggaagaucucacagacauggcagccucuguuuugggccuugaaagaugagcagaaauugggcaugcagggcugggagaaggguauuaugaaggcacacaggugagcaaucucaaaaccaccaagggccaggaacagccagcauagcaggggcggaagaggugcgaguagaacgagcaggaaaugcaggugaacccaaaccauggaagaggcaaguggcagcuccaggagacugaauuguaggcaccaggaagauccugaaaauguucugaugugucccaugacuaauccagccagauggaggaagugugucagauaggggaagaggaacagggguuugaagcagucagacaaggcaagacacuuuucuucuuuuuuuguuugaaacaguuuuucgcucuuguugcccaggcuggagugcaguggugcaaucuuggcucaccgcaaccuccgccucccagguucaagcaauucuccugccucagccucacgaguagcuggguuuacaggugcccgccacuacgcccggauaauuuuuuauuuauuuauuuuauuuauuuauuuauuuugagauggagucucgcucugucgcccaggcuggagugcaguggcacgaucucagcucacugcaaacuccgccuccuggguucaagcaauuauccagccucagccucucaaguagcugggacuacaggugucugucaccacacccagcuaauuuuuuauauuuuuaguagagacggaguuucaccauauuggcuaggcugaucucgaacuccugacuuugugaucuguccgccucggccucccaaaguucugggauuacagggaaguaaucccaguuaaguagugguugaaagaaggagguaagguggcucgugagccaccacacccggcuaauuuuuguauuauuaguagagaugggguuucaccauguuagucaggcuggucuuguacuccugaccugaggugauccgccugccucagcccccaaaagugcugggauuacaggcgugagccacugagcccggucuuuuuuuuuuuuuuuuuuuuuuuuuugagacggagucucucucuguugcacaggcuggagugcagugacacgauaccaggucacugcaaccuccgcuucccagguucaagcaguccuccugccucagccuccugaguagcugggauugcaggcgcacgccacuacauccagcuaauuuuuguauuuuuggaagagaugggguuuuaccauguuggccaggcuggucucgaacuccugaccucaggugauccgccuaccucggccucccaaagugcugggauuacaggcgugagccaccacccccagccaagacacuguucuucuaucccaugagcaacgaaaacugaggacccgagcuggggaagggcaagaggagugaagagggaggaauggaugcaaugcccauugccaacggugauagaauggccugggcuugguagcugauugcaggaugagggaaaggguuuugucaaaggugacugcgagauuuuacccagguugugacauuauaggacauuaaagcuaccauuacaggugacaaacaggaagacacagguuagagguagauuuggagauugugaguuccuuuuggauguuuugaguuucugguucugcugagacaucagcugagcauguugaacaggugauuggaaauaagggccuggagcucaggaaagaggucaaagugaagauacacacaagguaaucagcacuauaaagauuaaaacuguaggagccaggggaggagucucacucccguaagcccagcacuuugggaagccaaggcaggauugcuugagcccaggaguucaaaccagccugggcaagagagugaaacccccaucuccacaaaaaacgcaauauuagccgggcaugguggugcgccuagagucccagcuacucaggagguugaggcaaggggaucacuuaagcccaagagcucaagucugcagugaguuaugaucgagccacugcacuucagccugggcaacagagugggaccuuaaaaaaaaaaaaaaagaaaaaacuauaggagugaguuggguguggggagcuuuuagagggaguugagaaaacaggacugagaacagaaucuuacagaacauaaaauuuuagagaaccaaagaaacuggaaaaugaggugcagacagaauggauaagauuuaggaacuagaaguacuggaguugagccagggugguacacugugacuggaagccaagagaagccagcguugcacggaggguuuccacagcaggaucgaguauugcacagaguuaggcgaggucauugagacugacagguaagagaucauuguaauuucagcugaguaguggaaauacaaggcaaauuauaaagaauuuagguggaccgggcaugguggcucacaucuguaaucccagcuauucaggaggcugagggagaagaaucgcuugaacccgggaggcagagguuguagugagccaagaucgugccacugcacuccagccugggugacagagugagugagacuccgucucaaaaaaaaaaagaauuuuuuugauauauuugccaaugaaaugaaggaaaaaauaggguaguaauuugagggaguggcaugaucaaagcaaacaaauuuguuaggauuagggaguuuauauauggaagcagacagaaggagcaaguggagaggaggaacugguguuaacagcaagagagagcauaagauguggagagaaaggaucccagagagaugaauggggaggaaagagggggggagcaucuacccccgggaucccagagagaugaauggggaggaaagagggggggagcaucuacccccgaacuggaggaaaaggggguaagaagcacccaagaggcccuguuccuggccaggugcuggcccaauuaccgaguuuaucucugagcaacccaggaggucagcaucauuauacucauuucauagaugaggcaauuaagacucagagaagcugcccugccaguaagcaugagaucuggguuucaaccucagcccuaguccagaguccucacuccuucccugccaccacaaugucuaguuccugggaaugacagaaggaaagaggagggugugguacaggcaggaaggagcucugaacgguucccuuauguuucuccugcaacaggaagcuggcagcagaccacccauuccugaaggagaugcaagaucaaggggagaaccuguauguggugauggaggugguggagacggugcaggaggucacacuggagcgagccggcaaggcagaggccugcuucucccuccccuucuucgccccauuggggcuacagguuugauucaaacacacacacacacacacacacacacucucacacucacacucacacauacacauuuacauucagccccuccuuggaggcuucauuagcuuugccugaucagcgcccaccgaggaugcugaaaagggccacuccuucccccggcucuuaaagauccaaaccccagacauaugcccccucccuggucaguggcacccagugagggcagaucccugcgccagaugccacagggaacuacuggggaaggggaaagucacauuccuggguuuucccucguggugcucccauuccaaagaggagacaucuuuacucucggaaagucaucagguucauagaggagacacagaggcuaaagcccagagaacacaggcuuggaaaagccaauggaaauaaggaauggucuccauaccucuaucuauugcaucuaaauauucaagggaugauuugggauuuggagccaggaguagggguuagucauggaaggcguccugaaagagguaagcaugggacagauggugaagaggaagaaggagccagggcuuggauggaagcucuagggugauguacaggcaggagauggagcaggucugcccaguucccuucaugcaucugaaccaggaacuagaacugaccugacuagacucuacugaccugaaccaggucacuagagggaaaaucagcagaaaugagcacaaggacuuugaaguccuuccucagaguccagaccagggacaccacugaaggcuuccagcuucuuaucucccugaaggcucucagcccugacccugcaccucccccaacucacgcucccaauaucucauacuuaagauguccagagauucacaaauucucauugucuaauucuagggauccauaaaucacaaggaggcuguaaccauccccaagggcugcguccuggccuuucgagugagacagcugauggucaaaggcaaagaugaguggggugagcagagacccgcauguucuccccacaagaugagaauuaccugcaccaguacugaggcacccugguccccucuugcggaaaugucagagaaugaguagggggguguauuguacugugauccgacugcagccauggagccugcucuggagagaagggugaagaggcuccuggauucugagcaucuucugggugcugggcacugugguuauugggggaggggguacaaauaugaacaugcacugccucugcucucaagaagucuguggccaaaggaggaaacagacagagacuggaauggaugauagaaaguaguguucucauaguagagaauuuaucaaggaagaaaagauugcuuccagcaauggagguugaagcugggaauuaaaugaagcauuuggggugcaagguccuagcccuuagcagagcccuuuggcuugagacugaagaagggaauguggggcagcugcuaaguguccucccacccucccucccuugcccuucacagauauuccacauaucugcaaugauaacaugcaaaccuucccuccuggagguaagugaaauugcuuacgggcuucccacaucuuccgcccuaccccugacauuaucugccaaaauccuccacccucuccuagcuuauacuauaaucccccaaggagccucugcuuuuguuucccaagucccuaagaauaccuagccucaacuuuagaaagacagauagaggcauauaaauacugucccagagagauauagaaacugacagacagagaccggaaggcacagucagaagcagaaguaagacuuggagacugaguguguucccgaaucauggggguggaugagcuagcauaaucucccuguguuuuuauaaugaucacugaugaaacugccuugaagacuguuuuagaugaaaaggcaaaaauggguuuugugcugacagaugugcauuuuuucugucuucagaaaagucaggagaggagaaggucauccguaaguguuuccuuucauuccacugaaacuuucuugacuccaaauuuuaaaacuccagucuuuuucuuuccuucugacaggacugacagggaaauagcagagcgaaucucagcaaauaauuguccccgaaacauggcagaaauuccaauagcuugggaaaaagcaguggaaaggggggagucuuugcccagguggucugacgccugagaccuuuguccucaacagccuuacuagcagccaggcacagugauucacaccuauaaucccagcacuuugggaggcugaggcaggaggaucccuugagcucaggaguucaagaccagccugggcaacauagugagacaaugucucuauuuaaaaaaaaaaauuuuuuuuuggauggaguuucacucuuguugcccaggcuggaguguaguggcgcaaucucaguccacugcaaccuccaccuccccgguucaagugauucuccugccucagccuccggaguagcugggauuacaggcacccgccaccaugcccugcuaauuuuuuguauuuuuaguagagaugggguuucaccauguuggucaggcaggucuugaacuccugaccucaggugauccacccaccucagccucccaaaguauugggauuacaggcgugagccacggcgccuggccuuuuuuuuuuuucuugagacagagucucauucuguugcccagacuggagugcaaaggugagaucuccacucacugcaaacucugccucccagguucaagcaauucuugugccucagccuccugaguagcuaggauaacaggcgcgggccaccacacucggcgaauuuuuaguauagaugggguuucaccauguuggccaggcuggucucaaacuccugaccucaggugauccucccaccuuggccucccaaagugcugggaucacaggugugagccacugagccuggccuagaaaaaaaaaaaaaaaauuaagagucuuaguagcuauaaccugcuacacacacaucugcaacucggccgcccagcaacuggggccagagccacugagucacaguaaugccaggaacaagguagcugggcucucccaggagacaggcaggauguauuuccucaucuuccuuagugucucaaccccuggguauggcugccauucugaaggauugcauucuuaucuuuuuuuuuuccuuuuuuucucaguuauccaggcaucugauguugguaaggaacuuugugaguuucucccaagacuuuggcauggagguagcauuaggggcagagagaggagaaggcgaagucauucuuugucagcuaacucaugggaagggaaaacagacuuucuuucuccacuuuuugcuggagucucaaagaaaagucaaguguguacugauaugggauaaggccugggaucucaggaagauuaacuguuggguuagaugauacaugcauccuggcccaccuucucgccccaacccucagguuaggguugguggauaguucugucaccgcauuccuugguaaagaaaaauggggccaggcucaaacugggggguagagcauggguaccuaaagggggcugaguguaggagcccugcagggggaaugcugacuggagaggaaggugcccgauggagggcugugugucccauuauuguccccauaggggacguacacgaaggcuucaggacacuaaaagaagaaguucagagagagacccaacaaguggagaagcugagccgaguagggcaaagcucccugcucagcucccucagcaaacuucuagggaagaaaaaggagcuacaagaccuugagcucgcagugaggaccuaguggaaguggggaagggugggagaaggcauguuuuggugaagauuuggugggggcggguauugcagcagguagggagaucugacgggggcaggagguggguggccaggggaguccaccuuagauaccuuccccaaggcuggccacgugccccaaggcugccaggccacugcuccucccuuuguccccuggaaaagggcaaacaguggguucccccaaggcacaugcucccucugauggccagaagggacuucugcuggaggggcuggaaccuucucuuuccagaguccaaaacucaggaaacaaggaacccaggaguccaguacucuucaggacaugaggccucgaaaaagaaaucaggaaauggagagaguuuccgcaugucaagggguuauuaugugcugggcccuggguugggcccuuuccuauguuaucuucaauagucgcccaccuucccccacagcuugaaggggcucuagacaagggacaugaagugacccuggaggcacucccaaaagauguccugcuaucaaaggaggccgugggcgccauccucuauuucguuggagcccuaacagguaaguggggaauaaggucuucauuuauagaccuuuucaguaauaggaaugaaucacuugaaucaauucccaaauggaugaauaaaugaaugaaugacaaauuauaccacaguuaaguaguuuauaucuacauuuuuauaaauugguuucauggcuggcugcaguggcucaugccuguaaucccagcacuuugggaggccaagguggauggaucacccgugaucaagaguucgagaucagccuggccaacauggugaaaccccgccucuuccaaaaauagaaaaauuagccgggcgugguggcaggugccuguaaucccagcuacucugaaggcuaaggcaggagaaucgcuugaacccaggagggggagggugcagugagccgagaucacuccauugcacuccagccugggcaacagagcgagacuccaucaaaaaaaaaaaaaauugguuucauuccuaaggauuugcuuggucacauuggguagucugagaagacagccuagucuugcuaauagagguugaauaacccuaguuuuaucagcaacauauuuaaaauuucugcauauagcuaagcucaucacuucuauccugauaccuguuagcuuuaacuucagggaguaacauuuucuuaucuugccccuaagagcucuucuucccuccacauuuucuaguuuuccacuuagaaaaacucugugguccuucagguguaagccaaaacguuuguucccuuaggaagccugcccuccgacuccaagaccaaaguggaccccucagcuauggcucccuuaacaccugcguuguaauuacauccaaugaaugaaggcugaaauucuggaagugcgcuauuuggaggcuguaguccccucugcaccagcaacacacaucuuucucugcuuuuuuucuccagagcuaagugaagcccaacagaagcugcuggugaaauccauggagaaaaagauccuacccgugcagcuaaagcuggugagggaaaaacagcagaugcuggggagagucugggaguagcugcagccaguggagaugcagauuucgccuaaggauggagccauucuggaggaucccugucuuaucccaggggcuuaugcccacuccuccuuucucucucuauuucucauuuuuuguuauuucacaagagguagaagacugaauuucugggcaauaaucuggguuuauuagccugaucuugggagaagagacagaaacuguggcuuugcuuauuccuagccaaauauuguaagcaaauuuuuuuuuuuuuuuuuuugagauagaguuucacucuuuuugcccaggcuggagugcaauggugcgaucuuggcucaccacaaccuccgccucccggguucaagcgauucuccugccucagccucccgaguagcugggauuacaggcgcccaccaccacacccugcuaauuuuguauuuuuaguagagacaggguuucaccauguuggccaggcuggucucaaacuccugaccucaggugaucugcccaccucagccucccaaagugcugggauuacaggugugagccaccucgccuggccugugagcaaauuuuuuacugugucugagucugucucaauuuauuccucuguaaaauggggcuaaaaaucaaugugcugcccacuguauagggcuguucaaagacccagaugggguuguaauguaagguaaaguaaggaauucuaauaaggggaauguaaccuucuugugauuuuugugaguuaggagaggagagagguuuccaguucuuucuuuucaugcuguuuugauucccuccagguggagagcacgauggaacagaacuuccugcuggauaaagaggguguuuucccccugcaaccugagcugcucuccucccuuggggacgaggagcugacccucacggaggcucuagucgggcugaguggccuggaagugcagagaucgggcccccaauauaugugggacccagacacccucccucgccucugugcucuuuaugcaggccucucucuccuucagcagcuuaccaaggccuccuaauuugccuuuuacgucugcuucaugacucccuaaugccuucccaaccucguggugcuguguccuuaccaccuaagggcauuucagagccaucagcugaagacaucugaaaucucagcuggucacccaugauaaccaacuuccaccugcccaaccauauaucacccccuaccccuccagcuccgcaacccacuaagcccaucugcugaugcuuaaauuuucuuuacuuuucuuuucuuuuuuuuuuuuuuuuugagauggaggcucacucugucacccaggcuggagugcaguggcuugaucuuggcucacugcaaccuccgccucccagguucaagcaauucuccugccucagccucucgagcagcuggaauuacaggcacgugccacgacacccagcuaauuuuuguauuuuuaguagagacgggguuucaccauguugcccagguuggucucgaacuccuggccucaagugaucugcccgccucggccucccaaagugcugggauuacaggcgugagccaccgugcccggccugugcuuaaauauucuaggaguagaagcacucagacuuuuaaaacuaugagccguuucagcaaaacugagaaaaaaagaagauuaauuaauuuccuauccuaaucccuccuacuuauacuuccccaaaaaacaagcuuuacuggaauuaauggaaaauauuaugucaaucuuaggaaugauaugucuuuugguguuuuucuuuaaagaauuuaucauacagaaauucuuaauuugugccagaaaaagaaauuguuaucauacugcauauaaaucauauguacaugaauaugaugcuguacuguccucaggcaaacuggaaaaugcucagaggguauagaauguggaauccagauuuuuuuuucuguucaauuaguuuucuuuaauggaaucuagagucucaagugagaagauaucaaagcaguuugucuucaaagaagagcauuugggaguccccuagcucuggguugagggaaagaccgagagauauauaguagaagcccgaaacaaaaauaagacagauuucaaauuuauugaacagaaaaugcagaugggccuuuaaaaaaaagggggacccaagaauaagacuaacccaaaacuuuaaaaacuaaauugugauauuauuucaccuuucucuguucugcccugaaauuuaggguucuuguaggaggaaguaguguggguaggcuuggcauauuacuacuaauauggauauuacaaucucaucaaaccgcuggguuuauaucauccuccucugccuaaaagcuggguuuga

SEQ ID NO: 16822 - RNA, 1602 nt, Homo sapiens
uuuuucaccccccuauuugcuaaccgugggccguacauaggguggaccccuauauuuuguuaaacuggagugauucuacgcaaaugcacgcuccuaccuaucggcacucccagccugcagaaauuguaugccuuauguucagcacuaaacucaaaucuaaccaaggaaguccggaucccauaggguucuuccuacucuccaguucgguuuauuuuaaggccaacagcccuagcuucacgucccuccuucacagccuucuuuccuucccuccugccggaugcgcccggcagccguugagcacaagcccagcggaucuggaaggagaccccgccgcgaccggggaaaauugagcgaacuugggcgcaaaacccgcccggcaacucgugacgucaucucgucccgcgcucggauaggcuguacccacuccacgcugguugaggcgcucuuaaaguccuuuguaacccagauuggagccugaggggaccucucguggacgcccacagaaaugcacucgagaggaacauaaaagcaucacacuuaagcgcucgaaagaaagccccacgaacccauaaaggcuccuccccgcuccuuccucgaagcuccuccuucauccugcaccucggcuguggauuuauuuccccuuuguugacucggccaucggccugccgggccuggcguuucccagaaggcccagcgccgggaagggguuugcagcugcuccgucaucgugcggcccgacgcuaucucgcgcucgugugcaggcccggcucggcuccugguccccggugcgaggguuaacgcgaggccccggccucgguccccggacuaggccgugaccccgggugccaugaagcaggagggcucggcgcggcgccgcggcgcggacaaggcgaaaccgccgcccggcggaggagaacaagaacccccaccgccgccggccccccaggauguggagaugaaagaggaggcagcgacggguggcgggucgacgggggaggcagacggcaagacggcggcggcagcggcugagcacucccagcgagagcuggacacagucaccuuggaggguacggcagcccaggccgggaacgugccgcgaucgcgggugacagcgaccccugugauuuggcuucuugcugggaagccacagcagccuccaccacccucaguucuuugggaucacccccagauaccugcucccacugccccgacacucccgacuccaggcccaaugacugaaccuucucuccaggcugggaaccacuccccucccauccccuccauccccauaucugggguugcaucuauaucuaggucccagugggccuggggacucccucuuuuaaguccuccccucugaccuauuccguuuauaucccacccgacugauuuuagcgccuccaauauaugacugauuguucccgcuggaaaccaguguuugugucuguguguaaacagggccaggaugaccuagaauauugacuccugaguuuuaaaacuguacagcagauuuuuguuguccuagcugccuuuagcacacucccccgaaugaaccauuucgaccuaguaucuuguuuccuacuucucuaacugaaguguccc

SEQ ID NO: 16823 - RNA, 1602 nt, Homo sapiens
gggacacuucaguuagagaaguaggaaacaagauacuaggucgaaaugguucauucgggggagugugcuaaaggcagcuaggacaacaaaaaucugcuguacaguuuuaaaacucaggagucaauauucuaggucauccuggcccuguuuacacacagacacaaacacugguuuccagcgggaacaaucagucauauauuggaggcgcuaaaaucagucgggugggauauaaacggaauaggucagaggggaggacuuaaaagagggaguccccaggcccacugggaccuagauauagaugcaaccccagauauggggauggaggggaugggaggggagugguucccagccuggagagaagguucagucauugggccuggagucgggagugucggggcagugggagcagguaucugggggugaucccaaagaacugagggugguggaggcugcuguggcuucccagcaagaagccaaaucacaggggucgcugucacccgcgaucgcggcacguucccggccugggcugccguacccuccaaggugacuguguccagcucucgcugggagugcucagccgcugccgccgccgucuugccgucugccucccccgucgacccgccacccgucgcugccuccucuuucaucuccacauccuggggggccggcggcgguggggguucuuguucuccuccgccgggcggcgguuucgccuuguccgcgccgcggcgccgcgccgagcccuccugcuucauggcacccggggucacggccuaguccggggaccgaggccggggccucgcguuaacccucgcaccggggaccaggagccgagccgggccugcacacgagcgcgagauagcgucgggccgcacgaugacggagcagcugcaaaccccuucccggcgcugggccuucugggaaacgccaggcccggcaggccgauggccgagucaacaaaggggaaauaaauccacagccgaggugcaggaugaaggaggagcuucgaggaaggagcggggaggagccuuuauggguucguggggcuuucuuucgagcgcuuaagugugaugcuuuuauguuccucucgagugcauuucugugggcguccacgagagguccccucaggcuccaaucuggguuacaaaggacuuuaagagcgccucaaccagcguggaguggguacagccuauccgagcgcgggacgagaugacgucacgaguugccgggcggguuuugcgcccaaguucgcucaauuuuccccggucgcggcggggucuccuuccagauccgcugggcuugugcucaacggcugccgggcgcauccggcaggagggaaggaaagaaggcugugaaggagggacgugaagcuagggcuguuggccuuaaaauaaaccgaacuggagaguaggaagaacccuaugggauccggacuuccuugguuagauuugaguuuagugcugaacauaaggcauacaauuucugcaggcugggagugccgauagguaggagcgugcauuugcguagaaucacuccaguuuaacaaaauauagggguccacccuauguacggcccacgguuagcaaauaggggggugaaaaa

SEQ ID NO: 16824 - RNA, 35340 nt, Homo sapiens
uagaaagugagcuucuugacaagugccaaaauggcgaugccuaccaccuagaacuggauugugcgguaggcuuaaauuuggggaggugguggaugaaaaggaaauugggagguauaguuacagggcuggagaagguggaggaaaugagggagcaaaucuggacuuggaauggugguggccaagggacgcuuuuagagcuaagggcguaauuaggcaaccaggacugccuuaacuccuugaugcccuguuuaaucuauuagucccuuugauacuucuuuauucauuuauuugagagacggaguuuugcucuuguugcccaggcuggagugcaauggugcgaucucggcucaccccaacaaccuccgccucccggguucaagcgauucuacugccucagccucccgaguagcugggauuacaggcaugcaccaccaagcccggcuaauuuuguauuuuuaguggagacgagguuucuccauguuggucaggcuagucucgaacuccugaccuccggugauucgcccgccucugccucccgaagugcugggauuacaggugcgagccacugcgcucggccgauacuuucuuagugccccaguuuaaggaagggcgguucaggaggagagagucugacaggaucuuacuuuaucccuuuagcucuuuuucuuucaaauuccucugucucgcuuaaaucuucccgcaucuucuccuuucuauuuaauucugccuuccccgguucuccuuagaaccucauguccuuuucuuuagcuccauuucuuucaccucaaagcuggccgccaccgcugccaccugcucagagugaaauaaugaagguggucaaccugaagcaagccauuuugcaagccuggaaggagcgcuggagugacuaccaaugggcaaucaacaugaagaaauucuuuccuaaaggagccaccugggauauucucaaccuggcaggucucaagugaacugggaaagaaagaugggagggauaaacccagagaaguuguaaucacucaguuguguuuugcuauuccucuugcagaugcguuacuagagcaggccaugauuggaccaucccccaauccucucaucuuguccuaccugaaguaugccauuaguucccagguaagcuucccgcaaacccccaccaagaagugagaguucuggggguaaaaaacuuggagugcauuugggccccggugguucauggcuguaaucccagcauugugggaggcugaggcaggcggauugcuugagcccaggaguucaagaccagccugcguaacauggcaaaacccagucucuacccaaaaauacaaagaguuaccccugcgugguggugccccuguagucccagcuacuuggaaggcugaggugggaggaucaccugagcccugggaggucgagacugcaaugagccaugauccugccacugcccuccagccagagcaacagagugagacccugucucaggaaagaaacaaacaaacacaauuuggggugcaguuguacaauugucagcuuacucuuucuagaugaaagaguaagauucuagauugaucuguuugaacagaucauuucagugaguuucaguguucucauaaaaauaauacuucauuuguugugaugaauauuacauucacuuauucugcugggagugguagcagguagcacaggccuguggccccaccuacucagaagguggagguaggaggcuugcuugagcccaggaguuugaggcuacagugagcacugauugugccacugcacuccagccugggcaacagaacaacacuccgucuauuaaaaacaacaacaagcaaaagaaaaaaagaggauuacauucaccuauucuaucaacaaauacucaugaaugcuuuuaugugccagacagugcuuagccccuggggaauauagcugugaacaaaacccgaugucaguacacagaaaauuuaguggguaauauagacauguaaauaagcagucacuagauggguuuaugauaaagguuaggauagaguacagaugcuccucaacuuacaauggggugaugugcugauauaccacucauaaguugaaaauguacuuaauacacauaacuugccaaaggucaucuaccuaccuuuuuuugagucagagucuugcucuaucgcccaggcuggagugcaguggcgugaccucggcucacugcaaccuccguuucccggguucaagcgauucuccuaccucagccucccgaguagcugggacuacaggugccugccaucacgccuggcuaauuuuuguauuuuuaguagagacaggguuucacuauauuggccaggcuggucuugaacuccugaccuugugauccgcccgccuuggccucccaaagugcuaggauuacaggugugagccaccgugccuggccaucuaccuaccguaaaugugcucagaacacacuagcuuacaguugggaaaaaucaucuaacacaaagccuguuuguuuguuuauuuauugagaugggauuucgcuccuguugcccaggcugcagugcaauggcuugaucucggcucacugcaaccucugccuccuggguucaagugauucuccugccucagccuccugaguagcuaggauuacaggcgucugccaccacacccggcuaauuuuuguauuuuuaguagagaugagguuuuaccauuuuggccaggcuggucucgaacuccugacuucaggugauccacccaccucggccucccaaagugcugggauugcaggcaugagccaccacgcccagccuuauuuuuuauugauugauugauugauugaggcagaguuucgcucugucacuaggcuagagugcaguggcgugaucuuggcuuacugcaaccucugccucccagguuuaagugauucucgugccucagccuccugaguagcugggacuacaggcgugugccacuaugcccagcuaauuuuuguauuuuuaguagagaugggguuucaccauguuggccaguauggucuugaucucuugaccucgugauccuuccgccucggccucccaaagugcuggguuuacaggcgugagccacugugcccggccgcccagccuuauuuuuauuuuuugagaaggagucuuacucugucacccaggguggaguacaguggcacaaucuuggcucacugcaaccucugccuuucggguucaagcaauuguccugccucagccucccaaguagcugggauuacaggcgcccaccaccaauccuggcaaaauuuuuuuuuuuuuuuuuuuuuuuugagacagagucuagcucuuguugcccaggcuggagugcaauggcgcgaucuuggcucaccgcaaccucugccucccagguucaagcgauucuccugccuuagccucccaaguagcugggaguacaggcaaaugccauuacacccggcuaauuuuguauuuuuaguagagacuggguuucuccacguuagucaugcuggucucaaacucccgaccucagguaauucgccugccuuggccucccaaagugcugggauuauaggcgugagccaccacgcccagccagaagugcagauuucuuaugugcauacauugcaucguggugaaaucugggcuuuuaguauacccauuacccuaguagugaacacuguacccaauacguaauuuuucaacccucaccccacucccaccuucccaccuuuuauauucuccagugucuguuaguucacucuauaugugcacacguuguguagcucccacuuaucagugagaauaugugguauuugacuuuuuuuuuauuuacugagacggaguauugcucugucgcccaggcuggagugcaauggcugaucucagcucacugcaaccuccuugacuuucuauuccucaguuauuucacugaggauaauggcuuacauguaugagcacuugaaguacaauuucuacugaauguguaucucauauuuuuuuuugagacaaggucuuacucugucacccaggguggagugcaguggcgugaucucugcuuacugugaccuccaccuccugggcucaagugauucuucugccugucucccgaguagcugggaccacaagcaugcaccaccacacccagcuaauuuuuguaguuuuaguagagacgggguuuuacuguguuggccaggcuggucucgaacuccugaccucaggugauccgcucaccucggccuccaaugagccaccgugccugaccugaaugcguaucucucuuuuuuuuuuuuuuuuuuugagacggaguuucacucuugucccccaggcuggagugcaguggugcgaucucggcucacugcaaccuccaucuccuugggcucaagcaauucuucugccucagccucccgaguagcugggauuacaggcgugcaccaccaugccccgcuaauuuuuguauuuuuaguagagacaggguuucaccauguuggccaggcuggucucuaacuccugaccucaagugauccaucugccucggccucccaaagugcugggauuacaggcuugagccaccacgcccagccugaauguguaucucuuuuacaccaucauaaagucgaaaaauuaagguggggugugguggcucacgccuuaaucccagcacuuugcaaggccgaggugggcggaucacgaggucaggcgaucgagacccuccuggacaacauggugaaaccccgucucuacuaaaaauacaaaaauuagcugggcaugguggcgagugccuguaaucccagcuacuugggaggcugaggcaggagaaucgcuugaaccagggagucagagguugcaguaagccaagauugugccacugcacuccagucuggugacagagcgagacuccaucucaaaaaguaaaauaaauaaaauuaaaaaauaaagucaaaaaauuguaaggugaaccauuguuaaguugggacuguccuugcuaugggaauacaugggaaaggcacccaguccagugugaacaaucaaggaaggcuuuguggaggaagugauguuuaaaccaagaccugaauguugaguaugaguuagccggcacauugaggagagugugugugcaaagcagagaaaagcauauguacacggugggaggcaaaaaucacauaauguuguucaggaacugaaaauaauuugguauggcuagagaaaaggaguuugcucucaggaccccuuuuucuuuucuuuuuucuccuuuuucuuuuuuuguauuuuuuguggaaacggggucucacuauguugcccagucuggucuugaacuccuggccucaaguaauccuucuuccuuguccuccuaaaggcugggauuaugaguaugagccacugugcucagucccuggaccccuuuacagucuucaaaauuuugagacuuuucuuaaauauauuugauuguauuugaucucaugccucccuaaaauguauaaaaccaagcugcacccgaccaccuuggguacauguuuucaggaccuccugaagggccaugguuacucauauuugacucagaauaaauuucuucaaauauuaaaacauauauauuauuggccaggcaugguggcuccugccuguaaucccagcacuuugggaggcugagguggguggaucaucugaggucaggaauucaagaccagcuuggucaacauggugaaauucugucucuacuaaaaauacaaaaaauuagccgggugugguggugcgcaccuguaaucccagcuacucaggaggcugaggcaggagaaucgcuugaacccgggaaguggagccugcagugagccaacaucaugccacugaacuccacccugggugacagagcaagacucugucucaauaaaaaauaaaaugaaauaaaauuaacuggucucuuuguugcaccuugaauagaucuuuuaucuaugcaugauuuuugucacaucaugaauugguaauuuggacaauauccaugacuaaguuauauagauauuacaguuguugaugcauuuaauaauaucauauucucacauguuauggagcuuccaggacaauccacuguacaauugugagagaaaaagagcaaaaagguaaacaguaucuuaguaguauuuuaaaaauaauuuugacuuccuagacccccugaaaggucuuggggacccuggggaguuccugaaccguaccuuuagaacugcuaggcuggcacuuuaaggaggagagugguuuagggagagagaaugauaagauuguaacagacuuuugagugaugcuaaggaauuuggacuuuauuuuagggugacaaauaaucauuuaaaggguuuuaaguggaggcgucacaugacaagacuuccguaaaaauauacauauuuuaauuaacauagcauaacauacaaagaucuugcgcugggcgcaguggcucaauccuguaaucccagcacuuugggaggccgaggcgaguguaucaccugaggucagaaguucaagaccagccugaccaacauggugaaaccccgucucuacuaaauauacaaaaauuagccgggcaugguggugggcgucuguaaucccagcuacucaggaggcugaagcaggagaauugcuugaaccugggaggcggagguugcagugaaccgagauugcgccauugugcuccagccugggcaacgagcaaaacuucgucucagaacauacaaacaucuuaagaucaauucagucaggguuuuuuuuuuguuguuguuuuuuguuuuuuguuuuuuuguuuuuuuuuaugagauggagucucgcucuguugccugggcuggagugcaguagggcaaucucagcucacugcaaccuccgccucccagguccaagcuauucuccugccucagccuccggaguagcugggauuacagguguccuccaccacgccuggccaguuuuuuuguauuuuuaguagagacgggguuucaccauguuggucaggcuggucucgaacuccugaccucgugauccaccugccuuagccucccaaagugcugggauuacaggcaugagccaccacgccuggccuauuuagugaguuuuagcaauuguauguacccaugucaccagcauccaaaauaagauacagagcauuucuguucucucagaaaguucccuuuuaccgcuuucuaguccacuccccucucccacaauugccuuuauuuggauuucuuaguaauguagucagaugggauauaguucguauacugucuuuuguuuaacauaaauguuuuugagauuuauuauuuauguuguauauguuaauaguacauucuuuuuauuuauuuuuuuaaauuugaaacagggucuugcucuguuacccaggcuggagugugcaauggcaggaucacagcuuccuguagccucauccuucugggcucaaguaauccuccuaccucagguucccaaggaguugggacuacagucaugcaccaccaugccuggcuaauuuuuaaauuuuuuuguaaagaugggaucuuccuauguugcccaggcugauaauuuuuacauuuuuguagggacggggucucccuuuguugcccaggcugguaucaaacuccugggcucaagcgauccuccugccuuggccucccaaagugcugugauuacaggugugauccacccaugccuggccucauucuucuucuucuuguuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuuaguagagacgggguuucaccguuuuagccgggauggucucgaucuccugaccucaugauccgcccgccucggccucccaaagugcugggauuacaggcgugagccaccgcgcccggccuuuucuucuuauuuuuuaacugcugaauaguauuucucaguugacacauauauauuuuuuuuuauuaaaaauuuuuuuaggcugggcgcaguggaucaugccuguaaucccaggaacuuugggaggccgaggcgggcggaucacgaggucaggagaucgagaccauccuggcuaacauggugaaaccccgucucuacugaaaauacaaaaaauuagccgggcgugguggcgggugccuauagucccagcuacucgggaggcugaggcaggagaauggcgugaacccgggaggcggagcuugcagugagcagagaucgcgccacugcgcuccagccugggcaacagugagacuccgucucaaaaaaaaaaaaaaaaauuuuuuuuagaggcugggcgugauggcucacgccuguaaucccagcacuuugggaggccgaggcggguggaucaugaggucaggagaccgagaccauccuggccaacauggugaaaccccaucucuacuaaaaauacaaaaaauuaccugggugugguggcaugcacguguagucccagcuacucgggaggcugaggcaggagaaucacuugaacccaggaggcggagguuggagugagccaagaucgaaccacuguacuccagccugguugacagagcgagacucugucucaaaaaaaacaaaauguguagagucaggauccuugcuuuguugcccaggcuggagugcaguggcacaauaguggcucacugcagcuuugaccuccuuggcucaagccauccuccugcaccuguagcuuggacuacaggugcgcaccaaaacacccggccaauuuuugcauuuuguguagagacacgguuucgccauguugcucaggcucaucuugaacucuugagcucaaucuacccaccuuggccucccagaguguugggauuauaggcgugagccauggagcucaccccuaaaccacugcuacauaauauuccauauguacuuuuuuuuuuuuuuuugagaugaagucuugcucugucgcccaggcuggagagcaguggcacgaucuuggcucacugcaaccuccuccuguccccgccgcuggguucaagugauucuccugccucagccucccaaguagcugggauuacaggcauguaccaccacaccuggcccauuuuuuuauuuuuaguagagacaggguuucaucauguuggccaggcuggucucaaacuccugaccucaagugaucugcccgccucggccucccaaagugcugggaucacaggcgugagccacugugccuggcccagcccauauguacuuuaauuuagguuguuuguaauuuuuuacuguuauaaucaauguuucacugaauauccuuauaccuaccugucugcauaucuggaaguauuucucuaggguggauaccucacaauggaauaucugauuugaagaauauacacauacuaaauuauaguagauccugcaaauuucccccugaaaaugauuggauuagguuauaccccauccguaaugucugacaguauuuccccauaccuuugccaacgcuggauauaauuuuuuuuuuuuuuuuugagauggagucucgcugugucgcccaggcuggagugcaguggugcaaucuuggcucacugcaagcugcaccuccuggauucacgccauucuccugccucagccucccaaguagcugggacuacaggugcccacgaccacgccuggcuaauuuuuguauuuuuaguagagaugcguuucaucuuguuagccaggauggucucgaucuccugaccucgugauccgcccaccucggccucccaaagugcugagauuauaggcgugagccaccgcgccuggccagaaucuuuuaaaacuuuuuccagaggcaaauaauuauaucauauuauaaugugcauuuucuuuucuuucuuuuuuuuuugagauggagucucccucugucgcccaggcuggaguguaguggcauaaucuuggcucacugcaaccucugccucccggguucaagcaauucuccugccucagccucccgaguagcugggauuacaggcaugcgccaccaugcccagcuaauuuuuguauuuuuaguagauacggggauucuccauguuagcgaggcuguucucaagcuccugaccucaugugguccacccgccuuggacucccaaagugcugggauuacaggcguaagccacugcgcccggccuauguauuuaugaauacauaauuuauguauucauaaauacacaaauaaauauauaauuugccuauuuuucuauuuuuuuuuuuuguuacggcuuuuuuuuuuuuuuuugugagacagagucucacuccuucauccagacuggagugcagcugugugaucucggcuuauugcaaccuuagcuuccccgguuccagccauucuccugccucagccuccaaguagcugggacuaugggcgggugccaccacgcccggcuaaucuuuguauuuuuaguagagacaggguuucuccauguuggccaggcgggucucgaaccuaauauuuaaaucuuuguuuuuuuuuuuuuugagauggagucucgcucuucugcccaggccggacugcaguggcaguaucucgguucacugcaagcuccaccucccggguucaugccauucuccugccucagccuccugaguagcugggauuacaggcgcccgccacugcgccuggcuaauuuuuuguauuuuuaguagagaugggguuucacgaaaguguuagccaggauggucucgaucuccugaccucgugauccgcccgccucggccucccaaagugcugggauuacagacgugagccaccgcgccuggcuuauuuaaaucuuugaagcagaaaaauccuuaaggaagacaaaaguccaguaagggaaaaaaaggauaaaacugacaacaaaaacauaaaaaauuucugcauacuaagaaaaaaaauuacaggcgguucuccuguccagcccaccaccccuggacugucccugcauauaaguuccgccuagcaaaacccuaugugucaucugcugucuccaggucccuucagccucuugaaccuggugccaucccuagugaauagggguccagcacaacaauuggugagccagucaagaggcuguggagaaaaucccaucagucugagacaacgggaucugggaaggggaaaucugaagggaaaaucucauuauuaacaacaggccgggugugguggcucccagcacuuugggaggccgagguggguggaucaccuuagguuaggaguucaagacuagucuggccaacauggugaaacccugucucuacuaaaaauguaaaaauuagcugaugguggcgcacaucuguaaucccagcuacucgggaggcugaggcagcagaauccuuugaaccgcggaggcgcacuugcggugagcugagaucacaucacugcacuuuagccugugugacagagugagauccuaucucaaaauaaauaaauacauacauacguaauaaaaugaaaaauauauucucuaauuucugccaacacuggacuuuuauuuuuuguauuuacuuuguuugauccauuuagaauuuauugugguaugaggaugggauccacauuuauuauuuguucaaauagauggauaauggcucaacugucuuuauugaauaggccauucuuugucauaucuuaaauuuuaaauucucuuguacacaaggguccauuuuuugacacccuaguauauuucauugguaucuuucucuguuuuuuuugagacggaguaucacucugucuuccaggcuggagugcaguggugcgaucucggcucagugcaaccuccuccuccuggguucaagcaucaagcaauucucugccucagccucccaaguagcugggauuauagaugcccaccaccacgcacagcuaauuuuuguauuuuuaguagagaugggguuucaccaucuuggccaggcuggucuugaacucccgaccucauaauccaucugucucagccuccgaaagugcugggauuacaggcgugagccacugcgcccggccucuuucucuuuuguugcaccagaacuuuauuagagcuuuauaguauguuuugauaccuugguggacaaaucuucacuuaguuucuuuauuuuucaaaauuuuuuuggcuguuuucagacauuucauuuccagacaaauuuuagaaucaauucguuaaguuaccauaaaaauccuauuauauuuuaauccagauuuccuugacuuuguagauuaauuagggacauuuguggauuaauuuuaaaaagaucacucugguuauaguuugaagaacgaguuggagggagguaagacagaagauggggauaucauugagucuggcauauuuugucuuuaaaggacccagauaguaaguauuuucagcuuugcagacugaauggucucucucaucacuauucugucauuacagcucaaaaauagguauagcccaucuguaaacaaauggguauagcuguguucuaauaaaauuugauuaagaaaaauagugaugagccaaauuggacuugcagacuguaguuuuccaaccccugauuuaggcucuugcuguaauucaggcgagaaaugauacuagcacaaaauugggaaguggcagcagaaaaaaaugaugaauuuaagaacaguuuaggaaguggcauugaaacaauuugauuaaugggacgagcagagugagagaggagaaggggucaaggauaacgcuuagguuucugguuuggacauuagauagcugauggaucaugagacaguggaagagcagaguaggguugggaugugggugaggauacauguuugaucuuggccuuuuaaauuuaagaagacugugggguaucaaaaagaggauacucgguaggcaguugaacauacgugucugguacucaaaaggagaguucuagacuggagcuuuugguuuagaagucaccagcuacugaugguaaucaaagcuaugggcauggaugagauugugcagagacagcagggagagugagcaaagaagugacuaaacccaacuuccugaggaaccaaucucauuuaaggaacacacuuaggaggauaauuccucauaggagucugaagagaaggggccagagaguagggaagaaaagugagaguguuaucaagaaaagccaagagaggauugaggggugagggaauguuucaaggggucagaugcugcugggaagucagguaagaucagaacagagaaggauccauuagguuuaacaugaagaguuugucaaugaccuuaaugagaagauucauagaguggucaggacagaagugauuggagugcguugaauagucaauggaaggugugcagguagagccagggaguguagaagacucuuauguuguccgggcgugguggcucacaccuguaaucccagcacuuuuugaggccgagguaggaggaucacuugaggccaggaguuugagcccagccuagacaacauagacccuaucucuacuaaaaaaguaaaauuaaaaaggccggguucaguggcucacaccuguaaucccagcacuuugggaggccaagggaguggaucaugaggucaggaguucaagaccagccuggccaacauggcgaaacucugucucuacuaauacaaaaauaagcuggaugugguggugcaugccuguaaucccagcuacucagguggcugaggcaggagaauugcuugaaccugggagguggagguugcagugagccgagaucgcgcuacugcacuccagccugggcaacagagugagaaucugucucaaaaaaaaaaaagaaaauaaaauuaaaaaaaaaaacuuuuauaugugugaagaguagcagagaugggguggugguuaaauggaaguguggggucuauaggaaacucuuuuaaaaauagaagaaucuaggccaggcucauaccuguaaucccaggaauuugggaggccagugugggugggcaacucacuugaccaggaauuugagaccacccuugacaacacggcaaaaccccaucucugcaaaaaauacgaaagucaggcagcugggcacaguggcucacgcuuguaaucccagcacuuugggaggccgaggcagguggaucaugaggucaggaguucgagaccagccuggccaacagagugaaacuccaucucuacuaaaaauaccaaaauuagccgggcaugguggcgcgugccuguagucccagcuacucgggaggcugaggcagaagaaucgcuugaacccaggaggcagagguugcagugagccgagauugugccacugcacuccagccugggcaacagagugagacucugucucaaaaaaagaaaauuagccuggcaugguggcucacaccuguaaucccagcacuuugggaggccgaggugggcagaucacgaggucaggagaucgugaccauccuggcuaacauggugaaaccccgcuucuacuaagaauacaaaaaauuagccgggcgugguggugggugccuguagucccagcuacucgggaggcugaggcaggagaauggugugaacucgggaggcagagcuugcagugagcugagaucucgccgcugcacuccagccugggcgagagagcaagacuccaucucaaaaaaaaaaaaaaaaaaaauuaagcaugguggugugcaccuguagucccagcuacuuaggaggcugaggugggaggauugcuugaauccgggagcaccacugcacuccagccugggugacagagcgagacccugucucaaacaacaaacagaccaauagaagagucuugagauguauaaacacugaugggaaagggaagaaagagaaagaggcugaaguaacagaaguaaauagauaugaaagaccuuugugcccucucaagugcugugcaaaauuaguaauuuauucuuccuucagagucaagaggcucuuuggcccaauguuaugcgaguagagggcacuuaggaguaguugggguguugaauauucagaagagcagagaggauuugagagcagcugcagggucagguggggcuagccacaagcaugguggccacacagagggucuccugcccugggggccuguggugguuuagagcuucuacugugauagaaugauuaagacuugaauaggccagauccugcuguguaaaacaguucgucauguagaaagcauuuuugggucucugaaguagccgugcuuuauugauacaguuagcagaaaucugcugaacagaauucagaauuugaagaccauaaauucauuuugacgaauggcaucccucggaacaugcauaauuggggguuucucucccggcauuugagggucaguguucaguggggacauccagcucccccugcagguugguauccagcaagguucacuucuuugccaagcacucgcuauggggacaucaguuauaaauaaacaaaacgcucgccggaacguuauggucauccugcccaggcaggcucccagcuuucugauggauaucagacacuagcccuggccucacaguauggugguucugaacacugaugguauuuaagcccucuguguuuugcuccuguucacccaggaguacuagugaaagauggcugaacagagcaguguauuuuggugagagggaaauugcacauggauggaaaguuugccaaacccaggugauugagcagacggcuuucuuccucuccuuuuuuuuuuuuuuuuugagauggagucuugcucugucaucaggcuggagugcaguggugcgaucuuggcucucugcaaccacugccuccuggguucaagcgauucuccugccucagccuccugaguagcugggauuacaggcaugcgccaccacgcccggcuaguuuuuguauuuuuagcagagacgggguuucaccauguuggccaggauggucuugaucucuugaccccgugauccacccuccuuggccucccaaaguucugggauuacaggcgugagcgacugcacccggccgacagcuuucuucuuaaaucuuuggaggcuuccacuccuccagcagagacagcugaacuagauauccagucuuaugauggugaugaauagguuuuacuaacagaaauuuauuuuaagguaagauuuuuccagaaggcaacuaguuaguagaauucaucuguucaaagcaauaaaaacuuccugaggaccuauuguguaucaguucuugggcuggaugcuagagaaacagauauaaauucaauaccaucucuguccucugggaacuuacuguucagguagaauuucccaaaauguauuuuggaaauacuggguacaugaaauuccuuggucaaguaaguuuaaaggauauugcuuuguuuuaucgucagucuucuuagagauucucauuguauacgaguauaucaugguuccgagaaguucugugguaaaguucucguuauauguuuaauccaguguuucucaaauuuaugucacacacaagcucaggguaugugugugacauuucuuuuuuuuuuuuuuugagacagagucuagcucugucgcccacacuggagugcaguggcgcaaucucggcucacugcaagcucugccucccggguucacgccauucuccugccucagccucccuaguagcugggacuauaggcacccgccaccaugcccggcuaauuuuuuguauuauuaguagagacgggguuucaccgugucagccaggauggucuugaucucuugaccucaugauccucccgccuuggccucccaaagugcugggauuacaggcgugagccaccacaccuggccaaauuuuauuuaacuuuaauuaauuuaaauuuaaauaaccauauggggcuagugacuuguguauuggguagggcagcuuuggaagcuacuuugagacaugcugagcuaaagguguuuuuauuuauucauucuacaaacaucaaguuugugguggucacugaguaaaagcauccuuguccucaaggagcuucuaauuuaguggggacugcaggcacccgccguguaaugaugagccuuaggugauuacuuggagcacagaggaaggguuucagcuuugugggggagguugggguugaucagggaagguguccuggauggguccuagggaguaaguucuggagaacaaauaagaguuuguacaguaaaacuuacucuuuccuucuuuccuucuuuccuuccuuccuuccuuccuucccucuuucucucucucucccucccuuucuuuucuuuugacagagucucacucugucacccagguuagagugcgguggcaagauuucgucucacugcaacauccgucucccaggcucaagcagcucuccugccucagccucccaaguagcugagauuacaggcauaggccaccaggcccagcuaauuuuuguauuuuuaguagagacaggguuucaccauguuggccaggcuagucuugaacuccugaccucagguaauccugccucagccucccaaaguacugggauuacaaacgugagccaccacgcccagccacucccuguuucaaggugcagguacuaccugcucagugcaggaaauguuuguuugucucuaguucuuacccauuaaaaccucuguucuugccggaagcuguaggaauacagugacauggcuucacucuugcccaugcuucugcccacuagccgucaguuaacccaugcuuauugaggacagugaguagcaggcgcuuuuuuuuuuuuuuuuuuuugagacagagucucgcucugcucccagucuggacugcaguggcacaaucucggcucacugcaaccuccaacucccugauucaagcgauucuccuaccucagccuccugaguagcugggauuauaggcacgcaccaccacacccagcuaauuuuuaauuuuuaguagagacgggguuucaccauguugggcgggauggucucaaacuccucaccucgugauccgcccgccucggccucccaaaguuuugggauuacaggcaugagccaccaugcucggccugaaacauggagccuuugagcauccccagaaucaucuucuugaugggcuuaugcugauaccauuugcaguaagucugacagaggcaggaacagggcagugcacagugacacugccucuccuugcuuggguugaagagggccuguggaagggguugagguucaggagagcugcagcaacuugaagcaucaguguuuguuccucucaacugugggagacuaguugucuaaagauuaucuuucuuccuucucuccagaugguguccuacucuucuguccucacagccaucaguaagguaugaccauagacacucaggagcuagauuggggaugacagacaaggccccgccuccuugacggcccugaugcugugacccgugaggcuggauaggcagcacaugaugccucuggcuggcauugcuggacuuccaugggagggggauccuggcaaguaggggcuggugcuugggagccaauguccaguguugaggaugcugagucuggaacccaggguuggaggagagaggagcaggaguccugaaugcaccgucugccucaugugagaccuggggguggauggaggcauuccguagcaucuccacuguccuuuccacaguuugaugacuuuucucgggaccuguguguccaggcauugcuggacaucauggacauguuuugugaccgucugagguaagggcagggguaagggggcucacaauacaauguuccagccuugucuuugugcagaggugcagcuccuagcacacagaccgagaccaacuccggguuccaacguuuuuucuccccaccugcccaucuacacuuaccugugcccuccuuuucuuacucccuuaggacagagugccuccucucugucuggaguagcucauuugaaaucuuguccaguaggagccaaaggggcuaagcaucuuccccaggacuuugcuagcuucucagcccuagucccuaguaggggagugccagggacucuggggaacauugaugugggucggauuucagccauuggaagaacagagucugauuuugcauccuucccuguagcugucacggcaaagcagaggaaugcaucggacugugccgagcccuucuuagcgcccuccacuggcugcugcgcugcacggcagccucugcagagcggcugcgggaggggcuggaggccggcacuccagccgcuggggagaagcagcuugccaugugccuucagcgccuggagaaaacccucagcagcaccaagaaccgggcccugcugcacaucgccaaacuagaggaggccuguaugucccuugauuccccugagccccaccugccgcugcucccauagccgguccuuuaauugagaagggagaggcaggaugccaucccaccucuuuccaggaggaucugaaaccaucccacuuccuuuuuuuucuccccauaagcauugcacacaucccagggacuugggcaggguggcacccgagccaaucaaccaacagguauuuacugagcauuguuguauacccagcacugugcuaggugcugggggugggggguggggggcuaccaaaggagcauguggcagggucccugcccucaucaagcauagcugcuaguggguagcaagacuaguacaucacagacgaggaaaaaacuagaggacaagacaagcacaguguccauuauuguguuugucuccauguuacucaucgcuuggaagcagaugacucuuguauuugaauguuaccuaaaaugccccuuuuaacacagugccugucugcuguugggccuguuguaccauaugccucuugacucaaguucagauguuaaguuuggguacuuuccagagccugagaacagacagaucaccuggcgggagggaagaugccaguauuuccagcaaugggguccuaaggccauagucuugcuccuugaagcccaaguggcuugggaccaccuacaggucucuuguucuccaggaacaagaaugcuagaaugggcuacucucgaggcuucaggaccugguuggagagcuuguuuuaggacuaguauauuuauuucuuccccaaguauguuuuacugccugugaaaaguccaaaaagacaaucuuuauauaaaaauggacuguguugacagccucuucccuaccuugggcccuugauaaauguuuauuggcugaaaaucggaugaauacugaauuuuaauggaucucaggucuugucuuuuuuucccccuuuuaugcuccauggagguuaaugggcuaguuggugccauuauucaucauuugacccucuggaauuguaacuaggauaaguaacuuauaguucagugcuaaccaauauggcuuagaccaugagugugggcauuaaggagagaacagugaguuagaccagucgggugaguugcuaaaggaacuggggcuugaacagaagcuuagagcauggugggaguuugagagagaguguguaagaggccuucagcaggggagggcagcaaacgcaaugccuagaugagggagugguugagaaugagaaagccauuuagggacccaguucccccagaggagagugacagccucugcaagacuggacuuugggauccgcucacuccucgagugauuuguggccgcccucccuguuccagccacuggauucuggccucccucugccucucucuccugagccugugugaugccauaccuucugaagucagcuggcuguguccccuggaaaucaggcuuuugggaauggucucugggguuuccagcucuaggugcccaccccccuucuggaaacagugcaugcugcccucaggccccucccucccuguuguccucaggggaagccuuccugugugguuucgugugccggagggagugccaaaaucgaggaguucagggccaggugcuccuucucuccuguuucccaucauguuucuguacuuccuucccucugccagcuucuuggacugccaucgagcauucucucuugaaacuuggagagauccuggccaaucucagcaacccgcagcuccggagucaggccgagcaguguggcacccucauuaggagguaccggcucccugggggaugguggagaagggagagggaggacacgcccugggguaggaagauguggcacccgugccauccucuccgccuucaccuuuggccccccaaacaccguccccuguguuugugaccccucagcauccccacgaugcugucugugcaugcggagcagaugcacaagaccggcuuccccacuguccacgccgugauccugcucgagggcaccaugaaccugacaggcgagacgcagucccugguggagcagcugacgauggugaagcgcaugcaggugggaggggccgaguggcucucccuucuccaaggcaggccagccuguugggggcaggagggaggauucuucugguucucccugggagaagugggguuucuccugcuccaugauggaaagugggugccagucgugcacacuucugucauuggaccuuacuccccugguucucagcacauagcugagcagugacucugccaugcagucucugacccagccaaauccucagaguccacagaagggugacgggguaugggcacccucuuaggccucauccuuggcucuucccacagcauauccccaccccacuuuuuguccuggagaucuggaaagcuugcuucguggggcucauugagucucccgaggguacggaggagcucaaguggacagcuuucacuuuccucaagguacuggggacgugggaggggcagagccagucuaggaaugguucuuagcaagaccaguggcacccuggaccuuugcccuguguuccucccugcgggcacugggcccagccugccagguauuccagugcaaguucccauugaucauuuucucugaaagugccagggcuauauuuagcccauuuggcagacuccguuguuucuuaccacagaggugcaguuuagcuuggucaucagacagauaggugcagggcaguaaagggagccagggaaaggggccccaguccuccuugaagcuggggauccacuuuugcuuauggcaucuuuuucuguugagcuagcggaggugcagggugcuuguguccugugccuaggccugggggcaucaggggccugggcaccuauuggcuuucucauuuagcacuaagugugcucucacucccaggguaggaguguuccugucucucuuccuggagcagggguucggggggaugccuucagggguagaugaaagagaaaagaaauggaucuuccuguuuuucccccugccucacccccuagauuccacagguuuuggugaaguugaagaaguacucucauggagacaaggugaguuggggauugagauggaggcaugggagcagaaauaagggcaaaggggaggguccuucaggccccagcugggcaguguucucaugccuggaagagagccggaugugaguguacaccucagcgugcacgugcuucacaaugugcaugcuucagcaugugcgugugcuucagcaugugcgugugcuucagugugugcgugcuucaguguguguguuucagcgugugugugcuucagcguguacgugugcuucagccagugugugugcuucagcgucugcgugcacccacaacauacacccaggcuccaggcagaaagcagccaggcaacucaggccgaugccuccagcagacaagguugccugagaugaucagggccugguggcccuggaaaccagauggacacuucugccucuuucuaggacuucacugaggaugucaacugugcuuuugaguuccugcugaagcucacccccuuguuggacaaagcugaccagcgcugcaaguaugagcuccccuggucacccccgcccuacuggaaggcguucugggcucuuccccugaucucugugccagagaagccucaggggacucugucuccuuguucacuccccuuggcaggggcaggaaauaggagcccacaguugccaaguccccagagccccucuaccgucccucaggcacuccagauuuuccucauccugaaagagggaggaugcugcucagggaccugccacucccaccccucaccauccuauccaggugcccaguucccucagcaucuuucucccucacagcugugacuguacaaacuuccugcuccaagaauguggcaagcaggggcuucugucugaggccagcgucaacaaccuuauggcuaagcgguaagugugaacgcaccugugcuaccccaagagccccuugaccucucucuuguuacgguggggcugcugcgugccuuucaaccuccugucgaaaguuugggcugcaagugacugggaccgugccuggggguacagggaacaggaaggaaaagaaagcacagaugucuucagaccagaguuuuacacucuuagucacugcucuuuaacucauacccaucuuugugauaaaaguaaaaauccuaggcuggaggcggguggauuacuuggaggccaggaguucaagaccagccugcccaacauggcaaaaccccaugucuacuaaaaauacaaaaaucagcugggcgugguggugugugccuguaaucucagcuacucuggaggcugaggcacgagaauugcuugaacccaggaggcggagauuguggugaggcgaaaucaugccacugcaccccagccugggcgauagagugagaccuugucucaaaaaaaaaauaaauaaauaaauaaaaauccugaaucuuccuuuaaucuuaaaugugcuuucagagcauuuaagacuaaugauaggccggcugcgguggcucacaccuguaaucccagcauuugggaggccaaggcggguggaucacgaggucaggaguuugagaccagccuggccaacguggugaaaccccaucucuacuaaaaauacaaaaauuaaucaggcgcgaugguaugcaccuguaauuccagcuacucaggaggcugaggcaggagaaucacuugaacccggaaagcagagguuguacugagcugagaucgcgccacugcauuccagccugggugacagagcgagacucugucucaaaaaaaaaaaagacuaaugauaaauugccaggugugcuggcucaccuguaaucccaggacuuugggaagccaagguggguggaucaccugaggucaggaguuugagaccaguagaacauggugaaaccccgucucuacuaaaaauacaaaaaaguagccaggcgugguggugagcgcccagcuacucuggaggcagaggcugcagugagccgagaucgugccacuguacuccagccugggcaacagagugagaccugucucaaaaaaaaagacuaaugcuaaaucagugauugcaacauugacuaugcuuccauaaacuucaccccaaccucggagguucuuacaugcuucccaccuccucugcgcauuuccuuccgggcuugaacgagggaacgugucaagaauuucucuucauuccucuucccuuccuuggccaacuggugauguccacagcaaagcggaccgagagcacgcaccccagcagaaaucgggagagaaugccaacauccagcccaacauccagcugauccuccgggcggagcccacugucacaaacauccucaaggugagugugcccuucccuggccaccacagucuucucuuucuucuuuccagugcuccaucugcuugcagauaaauaaacagaggccacagaccucugucuccuuuagcuuuuauacauaguugcuuuggagguagugaaaggggaggcaagggcagcuaccacugaaugcuaacccgugggagcuucauuuguacaccaggcacugcaguaggcgcuuucacuuaggccaucucacauggaaacaacagagacgugggugcgguggcucacgccuguaaucccagcauuuugggaggcugaggugggaagaucccuugaggucaggaguuugagaccagcuuggccagcguggugaaacccagucucuacuaaaaacacaaaauucacugggugugguggugcaugccuguaaucccaguuacuugggaggcugaggcaggagaaucgcugaacccuggggggcagagguugcagugagccaagaucgcaccacugcacuccagccucagcgauagagcgagacucugucuaaaaaaggaaaggacagagaagauccuagccgugaccuugcccacuccaaccuuaccaccugcaugccaguguagaugagagggauggaucggagagcagggguggguuuuaggaaugauuuuccagauugaagucagaaagauguagauuacauuccagguugugaagagagaaaauguggcuaggcuguaucuuggguggggggucuucaguguucuucaggacuugauuuccuguccuguccccagacgauggaugcagaccacucuaagucaccggagggacugcugggaguccugggccacaugcuguccgggaagagucuggacuugcugcuggcugccgccgccgccacuggaaagcugaaauccuucgcccggaaauucaucaagugaggaaggccaagccccugaccccagggcgugcagggaggcugcgcguugggaggagguagcaggguaggagucaggugccugggucugggucucauccagagacccacgggccuaggcagagcauccuggcuggagaucuuggaggaagggccuguucucacgaccuaaguguuccuuucucuucagcugaggauggaguggacauguuugguaaagagaugaggguaaggguugagguguugaacauugggcauggaggaauuccaaguaugcccaguuauuaauaaggggcucucaaauucuguugccuuuuuugauugcccuggaauuugacauauauagaacaugguuccauucagugagccauucucuaggccuuggaaaucuucuaacaauaaaaauccuucuggccgggugcgguggcucacgccuguaauccuagcacuuagggaggccaaggugggcggaucaccugaggucaggaguucaagaccggccuggccaacuuggugaaacccugucucuacuaaaaauacaaaaaauuagccgggugugguggcgggcaccuguaaucccagcuacuugggagacugaggcagaagaauugcuugaacagaggcggagguugcagugagcugagauugugccacugcacuccagccugggugacagagcgagacucuuucucaaaaaaaacaaaaaaaaaacaaaaaacaaaaaccacaaaaaccuuuuuucuauagcaaugugucucauuuuaaguuuaaccaguaacucagacucuagcuaucgcucucugaacauguguagccccagcgcccagcuacugcucagcucaugcccuggucaaugcagccugucuccauuccuuucaguuugaaugaauucacaaccuauggcagcgaagaaagcaguaagucagcccugugcauccgcaggcccagugggcccugaggagggguguggcgggagagugugggagggaggagggcuccccagcucaacagggggaggcugugcucccuccucagagccaugaccaauggaagcuuccacagagcuugaaaguggauaaugcuggaaaaggauucuucccagaccaucccugugucuccuucccccccucaucccuuuacgacuugguuagguaugccaggagagggugcugggggucuuuggucucaaggaagggaugauguuccaguugagacucaagaaaaggauucugagccucagagcuuugaaggagccacuuggucccugaccuuccuagaggcaaaucccgaucccugucaacccagacacgggcuccccccugcccucgucugggagcucagccuucccguccuuccacagccaaaccggccuccguccgggcccugcuguuugacaucuccuuccucaugcugugccauguggcccagaccuaugguucagaggugagagaggggagcgaccgggacgggggcucaagggaaggagguaacccggaacucuccccaccucacugccugcgcccccgcagccucucagccaguuaguucugugggccucagaaaccaggugcccacccgggcuggaguccguagaggcaccuucagcccuauguucacauugaccacuagguggcagcauugcccccgucuggcucccuuagaccaguucguccccagucuuugggcugggcuggagcagcagccuggcgggaaacagugcagccccagguccagcgcuggcaggcgccgcgcccuccccacucggcuggugccccccuuccccuuucccaggugauucuguccgagucgcgcacaggagcugaggugcccuucuucgagaccuggaugcagaccugcaugccugaggagggcaagauccugaacccugaccaccccugcuuccgccccgacuccaccaaaguggagucccugguggcccugcucaacaacuccucggagaugaagcuagugucaguggcccgggcgcccacuccaaggguggcggugggggcagggucaagacccgcucccugagcccguuccuugcuccccugugcugacuucucugcacacccgcaggcagaugaaguggcaugaggccugucucagcaucucagccgccaucuuggaaauccucaaugccugggagaaugggguccuggccuucgaguccauccagguagccccgccuucccagcagcguuugcuccccugagacacagagccagccagugaugacuuguuauauuucguaagggcaagaagaccuuuaauccaggagcucauguuuugauauugauauuuuguguaaucguugucuuagcuacucccucuggcccagguagcucugggaagaucaaacuuguggagagagguguggaauguggcccgggacuccacccgcugcacuuagcugcccgcagaggcugagaaggugauguuggcucaagaaagggagauagaugguagcccaucaccuuuccgucuccccuagaaaaucacugauaacaucaaagggaagguaugcagucuggcggugugugcuguggcuuggcuuguggcccacguccggaugcuggggcuggaugagcgugagaagucgcugcagaugauccgccagcuggcagggccacuguuuagugagaacacccugcaguucuacaaugagaggucgguaaccugccuucccuucucagacccuucaaguguguugugagaagucagcacauccaauaacaagcaccccucucuuuucugaccuucgcaaacacgcuacuugaucacucacucacuuuccuauucaugcauucacucaucugacucagcaaacauguacugugucucuguggcagaagcguuuauaugccagcaccugcuguguugucagaaaugcagacccuaaacagggucugcccgcagagacucaaguucuagacaacuagcucccaaaagaacaaagcugugugacugucuaggagcuaggaaccugucuguagauuuuacaggccaugccccacccucaguuaccucuuaggacaguuuccugcccuggcucuucaggggcuuggaggacuucccuggugaccaguuacguugaguucauucacccaaccaauaaguuguuugcuuuuuuuaauuguaaaaaacacauaagauuugccaucuuagccauguuuaaguguacuguucaguaguguuaaguauauucacacuguuguguaacaggucuccagaacuuucuugcaucucugaaacuccauacccacugaacaacagcuuccuauuuuccccucccuccagcuccugguaacuaccauuuuacuuugugugucuaggaauuugacuacuuuauacuuuuuguuguuguuguuguugagacaaggucuuacccuugcccagaucagagugagucucacugcaaccucaaauuccugggcucaagugauccucucgccucagccucccgaguagcugggacugcaggcccacagccggcuaauuuuucuagucuuuguagagacagggucucacuauauugccaggucuugaacuccuggccuugagugauccucucaccguggucucccaaagugcugggauuacaggcgugacccaccgugcccugcugaauuugacuacuuuuuagaugccucauuuaacuggaaucauacaguccuugccuuuucgugacucacugacuucacucagcaugguguccucaaagcucauccauguaguagcacgugacaggaauuccuuccuuuuuaaggcugaauaauacucuguugugggccgggcgugguggcucacgccugcaauccuagcacuuugggaggcugaggugaguggcucacuugaggucaggaguuuaaggccagccugaccaacauggugaaaccuuggccuuacuaaaaauauaaaaaugagcagggagugguggcaggcgccugcaaucccagcuacuugggaggcugagacaggagaauugcuugaacccaggaagcggagguugcagugagccgagaucacgccacugcacuccagccugggugaaagagugagacucugucucaaaaaacaaaacaaaaacaaaagaaaccucuauuguguggcuauaccacaucuugaucccuccucugucaguggacacuucaguugcuuccaccuuugggcuauagugaauagugcugcugugaacauggguguuuaccagcuaauacguuuuggguguugccaugucuuuauggcaacguugaggaugucuuuauuuauuuauuuauguacuuauuuuugagacggcguuucgcucugucacccaggcuggagugcuguggcacuaucuaggcucacugcaaucuccgccuccuggguucaagagauucuccugccucagccucccgaguagccgggauuacaggcaugugccaccacacccggcuaauuuuuguauuuuugguagagaugggguuucaccauguuggccaggcuggucucgaacuccugauuucaggugaucuucccgccucagccuccugaagugcugggauuauaggcaugagccaccgcaccgggccugaggaugucuuaauagggagaaggggaagcauugagcugaaugagguuuggacggucuggaaaagcacaucucguuuuccccuugccuccuccuuuuuuccuuucuucucucauuucuccaccaccuucccccccgcccuaccaaguagggagcuuuugcucugguguaacccauucuaagcacccuaaauccuaucuggguaagggguagugagaagucuguggcuccauugugcaggugggaaaaguggcucuaaaggucauagcaacuuucccagagccacccugcauuccaggaacagucagcacucggcccgggucuguauucacuuccgaagccucuuuccaugagaaaauuccuggauauacacuucuaucugcccagcuaccaggggccgggaagaguccuguggggcagcccuugggccucuccuggaaggaacaguuuacuuugggaggaggccagggcugggcggggacccccaagcacucagccuagggggaagugauuguguuuauuuauguggcagguuggcagggcccaggccugggggaugggggaaguuggagaauaaaagaaaaugugaauaucuggcuggaauggccagggggaggaaagucccuccccagucccuauuuauaggcuuuguguccugcaggugagagaccugccaggagcagagcaggggccaggucaccccgggguauaccgucccccagcgcaaaacuggguuaaugccucagggagauuuccguaaccuaaguccaagggaaagucuggcauggguguucccuccucucccuccccacccuacaguggcaccugagccucagguucucucggcccucccccaggguggugaucaugaacucgauccuggagcgcaugugugccgacgugcugcagcagacagccacgcagaucaaguuucccuccaccgggguggacacaaugcccuacuggaaccugcugccccccaagcggcccaucaaagaggugcugacggacauuuuugccaaggugcuggagaagggcuggguggacagccgcuccauccacaucuuugacacccugcugcacaugggcggcgucuacugguucugcaacaaccugauuaagguacuugggcuggaguggcugugggccgacauggguccuguccccuggcuccccacaccuggccuggucugccaggcuucccugagaggcugccgugagccagguggccuccccggaaugccucgccucagaguugccuccuuggggagcucuggccagagacugggauucagccugaggggcggagcaacaucuggggcccccucugcgggccuuacuggacagccaugcugggguggcaggguguaggagccccagaucccgggccccuggcuccugaacugcccccuuuccugcgcacuaggagcugcugaaggagacgcggaaggagcacacgcugcgggcaguggagcugcucuacuccaucuucugccuggacaugcagcaagugacccugguccugcugggccacauccuaccuggccugcucacugacuccuccaaguggcacagccucauggaccccccgggcacugcucuugccaaguaagauucucuucagagcuugcccugcuccggccacccagggucaagcaccccucgccuggugccacccugggagacugggcuuuggggagcccagucagacacagaaagcuccuggggcaccucucacugucccccuuuuucuggaacccuuugccaggcuggccguguggugugcccucaguuccuacuccucccacaagggacaggcguccacccgccagaagaagagacaccgcgaagacauugagguaggccccccagcugcccucgccggcuucacuuguucaccgguuuguuacagcauuuccuaaggauuccccaggcaaagggaagcaguuguggccccugcccuuggggcagcugugccugggcaugauuggucaggaaucugcaugggugauuuguguggccccagcuugcccaugggcacaaggggccugucagauugugggagggguugagcagagaggggcugaggcccugcuagccaugcugaccucgcucaaaucggagcucaagcucuuuucccugacagcuggaaacugggggguuuagggguguauaacagugacuuucacucccucuaggauuauaucagccucuucccccuggacgaugugcagccuucgaaguugaugcgacugcugagcucuaaugaggacgaugccaacauccuuucgagccccagugagugugugggcuggccgcgcgccgcuccuuuuccugggaauucacuccccgaugcugccacucugccgcugccccagcugcaggcaucuuugcagcuggucagagaggguguggcagggaccugcuguucuagcccccaagggggugcucuguguccugccccuggagaagagguugcuguucucacucccugaggguugaagcuccucugcccagguccagcccagcccacaguuguucccccacagcccuccugccccucccuuaccccaggguugaggggaugacaagcuacccaagugagugaguucacugccucaggcacagccugugccauugacucaccagcucugaccuuccuuccuuccuucccccaaaacaugcccggagaggcccgggcuggggcauggggcuacuccccaccuuccugccuaaagagcacaccccccaccaaccacuucccuggaggucauccuuuucacuguccccuccucccugccaggcuuacugccaaggguuccuucuguggcauuuuuccuguuuccagagauuucuccugagccugaacuuuucucugaagccuuuuaggaacuaggggaccaacuauacacuugaucagaagaaagaugcuagguuugccagcuacaagugcugugaccuuuagcuagcgacugagccagcccccgucugggucuccucaucuguaaaugggguguugugaggaguaagcagcuuaggaaguaccaagaucggccccuggcccugugugcucaccacauguuaguuuuucucucucauuccauugggaucucuguaucugaggucccucugugcccuuuuuuuguuuuguuuuuuguuuguuuguuuguuuguuuguuugaguuggagucucccucuguugcccaggcuggagugcagucgcacgaucucagcuuacugcaaccuccgccuccuggguuuaagcaauuuuccugucucagccuccugagucucugggacuacaggcgccugccacaacgccuggcuaauuuuuguauuuuuaguagagacgggguuucaccauauuggucaggcuggucucgaacuccugaacucagaugauccacccgccuuggccucccaaagugcugggauuacaggcgugagccaccacgcccagccuguuuuucugagacacgguuuugcucuguugcucaggcuggagugcaguggcaccaucucggcucacugcagccuuguucuccuaggcucaagcagucugccucagccucccgaggagcugggacuacaggcguuggcaccacacccagcuaauuuuuguauuuuuuguagagaugaggucucgcuaguugccaaggcuggucucaaacuccuggacucaagcgauccuccugccucggccucccaaaaugcugggauuacaggugugagccacuguaccuggccucccuuugugcucuugaucucagggucuucucugggcucuccauguaccaguuaccuccgaugggugaaggucggguuggggcauccccggggagcaccacuuuugcacucggcaggcuguuucccagcgcuccaucugcuccgucccacagcagaccgauccaugagcagcucccucucagccucucagcuccacacggucaacaugcgggacccucugaaccgaguccugggugaguuccccaccccugcugccgaaccuggggcuaagcuggacgagucucucuucucauggaggcugggagaccuugucagcuggaaggggccuugcggugccccucccuucccucuccaugccccucauuguuggcuguccuggcccccaggcuccugucuaguucccccuccuccccuccccaauugccuuuuauauuuucucucucugacaccccauuuuggggacaugcucagcauguguuucuuuucccuuuucagucccaccuucucccagagugugaccucacccacucucauggaacucccuccugucacucuccccccacucucuacagccaaccuguuccugcucaucuccuccauccuggggucucgcaccgcuggcccccacacccaguucgugcagugguucauggaggaguguguggacugccuggagcaggguggccguggcagcguccugcaguucaugcccuucaccaccgugaguaccaccuucccggcucuccugcuggugcuggggccucggggcagcccuuagagcagggaggggccuccuucccccugggacagcacacccaccaccagccgucccgcaagcagcaucugucuguccguggcaggugucggaacuggugaaggugucagccauguccagccccaaggugguucuggccaucacggaccucagccugccccugggccgccagguggcugcuaaagccauugcugcacucugaggggcuuggcauggccgcagugggggcuggggacuggcgcagccccaggcgccuccaagggaagcagugaggaaagaugaggcaucgugccucacauccgcuccacauggugcaagagccucuagcggcuuccaguuccccgcuccugacuccugaccuccaggaugucucccgguuucuucuuucaaaauuuccucuccaucugcuggcaccugaggagagugagcagccuggaccacaagcccaguggucaccccugugugcgcccgccccagcccaggaguagucuuaccucugaggaacuuucuagaugcaaaguguguauguguguguguguguguguguguguguguuuguguguauuuuguaauaugugagggaaaucuaccuucguucauguauaaauaaagcuccucguggcucccuuugugacugugugugcu

SEQ ID NO: 16825 - RNA, 36888 nt, Homo sapiens
cuauguagccagggccccacccugagagccgugggaaggcuguggcccccgcugguaaaacugggcuaaugacagcaggggaaccggcggggccaggggggugcugggguaauuagggcucggccuggcgcuaggagauccugagaugaaaggugcucuggcgucacuggguugguuuuauguccaugaaugcaggugugugguguguguaugugugugcuggggguggggcuggcaugguggagaccucuccuuuggguuggguuaggggguccauuuguaugcagcccaccgucuuccuuagauugacucugguaccauuuggauuuuugugggagcaaacauggggggaaauaccaccacccgggagcuaggaauugaggggguauggcagaucuuguccccuccccgagcucaggagagggagcagauuguugggggaaauggcuggugacagagaauagaaagagccuauauggagaagggugacguuggaaaagggaggcaguggaucgguauugauguuagaaaugagaggggagggagguaacagggaaugaacccccacaaggaugaaaaacguaagaugauugaaguuaaaaggacaucaggggucaccugcccagcccucgcagcugaagcuugaggaagcucugcccccgacagcaguggcgauuugucaaggucacacagugaguuaccggcggagaagggacccgaacucccaaacaaacuacaccugcaagcguuugguguuuagacuuucuccccgauguauaaggugcaggcugcucgucgauacuuccuccuccacccucacggugcacacccgaaaaccccccaauucucccggcaagcaaaggcuauuuuuuaaugacaucuuuuccaaaauaugucaccaaguacccacuccugcgggagccgcccgggcuggggagggcgaguccgagcggggcggggcagaggcggccgaggggcggccggaccucuggcgggggucccggggcgcggcagggggcggggggcgggggcgggcggcggcgaggcggccugcagggagcagccgcgagccggccgggcgcgccgagcccgagccccagccggagcggggcgggggagggaggagccagagcggccgccgccucugccggaggagccgcggggccgccacacucgccccccgccccccccgcgcucacucgcacucacacccgggcgcaggaggcgggcggcccgggccccaccggccccccauggacgcccccagcacggggcgcugagacccccgcgucgcugcccagcccgguccggcgcgccacgccgagguaaggaggagggagcgagggggcauuaauaugcaaaugccuugcgauugauuaugcaaagccgcggggcuccguggccagcucccaggcgggcuaggggcgcccagggggugccugcugccagccucagccuuuccuggcgccccagugacccugucacgagcccgggagcuugcaacugacgcccuggggaagggagguguugcuaggaggucgcugggccccgggguucgcaggcggagauggcguccgagccucccccuggagggcccgcccggccucuguccggccagucugcugcgcauucccgggccgggccccguugccggccgccggagcucccccgcccgccgcgccgcgguuuguuuacggugcgccggaggccugcccccccagcccccaccccuagccucugaggcccgaguggccuuugcaaagcugccuccagcugcggagggcaguaugagugcgguggcgcgggugggcuugcacggguccggggagagggaaguucccccgccucacccgccucccgguugagcauggcugucugguugcaacacugcuaauugcaaaaacgcgguuguugggggggaauguguguguggaagggguguacuugguggugccuagaugauuaggagaguugcuggcuggggaggagagggagaaauggaccuguguguguguaccccaccuuguuucccuccccuugcaacgugucucuggugccccuucuccaucuggggcccucccuuguccagcgugaaagaaaggccuggggggaugacaggggcaauugaaagaaccaccguuccaggggugggggugggggacacagaaggaaagccagugaggugggagccugccccucagugcuggcuuuggcuccaggagggggaggggaugaagggggcuguuguccaaaaugaggggggaagcaaaagugacacgcagacacagagauauguccacacagacagccacaugcacauccagggacacccaggcagacucaaggacaggagcuacuggacacacccacauggggacaagggaagagacaggcugcugcugcaccguggagcucugaggggugggauauacccaugggagaccaagagcauggggaccgauccaugcacauacccacgcacagggucacacguagaugcugucacacacuggggcaaggaggaguugcugucacccacacauaaaaagucacugucacaugcaugcaugcacacagagcaauugcacacagcagcacaauuacaaaagacccugucacucacaggcacacacgugcucgcaugagcccagucacacagacaucauugcuugccgugacagucgcugucacucagucagaugcaaacacaguuacacaccaacacauguauacacaacuuagcaacaaguauuuuccuggacucuuuacuguggagcucugagguucuguaggcaacaaaacccuugcucccaagaauauuaaauuuggcuguaugaaaaaguguuccugcguaaugguguaaagcaugcauucccaaugacauguucuuggucucuaucgcuugagauaccacccuacuagacagugagcucuuggagaccugggagaaucacuuaaagagcucuggaucccacgcagagccuagcacaagggcugcucuguaaauacuuguuaguugauugacuguggaaccugcagacacaggugcacucauuugcacaugguccccugaacucaggugcagaaugaguucacaaggcccagguccccacaguugcagguccacaccaacagucguguccacacaaccccagauacacacaacugcagccugugcagccgagcacacacuuagaugcacacaaucacaaauuuuuccccuucagcuuccuccuccccuuuuuccucuaggcucagccacugugcgggaaugggcuguuuuuuuuuucuuucuuucuuuuagagggacagagaaacaagagcaaagacaguggguucagggggguuccagagggccgagucaugggcucaaagcaguguccagugacuucuagaagcuaggauucucuugacuguuggggaaggggagagcugcucuccucccuacccuaaaagcucaggggugucuaacugccccugcucugagucauuugccugggucuuuccugggaacagucagucacuuccagcugaguuccugcgccccaccuugagucuggcccuuuuucccaccuguacccuccuguccaaacuuggaagcuuuccuuaagaggccaucggcuggcgagugucugugugagugauauguacuuuugacuuggaauuucucucuaacucugucucucuguugcucugucuugcagugucugauucucccucucucucuccuuguuucucugccagucuguaacucucucucacccuguugcuacccccgaucuaccccuguccuugucucagagcuggggacuggcagcaauguucuucauacuuuuccaguuguuaauacccaagcuccgccccucugcccccccugcgcagccucuggggucagcuugagguugggguggggggcggggggcucagcuggcugcucaggacuuccugcacuuccuuagugccgcagcuguggccagcaaguuuuaggggcugggaaugggggaagggggggggggucagccacugcccaugcugaccccucgggccugcaugucuggagacaccaguucugugggcacccucagggugcaggcugcagccagcuagcagcucuuaaacaagccaugaagaggcuccccccacacuggcccaagcuggaaaagaaccgcccccaugggcaguggcgggagcuggcaggacccugcugaguuggguccacugcagggcucacaauggccuuucuccacaccccuggcagcugaggcccaccucagagaugcccaacagcuguguccuuuuugcccagccucagggccugguucugagggcacagcugccuagacuaaguauguacuaagcgaggcccucccacccgugagugcagguuccagccuagaagggguaccucuucuggagagggaauuugaggagggggaacucaggcaggagacaucgagcccgggggcaccaagcacuucucgcuaugcuccccucuagccuuggacuauuuggagguggaggcacuuggcagagaacccacagggcagcuacagaggggaaagacugaggcuuggucucagggaacacauagcuggaugaaagaacaaggcauugggccgggcacaguggcucacacccguaauccuagcacacugggaggcggaggcaggcagaucaccugaggucaggaguucaagaccagucugaccaagauggugaaaccccaucucuacuaaaaauacaaaacuuagcugggugugguggcgggguccuguaaucccagcuacucaggaggcugaggcaggagaaucgcuugaacccaggagguggagguugcagugagcugagauuguaccacugcacuacagacugggugacagagcgagacuccgucucaaaaaaaaaaaaaaaaaaaaagaaaaacaaaaaagaacaaggcauuaucuaucaagcaggugauauaccaucacagcuaagaacagagaugauggugaugaucaugacggccaugauugaccuggacugccuaggucugaaucccagcucugucacuugcuggaugugugacuuugagcaagcgauuuaacuuccccguugccucaucuguaaauuggggaugaucauaucuaccucauuuagcuuuuuugaggaaaaauguuuuuaaaagugccuaguucauaacaaacuguauaugugagcgguugugaugggugaaggaagcugugggccuggggucucccagauuucuuagagaagcuucguggagaauugggucuccuagacaucagugagacuggggccuggggcagugggucuccaauuuccagccuucucaccgucauguaaucuuuuccucccagacaaauuuuugcagccuggaaugaguguaugggaaagagcccaaggcaggccccucugccccacccuccuuugacccucgcccuucagcuuacaaggagcccuuggccccucagccugggacacaccccaccagcuaggggcaccugcauaaaucuuugggcaucacugcaucucuguucagggucugagcucugggggugggagagagagaacaaggaaagccguccccucucuuaugugugggcucaaagaggaggcagugcccuuccucccuccugggagcccagcauuggucaaccaggacccagcucuggcugauaggcaccagauuccccugcccuccauggagugguacuuagugugaaaggugguggcagagagaaacugaagcacugaguaaugaccaguguggugggcacagcacuuugagauccagcaucuguccuggguugccucuuugccuuugugagucuggugaucaggauccccucuccaaaccccuuuuauuuagcccugccccucaaggugaaggaaggacaaugggaggauacccuguaggggugacgggaagccuuuggagugggaaccaaucucaacucuaguucucggcugggcacaguggcucaugccuguaaucucaauauuuugggaggccaaggcgggaggaucacuugaggccaguaguucaugaucagccuggucaacauagugagaccccaucucuaaaaacaacuuuaaaaaguuagccaggugugguggcgcaugccuguguuaccagcuacuugggaggcugaggccggaggaucgcuuaagccuggaaggucgaggcugcggugagcugugauugugccacugcacucuagccugaacaacagagugagaccccccacacacacauccucucaaaacagacagaaaacaaaacaaaaaacccaacucuaguucucauggcugcaaaggugucuaggggacuuuggagaacuguugugucucuuggggagggaggcaagcaugaccguggugggaagaucacuggcugggaguugggaggccuggcuguugacauucacuagucguaugacuuugggccuggguuuucauuaucuagagacaaugguuccugucucacucagguugagggcaaauaacacaaggugggaugaccccuguguucaauccauguugcauccuggcauggugagcaaugccuguggauucuccuuuuuucccagggccuggcacaugccaggguggggcauacacaugcugccuggaaccagagacaguucucagucucucacugaaguaucuggggcugguguguggugggggcacaugugguuccaccuuggugucacuuggcaggccaaagcuggggucauagggaccucccuccgguaugccauugcgugaggugguccagagggagggucagaaguuugcuggguagacaagggaagcaagauggguguuacuggugcccaggaaauacuauccuugcuucgcuguuuugggggugggcauuaaagguugauaccaaagccucagccaugccccucagcaguggccaagagcagaaugauuggaccaagccccuggcccaccuccuccuccuccucuuuuccucuucuaaagaagagaucggcucuuggcucccagagccccagcugccuguuucuuuuucucuuuuaccaggcauggggguggggaaacaggggaaccgaggcuuuggugucuuucggcauuuuuguacacaucagugaguggguguguugugcacgcauccaugugagaguguuuuugugcaugugugggcuggggagggcucugaauaucuccuggaacgguacccagagcccuguggcucugcgcaugcggggugagugugugugucugcacguguccgugugugugccggagacucagcugcauucacgcgcgcgcucucucccucccucucucccucccucucucucucccucccucccuuccucuucccucucccucucucucucccccucccccucucugucucucccuccuucucucccucccucucucucucucacacacacacucucaaucuuucucucuucccucccccuuccucccuccuuccuauucccucccuccucccuuucugucccugucucucugucucugucucugucucucucucucugccucugccaguucugcuugguuaggggcuagcuccagccucuggggugccugggagaacaucccucccuuucuuucccccuccaccauucccuccccuccuaggccaugcucuucagggcuugcaggcaacuucuucuacugccuuagaugagggagugaggagggaggaccccaagccuugugcccauggugccaucugcagcaagugccuuggccccgugacauucaugccuccagcauucagcugccccagcucccagcuccaauuacccgcuggcugcugggggaggguggggagaaugugccgugcccagcuugggggugcuccugcuucugcuuucuuggcuacuuggaucuccugccuccauuccugaggggaauugggcagggggggcgugaaguucugugggcugauaaggaggggcugaguucuccagcaugggugugggcaugaccacccaccaguggucaugggggauggaugugaccugggaggagaccuccagaccugggcacccaccuugaugccuggcuggagcuggcccgggcaggaggagggagaggagagcagcaggugggugaggcuaugggggagccgagugggaagcagucuuugauguuaauacugggcaucuggcccaagucaaggcugcuguuuaugucuuucugucucugaccugcaggggggguuuccuguuauauucuuuuggggcgggguggggaggauccuuuguuuaaguaaccaaucucccccuuaugaggauccccaccccaucucccauucucuagccucuaaggucccacaguggcuaggugaugagucacugccccccagcuccagaaccugucuccugggggcccagugagagcucaccaaggggugccgccuccccuccucccgucucccccaugccugccaggcuggggcccugagucuguguguacuccucugccacaucacaccugccaaauaguaccuuccuucccgccuucacuccuccucuccuuccuggcacuaggauaacagagaguuggguggggcagcccugcucaauccauaccugagaauagaacaggggguaugggaaaggacagggagucccgguccuagagaggccucugccccucagcaugggggcacaugucgcugcugcagcacugccaccaccacagacucccaggggcccuugguguggguggcugccuguggugcccguguuggcauggggggcagugcugcccauagacgccugugcccaugcaugcccauuuaugugucugggccacgguggccgccccggccccucagcaucgcccuuccuggcucccauggugggaggcugggugaucaggaguggguggugggggagggaucuccccccacccuagcagcaggcagaggggaaggggagagggaggugugaaccuacccacagaacuauuaauagcccacaugccaggccaccaagaaccagcugucaccguggaaaccauuccuacgccccccuccccccagccugcauggggugggacuuagacaggguacgaagccccccacccaucuuucuuuguuaccuuucucucuuugucuccccuccuucaugugucucuccucccuuuaucuguccuccuuucuaccucaccccuucuccccaucccccaucucuggcuccccuuucuuccucucccucuacugccuugucaccccuagcucuaccccagcccugucccauuucuuuguucuucccccuccucccuucuucccucuuucccccaccagccuuuuuaccccuccucccaucuuuccacccuuuucucagccgccccgcauguacgugucccuguggcuggcaaggagggcugggcuuucuucagagcacuaaggacaaaguucaggggccccagaaagguggggccaaagcccagagcagauacgcaggaggguuaaugcggguaguauuggggguuagauccuggggacagaaacuccccucuggcagccccaggaguccuuuggggguguccucagauauacaggacugcagagugggacggcucggcagugggaaccuggcggggcgcccguggaugccgcauuggccccgugucccuguccccccauggcagaaguacuuaagcuuaaugaaaugcuucccccuccacgggcacuuugccuacacugccucccagcagcucuuaucucacaaggagggaguggguggccaggccagccgacaggugggucuugcuguccugcuguccagccugggcacagaaccccauagcuccgcccccucggccuccuuggggcagggccucccucgccucugcagaggagguaccaggaaggaguuuggggaguuaagcuggacucuggaggaggggugagaggcugcccuucaggguggguaccccugccccaugccccuuacccgcugaccuuuuucuguccguggcuaacacaggcucaugugguaugugucuccccacaugcugggcccucugccucgccucuguaucaccccaaaggcccaagugugucccuggagagaugccaaggaguccccagggguuccagccucuuucuggguacccagugagggugcccuaggcagcaagggcagcaccuugcuccucugcccacuaccaggggcugacuguagcugggcugcacugcccagcaccagggcaccauucaguucaaaagagggguggggcagagagcgagucugccccuccccccagugggcacgugcaggcccuuggcaguacccagacacauuuggaguuaaggcugggcaggagagagggauggggaaauaaacaugguggcuuagguuggcacugcuccaggucugcaauguagcaacugguaaguggcaggggccugggggaggggacccucaggagcccuggccuggggcaggagcugcccaugccauguggcugccacugguguuccccgccuggcccggcccacagcagccagugcucauuccugcacacacugguccuccucggcugcccccaggaccugcuccccggggcugccccucucucagcaugcccacuccugugcuugccuccuccccucccugggggcgcuugggccuccggcuggcgaguggauuuuuccagcuucuguaaacaagugguggcagugugccaggcgggcaggagacaggcgggggcagcaccacagccagggugugccaagcaccgaggcacagccuggggggcagacggagacacccagacccggagagagagacauucagacacagacagacagacagacaugcaggcagccucgcuggacguggagucagaagaucguccucuauuguccagcccaacccccguagcggcccucgcccccugccccucacugucuggcugagagcauuaggccccagugcccagccccugggcuuccccacccacuccuucuccuccccaaccuccaccccuuagggcuggcuacgccauuauaaauuuauaacaggaauuucuccacaagccaagaaaaacuugaccuacuuucuugauggcucccugggcuaaggcucccugcucaugcccccccaccccagucuccuguccagcccccagugcccaguccuggucugggguggguaucagagguagaacgggccacuuuucugugcaaugcccaugcucuccacacuaccagcuugccugggugcagaggccccguucugcugcuggcccugcccaauccccugacuuaucucccucucucuucccacccuggcugcuuaucagcuccuggggguggggccagggggccuaggggugaggucuccuaugcagcagccacgugacagagguugaggucguauguuggggagcuguacccuuugucccccuccuacccgccacaccugccugugugcacacagacaguaagccacaggucugcagcccagggucagaggugcaaugccguaggaauggugggcccggcuuggcacugcccuggacuccagguagcagaacaaggcuagcauuagggccaggcugugaggcuuaucccacagccaccugcuuacuaguugugugaacuugagugaaugaccaagcuuucugagacucaguuuccucaucugugaaguucucgugcccucuuuggaggguacagauucucucuccaguuaauauguguuaguuuccuuuccuuucccccuugccauccuggucgauagcagcucagcuaaaccaacugagaagucugguccucugccugggaagugggauucgagaccuugcgugggaagcucuggagucccugaggggccagaguuggggaucauaacuuggcuggcagcaugggaggucaguucccuacagcuuucaacaucucucucuauuaaggcacaaagaugggcauucaugcucacugcgugccgcucuaugucccauccuuccuucacagauacccucccugccuaugcugaaaacugcuugucucugguccccucuugccccuauaauacagaugaguuucaggaaagcuuuucuagaggggugguaacaauagcuaguguuuaauaguugcucauuaagggccaggcauuugucugaauaugaagacugagacauauuacuuaguacaugaaugaucucauucucucccuccauuccuucccaugucuggggcuuaggagguggaucuccaaucucgccugcuguaccuguuaucuaagggaucauccugguccccucucuaugccugcccuuccugcccccugcugucuuguuaugggaucccaaagccccaaauguugccaccaaagggauccuacccaccuuccuaccgugacaccuucuuaccccugccucucucuucucuccacagggaucucuggacaggacaagacuccgaagcuacucccccagcacacagcccgggacccacaaacccagcuugcccccagcccucccaccugccacucccuggccccucccaccgcccgccccccuuggggcgcagggcauggugugaaaggccaagugcugaggcggguaucaugggugcugugcccuagggccuggguggcaggggguggguggccugugggugugccgggggggccagugugcccaccccagucucuuggcgugcuggagggcauccuggauggaauugaagugaauggaacagaagccaagcaagguggagugugggucagacccagaggagaacagguaauggguucagcaacuaggucaugccaacuccuaagcagcaggcaugggcaccuggcugagcucuccuuuaggcaccgccuuuaagcaccucugugggauggacgugaggccagcaagccuucugccuaccuuugucuggcagaugaagucauguucagaugugacaggcacuuggauugagagaugcucauuuugaagcggggagcgauacagagcaauuacagggagcacauaaggggcucuucccuagacauugcugggcagucucagaugcccccaacgucccuuccaccauugcugcccuuaccuugagcaugugggauccaaacagccuugccauuuucuuccucucccuaccagcccauuuacuaucugaccacaaguguguuguccacaagcugcgguucacguaauacauuucagggcacaugcaccaguaacuauuggucauagcccaagcuuauauucggaaucuauugggagccccacaagcucuuccuuguucauggucaagggcgggcacugcgauggggcuccucccagaaagugcacgccaaccaugaugguuuugcuuccacaugggugaggugucagcccugcacauacaccaagggaugguuaccugugaucugcauugcccuugaggagcccagagggucucugucuuuucuaucagcuccaaguggcacagagcuuugucccaguuggcacggugcccugggagcuggguacagccugugccuauggccagggagagggugggggugggggugcuccggggagcaguguggcugacuguugccuaggagaucagaucccgagccaggaagccagaggccuggccaggcaaagcccuaaggcccacaacugggucccuggaggguagaggaaguagauggaacucacagcugggcagggcaugggguagcuccccucccccaaagccucaccccaggaaggacucugaggacgaucuggccugucgcuguguggcugucacuugcagccccugugucucccagcuuaggcuucugugggucuggaagagucugugcuuaauguuuggagaaaggcaggaaugccaguucccagucuccuaagacugcaaccccucccccaucaccuuccccucccccaugucuaugcgccaccuuguggcuaucucuaggacuacacucagaggcugugagucuggugguaacugcugaagccgcuagcucaacuggggccuaggugggcugaguuccccugcacccaacccucugggaggcgugagggagaccugaccuuucagccucauaggaaguagaccggaguaauccccacggggcguggagcauaggguugucugugacugugacccuggccaaggucacugugucaguguguugggagcugcauccggcuccaggaggaaggggccugcaacaugccacacgcagggugggugcgggagguuauacaauccuugcaugcauguagagggcuuauguaaccugugugcaccgagguuaugcaacauguauguggagagccuggcaacauauaugugcaguggcugaggguugcuaauaauacgcugcacagaggggcucagucccggcucugacucuagcucauggugucaccaggcacaagcagggucucaguuugcugcucuguuaaauggaggcugugcagaggguguaguguuuucuauugcuguggguuauuuagcauguguguaugaccuggagcucaagcaacacgugcacacuggagggaugagggugguuuuaugaggugccugugcagaguguuguguaacacaugggcauauccuagagguuguauagcacauuuaagaaugcccugaaaauuucacagguauguuggcccuggugcauacucaccauccauggguuuauagugaagguugcaugguuauucaucugugccgguguuauguugcauauguauguguguguucuaaaggcuacauagcuuuaagcauauccugagaauucuuccagcguauucgucauguacugaaagaugaggauguccugcagauuaugggugcuucaggucuucuggcgggugaauguguguguguuggggcucuagaauaugcuugugccacagccaagccccuuaucucucuccccugcaacuuccagauaacuggacccuuuuaagcauugucagcugacccuggggggugggagguagaaugaggacacaaaauggaaagaaucaggccuugggggauugcauaagccucucggaugagaaaggggcuacucgaagacugcucugugauucugcccacuuugccuccauccagugccaggucaccagauggaaagcgaaaaagaaagaacggccaauguucccugaaaaccagcaugucaggugaggcuggcugugcgugccccuucuccacguccccaaccccaccaaacccagccagggcuccucuggaccuggauguggaacaguaauucauguguucccuggggggagccuccuagagggcuugggauggacuugucugggggugagaaagguaaugugggaugugcccagcuuuugaggguggauuaggucaggacggccucuucccucuuccccuaauacccucaucugaggcccuaccagaaucagggccugagcugaaggacugaggggcuguauuauccccagugagcagcugacguuuauuuuucccucuccaccauccucugccuuguagauagaucaagaagaaagcccugaaugggcagucagaagaacugagauucuucauacucuuagggcagagauggacagguucaccucgugucucucuaggauucuaccagggaggcugggcuaggagaggggucagaaacaaaaaguugagggauggggaaaagugugagagccucucugcugggacuccaagccaugccugccuuccuccauccuuuccuuccucccaggguauaucccuaguuaccuggacaaagacgagcagugugucguguguggggacaaggcaacugguuaucacuaccgcuguaucacuugugagggcugcaagguauggaagcuaccuccugccccuccccugccaccugagcccccauauuacucccuaugucaccuaaagcccgccuguuaggucaucacuuuuuuuuuuuuucuuugagacggagucucacucuugucccccaggcuggagugcaguggcgcgaucauggcucacugcaaccuccgccuucagguucaagugauuccccuaccucggccuccugaguagcugggauuacagguaugcaccuccacacccagcuaguuuuuuuguauuuuuaguagagacgggguuucacuauguggccaggcuggucucgaacuccugaccucaggugaccacccgucucagccuccugaagugcugggauuacaggcauaccugccugguuacuuucucuucucuucucuuauucauucauuuacucauucauaacuccuccucugccacucacaggaaaauugccuaacuucuucgagccuuaguuucaguuucuucaucuauaaaaugaggauaaucauucucucuaccuuauagcauuguugggagaauuaaauauguugggagauaguucacuugaaguguuuaaaacagugccauugggugcuguggcucaugccuaaaaucccagcccuuugggagggaggccaaggcgggagcaucccuugaucccaggaguuugagaccagccuagcuaacacagugagacacugucucuacaaaauuaaagaaauuagcuggguguggugccacaugccuguggucccagcuacucaggaggcugaggugggagacugcuugaacccagaaggucagggcugcauugaacggugguggcgccacugcacuccggccugggugacagagcaagauucugucucaaaguaaaauaauaaaauaaaauaaaaaauagugccaugugcauaagaagcauuugauaaaugccagccaucacccauucauucaguguauucuuaggugugagaguguaguacguaccucgccuucaagcugcucacagccugucagagagagagacacaacuugaaacaaacaucaguguuauucaaaaugugguucauggaccaccuguccuacuaguuaaaaugcagauucccagccuucaucuuuuuuuuuuuuuuuuuuuuuugagauggcaucucgcucuguugcccagguuggagugcaauggugugaucucggcucacugcaaccuucgccucccggguucaagcgauucuccugcuucagccuccugaguggcugggacuacaggcaccugccaccacgcccagcuaacuuuuauauuuuuaauagagacaggguuucaccauguugaccaggauggucuugaucucuugaccucgugauccgcccgccuuggccucccaaagugcugggguuacaggugugagccacugcgcccagccugcccaggcuucaucuuaacccugcucacucagagcccuuuuguggagcccaggaaucuuccuuuuaacagaaucccggaguguuucccaugcaccugaaagagcgagagccaguacuggggggguagugggagcugggagcacagaggagaagaggacagcagguucuuccaggcagaggggaugacaaggucauagauuuugggaggccuaauuguuuuguuuuguuuuuuuugagauggagucucgcucuguugcccagccuggagugcaguggugcaaucuuggcucacugcaaccuccaccucucggguucaagcaauucucccugcuucagcauugguagcugggauuacagacaccugccaccaagccuggcuaauuuuuguauuuuuaguagagauaggguuucaccauguuagccaggcuggucucgaacuccugaccucaggugaucugccugccucugcaucccaaagugcuuaagaggccuaauuagauuucacuuugaucauuucagccuggauagccuuuccaggaucaccuccuaaaaaugcaaggccuuccaagaaacagaauuauuuaaaucccagcacuuugggaguccaaggcaggcagaucaccugagguuaccacacccgguggcacuguuuuaaacacuucaagugaauugucucauuuaauucucccaacagugcuauaagguagauaaaaugauuauccccauuuuauagaugaagaaacugagacucagagaaguuaggcaauuuucuugugagugacagaggagggauuaugaaugagcaaaugaacgaaugaguaaggucaggaauuugagaccauccuggccaacaugguaaaagccugucucuacuaaaaauaccaaaauuggccagguguagugauguacgccuguaaucccaccuacuugggaggcugaggcaggagaaucucuugaacuugggagauggagguuacagugagaguggagauuaagucaguguacuccagccugggugacagagcgacagagugauacucugucucaaaauaaaaaaaaaaagaaacagaaugauuuauauguuaaaggccagguauaguagcucacgccuguaauccaaacacuuuaggaggccaaggugggaggauugcuugagcccaggaguuuaagaacagccugggcaacauagugagacccuguccauacaaaaaaauuuuuaaaguagccaggcaugguggugcacacacaccuguggucccagcuacucaggcagcugagguaggacgaucacuugaggcugggaggucgaagcugcugugagcugugauuaagccauugcacuccagccugggcgacagaacaagacccugucuuaaaaacaaaaaacaaacaaaaaaaaaaaacggaaaaaaaguuuaaggcuugaaguuucucucucuuucuugaugucaaccaaaccaagaccaugagggauuuagaguucccuagcagaagcaauacaauccuucuggaagcaauacaaacaguguagcauagagaaaggaucuuuuacucucacggacaucugagucccagggaagcacccugaaaagacagagaugccuuggccccacccuuggauaguuuuauuuuguaguucuggagugaggcccaggaaucuguaucuuugguaggugccuuuggugacuuuuuuuuuuuuuuuuuuuuuucaagacggagucucacucugucacccaggcuggagugcaguggcgcgaucuuggcucacugcaaccucugccucccagguucaagcacuuguccugccucagccuccugaguagcugggauuacaggugccugccaccucaccuggcuaauuuuuuguauuuuuaguagagacaagguuucacgauguuggccacguuggucuugaacuccugaccucgugauccacccaccucagccucccaaagagcugggauuacaggcgugagccaccgcacucggcugccuuuggugauuuuaaugccccuggaaucugagagcucagacguuggugucccauaccugaggcccaguucugacucugcugcccaccggccacaugacuuugggcaaauugcuucaucucaccaagcuucaguuuccuugucugcaaaguggaggcaguaacaguuccuaccucauaggguugucuggaggguucacugugauguuccaugaaagacaaggcuuaucuuuuggguuuuuguuuuuguuuguaauggggucucugucacccagguuggagugcaguggugcgaucauagcucacugcagccuugaccuccuggucucaagcaauccuaagcaauccucccaccucagccuccagaguagcugggauuauaggugcacgccacaaccccuggccaauuuguguauuuuuaguagagaugggguuuugcuauguuggacaggcuggucuugaucuugaacuccuggccucaagugaucugccugccucagccucccagagugcugggauuacaggugugagucauugcaccuggccagcaaggcuuauguuuacuaagugacugacacauuguaaacaugaaaaaauacuaauucuucauauuauugcaaucaucuugaguuuugagguguuuccuuuaaaauaaaggcgaggcugggugcgguggcucacgccuguaaucccagcacuuugggaggccgaggugggcagaucaccugaggucaggaguucgagaccagccuggccaacauggugaaaccccaucucuauaaaaauacaaaaauuagccgggcguaauggugggcaccuguagucccagcuacucgggaggcugaggcaggagaauugcuuguaccugggagguggagguugcaguaagcugagaucacaccacugcacuccagccugggugacagagugaaacuucaucucaaaaagaaaaaaaaaauuaaauuaaaaaaauaaaauaaaggugaaucccaauguagagaauugaaauuuuucucuuccccuacuagaguucauacucagucccuuuccuugacuuuuuugguuccccuguuuuaugaauuccaccugcauggacaacaggcaacauauaugagaaugguuuuugggucaguguuguuuuuaaagucauuuagcaaaauggaaaaugagguuuuacuuggauuuccuuuuuuuuuuuuuuuuuuuuuuuugagacagaguuuugcucuuguugcccagacuagagugcaauggcacaaucuuggcucaccgcaaccucugcuuccuggguucaagcaauucuucugccucagccucccaaguagcugggauuacaggcaugugccaccauucccggcuaauuuuuucuuuuuuuuuucuuuuuugagaugaagucucacucuugucacccaggcuggagugcaaugcgagcuccaccuccuggguucaagcgauucuccugccucagccucccgaguagcugggauuacaggggcaggcccagcuaauuuuuauauuuuuaguagagaugggguuucaccauguuggccaggcuggucuugaacuccugacuucaggcagucugcccgccugggccucccaaagugcugggauuacaggcaugagccaccgcgcccggccaagggguggaccccgccgugguuccaccgcggcucaaaccuaggaccuucugcauguaaagcagaugugauaacugcuacacuauagaaucgcaugcuuuuuuuuuuuuuuuuuuuuuuuuuugagauggagucucauucugucacccaggcuggaaugcaguggcgcgaucuuggcucacugcaaccucuguguccuggguucaagcaauucucugccucagccuccugaguagcugggauuacaggcgcccaccaccacgcccggguaauuuuuuuuuuuuuuauacggagucuugcucugucacccagccuggagugcaguggcgcgaucuuggcucguggcaagcuccaccuccuggguucacgccauucuccugccucagccucccgaguagcugggacuacagcgcccaccaccaugcccggcuauuuuuuuuguauuuuuaguagagacaggguuucaccguguuagccaggauggucucgaucuccugaccuugugauccgccugccucagccucccaaagugcugggauuacaggcauaagccaccgcgcccggccuacgcccaauuuuuauacuuuuaguagagacaggguuucaccauguuggccagggugaucuugaacuccugaccucaugauucauccgccuuggccucccaaaguucugggauuauaggcaugagccacugcacccaaccucaugcccggcuaauuuucuauuuuuaguagagacaggguuucuucauguuggucaggcuggucucgaacucccgaccucaguugaucugcccaccucggccucccaaaguguugggauuacaugcgugcgccaccgcgcccggcgacuuggauuuccaaagcugcuauuccuuaaggccucacauuaucccagguucaaagcugccugcucuagacaucauuccugccucugccacaaacacuacccagacacccccaaccccucagcagccugggggcugagggcauauauuucucagguccuugagccuaguaaucuugggcucauggugucaggaggaugccagguccccucacugaucuugccuuccuugcucuccaccccugaccccuaguaaacugcaugguugguucaggaaggggaagccaugucaugaucacagccugcuccaucucccccaccccagggcuucuuucgccgcacaauccagaagaaccuccaucccaccuauuccugcaaauaugacagcugcugugucauugacaagaucacccgcaaucagugccagcugugccgcuucaagaagugcaucgccgugggcauggccauggacuguaaggggcccagguggagggaauagagccagguggccugggguggggaugaguucugggagggcagcuuccuuccaggguacccucagagcccacagggcagaguggcaauccagucuaggucagaauguucagugucuugguccuugcuguccuccuuccugcgcaaaaggaaacaggaucccugugugggccccaaugccuaccugccuuacaacacucgagggccuuagagagggagucguuugguagaaagagcuccugggcacccacucuagcacacuguucuugacucccagcgaaggcaccccacuucuagaugagacagggcaucuuccauuggcuggggauuggguggcaggauauucgaguaaccaccgucaccauaauccguuagaccagaacaugauauucaucuggaucagcccaaacuguuguugacauggucccggggauuaaucaugauccggguugugcugcccaacugcuaggugauuugggaagucauuuagccuccauggcccucgguuucuccaaccuguacucuaggaagaguaguuuccgggagcauuauggaaaggggauggagggugccaugcguuagaccuugugccucucuguucacagugguucuagaugacucgaagcggguggccaagcguaagcugauugagcagaaccgggagcggcggcggaaggaggagaugauccgaucacugcagcagcgaccagagcccacuccugaagagugggaucugauccacauugccacagaggcccaucgcagcaccaaugcccagggcagccauuggaaacagaggcggaaauuccugguaaggagaaagggggcauggggagagcaguagccagguggcagggagaagagagugagcucggagucuugccuccuccaggaagucuucuuaguguaauccaacccaaaauacauacucuucacacuuuugcuguccagauuuuauacacuuguguuuguguccuugcugucuggacugucuacuccauccaacugggagcucaaugaggacagggccuugccuuccucaucgaauuuccagggagcgggagcgaccuuucuucuuuuuccugcccuuagugacugggaggagaggguaaggauacaguuaugucacaguauuuuugagcaccugcugggugccaggcauuauguuaggcccuggucaagcuaguugcuaaguaaaugaugaguuugggaccaggugcaguggcucaugccuguaaucccagcaauuugugagaccaaggugggaggaucgcuugagcccaggaguuugagaccagucuggguaacauacagagaucccaccucuaugaauaauuuuuuuuuuuuuugauacggagucucacucucacccaggcuagagugcaguggcacgaucucggcucaccgcaaccuccgccuccuggguucaagcgauucucccgccuccgucucccgaguaguugggauuacaggcacuggccaccaugccuggcuaauuuuuguguuuuuaguagagacaggguuucaccauguugaccaggcuggucucgaacuccugaccucaagugauccacccgccucggccucccaaagugcugugauuacaagaugugagccaccaugcccacccucuaugaauaauuuuuuuuuuuuuuugaguuggaguuucgcucuuguuguccaggcuggagugcaguggcacagucuuggcucaccgcaaccucuaccucccggcuucaagcgauucuccugccucagcuucccaaauagcugggauuacaggcgugcgccaccacgcccggcuaauuuuguauuuuuaguagagacgguguuucuccauguuggucaggcuugucugaacucgcaaccucaggugaucugccugccuuggccucccaaagugcugggauuacaggugugagcuacugcucccggccucucuacgaauaauuuuaaaauuagcugggcaugggggugugugccuguggucccagcuacucgggaggcugaggcaggaggauccccuaagccugggaggucgaggcugcaguaagccaugauuacaccgcugcacuccagcccaggcaacagagcaagacccucucucaaaaaauaugaucaguuugggaggagauggacaguuggcuauacguggugaaggaaggcagaaaaccagcaccugguucaugguggagcaugccgggggguggcacagugcacacuguuaagggcacgggcucugauuccaagcagauguguaacagucacgagucagacugcccaaguucaaacccugguccuaccacuugcuggucauaugacuuuaaccuuauuauuuagcugccccaugccucaguuuccacaucugugaaauggugauuauuauaauuauuccuuuuaggauuauggucaggaugaaauaagacauguaaaacauguagccugaugccugaucauauauuaaguauucagucauuauagcugcuacuacuguuacuaccguuguuauuauuagcugacuuggagcucugguucuggucuauucucugcucaagaugaaggaaaagcuuugggccugggacucaggcacgggcggccccucuuccccaagcugccuuggagcucccccuggugggcagggagccucagugagaggcugaaaggggucugcggccccagcugacccccgucuuucucucuagcccgaugacauuggccagucacccauugucuccaugccggacggagacaagguggaccuggaagccuucagcgaguuuaccaagaucaucaccccggccaucacccgugugguggacuuugccaaaaaacugcccauguucuccgaggugaguggcagaaguggggagagaugugaugcugugcuggagggaaaccugcucccccggucacccaguacaggcucaucugagguucucuggacaaggagcaauuccuguaggucaacauacacagauaacauacacagacacacacacacacaugcauacacauacacccagcacacaggcacacaugcagacacauacacggacacacacacacaccuagcauacagauacguacacagacacacauacacacacacauacacccagcacacagacacacacacaccuaguacacaaacacacacacagauacauagaaacacacacagacauauacacccagcacacagacacacacacacacacagacacacacccagcacacaggcacacacacacacacaccuagcacacagccacacagauacauagacacacacacacagauacagacacacacacacacacagacauauacaccuagcacacagacacacagauacauagacacacaccuagcacacagacacacacacacagacacacccagcacacaggcacacacacacacacacaccuagcagacacacacauagauacauacagacacacacacaaacacacaggcacacacacacagcauacagacacacgccaaggucuggcugcucuaagaaaucagccggcuccaagugcuccccuccacagccccucauccuucaagucuaugcggccacccaacuccaggcagccugaaaguucucauuuuccagagcacuagugcuggagacaggcugcccuacuagccaugugaccugggguaaguuaccuccauccccugugccucaguguucccaucuggagugggcuggggauaaugaugggugcuaacucacaggcauaauuuuuuuuucuuuuuugagacagauuuucguucugucacccaggcuggagugcagugacgcgaucugggcucacugcaaccuccgccuccugaguucaagcaauucuccugccuuagccuccugaguagcugggacuacaggcaugugccaccacgcccaacuaauuuuguauuuuuaguagagauggguuucaccauguauguuggccaggcuggucucgaacuccugaccucaagugauccacccgccuuggccucccauagugcuggcauuauagucgugagccacugcgccgggccucacaggcauaacugugaggcuuaaauggaauagggcaugcacauggcccaauacaaggucagccguucagaguccaugggggccuugcgggccucacggcucccguaggacacucuaggggagacucaaggacgcggggagggguaugcugagugcuccuguggcccugccgcuccacagcugccuugcgaagaccagaucauccuccugaaggggugcugcauggagaucaugucccugcgggcggcuguccgcuacgacccugagagcgacacccugacgcugaguggggagauggcugucaagcgggagcagcucaagaauggcggccugggcguagucuccgacgccaucuuugaacugggcaagucacucucugccuuuaaccuggaugacacggaaguggcucugcugcaggcugugcugcuaaugucaacagguaccugcugauuagucgggagggcucagaagcuuccaggggucccagagauuggcuggacccugggccuguugcucaacucccuccugaaucuucuucugggcuaccucucugucaccugggccauccccuauccccuguuccuugcucugucacacacuucucacucguuccccaggcccaucccuugccuccccaucccugcucugugccuuuuccugucuuugucuccuuccuucucgcugcccugucccucugucacucacauuccccuuuguuccccacuccccacuuuguucucagccaccuuccauccccucaucccuccucugucucccagucccaucucuuaccccucaguccccucccuaaccccaucugcaccccgccucucugaccaccaaccucaguccuccccacuccaaggcuccucucucucccccagcccccggccugucccucuguccuccuugcauugcccccuccccccaguaccccccugccccucuccacuucccagcugccucccucucccugugcuucuccuguccacgucucucagggggagcuucuccccuccccucccccagccucucugccucuaucuccccucuaguccuuucuucccacguccccacaccucacccuccccaucuccaggccuucggccagccccucgccccucacgccccucuucccucacagaccgcucgggccugcuguguguggacaagaucgagaagagucaggaggcguaccugcuggcguucgagcacuacgucaaccaccgcaaacacaacauuccgcacuucuggcccaagcugcugaugaaggugacugaccuccgcaugaucggggccugccacgccagccgcuuccuccacaugaaagucgagugccccaccgaacucuuccccccacucuuccucgaggucuuugaggaucaggaagucuaaagccucaggcggccagagggugugcggagcugguggggaggagccuggagagaaggggcagagcugggggcugagggagacccccccacaccccuucucuccuuccucucguccuuggauagauucagcucccacacacacacccgcacugcccaggucccuccucagaccuccagcccugggacagggcaaacaacugaacuugcuauggaaaggacagugugggaggcugggggagcuguguccugcaguucccaggaccccauccucucagaagguaggggaagggcgggaggauugagaagggacaagccaccuugaccguaggggaaggaggaaugugggcugggggaagaugcccucaacucacccccuacacacacaugagagagagcccccacccaguuccuuggccuaggucuccccuccaggcugagggccucucuacuuccccagaugccugggugcaaagaacggcuuggcuuggcuccuccucuggagguuaaaauuuauagucauucuaacugcacuuuggaaaccaagcaaggggagaagacaaaugaagaaaaacuagacagagagaaaaauacaaaaaagagagagcgagcgauagagagagaugauauuaaguuauuaacugaggcugaccagaggggaggacccccccuuuaccaccccaugcacuuugcgagcugccccuucuucccccacaucagagagaaaugcccccacaccagagccccaaggguagggcugccgaucagagcugugaguuaacacaacaggguccuggccaccccccuugccauaccccgcccucugugccccuuuggcaccccccaacccuaguauguccucugcuuucugccacucgugcccgcugaguuccaucuaccucucaugcuggaugccagcuggccccucaccagccugcccugcugcccacacagcuccccuuuaagugcccagcccuaggggccucuccccauccaccuccuccuuccacaccuuggcacccacccaggaaaaaacuguggcuccaacuccuacccuccuuauauccugcaguauuagcuagaaaccggaugcugcugcauugguugggucggggguaggagggcugugcgugagcgucucccagaacccuccaccccuuuagcacucuguuucccuguuucccaucugucuucugggcucucucuaaccucugcccuccuccccagcuccuacucacugcacuaacucugggcgggcagguaccagaauggggguguuuagauaagugacacuuaguuggggccccaggggagggguggucggugcuccuuuuucuuuaaagcucuuuuggccagcugccccucugccccgggaccccuuccccucuucuuuucucuaauucagggacuuuggcuugagccccucucgcccuccuggugagggugcucuguuggucugcacuugggugagcuguccuccucccccucccuguggcugccgcccacuccucaggggagagagggagagaggaggugguccucccaugggagcaggagguggggugggacagagcagaccagagggugcugggcucagggcugcaugucggcagggauggauggguggacacagaugcccccggaagccauggggauuggggcaggggguggggggaggggugccagggcuuccugcgcuuugcacuauuggggcaaaaaugucuuaagcaguggggaaccugccaccccacccugacccucagccugccacagcccccuacacacacacacacacacacacacacacacacacacacacggacaugcacacacggacaugggaaggcaaugcuaugcugcccgucagggcacuguccuuccccaaucguucagguguuccaacagggguggagggccuggaggagcacccgcugucaccugugcaugugccugucccacccugcuggggccucgggcugcccgcgcugucuuugucucuauccucucucucucuccuggaguacugaauccuguauuacuccagucccauggguaggcccucuuguaccuuccuaccacgccugggggcccaguggaauuccugaccugucugcugucuuccccaucccuccauccccaccccaaccccuccauccccauucucagccauggacacggcagagaaaaggccuugaagagccuuagccucuuauaggcacuugggacucccccacccuccccaaucauaugagcugugaucccauccuccccggaccccucccuucccccucggugaugugggguguaugugugcguuccucugcgugaaugugugagugaguacacaugguaggggaggagccagggcgacucaggagugccacgcaccugcucuagagcggcagcugucccagucccugcuguggaagugggggacagggcccucuccugggggccauuggugcuaaugagggggauggccuugaugugggugcucagcaugccucccccaguauuggcccggggcacuagggcaggcaggguggagcagcaggugcaguaucggugggaggacggguugcugggaauaggacgagggggccaggccaggacaagggguugccagagccaugaccacuaccccgcccccaccacccgccucuccaucucaguauugccccucccaucacucauaacacacauaccucauccagccuccucccugcucagacuuggggagggugggggaggagccccuaccccuucuccugguggcgggucugcagggcugggagagggcagggcguugugagagagagaccguccauaaggaggacaguaacuccugcccugggaacuccugggcgggggggagggggacacugcccagaggcgcuacugaauguaugagaagcuggugcugggcuggggggagggggguuguggccagaaacagggaaggagguaggucucuuccccagggaggggugggaccggcaggggugacuugaggggcuccuacuccugccccacguugacaaucaguaugucuguuaugugcgauuuuucaccccguuguguuuugggucaggauuuuaaagaaagauauuuuuaugguaauuguugcucgucuauuuuacuauauauuuauguaauaaauauaugaugaaaauaacccccuugggcaccccccuuagacuugugugcuguuucccuauauccucccaucugcuggcagaguacccaccccacaaacugaccagauggagagguggccccccccagccuuggcaguauuuccaccccaccccccaaacgagcacacaccacagaagccagcucagcugugaacuauuggauuugagacaggaacagaacaaaucagagggccaggggaggguugugggggagacagagugguuuaaauaggggaggaggggaaguucggugaugggggagggaggcagguauuuacaagaaggcucagggggccagaggcucaucuuggaauauuuuauaacaauauaaauaagauucugguuugcuuuuccuuuucgucucguaaaggagagagaagugcagaguucgauucuguacaagggggcagcggcagaaggccggccgggcgggucacugggcguccacccggaaggacagcagcuucucggaaugcauguuguucaggguccgcagguccggcagcuugagcagcagcuuggugaagcgggaagucuccaagggccgguucuucagcaccagagcccgaagagcccgcagcagcgucuccuggagcugcuccaccgaagcggaauucuccaugcccgagcggucuguggggaagacgacagcagugaggcggacuccccgagcuccucugaggaggaaccggaggucugcgaggaccuggcaggcaaugcagccucucccugaagccccccagaaggccgauggggaaggagaaggagugccauaccuucucccaggccucugccccaagagcaggaggugccugaaagcugggagcgugggcucagcagggcuggucaccucccaucccguaagaccaccuucccuuccucagcaggccaaacauggccagacucccuugcuuuuugcuguguaguucccucugccugggaugcccuucccccuuucucugccuggcaacaucuuacuuguccuuugaggccccaacucaagugucaccuccuuccccagcucccccaggcagaaauaguugucugugcuuccuugguucaugcuucuacugugacacuuaucucacuguuuuauaauuagucgggcaugagucuguuucccaagcuagacugugucugaaucaugucuguauccccagugcccggugcagggccuggcauagaguagguacuccauaaaagguguguugaauugaacugcgucugccuccucccccgggucaggcgagagccugaccuaccugcagagacaagcaccaccgcggugaagaggcccagcuccuccucgguaagcgccagggaguugagcuucucgcugaagucgaacauggcacugagcaggucucccaugcccauggcaccaagcuccugcaggcuguagguggugcggcuuaggaacaucacugucugguccuucacguugaacaacgaagcaaagcgcaccaucagcaccuaggagggaaggggaacagucauccuggguguggugggaggagcacugaccaaaucgccccuguaguuugccagaggguuuagcggugcugccuucgauuucucaguagaguggggguuguuucugaauggccaaugagggagcccagguggaaggauggcuuugggauccaauaagccugaaucugagugucagcuuugucacuaccugugaccuugggcaaggcauucaccaaaguuaaucugcucuugucuagaaugggggcagcagugcacccaaggcauuauuucaguguaauggguugugauuaaauuccagcugagaugacagaagucccagccaucaagaggaagcagcaggagccgcucagccccuuucaccaaucaggcuauaaggacaaagauacuggguuccaaaaccuuucagagguccugcccaccccagacagcagggcuuucuguuggauccuucccaaggucaaaagcaggaagcgucugggugcaauggcucacgccuguaaucccaauacuuugggaguccaaggcgggcagaucaccuggggucaggaguuugagaccagccuggccaacauggcgaaacccugucucuaauaaaaauauaaaaauuagccaagcgugguggcgggaaccuguaaucccagcuacuuggaaggcugagguaggagaauugcuugaacccaggagguggagguugcagugaguggagaucgcaccauugcacuccagccugggcgacaagcgaaacucugucucaaaaaaaacaaaaaccagaagcauaaacggucacucaccucaaaggugccagccuuaagcagggugacuuggucaugcugagaaaggucacggaagcccgggauguguuuggcaaacucuaccaccucccgcacagcgggcgugaagcucauggagaaauccucccagaucuccugcaccguucgcccacugcguccaugcggguacauguucauaggacaugccugggggaggaaaagauugaaggaggggagugucagccaggcugggucagauggacgccccgagcagagcuggaccccagauucugccugggcuaggggcuguggcccugaaggaugggucuuucagauaaaguagcaauuaggugccagguggagauuagggauucccaggcagaguccagacugcaaggcaagacauuuucuccugggaagaugcuauccccacacucagccuccaggaacccccagcugcccuacacuaaguccauucugccaggcccccccaaucuucuuaacgcacucgcccgcccccaugcccuuaccagcagaacauucuuugaguugcccugccggggacuguuggcaggugccuugccuucuggggcugcauacacguggguggggcauagacggugcccguugcuguuggacugguggcagcuguggugugcagggccaggaggccaggugggaggguaggaggagggagccuggcgcagaccauuuagggccucguuaugacgcugggcagccaagguguuguugucauugggggcaggugggcagcccugauuuucccagcgauguggggugguggcuggagggcuaccugaugcaugguuggcauugaaguugccaggugagcugcccagcuugucaugggcguaggugaagaucucucgaugggcccgggccaccugggauaucacauccuccacugugggcucagggcuuggggaucugggaggcgucagcuguuguggaaacugggagaagcccaccaggggugaggggaccggagcaggggguggcgaggggcccauggggccugggguggggugcugggugggugaagucuccagcgggcacuggcugcucaacugguuguuggccagguucauggcacucugcaucucagcaagcauccgcugcuucucucguuuggggaugcgcccaaaacgcacagcugcaacaggaugagaacagcaucaggaaguucucaaccaugcucacgugcuucucuuccuuccuuccuccugaaagggcaaggcccugaaggcuugggguuucacaucaaaacuaaaaccagcaaguccccacccaucaaggggguuucccuaggagggauugcugguaggaggugacccgagggaccaaugggauagaaguauauguugacccaagcaaaugaaggauggacauccccuggcacaugugauucacaguaugaugugucuccauuugugacuuuuuuaaagggaaggauuaauucagaaacuuugggcggaagaaggggggaggauguggggaugcugccucaccgucucgagacaugcccacagagagacacuucuugaagcgacauugcuggcagcgguugcgauugaugcggacgauggagcaauucucauucuucagacaccuuuuguacuggauguucugcuggaugcuccgacggaaaaagcccuggagggcaggggugguuagugaccaccuccaucauggcugggccucuguguccagggggagggggccaccugccccugcccuuacccccaguccgccucaccuugcagcccucgcaggcgugcacaccguaguggaagcccgaggcaacguccccacacacuuuacacaguaacaccaugccauucagcucuguggaagagacgggcagcaggugagcaggagaggccaggcugaguggccacagguguggaggcuuucugggccggagauccagggagggaaaagcuaaggaggaacuccaguguugaggggcacuggagugacaaaacugggcugaagaggggcuggugccacucuaggagaaaucccugaagccagaauagguccuggcaagacuggugucacguaaaaacccauucccaaucuggcccuggccugcuucccuucccccgaaucagcuggaaagguacucacuggugauguugcuggugcucuugcugggggacacucggcugcuguccuccauggccacuuguagacucccaggggggcucccauuauagaaggaggaggaggaugacgacgaggaagaugaggaagaaggggagccgucaucacucaggcuggguggaaugcucccaaaggagcgagccgggucuugggugagggagccagugggggauggugggaaguaggugggacagccuugggucagggacuggaagcugccauuggaguugucacuauagagggauucagggcuggugcggcuuggggaggagccacuggagccaauguaggugaugacgccaccuggagagagaacaaaaggaaagggggugucagccgccaugucuccggaccuagggugccacugugcucauccccaccugucugcccaaaacauugcuggccacucaguucaccauguggagccccuaaucuuggaguuaauaagcaauuccccaacacacaguagacauggcauggccaagcaacaccuacgacccuuugcaggccaccuucagcuucugcuuucaguaugaggcaugaccccuguggcaucucgcauaugugccccccuuccuuaguugccuuccuugggaauaucgacugcagcuaaugacuuaguugucaguugaagaucuggggaugggaugggcagcugagcaccauucaaagugcccaguccuccaaaaacaaaaacccagcugcugauuuuaacacuaagaccauuccaggaaugagaccauggaccauggagagauagguagccaacaguaaagagaauggaggguuuacaaaaguaagacagucacauuccccccaguuggggacauauauucucugaaggaaaugaagggaaggaaucugcccagccugguuccccuggccucuuaagagagugagccacaguggagucuaucccuguguccaaaaaggacuucgaggugcgaguugcaggagguggaaguacaaacuguccagccuggggcucuaaaauucccccuucagaucucagccugguaacaaugaccuuggcucucuggccauucagggacuuugacccucugguuacauugccaaugagguggcugugcucccgugguauuagcaggagaaaaaggugaccugccugccacaccuccggcaagcaccuagauuggucugccaugggcggggugggagaagggaggaucccaggacacaugugaccuaacacaugccaugccacugugucugcagaggcacaugucuugcucacccacugacacacacugaacugggcagggcggcccuaaaauagcucaagguuggucagggugaacccagcuccuuggaaaauaguugcacaacagaucagcucccccgguuucagggcugaggugggggauggaaucauuaguuggcaguaaaugaaguugaccuaguucacccaucccccaaaaaggagugagaccuucaugcagaggcuuccaacguggaagugaggagcauacucaagagucuaggucuaggucuagacccaucacuaccaacuuauuuugugaccuagaggacauca

SEQ ID NO: 16826 - RNA, 7939 nt, Homo sapiens
cucagcugugaacuauuggauuugagacaggaacagaacaaaucagagggccaggggaggguugugggggagacagagugguuuaaauaggggaggaggggaaguucggugaugggggagggaggcagguauuuacaagaaggcucagggggccagaggcucaucuuggaauauuuuauaacaauauaaauaagauucugguuugcuuuuccuuuucgucucguaaaggagagagaagugcagaguucgauucuguacaagggggcagcggcagaaggccggccgggcgggucacugggcguccacccggaaggacagcagcuucucggaaugcauguuguucaggguccgcagguccggcagcuugagcagcagcuuggugaagcgggaagucuccaagggccgguucuucagcaccagagcccgaagagcccgcagcagcgucuccuggagcugcuccaccgaagcggaauucuccaugcccgagcggucuguggggaagacgacagcagugaggcggacuccccgagcuccucugaggaggaaccggaggucugcgaggaccuggcaggcaaugcagccucucccugaagccccccagaaggccgauggggaaggagaaggagugccauaccuucucccaggccucugccccaagagcaggaggugccugaaagcugggagcgugggcucagcagggcuggucaccucccaucccguaagaccaccuucccuuccucagcaggccaaacauggccagacucccuugcuuuuugcuguguaguucccucugccugggaugcccuucccccuuucucugccuggcaacaucuuacuuguccuuugaggccccaacucaagugucaccuccuuccccagcucccccaggcagaaauaguugucugugcuuccuugguucaugcuucuacugugacacuuaucucacuguuuuauaauuagucgggcaugagucuguuucccaagcuagacugugucugaaucaugucuguauccccagugcccggugcagggccuggcauagaguagguacuccauaaaagguguguugaauugaacugcgucugccuccucccccgggucaggcgagagccugaccuaccugcagagacaagcaccaccgcggugaagaggcccagcuccuccucgguaagcgccagggaguugagcuucucgcugaagucgaacauggcacugagcaggucucccaugcccauggcaccaagcuccugcaggcuguagguggugcggcuuaggaacaucacugucugguccuucacguugaacaacgaagcaaagcgcaccaucagcaccuaggagggaaggggaacagucauccuggguguggugggaggagcacugaccaaaucgccccuguaguuugccagaggguuuagcggugcugccuucgauuucucaguagaguggggguuguuucugaauggccaaugagggagcccagguggaaggauggcuuugggauccaauaagccugaaucugagugucagcuuugucacuaccugugaccuugggcaaggcauucaccaaaguuaaucugcucuugucuagaaugggggcagcagugcacccaaggcauuauuucaguguaauggguugugauuaaauuccagcugagaugacagaagucccagccaucaagaggaagcagcaggagccgcucagccccuuucaccaaucaggcuauaaggacaaagauacuggguuccaaaaccuuucagagguccugcccaccccagacagcagggcuuucuguuggauccuucccaaggucaaaagcaggaagcgucugggugcaauggcucacgccuguaaucccaauacuuugggaguccaaggcgggcagaucaccuggggucaggaguuugagaccagccuggccaacauggcgaaacccugucucuaauaaaaauauaaaaauuagccaagcgugguggcgggaaccuguaaucccagcuacuuggaaggcugagguaggagaauugcuugaacccaggagguggagguugcagugaguggagaucgcaccauugcacuccagccugggcgacaagcgaaacucugucucaaaaaaaacaaaaaccagaagcauaaacggucacucaccucaaaggugccagccuuaagcagggugacuuggucaugcugagaaaggucacggaagcccgggauguguuuggcaaacucuaccaccucccgcacagcgggcgugaagcucauggagaaauccucccagaucuccugcaccguucgcccacugcguccaugcggguacauguucauaggacaugccugggggaggaaaagauugaaggaggggagugucagccaggcugggucagauggacgccccgagcagagcuggaccccagauucugccugggcuaggggcuguggcccugaaggaugggucuuucagauaaaguagcaauuaggugccagguggagauuagggauucccaggcagaguccagacugcaaggcaagacauuuucuccugggaagaugcuauccccacacucagccuccaggaacccccagcugcccuacacuaaguccauucugccaggcccccccaaucuucuuaacgcacucgcccgcccccaugcccuuaccagcagaacauucuuugaguugcccugccggggacuguuggcaggugccuugccuucuggggcugcauacacguggguggggcauagacggugcccguugcuguuggacugguggcagcuguggugugcagggccaggaggccaggugggaggguaggaggagggagccuggcgcagaccauuuagggccucguuaugacgcugggcagccaagguguuguugucauugggggcaggugggcagcccugauuuucccagcgauguggggugguggcuggagggcuaccugaugcaugguuggcauugaaguugccaggugagcugcccagcuugucaugggcguaggugaagaucucucgaugggcccgggccaccugggauaucacauccuccacugugggcucagggcuuggggaucugggaggcgucagcuguuguggaaacugggagaagcccaccaggggugaggggaccggagcaggggguggcgaggggcccauggggccugggguggggugcugggugggugaagucuccagcgggcacuggcugcucaacugguuguuggccagguucauggcacucugcaucucagcaagcauccgcugcuucucucguuuggggaugcgcccaaaacgcacagcugcaacaggaugagaacagcaucaggaaguucucaaccaugcucacgugcuucucuuccuuccuuccuccugaaagggcaaggcccugaaggcuugggguuucacaucaaaacuaaaaccagcaaguccccacccaucaaggggguuucccuaggagggauugcugguaggaggugacccgagggaccaaugggauagaaguauauguugacccaagcaaaugaaggauggacauccccuggcacaugugauucacaguaugaugugucuccauuugugacuuuuuuaaagggaaggauuaauucagaaacuuugggcggaagaaggggggaggauguggggaugcugccucaccgucucgagacaugcccacagagagacacuucuugaagcgacauugcuggcagcgguugcgauugaugcggacgauggagcaauucucauucuucagacaccuuuuguacuggauguucugcuggaugcuccgacggaaaaagcccuggagggcaggggugguuagugaccaccuccaucauggcugggccucuguguccagggggagggggccaccugccccugcccuuacccccaguccgccucaccuugcagcccucgcaggcgugcacaccguaguggaagcccgaggcaacguccccacacacuuuacacaguaacaccaugccauucagcucuguggaagagacgggcagcaggugagcaggagaggccaggcugaguggccacagguguggaggcuuucugggccggagauccagggagggaaaagcuaaggaggaacuccaguguugaggggcacuggagugacaaaacugggcugaagaggggcuggugccacucuaggagaaaucccugaagccagaauagguccuggcaagacuggugucacguaaaaacccauucccaaucuggcccuggccugcuucccuucccccgaaucagcuggaaagguacucacuggugauguugcuggugcucuugcugggggacacucggcugcuguccuccauggccacuuguagacucccaggggggcucccauuauagaaggaggaggaggaugacgacgaggaagaugaggaagaaggggagccgucaucacucaggcuggguggaaugcucccaaaggagcgagccgggucuugggugagggagccagugggggauggugggaaguaggugggacagccuugggucagggacuggaagcugccauuggaguugucacuauagagggauucagggcuggugcggcuuggggaggagccacuggagccaauguaggugaugacgccaccuggagagagaacaaaaggaaagggggugucagccgccaugucuccggaccuagggugccacugugcucauccccaccugucugcccaaaacauugcuggccacucaguucaccauguggagccccuaaucuuggaguuaauaagcaauuccccaacacacaguagacauggcauggccaagcaacaccuacgacccuuugcaggccaccuucagcuucugcuuucaguaugaggcaugaccccuguggcaucucgcauaugugccccccuuccuuaguugccuuccuugggaauaucgacugcagcuaaugacuuaguugucaguugaagaucuggggaugggaugggcagcugagcaccauucaaagugcccaguccuccaaaaacaaaaacccagcugcugauuuuaacacuaagaccauuccaggaaugagaccauggaccauggagagauagguagccaacaguaaagagaauggaggguuuacaaaaguaagacagucacauuccccccaguuggggacauauauucucugaaggaaaugaagggaaggaaucugcccagccugguuccccuggccucuuaagagagugagccacaguggagucuaucccuguguccaaaaaggacuucgaggugcgaguugcaggagguggaaguacaaacuguccagccuggggcucuaaaauucccccuucagaucucagccugguaacaaugaccuuggcucucuggccauucagggacuuugacccucugguuacauugccaaugagguggcugugcucccgugguauuagcaggagaaaaaggugaccugccugccacaccuccggcaagcaccuagauuggucugccaugggcggggugggagaagggaggaucccaggacacaugugaccuaacacaugccaugccacugugucugcagaggcacaugucuugcucacccacugacacacacugaacugggcagggcggcccuaaaauagcucaagguuggucagggugaacccagcuccuuggaaaauaguugcacaacagaucagcucccccgguuucagggcugaggugggggauggaaucauuaguuggcaguaaaugaaguugaccuaguucacccaucccccaaaaaggagugagaccuucaugcagaggcuuccaacguggaagugaggagcauacucaagagucuaggucuaggucuagacccaucacuaccaacuuauuuugugaccuagaggacaucaacuccccucuuugggucucaguuuuccuuucugugagaaaaaaaggacaguaucauuucagcuaugauuguggggugcaguugcuuuggggagcccuuaguaggcaaacugcagcuugucugguggagauggggguaagacaaugcucgcagaacuaaggagagagaagcuuggggaacaggaauuuguaauguggggaagcugagucuaaaugcaguacggugaaguaggugcaaauaagagugaaguggaaaggagugagaagggugguuaggggugaggucucuuuagggaguguaaaacagaaggccaugaaaggucaggaauggcuccauguuacuuuguuuuggugaugggggagggggccgggcaggcggaccggaaaaggaggcaggcgggggcggugagucagcccagcuucacccagaucucggcggggcggggcagggcgggagcugggcccucagccggccucacgucccugcuccacgugugccucucgcacguggcuccccaacgaggaaccccggaacucgaggccccgcccuccucgcuucccgucaaucgagagcagucgccccgccuccuacccgcccuuccccggccaccaggucgugggcuggaccccgaacgauagcagggccaggacaaccuaggggaggagagaagggaacacgcguugccggggcgaccgggggggcggagcucauuauguaacgaggccgggaggcaacgaccaaugggguggcagccacggcuucugcugaaugaaaacaaacgcagcacgugggcccggcucuagagccaugugagcccucccggcggccggagcccuguaggugcccucccucgggccgggcaccacgcucuggacuccucaagugucgcucccuccugucacugaggauuccccagugagauccgaacgauucucccagccccuccuucccugaaccccaucgcgccacucuucucagauucccucgcgccugcaggaacuagaggagggggaagacaagaggggaggggguccguuuucugaggccaggcauacuacagcugcagguaguggacagauggggccguuucggggcacuguuccaaagcucccagucccccuaaauucuucgcuucaccacccguaccuccucuccauuuccuccugcccagggauucgaggcucaagggagcuuugggacucugagggguggugauggggcguuucugagagcauuuccagcccgaacaagccgcucuggaaaucccacacuaaagcaccgcagcacguuagcaaaucuccgggccgagggacaccccagucccuuacaaaguuccucuuuuuauaaggcguagauggagguggggagacagugacagggaaaagaugauaguaaagaaaucucaguaccuguguuguuguuggaguccagggucgucaugucuucaccagcugagagcggucauucaaacuggaccuugacucaaacuagagguugcgaucgccgcuguugcccccugggcacuggcuaagggcggggaguggaccccgcgacucacgaucaggauccgaagcacccugcagcaaggucuugggguggccggacugcagcccugcagaaggguuggacguugaggcaacggaguucugcuuugcaugggaagagcagagagaguguguagggggaaucagccugcaguaguucuggcuagaagguagcaaggagggucgggucucugcaguguacggggugccucugccugccggcuccgcagcgcugcgggguggcgaaucuggagcucccggugcaaaagucccagaggaagagagguugcaaccaggaaguaaguaggugauggggagaaacggggcaccgagucgcaaagaggcgagacgugugcccugcuacguucccucggcaguaauauuucacucugccaaucucagccgccuuuugcccgagccuuucccugggacagagggcucugcgcaggcgccagcagcccaggguucccgggccgcacgcggcacuggagcagguaccaugugaucccagggagcgccucgugccccagug

SEQ ID NO: 16827 - RNA, 1994 nt, Homo sapiens
cugcaccugcccauuggcugcccuugagccucuguagaacucagaugcagggagaaugugggggagguggaggaaagggagagggggugcucugcaucugcuuccaucucuacccuuuaucccaagcuccaucucaaacccucuccuuauccagugucucuccauccuuugggccucugcagaucaccauuagcugccuggggaggccagaggcucaugacaguccucgugagcagaauggaccucggaggagcgguggccugggcaggcauuaggggccuuguguagcuucugggaggcuuacauaaacacuggcugggauggggaggaaagggggguugcaauggcugcccagggaaaaaagcaacccccgcccggccggcucagccugaguggaaagaaggaacaaggcuuacuuucccuccucucacuccucuccccuggucugcagcuguuagucgggcuggaaagacugcgguaucuugggggagggggggcaggagaaggagagagagaggaugcgacuucacaaauuugggaucccuccuccucuucuaaauuggggggagggcgaguggggaagaagcaguuugccaaagagauuuucaaugccgcaggaaggagcuuuggcucauuagaaugcgcaguuugcacccuggaaaaaaaaaaucugugcugguugcaaaaaugcagacguguguaggggcccagcggagauuaaaaaaaaaaaaaaaaagcgcuagcucugcaaugcaggaucugcgaaguuuuggugcgaugaggaaaugugggucgugcucauuucauuugcuuguuccugcuaaccuacugucccccugacucuagcauagucucauagcccagcaagaggcaccgcagcuuagaaauggggucacgaguagggggcagaagcagagagccagaagugggggucugugguuagagugcccagagaaggaccaauggagguuagagggccaggcagauggaagggggcacuucaaugagggauggaggcugaauuugccuuuugcacacgcauuuguucugcagcuacacagggguuauugggaaagcccuucuagguuuccuccagcccucggcucuuccccaucuccaaguagcagagggacuuuccccuuccgguccacuaaccucacagaccacuguugcagaaccuuugcuucauguccccaaacacacaaaucccugaacuguccuuguucuaacccuggagggggcacuugcugcgugugugugucauccuccuuccuagaaagaggggacaggguagccugauuuggggagcccaggcuacagggaagccaagucuuggcucugggcagacaucaacacaucaccaugagggcuggggugggcuguucuguguucuuggcuugggaagguccuuuguucuuuugaggcuuaggguucuggguugugaaaacaccaaggggcugccugggaggaaaauaugcuuggggagaccauguuucuuuucuggguguuugcuccccugguggcucaggagagacaaaaggagacagaagcaggauaaagcgcaaggagacaagaagggagccccgcgcgcuuucccuccuuccucaucuugccuccuguuucucuggcccacggaggaaggggcccaguguguuugugccggcucgaggcucacgcgggcugccggggucacauggcccgggcaugugcagccugcuccauuucuaccacaacaacucgcucauaaacagcccggcugcugcggcgguggcgguggagacaugugcaagcgaggggguggggcacguggcccugcccgagccaagggaaggcgcucgcucagcacugccuccaccccuccccagcacuggcgcugccucgucacaggaaauuccuagugcuccuguugcugcugcaaaacauguuuuggggaagugacuuucaauaaggauggaaucaauggacuauuuaaaaagagacagaauggauaauca

SEQ ID NO: 16828 - RNA, 16726 nt, Homo sapiens
cacuccgacuccucagcacucuuggcgcccccgcucuccacccgccgcagaugaagggccccgguucggccuccgcgcugugaaggcagagagccgcugccgccgccuccggcgcuaccgcugcagcucccgccuccccgcaacggggagccgccgcugucggagcccgaagcaccagauuccucguccucggugucuugcgaagcgcgcugccgccgccgguccgccaucuuacggagaacggccaccaccggcgagguacuuacgcaccgcgcccgucgcagaggcugcugggaggcuggauagcuagucccggcgugcuacgcgugcggcgcucggccaucccgcuguguguguguguguguguguguguguguguguguguguguguguguguguguguguugggguguguguguguguguugggguguguguguguguguguguguguguguguguugggggaggggcggggcacugggcggggccuaggccugcggcacguuugcggccgacccggauuacgucuaucggugauguaagggggcguggcgcggcuccugacuucccuugggcaggccuagggcgaggggaauugagacuucagcagccucccggguuccuggcccggccaucuugggcuucccgaguggaaggagucaaccugucacagcuucacugcaacacuagggcuguuucaugguuuucuguuuccauuucucacuucuaccuacguuugaagcaggucaauuuacugcauuccuuugcuugguaaaaucacgaaucaagguaaaucuuaaaagcuguagugcugcgucagauuugcugcaccagccuuguuuaagauaacgggcgaaggagaaaccaguugucugcagugaagccagaggacuucuuguugcagcguuuucucuguguucucauuuccucuucacguuucuucccaccccagccaucaccugucccaaagugcaggcugguaugaugccaguauuaccgguuuuguuuuggcuuuuucgaggcagggucucacucuguugcccaggcuggagugcaguagcgcggcucacugcagccuugaccucccaggcacaggugaccuccuugccuuagcuuccuuaguaguugggacaacgggcacacacuaccacacccggcuaauuuuucuguuuuuuguagagauggggucucgcucuugcccaggcuugucuccuggcugggaucaagcgauccuuucgucucagccucccaaagugcugggacuacaggcaugagcuacugcccuugucaggauuuuagaaccuauuuaaaaauaaauggucaguagaaacagauguugauucaaaauccugacauuauuuccuucuuaagguuuauggaaauuauuucauuuuggcaaggcauuggccaccauugaaaagaaucaguguguuuucuuuggaccauuauaaggauauacaaagugcaugagcuaaguuuuuagugcaccuacaggagugcacguuaauaauguauguuaucaaacaaaggccaccauggcauagaauucuucccugaguaaaauauuuuuuuuuuuuuugagagggagucucacucugucugucgcccaggcuggggugcaguggggugaucucggcccacugaaagcuccgucucccggguucacgccauucuccugccucagccucccgaguagcugggacuacaggugucugccgccaggcccgacuaacuuuuuauguuuuuaguagagaugagguuucaccguguuagccaggauggucucgaucuccugaccucgugauccgccguucuuggccucccaaagugcugggauuacaggcgugagccaccgcgcccggccuuuccugaguaaaauuuuuauaaaugacaugguuaaggauccugauguuuaucaaauuuauagauaacaugaaacuggaaguaauuaugaaugccuucagagaugaaaggaaaauucaaggccgggcgcgguggcucacgccuguaauccuagcacuuugggaggccgaggcgggcagaucacgaggucaggagaucaagaccauccuggcuaacacggugaaaccccgucucuacuaaaaauaaaaaaaaauagacgggcgugguggcaggcgccuguagucccagcuauucgggaggcugaggcagaauggcgugaacccgguaggcggagcuugcagugagccgagaucgcgccacugcacuccagccugggagacaaagagauucuguuucaaaaaaaagaaaaaaagaaaauucaaacaaucucagcuaauuagacaaguggccaaacgugacaacuuauaaguccagcuccaaaagccaacugccugaguucaaaauggaggauaauaugauuuaauaaguguuaaagaaaaagaaccuggaggaucuuaucgaucacagacuaaauuggugcaaauaaggcugccaaguuuagugucuaaauaaggaaagugauagucugccacuuuguccuucaguuguuuagucuggguccaguuuuuuuuuuuuuuuuugagggggacggagucucgcucugucgcccaggcuggaguggaguggugcgaucugggcucacugcaaccuccgccuuucagguucaagcgauucuccugccucagccuccuguguagcugggauuacaggcgcgcaccaccacgcccagcuaauuuuuguauuuuuaguagagacgggguuucaccauguuggucaggcugcucuugaacuccugaccucgugauccacccgccuuggccucccaaagugcugggauuacaggccugagccaccgcgccgggccuggagcccacagcaaucuuuaacuagggacuaugaagaaaggagggauuggucuuuuuuucaucauccuagaaggcaaagcaaaaaccagugaguuuaaguuacaagaaguuagauuuuuugucaacaagcaagaauuuucaaacacuuagggggaaaaauguauguagaaaaaguguugaagcacagccuggaauuugcuugucuggaguguuaucaaggguaaaucacauaucggggucacacuagaugaccucuaaugucuuuccagcuauaagauuuuguuaacuuacgaaguauccuauaaucucguuucuaaaauugcuaauuauacuuuuuuuuuuuuggaguuggagucucccucuaucacccaggcuggagugcaauggcaugaucucggcucacugcaaccucugccuccuggguucaagcaauucuccugccucagccucccgaguagcugggauuacaggugccugucaccaagccuggcuaauuuauuuuauuuuuaguagagacaggguuucaccguguuggccaagcugguuucgaacuucugaccucaggugaucuacccaccucagucucccaaaguggcugggauuacaaaugugagccaacacgcccgacccuuuuuuuuuguugggggugggugggauggagucucgcugucacccaggcugaagugcagcagcuugaucuuggcuuaccacaacuuccacuucccagguucaagagauuuuccugccucagccucccaaguaacugggauaacaggugcaugccaccacaucuggauaauuuuuguauuuuuaguagaugggguuuuaccauguuuuacuguguuggccaggcuggucuugaaccucugaccacaagugaucugcccaccucagccaccaaagugcugggaucacaggugugagccacugcgcccagccaaguugcugauuauacuuaaggaaguacacuggacaaagagggaugaaacauacauuauacuuauacacaaauggaagugaguaccuuauuauaaaggggaaaauaauguguuauucuuuuuuauugagaaaauggauuucuuuuuccaauguuucaaauauacaagcagaauuguuuguuugccaauaaauauaauaaauugaagcagaaguucaaaaauuaacagccacaauaguuuauuuacaauugaacucuuuauaagauauuuacaagacaaccaauuuuacacaucagaaaugguaucaaaaguuaugaauuacaacacagacaacaauaugaaaugggcauaaaacaaagcugaaguagacagacaagcaauuuuuuuuaauuuauuaacacuagcuuaaacuuuguuaaagaaaaacaaacaacuauguuuuaggagaacugcagggccuucaguugaagauugaauucacaguguuguaucccauguagggaaaaauaagacuaauuuuccccccacacucuaacacacuguaauuuugcacuuggaacuuugcuaaucuacuguccaaccuccuucucaacaaagucaaaucaaaggagaauuaaccuagaagaggggacaauaaaauaagagguccucagggagagggagaaccaaggaaauagaaucuacuuaaaucuggccagauagcaccucguggauucuucucagucuacuucaagucagaaacuggggaguccccuggguagggcacaaacacaaugguuaaauuugcuaacucauacccaaaauuaggaacccgacacaugcugaaaucaagaagaaacugagggaucaaagaacaaagucaagagacacugauugggucuuuuuucuuuuuggacacguuacgaagaaauaucacauagguaagaguaagaaaacugaacagccugccacauuaaaaugauggagaacaaagaaaaucuggcccaguuuuucuagaaaucuccuccuuaaggugugagaugagagccccuaguggaauuaaguccuauuucucucuacauccuugcugcaaugaaguuuacagcagguucccuuauagagagcccacucuccuaagcagauggaguuacaaaugaaaacccauagccacacacacacacacacacacacaaaaggagaaauaagagcagcaagaucauccaagaauacuacaugugcugccagaauaauuccuuuaaaagucaaauccaggaagcacagaucaacaucucacaaaaaacuuuagcagugggaggccccugaggaacuuuucuucucuucccacaaugguaucccauucucucuucgugcuccacugaugggccagccacacacccuacauaccuuggcuucuccucuaaaagugcuaauaaucuggggacauauucucuuuaaggauaaaagccccuaccuucuaggagauuagaccccuacuuguuuucacacaauaguccugaagacuaaagaaaggcaauuccuauauauuugagaccagaggucuuggcucuauuuuccuuucagauaguuaauagggaucuuacacugagaccaaaguggccugggagugcuauccugauauuuuaacaaaacgggaggggagaggaccaagaugguacacauacaaauuauuuuuacaaagugaauggagaagcucauuagguacaucuguuuguuucaagauguagacauuugccagccaaaggaagcaccuauuuccacacucucccccuacccucccuaagucucuaucccaccaccaagaguucugcuaaaaggaugaagcccaaugaaggaauacuugagaagugaugugauacaaggacauuuauacagguuuuggcaugccaucccaaauacuaagugcuuuuguuuacagcuguaacuuguucugaaacuaaccauccccacuuucuuuuccaaagauuuugguuuuugagcaguaaagaaauuguuauccauuaacugaaaaaauaaucacagccaaacaucccuucccacaugacuguaucacagaauaguuucaaaugaacaacuaucuuuucagacaguuaucuaccaacucuccgaugucuuuucuacucugugaagauggcuugcuucaucgcuucacuugucauuccucuucugguccuaaagcucauggugagguuguuuguuuuauuuuaggguuaaaaaucacuauacccacuauaaggaggguguaccagggugagaagagugccaugcaggcacagcucuaaaggaaggggcugcuucaucuuccacaugucuaaugaagagagcccuuuuaccccuuuaacauaggcaaauguauagaaacagaccccugaaacuucugaaucugccauccuauagcuuuagcuugagagcccauuucccaaaaaagggaaaagaaaucccaaucacccuccauaacucacaauuagccgaaugaaagaguuuuugugaaaucagaguaaugaaaacaaagucaaggaaguaugaaaggguauuaucagcgagugauaacauaugugaggacaaaggucacauauacaggucucugccacucucgggaauggcaugcuacaacuaucugaagacaggguucuugccagcacagcuauuuccuacacguccggugagguguuugcuucuucuggaucuccaaucugcaucggcuacgcucauccaaccaggguagcucaaaauuccuggcaaaaaaggaugaggaaaucaacuugcaagacuagaagggauucaguguggacaugauagcaacuacaaaaaagucacuaugucccuuaccacuccuaucccugacuaguuuggagugucuuuccugccucaaagccagagcaacuguguaccauuaaagugauggaaucaucuauuucuaacucaaaaagcaauacuccuaauuauuggcuugggaaucuuauuacaaaagcuaguugcccagguagccucauuucugucaaagacccauggcuaucccuaagccaccugguuccaccucauaucuaggcuuccaugaagucugaaaaggaugugcagguuaccuggaaggggagaaaaaaaauguauacuuacuguggaguuaauuuugguaauggucguccaaaugcuacaacaggcaagaaggggguaaucaucaaacuuucaacuaugggagaaagucaaacgggagcguauuaguaauacagaugggaaaugucuagaagcuauaucugcuccaaaauacacuucauucauucagagcaaguuguacccuggagccuugcacccuccuccuucuuucaaaaaccuacucuuuuagauggacacaacuuaccaucaucuggcucagggaaaaaugagguaaccucaggcucagauuccugaauuccuuucuuuuuauacauucugagcugcagucgcuguaaaauucuuuguucccugauccucugaauaucccaucugggaaaaacaaaccaaacaaaacaaagaaacccaacauuacuguuuacccaaaaccugcucuauaaaagcaacucacacaauccagaugcuaggaagacccuugcugacuccucuagacaggguaaagagaaaugacugccuuguuaagggagagcuguuuaggucuaccguuuagaucauguguugguguuccacagaaaguagaauugaggaaggucauacacaaaaagaggccaaacauguuuaccgcaacaacuaccauuuccaacuaagauauucaaccaacugggaagccaguaauguaagaguguuaagcacuccaagauucuccacagcaugaaaaagggaggucagguucccugauacucuguccuagguccuagggcucaguuguuuccaggauggacaucucuggccucaccuuuuccuucucuucucauccagcuccaguuuugcaugccgcuucgaaaacacacugucauccagguucuguguaaagaaaagcagcugauaagcuauuuaucaccauauauuaguuacacacauauacuaacuaauuuccagcuuccaggaacguaaaaucuuucaccuuccgguucuaccugagucuguggguuccauggacaguaugggaaccuccugguaacagaaucaacaaaacacauacuccuuuccccauccacauccuuuuagaaucuccaaauuucaaaaucauuuccauaucuuuccaagguaaacaucacaucaaacuaaaacccccagacugucauaaacccucccugccuccauacuuuguaagagucugacuuuaaaauaaucaaaacuuuaagagucaaaugagcuuggaauauguaauuuuaugguugagggguacaugcuuuuuuuugugugugugugauggagucacuccgucacccaggcuggagugcaguggugcgaucuuggcucacugcaaccucugccuccuggguucaagcaauucucccugucucagccucccgaguagcugggauuacaggugugcgccaccacgcccggcuaauuuuuguauuuuuaguggagaugggguuucaccacauuggccaggcugaucucugacuccugaccucaggugauccaccugucucagccucccaaagugcugggauuauaggcguaagccaccacacccagcccuaacuuuucuacuuagcauaaaaucuaccuuuguuuugaacauuaccuagcuauuuauuuuuuaauaaaucacuuaacuacucuagaccuguuuuuuaaucuauaaaaugaaggagcuggacuagauaauuucucaaguuucugucuggccuuaaaauuauuuaauucauccauaguacuaugacauuuuccaguuauacccucacauucuauuuaaucucuuacucucuucaauugagugcucuugguuaccuaccuccaaaaggucugaaggauuugggucccuuagaggcucuacugaguggucccuccaagaaggaacugaaaaaaaagagagagaaaaagaaagggaggagggguggaaccacccuuaaauccaaaguugcacaacuauucacuaggauaagaggucucuccccagaagagacaaaguuaccaagugauaggaauccauucuauggccucccugaagccauauucaguguccuugcuaugguauaaaagaaccuaaaaugccauugcagucugccaaacucaggaucacaaaaacccuaaaccaauaccugacaauucauauaaugaugcuauagcaguuccugaaaaacaacugaaauuuguugucauuuugaagucuauaguaguguaaucaaucauacaccaagaaaucucagucucccacauccaguggauggggaaugcagcucccaaccauccaccaucccaccaacccccaccccaggcccagccagcacaauuccuauucuacucaccagccaagacugaaguuucuccugcaacacuugauggcaucagacacccuaaauaaugcaggaaagaagaauaaucucaguguaaaaagaaaaaaagcccauaccccaaauggaggaaaggaucaucacugaaguucucacuaggaagccauuuuguuuuuugaguuguucuuuugagaauuucucucugggggaggggaagagggaacaacagacaaaagaaaagaaaauaagcccaccacuuuuuuuuuuuacacugagacgacuucuuuucuucauuauuuagggugguuucccugcaacaguugauggccaaggauaucaaaccuuaaacucagaacauggcaggugaguaaaaguugacccuauuuuucaaauaaaagaucaguguucucaaaacuuacauauguagucuucuuaaacagcucccuccucccuccaaacaaacuaccuugcugguccagccugaacaacaugcacaaagacuuuggcuccccuagaacaagccauugagccuuccucuugagauaggggcaucaagaauaaggauucacauguuuauucacaacucaggcuccucaaggggcugggaucuccccaauuagacuccuuuguuucacuaugcccacaaucucagagguguuugaaauugucuguacuagggaagaaaggauuuucaaaaauagccagucacacagaacagcucuggaccaagccauuacccaaucccggaugggaaguugcuucacguuucucuuaaguuguuacgcagcauugccauggcagcaaaagagguuaaccauuaaggaagaaccuguucaacugacugaaccaacaaaaaucugaaccuagaucaggauccugaucuaucucauguacucaagugugaggccuaauagagguuagaucauuaagacgacuaaucuagcuuucccacuuaauuuugucaccagaacagccaaacaaagccuggagaacgcucuugucucacuggaauggauuucuauccccauccugcuaggcaagacacagugguagaaacuugggacugcggcucuauccuagaaggccuccccaaccauuaccccagaguaaccgcagugacugacauagacuaauauuacaugauugaaggcacauuccaguuacugguugauguagaagauaggggagcaucucuguguggaagccauaaagaaaaaaaaaagggaaugaagaccaaggucccacaccccacacccuccccaagcagcucagauaucccaagauaguccuuauuguuugaaaaauaguuuguagaccauuuuauuuaaauauaugaacaaccaaugggcuacugcaauccaaguaaacucuucacauuuuagaaccuuugugaaguauaguaagauaaaguaagacuguuggucuuuggcagauuccuccugccccccagacagggacauagauauacagauaaauguuuauauaguuaaagagcggaggcccaggugaaaauuccccaccccaagcuggcuccccaacccaaaaauuaccauuggccccugagaacacccaaagaccacccucccagauuucacacaauaucaauugcaggaacagucgugcauggcaaaguauaguucuaugcauuucacagcacagaaaacccuucuuucagagggcaugcaaguugccggagauuacacccccaagucuggugcucuugugaugagcaacuuacuggcaaacacaucucccaguguuguaagcaggcaaauacauugagcacauuuugcuguaauuccaucuauuugcaaugccugcacagugucugucucuggcuguuaacuuacucauucuugacagaacucugcuuuauugauugcacuuuuuuaaaaaugccaaaggcauuuucacacuuguuagcuugaccgccaccacuaggguauaagagcaaguguucucuaugccuuacuugcuacagucuccuccuucuuuggagaggauucccguaaugguaacggugaugggggaggcuggugccaacgacacaaauacauuucugugguggaaagguacggcaaaucuucuaucucacuugagaaggcuuucuccuugggaugggugcugggucccuuuuggggaguggagagucuuggugggguguccacugaagaccggggcuuuucugggguuucuuggcuccucaauucacguuuacaaacaguuucagauaaggaaccacaggguuccucuuuaauaggagagugcuuaggaguuuuuguuuugacuuuugaaaauucaggagccagcuuuuuaacaggagucuuucuuucuguacuuccaaauggggauuuccuauuagauagggaagaaaacauuauaaaauuuauugacacuugaauaaaaucuaauuugaacacauucuggagcaaaagaauaagcugguucuuuugccccaaaaugacaaguauucagguaccuaaaugucuggugcucauuuagcagucaugagcaggaacagcccaggcuuagcaguauauaaaauaggcccauaguaaauuuuuuguuuuguuuuguuuuguuuuugagacagagucuugcucugucacccaagcuggagugcaguggcaugaucucggcucacugcaaucucugccucccggguucaagcaauucuccuaucucagccuccugaguagcugggauuacaggcauacaccaccaugccugguuaauuuuuuuuguauuuuuaauaaaggcaggguuucaccauauuggucagacuggucucaaauaccugaccucaggugauccacccaccuaggccucccaaagugcugggauuaccggcaugagccacugcaccuggccaguaaauguugaacaaggaauuuccaugcuuaagaauauucaagguccaccaggcgcaguggcucacgccuguaaucccagcacuuuggaaggccaaugcaggcggaucacuugaggucaggaguucgagaccagccuggucaauauggugaaaccccgucucuacuaaaaaaaaaaaauacaaaaauuagucaggcgugguggcacaugccuguaauccuagcuacuugagaggcugaggcaggagaaucgcuugacccugggaggcagagguugcagugagcugagaucacgccacugcacuccagccugggcgacagagugagacucugucucagaaaaaaaaaaaaaaaaaaaaagaauauucaagguccuuuagccaacauuauguaccacuacaacccacauuaggugcaccuacuucuuguaauccagagaucagucucuuuccuuuucccccaacccuguaccacauuaauuguaaccuuuauuuccuuuuucuuacugucugcuggcauucucuagccucuuucuucuucccuucuucccccaccacaucccaagaaagucaucucccuuccucuuuaccaaccuaaauuuuaauacuuuuuuggagucucacucugucacccagaguggagugcaguggugcgaucucugcuuacugcaaccuccaccuccuggguucaagcaauucuccugccucagccucccaaguagcugggacuacagguguaugcaccacacccggcuaauuuuucuauuuuuaguagagacaggguuucaccguguuagccaggauggucucgaucuccugaccucgugauccacccgccucggccucccaaagugcugggauuacaggcgugagccaccgcacccggcuauacuucuuuuucaagacugauuucuacuuaaaguuucacaauucuaacccagaauaacuuuuaauaucccugaaucuuacaaaacuuaguuuaaugucuguaaucccagcacuucgggaggaucacuugagcccaggaguuugagaucagccugggaaacaaagugagagccugucucuacaaaaacuaaaaaaaguuagccaagcauggugagugccuaugguccuagcuacaugggaggcugaaguaggaggaucacuugaguccaagagguggaagaugaagugagccauguuggcgacacuugcaccccagccugggugacagagagagacccuaucucaaacaaacaaaaagccuuaguuuauaucagguguuguacaucuacguauuuuacugcauuugaauucugaguuuucaaaauguaugccuauccuuacaguugggcuaauuucuuugaguccaaggacaguuccauuuuuaccuuuuuuuuuuuuuuuuucaauugagacaggguaucacuccgucacccaggcuggagugcaguggugcaguaacagcucacuguagccucaaccuccugaguagcugggacuacaggugcauaccuccaggcccggcuaauuuuuggauuuuuuguaaaaaugaggucucacuauguugcccaggcuggucucaaacuccugggcgcaagcgaucccuccuuccccacuuuccauacguuccauacuccuuccccaccuugcccucucaaagggauuacaggcaugagccaccacgccuggccuguauuuuacuuuucuaugucuaccaaugcacgacacaaugaaggaauuuaacacuuccuaacuugaagugaacugcuauaguuuuaagaaacucagcugucauacuuauugcccauucucuuuaugauguaagcugcauucaauaauuauuacugugaccaaaauacuccuaaacagacuuuuacagucugcauaagaauguuucaagauaguuucucagcauagaagacuucuuuuuuuuuuuuuuuugacggagucucgcucuguugccaggcuggagugcaguggagcaaucccggcucacugcaaccuccgccucccggguucaagugauucuccugccucagccucccgaguagcugggacuacaggcgcccgccaucacgcccggcuaauuuuuuauauuuuuaguagagacgggguuucaaaauguuggccaggauggucucuaucucuugaccucaugauccacccgccuuggccucccaaagugcugggauuacaggugugagccaccacacccggcccuccgcauagaagacuucuaaagcaaguuaugauugcuauaaaaccaauucauaaaucccaaucuccuacucucaaucacugguaacaaggguccucaucaaacaaaguuaucagcacaccuuuuaugucccuuuccacuccgcccacaugagaagggcuugggaggcagagucugggaugucucggaaagcuccggcuggcacuccaguuuaauuuucucagauagcucuguuuccucucucucuucaguuucauagcccugaaacagcuugugccuuucuuucucguuauccuucuuuaccagcugcauccgccuuuccauacguucaauccgagcaaggagcuaaaagagagaguagcaaaaugcagacuuaacacauaaaaaauuaaacacacagauacuuagccccauuuaggaaucaguauagucuucugccucuuucuauggaccacaucaacucaacuuuuuaaauaggcagacauuaaucugaacaguuuuccuuaaacaaaauagagaagagaagguauacuguuaaauuuuaagggcuaaccuagaugggaagaggcaugggguaauuuguaguucauucuucuguagggagauccucuccacugggaagggccguaacaugccuuuuaauggcauggucucugcuacugcuaccuguguggcuccaaguugguucgggaguuuccagaauuaauuguauacauguuuuguuuguuuguuuuuguuuuuguuuugagacggaguuuugcucuuguugcccaggcuggauugcaauggcucacugcaaccuccgccucccugccucagccucccgaguagcugguauuucaggcgcccgccaccacaccggguaauuuuuguauuuuuaguagagacaggguuucaccauguuggccaggauggucucuaucucuugaccucgugguccaccugcguaggccucccaaagugcugggauuacaggcgugagccaccgcgcccagccuacaugaucuuuuaagaggcccugagauuguccaaauucuauccucucuacuucuacuccaaagcucuauacacaacagcaaagugcaaacaguacauugagaaggaauuaagagcucauacagugccaccaggaauggcaguguuauuugaaagggguaugugugggaggggguacuuuuaaaacaaugaacauuucauuuggaaaauagaaaucaguacccauaauuccaacaaucaugacauaaacacauuccuuugaauuugagguaacacaaaaaauuauaccuauucaucuaaauauuuauuaaaaucaaaguuccuuuaguuuuaguuaaaaggaaggacuaaaaaacuaaacagaaaauggaacucuauuaguauugaaaacuuuguguuaguuuaguuuugagaaaagguguugugcuacuuauacucuauuacaagaauuuuaucuggguuagacagugauguuuaacgcugccuucauuacauucauugcauagauuucagacaaggccaaacaacaacuggaauaagugaaacaagcuuaagcaauauuaagauugcaauacacaacagaagcagugaguaccaaguucagacugacacucuauccuuaacucaccccacuuuuccugacuaggaaagccugcaaaggggccauuaccucaggaacugagcagaaaccuccacaaucagcagagaaccccccuaucagccauacucucauuucaucuccuuguauauguuuugauucacagcccuuaaccaccauuugugggugacauuuccuugauuuuuuucuccuucacugguccuucucuucccacuccccccauacaaggauaugauguguuguaauuacgguaccaucacaccccuagacugcaguacagucugagcagugccaccuccauguugaguaacuuccacaaaucaacaccaugagauauuuuaaugagaccugccccagcucccaauccaccuugcagaaugcauucuccaauaaaacagccacccgaugagauucauuuggaaagcaaacaaaaugaauagccgcuugcucccuugcucagcucuuagcgcacacgacgccagagagaaagaggagagagggagagaugaggacggcggggagggagggagagagagagagagagaaagggaaagagacagggagggaggaagagggagggagagagggagagagagacugcugcagccugaacacaacaauuguagaaaccauguuuauuuuuaggcagcuguaagguaugcuagcacaguaauaccccccaccccagcuucccucauaucugaaggaauauguuuuaacgcagagaugcccuuaacuacugcugcaguaaaaacaagccugugucguccaagcuccucagaaguaaagaaauaauaaacgacuuuccuacucccuaagauucuaaaauaaggauggggaggucuauuuaauacauuuaa

SEQ ID NO: 16829 - RNA, 16816 nt, Homo sapiens
ccgggcuuuggcgggaggugggaacgcuguggccauucggauuuggcgcgagcgcggcuggaguuugcugcugccgcugugcaguuuguucaggggcuugugguggugaguccgagaggcugcgugugagagacgugagaaggauccugcacugaggagguggaaagaagaggauugcucgaggaggccuggggucugugaggcagcggagcugggugaaggcugcggguuccggcgaggccugaggugaagugaagggaaaagagcugagcucgcuggaggucugaggucgggaucagggaaagggcaggugcccucgggguaguucuagcaguuaugcguggugugaaggaggugaaaguuguaggaaggaaauauucuggggugcguugagagcugccuagaaugaggacugagugcaggggcggaaagaacugagggaagacugagcugcagugugagggcuugggauagaagagacuaaauguggcgggugcugggcugaacuggugauaaagacaccccgcgugccuggagggaggaaacuagaaguucuauauaaaucaauucauguaacuuuuuuuuuuuuuugagacggagucucgcucuugucgcccaggcuguagugcaguggugcgaucucggcucacugcaaccucugccugccggguucaagccauucuccugccucagccucuucauguagcugggacuacaggcgcccgccaccacguccggcuaauuuuuuuuuuuuuuuugagacggagucucgcucggucucccaggcuggagugcaguggcgcgaucucggcucacugcaagcuccgccucccggguucaugccauucuccugccucagccucccgaguagcugggacuacaggcgcccaccaccacgcccggcuaauuuuuugcauuuuuaguagagacgggguuucaccguguuagccaggauggucucggcccgucucggccucccaaaguguugggauuacaggcgugagccaccgcguuuggccguaauuuuuguauuuuuaguagagacgggguuucuccauguuggucaggcuggucucgaacuccugaccucaggugauccgcccgccucagccucccaaagugcugggauuacaggcgugggccaccgcgcccggcccauuucagguaacuuguuauugcaucgcucaauugguuaagaacuugggcucuggcaccagaugcccgggguuacauuccuguuuuucugugacuuugggccacuguuuaucucaguuuucucauguguaaaauaaaggcuaauaauaguaccuacuccuaagaucguuguuaaacgaguugguaccuaaaguguuuauaacagcgcccuuccacguaguagguagacaacaaaugucagcuguucuugcauagauuuggaugugaagcaaaagugaaugcuaaaauaagugugauaacauaauuaggaaauaaguguuaaucaucaguauaaauaaauuccauguuaguuauuuucucuucacuuucacauauugacuaguuguccucuuauuuuuuuuaaucuagcugugcugucgucaugccucaaacccgaucccaggcacaggcuacaaucaguuuuccaaaaaggaagcugucucgggcauugaacaaagcuaaaaacuccagugaugccaaacuagaaccaacaaauguccaaaccguaaccuguucuccucguguaaaagcccugccucucagccccaggaaacgucuggguaaaccauccauuauaucacuuuuucacuagcagcucgugaccuuucuuuucuugguaagauguguguccuuugaaggagcuuucuaaguucaguuaagacuucuuuuuuuuuuuuuuuuuuuuuuugagacagagucucgcuccaucucccaggcuggagugcaauagugcgaucuuggcucacugcaaccuccgccuccuggguucaagcgauucuccugccucagccucccaaguagcugggauuacaggcgcccaccaccaagccuggcuaauuuuuuuuuuuuuuuuuuuuggauuuuuaguugagacaggguuuugccauauuggccaaucuggucucugaacuccugaccucaggugauccaacugccucggccucccaaagugcugggauuauaggcaugagcuaccgcuccuggccuaagacuacucuucauuuuaguuauuuucagaaugguugcuaagugcuuaccgaacuccagaguuagacacuuacugaggucacucugaacuacuuaauaagucugaucuucaauuccuuaauacugaacuuaguucugucaauguuuuaaguuaccuuguaguuacaugguauuaugaaacuuaccucaauauuugugaaauuaaaagaaacaaaaacgugacaugaugaauauuuuccauccuuuaggacagugauugguaauucuuucuuguuuuggaacauuuauuuuuaaaugggggguaauuugguuguuucuggagacauuuuugguuguuacagcuggggguugcuacuggcauaguggguagaggccagggaugcugcuagacauuacaaugcacaggacagcuccuugacaaugaagaauuauuugguccaagaugucaguggugccaagguugagaaaaccuguuucaaaauagccuuacaauuucauccuacuaaaacccauuugguuucuacuaaaugcaguaguccccacuuauccaugggggauacauuccaagacccccaguggacgccugcaaucgaggacaguaccaaacccuacauauacuguguuuuugauuugauaaccaagucagcuacuaagugacuaguggguggauagcauauacaguguggauaugcuggcugaagggaugauucaugucuuggguaggauggugcgggauuucaucauggcacuccacagcaugcaauuuaaaacuugucaauuguuuauuucuggaauuuuccauuuaguauuuucagacugaggguaacuagaacgguggaugaagggacuacuguaguaagaucaguggugccaucuggugaccaauauuugcugcuaagugagaaggcauuuuauuuuggugguucugacuaagguagaaauucaccucuuucuggaagaggcagaggucuugcacauccuuuuacuauccaaugcuaugagugacuacauuuuuauuuuauuguguuucaggcgaugacaaccuaugcaacacuccccauuuaccuccuuguucuccaccaaagcaaggcaagaaagagaauggucccccucacucacauacacuuaagggacgaagauugguauuugacaaucagcugacaauuaagucuccuagcaaaagagaacuagccaaaguucaccaaaacaaaauacuuucuucaguuagaaaaagucaagagaucacaacaaauucugagcagagauguccacugaagaaagaaucugcaugugugagacuauucaagcaagaagguuuguucuuacauggcaacuguuagugcagccauuguaaccaaggcugaugacuccaaaugaaaccacccacugggucuucucauucaccuucuguugugucuaauugaccuuuuaugucuggcacaggcacuugcuaccagcaagcaaagcugguccugaacacagcugucccagaucggcugccugccagggaaagggagauggaugucaucaggaauuucuugagggaacacaucugugggaaaaaagcuggaagccuuuaccuuucuggugcuccuggaacuggaaaaacugccugcuuaagccggauucugcaagaccucaagguacauugagagucugaauuaugauacucuugguaaaaugauacuuggguguuuuuguuuguuuguuuguuuuguuuuguuuuguuuuguuuuuugagacggagucucgcucugucgccuaggcuguagugcaguggcgcgaucucggcucacugcaagcucugccucccagguucacgccauucuccugccucagccucccgaguagcugggacuacaggcgcccgccaccaugcccagcuaauguuuuuuguauuuuuaguagagacggggugucacuguguuagccaggauggucucgaucuccucaccucaugguccgcccuuguuggccucccaaaguguugggauuacaggugugagccaccgcaccuggccuguuuuguuuuugaaacagggucucuguuguccaggcuggagugcaguguugugaucucagcucacugcagccuugaccucuugggcucaggugauccucccaccucggccuccuggauagcugggaauacuggcacucaccacuacacccagcuaauuuuuuguagagacaggguuucaccauguugcccagacuuguccugaacuccugagcucaaguaaucugccugcuucagccucccaaagugcugggauuacagguguaagccacugugccuggcuggcacuuaguuaagaaagagggcuaggcacgguggcucacaccuguaaucccagcacuuugggaggcugagguggguggaucaccuaaggucaggaguuugagaccacccuggucaacauggugaaacccugucucuacuaauaauacaaaaaaaaauuagccgggcaugguggcaggugccuauaaucccagcuacucgggaggcugaggcaggaggaucacuugaacucgggaagcagagguugcagugagcugagaucgcgcuacuguacuccagccugggugacagagugagacucugucucaaaagaaaaagaaggcugggcaugguggcucacgccuauaaucccagcacuuugggaggccgaggcgggcggaucaugagguuaggagauugagaccauccugacuaacacagugaaaccccgucucuacuaaaaauacaaaaaaaauuagccaggcgugguggcgagugccuguaguuccagcuacucgggaggcugaggcaggagaauggcgugaacccacagguggagcuugcagugagccgagaucgcgccacugcacuccagcaugggcgacagagcaagacuccgucucaaaaaaaaaaagaguuaagaaagaguaggccuggugcgguggcucacaccuguaauuccaacacuuugggaggcugaggcagguggaucaccugaggucaggaguucaagaccagccuggccaauguggcgaaaccccaucucuacuaaaaauauaaaaauuagcugggugugguggugcauccuuguaaucccagcuacuugggaggcugaggcaggagaaucacuucaacccgggaggcagagguugcaaugaguugagauuguggcauugcauuucagccugggcaacagagugagacuccgucucaaagaaaaaaaaaagaaagaaagaaaagaaagaguagaaguuuagaagauugaggguuucuucaaaauaaaacauuuguaauuucauuguuuaaaucuuuccaaaugaaaguagagcuuccuuacgugcuguuagcucuucaaagacauuuuaggcucuaucagaucuuuauuuucugaggccaaaauaacucccauauuugcauuuuuuuuuccagaaggaacugaaaggcuuuaaaacuaucaugcugaauugcauguccuugaggacugcccaggcuguauucccagcuauugcucaggagauuugucaggaagagguauccaggccagcugggaaggacaugaugaggaaauuggaaaaacauaugacugcagagaagggccccaugauguaaguauuguucugcuucauguugcucugugaaaaucugcaaggucuguugcccauaaaaaguacauuuuguauauuuucucucugaaggauaguuacauaaacuuaaagggaaagaagagaaggaagauacaccuaauuuuaaauuggauuacuuauagaugaugugggguauccuuguagcaguaacuagagauagguuagauuaugaucuuuaaacuggucucagcuuuaggaaagugaccugaagucagccuauaucaaacauuagaggguuaagaaggugaauauggauacuaacuguuucucuuuuuauaguguguugguauuggacgagauggaucaacuggacagcaaaggccaggauguauuguacacgcuauuugaauggccauggcuaagcaauucucacuuggugcugauugguuagugcucaauuguuaauguuacauggugguucuaaaguauuuuuuaagaauauauauucagcuuauuuaucagcuauuuuaucuuaaaccagcuuucugccgugucaaaauaagaaaguuaaaugacuauguacaucuuaccuaauagauacaucuuaucuauugggaugggguaggagacaaguggcaagcaacaauuagaaugcuagauucuauaacuggagauuuauuuagcuuucagaagauuuaguuuucccuuuaggauaauuugaccaaugaucaauguuguugaucuccuccuuagguauugcuaauacccuggaucucacagauagaauucuaccuaggcuucaagcuagagaaaaauguaagccacagcuguugaacuucccaccuuauaccagaaaucagauagucacuauuuugcaagaucgacuuaaucaggucagugccaacuauuuugccaaauuauguguuccuuggaucaccugugcuaggaaaauuuaacaauaguucuaaaauauuuuugccuugauugcuuuauuaauggagcaaggaguuccuauggaccauagugagaacauuuuuaugugaauuucagcuucauucauuuacugggugucucaguguugaaauaaaagcaggaguuagaggaaucacccaagcgcuuuuuuuuuuuuuuuuagaugaguuuugcucuuaucgcccaggcuggagugcaauggcgugaucucggcucucuacagccucugccucacggguucaagcgauucuccugccucagccuccccaguagcuaggacuacaggcaccugccaccacgcccagcuaauuguuguauuuuuaguagagcugggguuucaccgucuuggccaggcuggucucgaacuccuaaccucaggugauaugccugucucggccucucaaagugcugggauuacaggcaugagccaucgcacccagccucaagugcuuucuuuaaugaccuuuaaaaaauagggccuaugaaaaaacuuuuucuguugaaaaugacuaaauagauuuuuuauuuuugcuaauuucaguucugauugcuuuuuuccauuuaugaacuucuacugcauccguacaaaaagcuuaaaugugugaaaacucucaaacgucuccauuauuuaugagaagaaaaggcaucuuuuuaacccuaaagaguugccaaucaaguuuaggguuaaaugugaaaauauuuaugcuugggaccuaaauuacagagggagaaucuuaugguucaaacugucaucuucuaugucuugucugaagguaucuagagaucagguucuggacaaugcugcaguucaauucugugcccgcaaagucucugcuguuucaggagauguucgcaaagcacuggauguuugcaggugaguuacggcucuguugcauucuuuuauuaaaaaaaaaaaaaaagaaaugcuguuaauugucucauguaacucaagugaauguggcuuaagaggcucuguucugcuacuuuuuuacgcucagaaaggaggacuuguuucucaguggggagcucuggauuuccaccguguuaaugucugaaacauuaucaguccauuaccuacagagggagaaacaaaugagauguugcuggcacucccuguggugauuauagauugguuaauuacauuuguauuaaaaaagacuccaguuuacuuuuccauuagcuggucucaagcagguuuauuuauggaccugaaccgucuuugccuuuagacuuguuccccuuccuuuccuuuugugagcaccccuucuucccuucaguugguggucccccacaguuguacuccagaccucuuucucccuucccauccuccugccccuccugcuggggaaagccucugugccgacugaugaaauuucuuccuucccaguagggacacuggguccauuaaaaugauacuugcugugcuggccugcugguccaaccucccccuauugcuaugcagaagacccaggucuggcuuauggcuuccugugggcaaguacuuuggagagagcagugggagaguaagcucuuccuauugcuagauugcaugauccugaauuugaaaguuuccccuaaucagcaaacuacuuggguaaagacugcaacuaugagcaauagucauguaggcuagcgugguuuagccuacacauauccuauguauauauaacugaagauaucccuuuuagguuugguguguaugggugaugcugacucccuuuagucagucacccacacuacauauccucucuccuacccaugacauuuucuccucauccaaaauguuaucauuggcuuaauguaugaugaccuacuuggcauccauuaggaggaaaccauugaaguuucucaaaucugauguccaugaauuauuucaaagcaauuaaguccccuuaucugagaaauaacccaguuuuguuugggggcuuuaaaauuauaaaacaucauaauuuuaaaguuacacguaggauauguguaggcuaaaccauguuagccuacaugaccauuguucauaguugcagucuuugagcaauggucauuaaugugccgcuuuugaggcuggugguuugguguguuugguuuggcucagacuaaauuaauuuuagaaauuuuuuuuauaggagagcuauugaaauuguagagucagaugucaaaagccagacuauucucaaaccacugucugaauguaaguaguuuaucuccuuccugucuuccuuuguaacuagaagcuuagcuuuucugaggaaagagguagaaagaugaaaugaacauaguuaaauccaaacucacccauuuuuaugugugucuguguuuuuaguccguuucgucuacuuuauuucaaucuugccugccaguacuauaguucgugcauuacuggaaaugaguucccaggguauugauugcguaaauggcugggacagaguaaguuuuuuuuccaagcucuggaaaugaaacuuguagacaaugagguuggaucagcucucugggugcuuauguugcgugcacuuuaggucucaauauaggugaaagcaaagccugauaaauaagggagaauuggguaaaagaauugugaagccaggugcggugguucacaccuguaaucccagcacuuugggaggccaaggcgggaggaucgcuugagcccaggauugugagaccagccugggcaauauagugagaccuuguuucuacaaaaaauuuuaaaaauuuugcagccauuaaaaauaugaguucauauccuuuuuagggacauggauuaagcuggaaaccaucauucucagcaaaguaacacaggaacagaaaaccaaacaccacauguucucacucauaagugggaguugaacaaugagaacacauggacacagggaggggaacaucacacaccggaggcuguuggggguggaggccaaagggagggagagcaugcaggacuuaaaaccuagaugacagguugaugagugcagcaagccaccauggcacauguauaccuauguaacaaaccugcauguucugcacauguaucccagaacuuaaaaaaaauuaggcaagcauggugugugccuguaguccuagcuacuuggcaggcugaggcaggagaaucacuugagcuggagaggcagaaguugcagugagccgagauggugccacugcacugccagccugggcaacagagcgagacccugucccaaaagaauaauaauaagaagaauuauaaguucaacuugggauaucucaagcuuuuaaacaagucuagaggguagagguaaaaagaucauacugcuacaguaagcugcaugguaucacaaaugacaaaauuaauauuccauucccucagccuuguuuugguuguggcaaauguaaaauggccaugaacuacguaucuuacaguauuugauauccaguguuagucuuuauaaacagaauaguaagauuugauuguuucuuuuucacuccuacacuggcugggaguuuaaguaaaauuguuucuggcauuauaguucugcaugaaauucuuucuuuuuuucaucaauuugcuaaaauaaaauaauuaaaaauguuucagaaguagccaaaaauagugcuuaggcuaauaguaggcaauauauaccaauguauagacuuagauacugguuucuuccuccuuuucaacuuuucagauuauccccuuuuccuccuccuuuuuccccaucaguaacauuuaggcuugucacuggccccugugagcaccacuaacacaaacauaauucaaaaagguaaagagguuguaaguucuaucuuuugacuucugguuugugcgggauuggcuuuuuucuuucuuuuuuuuuuuucuuuuuguguaaaacaaggucuugcuuugucucccaggcuggaguccaguggugcaauuauggcuggugcgaucauggcucacugcagcugcaaccucccaggcccaagcaguccucucaccucagccuccccagcuccagcuacugcuaauuuuaaaauuuuuguagagucaguggguggaggagucuccuuauguugcccaggcuggucucaaacuccugggauaaagugauucuccugccucagccucccacagcuuuggaauuacaggcaugagccaccauaccagguugagauuggcuuucaagggcuccagaaagcuauagggagaaugacuuuaacuaaauauaagaagaaaauuuauaauaacuagaacuaacugggcuuccuugaaacauaguggguucuccagcauugaagauauucagacaaaagcuggauagaugccacuuguugagauuguucuagagaggacucggccaguggauagggaguaaaaauagacuucuaaauuccuuucaauuuuaagauucuuuuacuugaucugugaucuccgguuucuccauuaguccucugcagcaucccuuugugguaauguaauauuauagaaguaaauuguuguggggcaacugcaagugauuucaggaaguaacuucagguaaagguuguuacagaacacauuucuuugucuuggaauucaugcaucuccaaacgauaaggccauagucuuuuuuuuuuuuuuuuuuuuuuuuuuuugagacagggucucgcucugucaccaggcuggagugcaguggcgugaucuuggcucaaugcaaccuccuccucccaggcucaagccauccucccaccccagccuccugaguagcugggaccacaggcacacaccaccacacccggcuguuuuuuuuguauuuuuaguagcgaugggggaaacccaucgccuuguugcacaggcuggucaugaauuccugagcucaagccauuaguuauuuuuccugauccucucccuccacccuccuauaggccccaguguguguuguccccacuaugugucuauguguucucaucauuuagcucccacuuagaagugagaacaugugguauuugguuuucuguuccuacaguaguuugcuaaggauauagucuuaugaagcuuauuggcaguuucccaaccccuggcuuuuauuaagaugaugauaucuggccaggcaugguggcuuacgcccauaaucccagugcuuugggaggccgaggagggcagauugcuuugagcuaaggaguucaagaccagccugggcaacaugaugaaaccccaucucuacaaaaaauaccaaaaagaaaaaaaaaaaaaaaaagauggugcuaucugcuagcauauccaaugacauuuucucaaguguugcucuacugcuaaucagcuugggcaagugaaccaaaccucaaaggucauuuggggaagccaucugaagggcugacauggcagcgacuucacucuccacauuuagccacucauuugauccaaaauauucgguaauuuuccaacuuuuuuuucccuuucuuuuuuuuuuauauggaguuucacucuugucguccaggcuggagugcaguggcacaaucuuggcucacugcaccucugccucccggguucaagugauucuucugccucaaccucccaaguagcugggauuacaggcgccugccaccacauccagcuaauuuuuuguauuuuuaguagagauggaguuucgccguguugggcaggcuggucuccaacuccugaccucaggugaucugcccgccuugaucucccaaagugcugggauuacaggcgugagccacugcaccuggccuuuuuuuuccuuucuuaauuaccaagcacagucaccaucuuugcuucaagguucuguuauucuauaccucugagauacuaggaacuagccuggcaugguggcacguaccuguaauccuagcuacacaggaggcugaggcaggaggaucacuugaacccaggaagccaaggcugcagugagccaugauagugccacuguacuccagccugagugacagagauccugucccaaaaaaaaauacaguaguucucugguccuuucaugagguggguuuuguuccucugacauuaaauuacauuccauaggacaaaacagcucacuauuuggcccagagaaaggguaacccuacuuuucaagucaucccacauuauuuugacauccuuaagagaauagcauuaucucucauccuuuggccucugguuagagauuuaaaaccucugcuuugccaccaugugacuauacuugaauuuccuuuagcucaaacuuaguaucaucugucucaucauacauacacacacacaguauuuuagaaaucgaauuaagcuuggcuuauuuacuuuauagguaaaucaccuucugagccucugauucccaagaggguuggucuuauucacauaucccaagucaucucagaaguugaugguaacaggaugaccuugagccaagaaggagcacaagauuccuucccucuucagcagaagaucuugguuugcucuuugaugcucuugaucaggcaguugaaaaucaaagaggucacucuggggaagguaaguugggauggagcagauggaacggagguagagaucagaaucugcuuugcagagcagguauuuuccaaaaggccuaugauacuucagcugauaauaaauuuaaaauggauuuuaacaguaagaauuaauacugguacuauauaaaaggcaccuauuucccuuggauugugguugagaguuuaucauuaauccuuucccuauccuccccuucauuucugcaucucucuaggaaauauauaaagccccuuuccuacauuacuguauagguuuucgggaauaucuacagaagccuguucaaagauuuuauugaaaagaggaagaaauaggguauucagauaaguuuuugcaaacccagacucagguuucuuaaaugauuaaaggcuauaagcaaugugacuuuuaagcagcguuuguucucccuuguuuccuaccaguuauaugaagccuacaguaaagucugucgcaaacagcagguggcggcuguggaccagucagaguguuugucacuuucagggcucuuggaagccaggggcauuuuaggauuaaagagaaacaaggaaacccguuugacaaagguacaacugcuuuuuugugacaguguuuuuaauuguccuauuuuguagagugaugcuaaaguaaagguuuauuguuaaacaagaugaccacaguuaguuaaacaagucguuuuuuguuagguaagguuuaagguguguaaagaugggagugugauaugaauauuuuuucaagccauuggaaaaaaaaguguuuaacuugcuugccuuuugugagaaaaaguuuaauaugguagaaguuuguauacugacaacuuugcuuuugugaguuccccagugugaaaaauccuuuucucuucuuuccagguguuuuucaagauugaagagaaagaaauagaacaugcucugaaagauaaagcuuuaauuggaaauaucuuagcuacuggauugccuuaaauucuucucuuacaccccacccgaaaguauucagcuggcauuuagagagcuacagucuucauuuuagugcuuuacacauucgggccugaaaacaaauaugaccuuuuuuacuugaagccaaugaauuuuaaucuauagauucuuuaauauuagcacagaauaauaucuuugggucuuacuauuuuuacccauaaaagugaccagguagacccuuuuuaauuacauucacuacuucuaccacuuguguaucucuagccaaugugcuugcaaguguacagaucuguguagaggaauguguguauauuuaccucuucguuugcucaaacaugaguggguauuuuuuuguuuguuuuuuuuguuguuguuguuuuugaggcgcgucucacccuguugcccaggcuggagugcaauggcgcguucucugcucacuacagcacccgcuucccagguugaagugauucucuugccucagccucccgaguagcugggauuacaggugcccaccaccgcgcccagcuaauuuuuuaauuuuuaguagagacaggguuuuaccauguuggccaggcuggucuugaacuccugacccucaagugaucugcccaccuuggccucccuaagugcugggauuauaggcgugagccaccaugcucagccauuaagguauuuuguuaagaacuuuaaguuuaggguaagaagaaugaaaaugauccagaaaaaugcaagcaaguccacauggagauuuggaggacacugguuaaagaauuuauuucuuuguauaguauacuauguucauggugcagauacuacaacauuguggcauuuuagacucguugaguuucuugggcacucccaagggcguuggggucauaaggagacuauaacucuacagauugugaauauauuuauuuucaaguugcauucuuugucuuuuuaagcaaucagauuucaagagagcucaagcuuucagaagucaaugugaaaauuccuuccuaggcugucccacagucuuugcugcccuuagaugaagccacuuguuucaagaugacuacuuugggguuggguuuucaucuaaacacauuuuuccagucuuauuagauaaauuaguccauaugguugguuaaucaagagccuucuggguuugguuugguggcauuaaauggcaauuugugacugagacaccagagggcacccuuauaacauugacuacuuugaaaggggaugcuugaggcugagguaguuuugagggaaagggggaaguucuaguuugauuuguuugggagauugcuguccuuucauaacugaagcaaaugcuugaaauguaaaccaugugugauacgaaugaucugagagccagugaccaagucugcuuuucccugagcucuccugcugccgccucuaccuuucugacauggccuuccauuuggaacuugauauguguacaagugaucuguuggccacuguuucauucauccugaccacuguauccguguaaugugaucugagcuacaacaggugguaugggauagaggcaaggaaagcagagagagcccucugaaaugaacacuacccacugguguguguagcacaugauagucuguaggcaugagucugaauguuguucucacacuccuuuacuagaguauucguucccucugaagguaguuugaacauggaaacacaguucuauaccuagaagguuggaaagugucugggacuauaaggguuaacaugcauaauugcaaagauuguccgaaggcugauggaaagcagagacugaaugggauugagaacagaugcgaagcuugauuuaaauuacauuuuauuggaugcugcagccuuaagagacgugacugcuuuacaguuuguuuccacacugugggcagcugcugucuguucuguguccacaguaggauccugcccaauaaggagcagccuccccaccucauuguguuugaggcuuggcgccuuccucuuaacuguagggcuugagucaggaacauggcuugacucgcaguggggcugcuauguauccucccuggcuuccagccaaaaucacauugguagauucaaaggggccaaauuucuuuccccucuaucuuucccuuuccccugguuuuggaaauagaguuuucugucuacugauuuguuaguuuccuuuucuucuccccucacugucaauuucuaggucauugcugcucuuaagacuuuagcaguuggaacaggguugguucugucaaugaugcaugaagcagacuuagugucccugcuuggcuucugcugcccuugugggagcaaaagcugauauauguuugucaguaaagucuuaaguguaauucagacugcugaggaagaaagcccuuuccuugcuggcuuuucucccugaagcugagagcuucaggaaggugguaggaguuuuagugggaugggaugggaugggcuugugguuagcaguuuuugccaggaucauaggcugcuucacuuagaguaguggcaaagaugcugaccuacauucuuccuuuugaaggugauggagugugugucuauauccugguuuaucucucucccccaccccaaggaagcugauuaagcuuccauagaguguuggguguugccauggaaagagcauagacaaaauaaauuguguguuucaaccccagag

SEQ ID NO: 16830 - RNA, 15916 nt, Homo sapiens
ggggcuccgguucagaggcacucugggcgccugcuacagcuuccaaacugcgccgcuuccuucuucggcagaaaaggacuuucagaugcggcggcggcggcggcggcgacucaggacagcgcccccucccccuaacggccgccucucccucucccccucgcccgccccggcucccccaccucugggaaggcgcuggggguguggccagggaccgguauaaaguccgggggagccggucccgggcagccgcucagcccccugccccucgccgcccgccgccugccugggccgggccgaggaugcggcgcagcgccucggcggccaggcuugcuccccuccggcacgccugcuaacuucccccgcuacguccccguucgcccgccgggccgccccgucuccccgcgcccuccgggucggguccuccaggagcgccaggcgcugccgccgugugcccuccgccgcucgcccgcgcgcccgcgcuccccgccugcgcccagcgccccgcgcccgcgcccaguccucgggcggucaugcugccccucugccucguggccgcccugcugcuggccgccgggcccgggccgagccugggcgacgaagccauccacugcccgcccugcuccgaggagaagcuggcgcgcugccgcccccccgugggcugcgaggagcuggugcgagagccgggcugcggcuguugcgccacuugcgcccugggcuuggggaugcccugcgggguguacaccccccguugcggcucgggccugcgcugcuacccgccccgagggguggagaagccccugcacacacugaugcacgggcaaggcgugugcauggagcuggcggagaucgaggccauccaggaaagccugcagcccucugguaagguaccccuggccucccaauucccuccugagugcgcucccuucccagcggcuucuuccccauuccagccgcccuggaaggcccuuaaaaauccccuaugaguugaagagaaggcagguacguggcagggcccgacuggcaugggacaggcucaucaaggaaacugcuaccgagucccuagcagccuguugccaccaccaagggagacugucccaucgcuccaucucaaaccuccaaggguugucuguuugauaagggggucccagugggaggccuggcugcuggugcaggaguggcagauuaagguccaguuaagucagcugucuagggccagagaacuggaggaugguggugggguguguguuggggaggaugagggaguggggaaagcuuucuguuccugauccaggccgagggugaaaucccaguggucuggggagccagggccugaacuuuuuuuuuacaugguccagugguggagugggacauacaaauuagagggacuuuggcguugaggggcauuagacuugcccuuccccaaagcccagagccaggucaccuuguuguuugagaggcagugggaagacaggggucccucugccaggccuggacaccucugccugcccugguauacaggcccccuguucuuuucuccaggcagguaggauuugaggugguagaaaagucuuggcuccuagccgagagcugcaggagccucaugugugugggauagggaauagagaaggggccagggcgccaggggagagaaacagagagagagagagagagagagagaaacacacacacacacacacacacacacacacacacacacacacagagacagagagagagagagagagagagagagagagagagagagagagagagagagagacucugagaaggcccuugcccuaaccucauucuuacacuuucuuuuuuuguuucucaguuucuccuuagacucucagucucuuuuccuucuuucucuugcucuuuuguucuuccugauuugucucucaaccucuaguuucacuagucaugcucucgaguucuguuuuccucagugucuucugcccaucgugcguuucuuucuccaccuuauucuguguuucuguuucaguugcucugcuucucucccucucuuucuguugcuguuucucugugucucugucacuguuggucuuucccuguuacuuugggaaucucucugucugucuuucuguaucuaugccucuguuucucauuccaucuccgacccuguuuugcucuccugugccucugucugucucugucucuuuuccuggugcuugaagcuuccauuguugcaguccggaugcugggacuccagccccaagcuuccuguccugggacccaaacccuccacuuccucaauccucugcagcuugucagccgaggagagcaggaugcagggaaaacaggaaggagguggacuccaggggucugggccucgggccucucugcccuuccugccccuggguagggagagaugggucagcagaaaacauucuaggagaaaugccagccuggcacccagcauaucugggaagggggguccugggggagaaagucgcuaaucuuggggcagagaugccaguggcaaugguagaggagggguacugagacugggagggagcaagggccgagcccuuggguucgcgggguacaacagagucacguucccuuugaaucuccauccuccaccagccagaggguaucuggcaccagauaaggauggcugguagccuccuccucucucagcacuuugaaugcaagacagaagagcccucaaagggcuggguaggaauaccucauccucugguuggguaggaauacuccauccuguaguggaggaaaauaagauccccuagggguuuggggagggcauggcaugagaauuuugugguuguccucuggauauaaugcaaacuggccuccaggaauaucuaggggcuggguguggagguucaugcuuguaaucccagcacuuugggaggauugcuugaggccaggaguucgagaccagccugagcaauauagccagacccccgucucuacaaaaaaaaaaaaaaaaaaauaggcaacugcaguggcucaugccuguagucccagguauuugggagucugagaugagaaguucaagguuacaaugagcuaugaucacgugauugcacuccagccugggcgacucuauuucguaaaaaaaaaaaaaaaaaaaaguaggccgggugcaguggcucacaccuguaaucucaguauuuugggaggcugaggagggugaaucaccugaggucaggaguuugagaccagccuggucaacauggugaaaccucgucucuacuaaaaauacaaaaauuagcugggcaugguggugcgugccuguagucccagcuacuugggaggcugaggcaggagaaucacuugaacccgggagguggagguugcagugaaccaagauugugccacugcgcuuuagccugggugacagagcgagacucugucuaaagaaaacaaaacaaauaaacaaaaaaaacaaaaaacggugucuuggaaugggguggcuuuagguccccuuuggaugacacagccaaggucuguaaugccccucccccuuuccuccuugccuuguccuccagccuccagccaugcaauggaugcagguaucuggagagagacgagggaagccuggagguaccuacugagcaagcuaugcccgugcccucccacaccuccuagucaucauagaaguaaucccuugcugugaccugggccacauggcaccauguaaaaggcacucucuagaguucugcugcagcccugcagggucugugggugagauaagacgaccaagccccuacccacccaucuuuuuagccuuacacagucaguaggccacugucugcuuuaggucccaagguuugggcccacuggcccgcgaauagcuuggucgaggguaccugucuauuuuuucugccuuuuccuuuuggggcugagugucagcagguggcugggggaggguggccacuuggcaugcccccuucuuuggcugcuaugguccagcugccuccuguuugccccaggggcagaucuccccuuuccgucuccagccaccccugccugcccuccugucacagcuuuccaugugcuggccagguuguggcuuaacaccacugaggccaccagagaugaggcggggcgugugcaucaaaaguccacaccucugcauccugguacugauccuagacucauggaaucugggggaguggacagcggaaagaucagcguuuggacggggaguuccuaagcugggcucucagucccuuugggacaggguuagggaacaggcaggcuggguuaauuuuuagucaaugcagcaaauucugccccccuacuucaguacugggaauccaguuaugucaugggaacaagggcauucccagaaauucugugccuuguggggagggggagggaggagcauggccgcuucccauuuuuaauuuaguacuggcaaagcuagcaguauuggugccucggguaucaggagucuuuccacuuaaagacagagugcugcagagcuaagucucuccuccuccccuuccacccagucuacuucauuuuccuaauuuuuaaaguggggagggcaacaggaccugccucacaggguuggggcgucuggcaucggguaagagcucaauaaauugaagugaugaggaagauggugaugaagaagcugaugcugggacuuagggaagcgguaggacgagggagcaaauuuggggcaacauucagaggaguugagaggggugggguggccuuuggugcauuuugcugcugucaacaugggaagaacaggccaaguugccuuaucuguuuuuuauucugaggcuggcagcaugacacagcuguugggggugauaccccuugagccagaccucagagaaagggccugguacccagcaccagcggucuuggcuucuccagcuagagucuaggggaagagggaaaagaccuuucuagcaggacaggugggugacccucuggaucacagcugaaacuucuggucgggauggcugggcccacucaguucauagccuaggugucucucgagggccaggggcuggcguuggggagaaauugugaggguaaaaucaggcaacaggaaagaggaaauccucuggcuuucgccacaaacuuugcagccgguggugccaaagccguguggccucuucucuggcgccuucccuuccucugcugcuggagcaaagaccgagguuuccccuauagucagaugucaacuggcuuagcuccaagcugggcgcuguaggaggaccaagccuacuuggaagucccaucucccaaacaagcuuuuuggaggucagacuuuucaggggaauaggucugacuccacuccugcucagaggggaacccacaggcauuggaauuucuccagagggcacuaccaggaugaguagcaccagguggcuggaacucuugugugagcagggaaauagcaaguauuuagccaguuuuggagaugagaagguuaacguuaucaagagacucaaugcuauaacccuuacccccacaaaaaccuggugcuuagggguggauccugggguggcucuucagucugccaguuaagcaggguugggcaaggaaaaguuacagauuacauggaaagucaacaaaccacggugcagagaagcuguugaagucagcgugcccugcccuggcucugugucucugaccagggcagggucagagugcccaagugcauguggguaaggcacauguggaugaaugugugucuggacacgugauuguuuguguacacuugcaguucuugagccugagccugucugugugaguaggcaaauacggauuuacccuguguccccaugagacuaaggagggagcuacucucccuaucuggugggugcuacuccguguagacaugaacuggggauaaguaggauggcuaguggggaaccuaacaagggagaagccaggcaguuugcuggcuuagcuuuucguagguaacccucugaugugacauggggccauaccaacccaagagcauaagccaugccucuggacucacccugugccccaugcagcccuaggcuucagugagcauaccuaauccuccuuaaugguaaacaucccaaauauccauuaauaauccucugaggguuaguuauuugugaacuuugacucguaaaagcucagcacuguggcucacgccuguaauccuagcacuuugggaagucuaggcaggaggaucacuugaggccaggaguuugagaccagccugggaaacacagugacacccugucucuuaaaaaaaaaagaaaaggccgggcgcaauggcucaugccuguaaucccagcacuuugagaggccgaggcagguggaucacgaggucaggagaucgagaccauccuggcuaacacggugaaacuucaucucuacuaaaaauacaaaaaaauuagcugggcaugguagcgggcgccuguagucccagcuacuugggaggcugaggcaggagaauggcgugaaccugggagguggagcuugcauugagccgagaucgcgccacugcauuccagccugggcgacagagcgagacuccgucucaaaaaaaaaaaaaaggagagagagagagaaaaagaaacucagcauggaaagcauaguuguggucaugcuucuauuccauaucucuugagauuuuugaggcugcuaccacccuaauucuccacacuuccagggugggagcucacuaccuccugaaaacucuuccucacuccuugaacuccugaaaaaccuuccucacuccuugaaccaaagaauauucuacccauuuacugagaggaaugaaucauuguacaaaauagugcuugcuuuuuuaaaauuuugagacagggucucacuuguugcacaggcuagagugcaguggugugaucacugcucacugcagccucgaccuccuggguucaggugauccucccaccucagccucccaaguaggugggacuacaccugugcaucaccacaccaggcuaauuuuuuguagagauaggguuucacuauguuuccuaggcuggucuugaacuccuggguucaagcgauccaccuauuucggccuuccaaaguguugggauuacaggcgugagccaccccagcuggccccuaguacuuucuuuuauggucauuaaaagaaagcaaacucaggaaaaacaaaggcuuuccagguuggaagggugcccccugguguuaguguccugggcuguggcaaacaaguccaggugaucuccagcccuacuuaaguaacaggguggggccuuuguccacaucucagcucagccucuguccuucugacauuugguucuaauucuuuaauucuugaauuuuuuuuuuguuuuuuuguuuuuguuuuuguuuuaagagacagggucuugcucuguuacccaggcuggagugcaguggcacaaucauagcucacuguagccuugauguacuggggucaagcgauccuccuaccucagucuucuaaguuaggaccacaggcaggucugacuaauuuuuuuuuuuuugguagagacagggucuugcuauguugcccaggcuagucuugaacuccuggccucaagugauccucccaccucggccucucaaagcacugggauuacaggcgugagcacccagccugguucuaauucuuugaggucuuccauuuccuuuuucucuccacuccccaguuccagcuuacaccccugaaacacggugacuccauccucaagccuuauggcuuugugcaagguggggguguggagggaggugaucacuggggcagcuuagguuucuuuggcuggaggaauuccuugggagggucucaaaggaagggccuggaucccagaucuuucucugguuccuaaccgagggcucaggauccaucuccuuaugguccccuuggcacaguccucgucuucugaaguuuauguuucuucuuuugcugccuaccuuggccagggggucuugcuauagugucuucucuuugguugacucuuaggaacuugauguaggacuggaguccccucuggacuguccuucuugggauuuuaaaugugcagaaggauggauuauaucugucuacucuauuuauuucuucccuuuuauuccucuuuucuaagccagcucuccaccguaacaaaaucuucuuccauccuuggugaauuuuauuaauaaccuuugguguggaagguuauugauaaagacuuucugguuagauuccuccuugccugguuugccuuuauccacauauuucuccccacaccccccaaaccaggagaaugaaaagagaaccaacccccccagcuuuggcuaggcagaaaaauaccauuugacccagaggcagcucugggaucgcugccacgcauggaggaaccugcuaacuccucaggaaaaaaaaaacccugacgcaaaccagauguaaccuccuguccggcugccaacaucuggaaugcuggcaggggcuuugcacucaggccggcagcgagcugccaagccugagcauuucagagguggcucugaucugcagagaggucuuccaaccucuuucuccagcucagcccuguauucugguuuugacugcuuggagggaggagcagugguuacaguucugggacucaagcaugggguuuuucuuuuuuaaaaaaauguauuuuauuuuauuuuauuuuuuuagagacagggucuugcucugucacccaggcuggagugcaguggugugaucauagcucacuguuaaccucgaauuccuggguucaagugaugcucccgccucagccuccugaguagcuaggacuacaggcacaugccaccauacccgguuaauuuuuaaauuuuuugugaagauggggucuugccauguugccuaggcuggucucgaacuccuggccuuaaguaaucuucccuccucagccucccaaaguguugggauuacaggcaugagccacaaugccccauuuggauggaguuuuucuugagcucagauagagccuucaggagaucccacagagggguugaagguccagccucaucacucccgucuccagaucccuggugcccugguucugggcaaccccuauggacuuuggauggagucugaagucuaagaaugggaaacuucgaggugggggacugaaggaaugugugaggcuguucuugugguccuggggccacacagguuguguuacacacacacucacacacacacucacucuuccucaugcaggcggauacacuaacucccacuucucucccacucagccaauggggagagccuuuugggcuagaguucucauugcucauggaaacucugauucaggccauuuggaagagggcgagcagaguccacagcccuggggauccccuggcuggcucagccagacaccgaaaaaaucaggagaggcaacagggagaacgaucagauggagaggggaauggugggagcugaauggaaaggggacaggauccagcagggggucccccugccugccucagaccucccugcagggcccaggggacccuccugccaucugggcagcugcagcuggugacucaucugagcgcuggccugaguggggugagggacaagucaaggacuucaagaggaauauucuccugagagauccaggggagaggggaggagguagggggcugcucuuguuucuucccgcuccccaggcccccugcucuucuccagcgccaagccgaagaauccccaggaaggagaacgugggugggaggcuggguuggugugacgcucugaccucuuccggugcugaccucuccuuaucgcuaccugaauacagacaaggacgagggugaccaccccaacaacagcuucagccccuguagcgcccaugaccgcaggugccugcagaagcacuucgccaaaauucgagaccggagcaccagugggggcaagaugaaggucaauggggcgccccgggaggaugcccggccugugguaaggaccuccgaugcacaaaugugcaugugcauagacacacacacacacaugcccccugccccccacaugcacgcacccacacacaccaucaccaccagaucuggggcguguucauucagcacacauucuagggugacuacugugugcaaggugcaacuagugugagucaucaggacccagagaaagcacucauucccuuccuugggauuccuuuccugcccaucaguuauauacaucggggcagcuuaagugauuauuaaauacugaaaaacuucuauaccaauugguaaaaagcaguuacccaaagcgcccugggguuucuuggccuuuuuuggauuccccaccccagaccuucucaguaaccaaaggguaaugcuggccauagcagggggccugggacccugcuccagggucuggcuaauuucccuucugaaggucuuacaaguugucaguuggaaguuuuaucugucccuucugcauagaaaucacccccucccuggcuuucugcauagguucccacagccccuuuccccacaguguccccucacuucccaccccuccuuugaagaagcucuuuggcucgagacccuuuccuccacgucucuacccucccaguguguccuccagacccaggccucucucuucaccucacuggguccugcccagccccuggggcucaggccuccuuucggggccuucaguucucacuuagcucugaccccaggccugggccuccugccucucuuccuucugcugagcaauuuugucuuccccuccuccagccccagggcuccugccagagcgagcugcaccgggcgcuggagcggcuggccgcuucacagagccgcacccacgaggaccucuacaucauccccauccccaacugcgaccgcaacggcaacuuccaccccaagcaggugggucucugucucccgcuggcuuggcccuggacucagcucuggggcauuuccggccucuccgcaggaugguccuggauggagaucucaggaaggggaaacuccucaaccccaacccaaccccuuggagccucccuaaaccuaccucagcgucagaaccucacucauuuuggagaugaggagacugugauccagagaggaguaaaagcgccgggcuaguccagagucauagaacaaguuaacagcagaucuugccucccuauccagggcaauuucccucaccccuggauuucaccaucuguggugcagaccuagcaacccugacaaccucuggcucccaacacucucucauucacucuacucuauucguaugaguaauuccuccugucacugagugagguuucuucugggaauggagggccaaagucaugaggagucagggaggaaacucagccuaccccucccugcaaggcgaguagcaaaaccaccugggguacagcaagagugaagguaaaaccagauuggacgguuggagacaggcacuuuggguagaagcagaggaaggaguggggcaggagagaagacacaaaggcagcaacuucccuauuccuuccugcccuuggaagcugggguccucugacaagccuccaggaggcugggauggucagcaggguuggccucuuccagucuaucucuggcccaucagaauggguggccugucugggcagggcucuggugugccuccugcuggguguugccuggggaacccuagccuggagcucuuugucgacguagacagacccauuucccugcuccaugagcuauagacaaauccacaauuugagcugccacucugccagcagaagucuagauagaaggacaaagguugcccugagucugugcaucccaggauggcaugaaaaggguaugagugaagggacagagagggcaccccaaaaccaaugcccagccuauuucuaaccuuuauccuaacacgaauuuuauccuugucccaauuuaaaaaacuuuuucucuuaauuuaaaaaaaacaauuaauagcuuuauuuuuuagaguaguuuuagguuuacagaaaacuugagcaagaguacaggguuucaauguacugucauccaccccaguuuccucauuauuaacaucuuacauuuguugcaauugaugaacgaauauuaguauauuauuauuaauuagugguuuauauuaggguucacuuuuuguguugcaaaauucuaugcauuuucuucuccugauuuuuuuuuuaaaggcaggaucucagucucccaggcuggagugcagugaugcgaucacagcucccugcaaccuccacauccugggcucaugugauccuccuaccucagucuccugaguagcugggaccacaggcacacaacuaugucaggcuaauuuuuuuuuuuuuugagacagaguuugucucuuguugccgaggcuggagugcaauggugggaucucggcucacugcaaccuccaucucccggguucaagcgauucuccugccuuagcucccgaguagcugggauuacaguugccugccaccacacccggcuaauuuuuuguauuuuuaggagagaugggguuuugccauguuggccaggcuggucucgaacuccggaccuaaggugauccacccaccucggccucccaaagugcugggauuacaggcuugagccacuagcuucuuccucugauuuuuaucccauugaaaguucugacacuugaacuuuauccccagaccaguucugauccuuaagcuauccuucacuccaagauuaauucucacacugaaauauacauuugcgcccccugaaccuucuacuaucuaauuuugacccaaaauuuagcuuaacuuuaguuauucugaccuugaccucugucuuuaucccaauuguguuuuuaccugggcuuuaacccucacccaacucauccagcucaacuuuuagucauauuuccucauucaacugcaacucuuacccugguccuaccuuaaucccagcuuggauccaccucauaacuauaaucccauucuuaaagucccaacccaaucagaauauguacccaaaacaucuccaaccugaacccagccuuucaaauccagcugugccuuuaaacccgagggcuuucuuaagguccugccuuccagaacucucuggaccuuuccuucuugaccauguucucccugcuccagugagcucagaagacccaugcucaaaaaagagucaccacccucagaggccaucuugaagcagcgaccgucugacuugggggcugggcugggcugggauuggggugggucacuuggggucucuuuuccugcgucggaacugaccccucauguccuucucuuggcagugucacccagcucuggaugggcagcguggcaagugcugguguguggaccggaagacgggggugaagcuuccggggggccuggagccaaagggggagcuggacugccaccagcuggcugacagcuuucgagagugaggccugccagcaggccagggacucagcguccccugcuacuccugugcucuggaggcugcagagcugacccagaguggagucugagucugaguccugucucugccugcggcccagaaguuucccucaaaugcgcgugugcacgugugcgugugcgugcguguguguguguuugugagcaugggugugcccuugggguaagccagagccugggguguucucuuugguguuacacagcccaagaggacugagacuggcacuuagcccaagaggucugagcccugguguguuuccagaucgauccuggauucacucacucacucauuccuucacucauccagccaccuaaaaacauuuacugaccauguacuacgugccagcucuaguuuucagccuugggagguuuuauucugacuuccucugauuuuggcauguggagacacuccuauaaggagaguucaagccugugggaguagaaaaaucucauucccagagucagaggagaagagacauguaccuugaccaucguccuuccucucaagcuagccagagggugggagccuaaggaagcgugggguagcagauggaguaauggucacgagguccagacccacucccaaagcucagacuugccaggcucccuuucucuucuuccccagguccuuccuuuaggucugguuguugcaccaucugcuugguuggcuggcagcugagagcccugcugugggagagcgaagggggucaaaggaagacuugaagcacagagggcuagggaggugggguacauuucucugagcagucagggugggaagaaagaaugcaagaguggacugaaugugccuaauggagaagacccacgugcuaggggaugaggggcuuccuggguccuguucccuaccccauuuguggucacagccaugaagucaccgggaugaaccuauccuuccaguggcucgcucccuguagcucugccucccucuccauaucuccuuccccuacaccucccuccccacaccucccuacuccccugggcaucuucuggcuugacuggauggaaggagacuuaggaaccuaccaguuggccaugaugucuuuucuucuuuuucuuuuuuuuaacaaaacagaacaaaaccaaaaaauguccagaugauuguguuugguugauuuauucucaguuagacacagggaugcaccagggguggagagacggggacagauuuugggaggugaguauugugugguccccagaccugucuguaugguaagggacugcagaaggacggccaauccaccuuccucuucccugcaacggaaguuuccuagggaacuccuuggcuucaaagucugcgcugucuuuacuuagacuccuggugggcaaacaauggcuccugaaaggggggcaugaccaaggacagcccugugggggcagagcugucucugggaucagcuggcauguggggcuggggcauuuccuagggcaucgggcggacugggcuugcaucuggauuugauuuauuaauuuguuggggaggggcagggacacugcccugcauuugaggaaaggggguagaugcuucagcacauuccacagcucugacugccgagaucucugacucgggcauugugcugagauuggauucugagguugggagggguugacuuugcuguagacucagugccagccacagcuucagagauugugcucacaugguaugccuggacucuuggccauccuccaaaugccccuccccucccacaccucugugccuugugugugugugugcacgcauguguguggcaggggguggaggguccgggagcagaagcugaucucucggugggggccuuuuuccaggagguugcaggcagucuggagacgcugcauugagccugccgcccgcugcgcgggcucccuccuaucuagcuguguccuggauucucagcccccuccccagcuccagaggcgcuuccaggcuucugauuucacugggccccaacuuuguuggcaccugucccgucugcaucuugaggcugggucugcaguucugucucucuagcucugccccagcagcaaaguccugcagccaucuggucucccugaggcaccacggcggcugccagcagcaggagauaaagaacaaagugguguugaggguugcuuccucagccccagccacucuucacagaguccccuccuucuggagcccaggccaaggccuguggggaugggagguggugcacgcugaagauuaaguuuuagguuucaaguuuagggaaaguaucucuuucccuaaggcaucuuuuucaacccccuugucucuaguccccuucccgaugcucuaggcuugcacccuuggcaguggugguaggagguccuuuuucuuucaugggccucccaaaaaagccaaauuggcuuggaaguagcugugugcauggccuggguguaacuucgugacauacgugcauuuguggaguaugugugugugcaugcaugugaguaugacgcagugacaccugaaacgugaguguaugggcuuuuug

SEQ ID NO: 16831 - RNA, 21431 nt, Homo sapiens
uauuccuguuaauguagaaacauauucccuuuacuuuuggaaucaaagaccaacuuccauaugugacaaugacuauaauguaagaaaacugauuuucacaagugucuuguacaaauaagcuacugcagcaguuuauagagauaguugggugagacaagggcccugaguacacaaauuuauaauggcugaguggucauuccacacugucacugcauuacagaaaaaaacuggaugcuugucuugcauacaaauauguagugcauuaaaaacacugagaccuuuuuuucauuuuuuuuuuuauuacauuuggaccuuuaagaaacauauaccaucagauauaccacuauucaguaaaaaucuauucuaguuuuugggaagcuuaugugucacaaacuaucuugcuucuagucuccaagacuuuacuaaguuuaucaaaaaggugggcucuggucuaugggauccugagccuugagguuuggauguucugauuauuguaaaacaauuucaaguggauuaacuuaauucccagcuguuuuucuucuggaaugggcuaaucaguuugaauuaucuaguccauuacaagaauauuaaauuccuugagcuuugugaucuauucugucuuuggaaaaccugguaaaaaaguaauuuuuuuucuauacaauaaggauggauuuaccagaacauacccaguauuaaucauaacaaaaagcaguauagauaauguauaugugcuguguucacuuuaauaaccacuucauaaguaacuacucuaacuauggggacuauuucuggaucaguaagauccaaguguaguuaguuacacacuacacucagcuuaacacaacucuugguaucugacauugauuaaaaguaaaaaaggguaagugaacaaauacauacucauacaugaucacguuuuuaagaagcuacccuuugcagaaguaaacaagagaggagacuuucaggaagcuacugauggggacugggaagguuuaaagcuauggcuuugguaagcaccccagugagcuguaggaaggcauuguaagaguagauucugcagcaucaaaggauaauucucuaaaagagguggguguuuucucaauuaaucuaaauucugaggcuuucagcaguugagggcuagaaacaagauccaaagaaaagagccaucuucacaacacuuaagaaaggugacugacugagccauuaggcucaugaugcuaaaugguccaaaagccuuugguggugugauauggacaagaaaaaaaauuaauacacaaaccacguaacaccauuaaaaccaaaaaacauuuuuucauuaaaaaaaguauuuagaacacacaaaacaaggcaacacuuauucuuuuuucucaucuucugguaugggaucuguugguggcuccuccacuguugcacuguugcucuccgagccaguguuacuaucacugguuccuuccucugccauacugucgacccccuccugcccacucuccuuguccucaggaguagacgugccuucuucaccauucuguuggcucucuguuguuucuucaaggugugucuccucuguaaucacacauuugucacugucaguuccaagaugaaauuuuacucuaguuaugcugacaguauacagcugugcuguccaauauagaagccacuagccacaugugguuauuaaaccccugaaaugaaccagugugacuaaagaacuuuuaagaauguuggaacaauuuggguaugaaaaucuacuuuuuagcuguaaaugaaugaaauuuauuaaauaaaugcagaucaaauacuuccgaugaaaauuuagcuucugaauugagauguguauaaagacuguuuaaaaaaaggaaagcugauuuuaaaaauguuccuucuguguugaaauaauuuuauuuaggauauguugaauuaaauaaaacauauuguuaaaacacuuguuuugcuuaacuuuuaaaaauaugucacuaguagaaaauauaaaauuucacgugacuugcauuuuauuucuguuggacagugaaugagaguuagucuguagugcuauggauuaaacgaggagaaagcaguuguagaaauaauauaagguuggucuuuuagacacuuuguuuaaagucaugcugggcuguuuccuguaagaaauuaaaagcaugagguuuuagcucuaauagucucaaacgauuuucuucagguuuuuuccuugaacuaggacagaaucugaguaaagaccugcaaaccuuaagcauaagacaugccccauucauagaugccaaaacagaggcaaaggacugaguguuugucuaguugcaaaauuagcaaaaaucaguuauuuuaauuuucaagcucguuuuaaccacaaaaaugugcucaugcuccaaauucauuacaauaaaaaacacauucauacaaaacagaaagagacucagauacugaaacuuaaaauaugaccauuucaaauguuaaucugcuggauuaaauuuugcagaaauaccugguaaagauaucuauauuccauuacauguuuuccagaugguugucaucugaguaccaaguaugacuacugucccucccacuucuugcaacgaugcuccaggaagccuuugguuuuguuuuccauaacuacuuuuagcuuaguccuguuuacacaguguacuaggcaguguuaaaacagugccaugagguaaggugaucucaaaauuacaagugacgaucaauguaaucaguacuuuauguaaguuuuauuuauacaaguuauuauuauuauuuuuuaccuugagggaugcuuuuaaucaggaaaaucaguauaccuagaaguaaggguuuuucuaggacagagcuggcaauuuuuuucuguaaagagccagauagaaaauauuuuagacuucgcaggccaggcaguuguuguugcaacuacucaacuauacuguuuuauccccaaagcagccacagacaguauguaaacaaacaaguguggcuguguuccaguuuuauuuacaaaaacaaguggugggcaggauuggcuuacagguauuacuuugcagaaugcuguccuaggacaccaaagacaauuaaucuuaacgguaauaaccacaucuugauaaauaauguaagcauuuaaagguuaaaauacugaaugucaauaucaugucaaauuuaguacugggaaucacccucaguggcagguaccagaauacuugcacuuagaaagaaaaaccuaaauuaaagacagccguacaaagucuuggcacugccucugcguuuguugcuaguggguuaccugucuccaucggaauguucucgucgucuuucuucuccucgccuuuguuagcugcuuguucuuccucaggaacgaugcugcucugacugcgcucagcuugcucugcggccuccuucucccuuuccuccugccuuuugcgggccuguuccucugccugugcaaucucagcugcaauuuucuccauauccacuucuacuuucagaccgcacaacuaaucagaaaaaaacagaacuccguaauguuuuuuccuuauaauuuuugagccagauauauucuuucaaaaguugguuuucuugccuauaaacuauauauauauaucuauacaccuguaugugugugugugugugccaaaaaaaugugguucuaggucuucucugaaacucuugggucuacaagaaaaaacagcagcucuagcaguuguauaauauaggauauuccagagcagcuggugaggcaaaauagugaaaguucugggguauacauaaggcuuccguuuuacauuuugggcuaccaacuagauuuccuugucugaaugcaaagugcaaauuauaaauuacauuuaaugacgacauuugaugaauaaaucacaauaaaaugaaaguaauuaaugacuguaugggaguuuaacauaucagagggcucuagcauuuacaggccuagaagauauguguauacucuaugauauuucaaauuuauugcaauuuugccagagaaugggaacaaucuuauaaaaaaaggauccuacagguuuauaauaaaguuagcccuguuucaaagugaacaacauucaauaaaaacacuauuuuggaaaaaagaaugaggaaaaauaaaguaacagguauagugauaaaaguauaguuaacauauuaaacagauacccuuuuaaguucauuguuaaaugaaucugugcuuuccaggaauuuccucuucuucuccuggugucguuccucuauuugaagaaguucagcuucuaguuuucgcugcaagacaggaucaggcuucauaauugugucucauuuuuuaaugguccauacuuucaaacaguguaccaaauaauguuuugaacuuuagaucauuuaucacaugagucuagcuaagauuuaaaaaauacaaaaugcagcacaaagaaaugauuaugaucaauagguaaauguuaaagaauacuguuucaggccugagcaauuccuugggaaaaaauauuuagcauagcaguaaagauugauaggaugccucaaaauucuuaaguucacacguauuucuuaacgaauauacuuuccauuacaagguucuauauuauaguuuuuaaugacaaacuuauuaaacaucugggaaagguccacuuccuuaaaccucuucuccaaaucaggaacagguuagauugacauauuuaacagguagauuuaggcaugguguaggaaucauaucaccugggauuugugguauaggcacaucuuauugaaaugaauguuuuaugacuuuaccugaugaaccauuaaggacuggaccugccguuugaggaccugcauucuagcuguugugacaacugaccgaacgucuggcaccacacucucacuaagaauuucacugaugaggcggugguuucucuggaaacgggcgguggcuguaugcuucauugaaaagccaucaucauaaucuggagugaacaaauuguucuggaaaucaggucaccaguaaccauaaaaaggaguguaacaauguuaacacuuaauuaccaacgaacuauggcccucacuggccuaacaaguggaccugcccagcgucaugggagcacuggggcaguuacuugauaaaaaccauacagaggacguaauguguucauuggccaagguaguaauuuaucucacagucuuuaagugauaauguugugucugagaaggauuuggcuaaaacauaaacgagauacaacaugucucuucuggcuucggaaucaaugugaaggcuguaugugauggcaguaauugaaauucugcccaauguuucacucucuugguaguaacuuaaggcauuuaacaacuaaugaacaacauaugaacugggcagugacuuugucacuuguagcacuuuaaaaaugaaugaaaaugcccauuuguaaaauuaugacagcagagaauacaucaccucuaacaauauucaguuucccaggcccucaaguaauuuuauagaagaaaaauaaaugucugauuccaaauuuaauuuuugucaguuuacacuuagccagcuguugucaguguguaaugguaugacccaaguucauacaguaugggucugguuuauaugcuucuguuucguuuugagacagaaucucccucuuguuacccaggcuggaguacaguggcccagucucagcucacugcaaccuccaccugccagguucaagugauucuugugccucggccucccaaguagcaggaauuacaggcgcaugacaccacgcccggccaauuuuuguauuuuuaguagagaugggauuucaccauguuggcuaggguggucuugaacuccugaccccaugugaucugcccauccuggccucccaaagcgcugggauuacaggugugagccacugcacacacacuacaggcuuauuuuuaauagcuaucuaguguuuccuuaaucucagucuuugcucuaucaccuucauaguuuuucauauaucuacuaacagccuguacuaucguuuacuuaauauuuuucuuuaaacuaacucacuuaaaaaaaaaaagagcuuucucuuuaguaauacauauuaaaacaaacgcuccucucugaaccacuuaaucaccucagugacccaccagacagggaggaaccacacuuaagaaaaccuuguuacaggggaaacccuguuacagaggccuauguugcgcugcuaugucaguuuagcaccucccuuauugucuggcacuuaaguaguuccuaaaauucucauuauuauaaauacuacagcuaaaaacuguuguuuuuguaaaaaguuaaaaaaauuacuuuuguuuccuuuugaguaauuucuuuaggaaauaaacuucugaaauuaaaacuacuggguaagauacaguuuuuuuaaaacucuguaaccuuucuacuuuuuaagaguuuuucaccuuuaggguuauauaugguacaucugugcuacaucugucuaaguuaucuguuuuuguuguuagcuuuuguuuucuucuuucauuuauauggccccaguguugaccacagauggggacauaaggucuaagcaauuugggcuuguucuucuuugcauguuagucgucugcuuccuuuuuugggggaauggcuucucugguuaugaucuaauugaacagcuauuuauccuaugaugaagaggcucucacugaauaaaagccuucauugucuuguguggauaauugcacaugcccucuuuuuuuuuucuuuuuuuugagacugguuauugcccugucauccaggauggaggacaguggcaugaucauagcucacugcagccuugaacuccugggcucaacugauccuccuaccucagccucagcuggaguagcugggacuacaggcacaagccgccaugcccagcuaauuuuuaaguauccuguagagauaaggucuugcuguguugcccaggcuggucucaaacucuuggccacaaacgauccuccugcuucaguuucccaaaguauugggauuacaggcgugagccauggcgccuggcaaugucuaucuuuugauaguccucuguuaaagaagucaguagcuguuguacuucaugcagaugccaccuuucuguuauguacauuugacauacauuuccaccucccaaguauuccucuuucuaaucauuuucguacugguaugcuaaagacauucucauauuggcaucuuaauugcuaccugaauuuacuagcaacuuuaagacccaaucugaaaguuaaaaacaucauaggcccaaguuucagacuguuucugagugaaucucuuuaguccuucucaguguucaugguguuaaugaaagcuuuaguuauuuucuacuuacguugcuagccuuuguuuccucuuguacugaccuccauccucccaauaucuguagacuggauugucuucugauuuuuaguucuguauguuucucuugcauuaaucaccccauuugaguaauuaaagugugaggaugcuagugugucuuuagcacugcugauucugcuuaacauucaauacuguuucuauuccauauucuauucucuauaguauuacauuccacugucuguauuuaugagaacauuugacaauauuccaguacauuauuuuuaaaaaugacuucuguuuuuccccacuuuuaucaacuuauucuugucuucagguacuauuauugcuuccucccucauugauauugucuuuaaaguucuuauagccuuccucuuuguuacugcuacuuuaagaugggaucuuaaaucauuuuccugauguucuugucgcuugcagcuaaagcuucuaaccuuuugcacaucauagcaguauacagagaaacuauuaauguuuauacagcacacuagauaugugguugaguguguucacacugcagguggcuaucucugggucuccucgcagcuucagacccugccuggcugcacaagaccagaacaaucagaacaccugcuaacuacucauacagaauggcaauuaggaagcucugccauucgugugcauguauacaauuuguauggguauacccucauguacacccauacaaauaguagcaugagcuauauuuauacauucuuauuggauuucugaauuaaauggaaaggaaacuucauguuuccacauacucauuagcuucucccuuaagagccuuuaauucagcgaauuuagugaaccaauaagaaaacaagauauaauuagaaugcauuuagcuuuuuaaaagcagaugaggcaaaauccugauugugauuuaaaaaccuuucgugcauuuugaguacaaagauuuugauaaacaaucaauaauuuuugcuauuuucugcacugaaaaggauauuucuuuuucuugugggaaauucacauacaaaucuuacucaauauaaccaaaauacuaagacgauacuuaaauuauacuuucuuuuccauuuaggauaagaaauaaaaacuuauacuuaagagauuucucauaucuuaacucacagagaaagcauaaacaaaaccccacuuuuuuucuuuuaccaucuggaucuucagcaggcugaaugcucauguacgguucuccuuucuccaugcgagauugucucugucgacuuucuuccucuaaagcagcuucugcacgacuuuuugcauuuauguaagcaagguacgcgggggaauuaugauaggccuucauagauucauuguacucuaucugaaauucaaauguuuuuugguuuuauaauuaacauuuugcagguuauaaugcagaccuauguuaucucacuugaauaucaaaagauaugauguaaacaggguguugggauaauuaucuccuuuuuacaggcaagaaaucugaggccuugagaaacugacuugacucagguagacagagccucaguacugcaucaguguucugaccaaaucuuauguuacuuuuauaaauaguaagccaauguuuuauguacuuuacacauuaucuaucccacugugagccccuacccuaccuuuucugcuucguauucguuuaaauauucuuguuuuucuucaucagugagaucucgccacaugccaccaauaaucuugccaaucucccacaacuuuaggucaggguuggaagccuuuacuuggucccagaccuuaaaaagaaaacagaugaaauguuaauacugaugucuaaacguauagaccuuuaaaaauaguuuuuaauguggaaacuuuucaacauacaaagcagagaaaacaguaucaaauuucuagguacucaucagccuacuucaaaaauuaucaagaacuggccaaucucaaguuaucuuugcccuacuggauuacuuuaagauagaucucagacaucacgucacucacuuauaaauacuucaauuugauaagcaagaauaucuccaaucacuacagacacuuaggaugaguuacuucaauaacauagucuacgucucuaaaaguucaugugaauuuagaagaaaagugcuuaauuugcauaacacgguacaucauauuaucaaauacaaauauaauagucaagaucaaaagguuuaacauuucuagauagugguuauaaugcucugccuuuuaauaaagauauuggcuacuuuuuuuauuuuaagaguaauguaggcucaucaccaaaaaaaaaaaaaaaaaaaggaaaacuugaggaaaagaaaauaaaaacuaccauaagcuuacugcuuagagauaauuauugucuucuguguuuucccccuucaaacuaacaugugguugcuauuauuuuuauaaaaaugagauauuaauucauguagucuugcaguccuccuucacuuaacauuuuccucacgucauuaaauauucuccaaaagaaaugacuuuaauggcuauagaacauucuaucuuaaggauuuuaacaguuuauuuaaucacgcuccucuuguuggauuuuaguucuggaauuuugaaaucagaacuaauugcuuuaaaaaccguauuuuuuuggaccuuuccucugaauaugcacagaaaagcuggcuaagccgaucuaaaguuggauguuaagcaaagaagcagcaaagacaguguccucacuccuuaccagguccuaagcaccuaccuuucugcuguaccucauguagggcaucagcggcuuaucugguggcuuuggggguuuuggaaucgugauaccagaggaugccuacgaaagaguuaaauacauucauuauucaacuguaaggaguucacuggcaaacugaaaagagagucccuuaaaaaauucuaaugcgccuuucuucuauucguccaaauauuuucuucacugaaaauagcuaucacugcaaauucagaaauguucaaaagaaaaugacuuuaagcacauaauuuuuaaauguuuuacuuagcaguuuauugccaaugcuuugacaaccuggcugcaagaacaaauaaaauauuacacaguaacccauacauugaaaauauaugguuauauaucaaccgucucaaguucaggacauuaccugguacccucuuauucugcucaauuaccauuacacauacagucaacacuugauuaucugcagcaggaucugaacccuuaacacuuaccauucucacacugucuacaggggccuuaaccuauuagcacuaggaauguacucccaacaccaccacaaaaacaacuucccagguucaaaaacaaaaacaauuagugaaauaacaaaccaccuuaccuccuuugccaggcuagagauuuuauuucucuuaagguucugucuguuaccuagugguuuucuuguaaaggggaaugagaagugugaauuaaaagucacacauuguuuuguccugaguccuaaucacaguguaaaagcaaacaaguuuaucaggaacagagaaguggcagauaucgggccugauuacguuauuuuugaggucuuauaucaagaagcuccauuccauuaaaaauguucaguuuuaugggaaagacagaggaaaaggaaagaugugauguacaggaaaagagagacagaagaaaaggaggcggagggaagacugaaaaauauuuuuuaaaaagguaaagcaaaaauaggugaaagaaaaaauaaaaaaagaaggaaagagaaagauaaagugaucaguuuuuccuguggcuuaaagucuaggugagauuccagacagccucugguagaccacccagauaacacccaucuaaaaguaucuauuucugaacuuuuuagucuccuguuaauauacaugacugcauuugauuaaagacccagaauaagaaaaaucauugcuauuucagacaauuugcaaauuuucaggagaucucugauauugacucucccugcuaggcuggagaaaugaaguguuggcuuuauuuuaauuaucgaaagacaggauuggcaaauccuuauaggaaaacuaaaguaacauuuuguucgcuuccccuucuguuguugcuaugauaaaaccccagagauacuccuccacucugggcugggaccccaaucauaaccuuauuuuucauuugagggcucagggauuagcauguuuguguccuuuuccacuaugaucaagaaauguuuccucuuccuacaagggucucucuccaucccuauaacucuacuucuucaaagcauuucgccuuggaagcaguauuuccucucuuuccauuccucccaugcauucuugucacaccucaugcuagugcccagguagacagacacuguuuuuggccagcaguggguaagagagugagauggccaggggcauggaaacugucaaaagugguaggaugggcagccaauacagggaaaccuguaucagggucuauaguucuuucaaggggaaagagaauuccuauaagacuaaccuuauggauucagaggaacagacacacacaagucugcuucuucacacauaaaguuacuagaaaguauuuccaacucauauccaacacaaaccuucagaauuccaugaaauggauuacaaauaaaguuggaauugugcccauaacugaggugguaagaccacugucaaaauuuuuugaaauuaaagagguaaagaauucuaaaaugccuaugcuuccgagcuuuaauaugaauuaaaacacuuuaaaaacacaguaguauuugcucuuugauauuuuucaaagaaucacauuuuauauuaauggaauugcuauuuccccuccuuucucccaaagaaagguacacaaaucaucuguauauugagaccagucaacuuacaacaacaacaacaaaaacccaaacuaaaaaaacaccccaaaacaauaauaaaguuaaauuccagaugguuuucaggauaguaaagauuuauaucauuacacaccuccaauuuauuuaacgucucagacagacaucuuucuacaaugucuuaaacauuucuuuaaaaaaagcugaacauacuuuagacccuuucuggauaagauucaauuagaaacaaccacuguuuugcugugcuguaacccucugucagaugucaaaaucuguuguugacucuuucaacggccuaggggcuaugcuuuuggagaauguguuuccauuuuugaacuguuucuuuccuugcuacuaucaggaaacccaccucuagcagcaacucucuuuccaauuuucugcuuucaauuuccaauggggaggcggguagaacugugcuuacagaagagcaagguccuaggaaaucuccuaugaauaaaguucaugguuuugugaaauuuaucuugguuacucaguuuuuuguuguuguuucuuuugcaauucucagcuguuucucuagcaagaacuuauuuaagagcuuucuucuggggcagaauuucuauuaauguacagaaauaggcuguuuuuaaagacauuuuugucucaauguguuuucacaccuguacuuaagagaauguuaaucaucaucugaaugaagaacugacuaggagugaauuccaucuuguagcuaucauaagcacuccaaaaggucucgacaugcuauacaaaguauuuacugucugagaacuacccaaguauacuggagucaucagggaaacccaauguucucuacagccuaccacaagcuacuggacagggcuucacagauucguuccuugaaaaccacuaaugcaaucugcgcacaacaauaccauacaggagcuuccccucacccccaaaaguaaugcauaacuagggucauaguaaaaucaaaaugcuuuuauuauggucaaaaucagagccauugaguccuaacagcuuaaacuagauauagaaagcagggcaaguaguguaaaaccuccacauuuucuaggcccuucuucauauagcaguuugauuauacuucaauuugguguuaagaggacaauaauacaaaguaaauguccacaaaggaccaaaacaccaaauuuuccauguccaacaacucucuauaauuaaucuacuauguagcuaguguccacgccaaauguucaguucuuaacauucgccaagaaggaaugggaagaaacagaugagugacuucagauagggaguacacuuucucuuccuagucuccaucgaacaaucucacuuuuuuaacugagaaucccccacagcuacauccaaguuaagagcaaaauacuuacacaaaaccaaaagacaaauuacuguaauauuauaguuaucauuucuauuccauuaacauagauaaucaagaggugacuguauagagcuauuaaaugcaaucauucuuguuuacugcccgugaaaaaauugcugcauuaacauuaagauccaugauugauuccguucauuguuuaaacugaaauguucuuuaucauuugaaaaccuugccauccauuacacuugugaaacaacauguuuaggccagggaaaaacauguauugaugcacauaaaaauuguaugcauugugaaaugcauacauacacacacuuugucagaauucuuuuucagauaccaugaaauaugcauggcacauaaaacuugauaugcuuaugaaguacauauuaugcagaaacaaugaaaaauuuagacaaacaaaaccuaucaagcuaagcaauaugcuuaucaagauagacauucauuugauagcuacaagcuuucaguuccagcuugacuacagggugagagggcuuuuuugaaguuacauuaauagaaggcacuuguuauuuaugaauacagcaaacaaaaaccagguauuaaaaacuuuacagccauucuggguuguauaaauucucaccaacacuacauuccaauguaguauuugacuuuuggauuuuuuaucuuuaguaagucauuuuuauaauuauuggcauuuuuuggugcuuaaacuuuuuugaaugaaauuuaagaugauucuaaacuaaaagauuugaaguguaucauccaauuuugauaucuuaggcugaucacuuaaaugaaacaugcuaaguuucagaaauccuaucucuuauacuaaggauuagaaaugcacuucucguuguacauaucuagucugauacuucaaauuaauuucauucaaccuucacucugcauuucuuugaggugacauuaaaacguuuuucucuuuuucacuguagagaaaugagucuuaguuagaaggucaacuacuaaauccaaaagacaaauaacuauggguagcgauucaaacugguguaccagccaaaagcuuuccagcccugaaaaagccaggucugaaagaccagccucuacuagaaacucaauccuugagacuaaugccaaucaccuuauaaaaaugaaaaauacucuuuaugucaaaaaggauauuuuuaccuuaagaaauucuguuuguuuacauacaguauaagcaucaagugcucaaggcuuuaacccuaccaaccaccaaacagaauggauuuuucuuuucuucuauauacauuccagaucucacuauuuauuuuuucagugugagaugcuacaacgaauguugaaaauacucaaaaagcuagguuaaaaaauuuuuuuuaaauggcugugcuuaugauucaaaaagaccuaauucugaaggcauuucuggucaauuccaguuguuugccggaugcuguaauaguugauucuccuaccgugacccggcuguuggugcccggguucccucccagccuguaguuguuguaggcgagaugacuguauggauuguaucccacaaacccuggugugcugggcauuugcugauggaaacaaaugagacaaaaacacgaaugagaaaugagcucaaacgaggaaaacacagaaaugaaaaaugaucugcauauggcaugcaaaagcaaccugaauuuaaacaagcaaugauguguuguaauuguucuuuuuuuccacugaggaaauuaaauauuuuucuuucauugagaaaccugucugcagugucuuuugguuguuuuucucuuucuuuuuugcaggggcuggggguguuugugugacugugaauguguguuuuguuuuuugagguaagcaacacacugaaguguuuaaaacauucaggauuacuuuauggucaacaauaggauaaaacaacuuagcaauauaugaagacugaaauaggaaggcuugaagugugaucaacuagaacucugaaaacacuacaugcaaaacaaaauacaauuuauuugacauguggaugccaccaauguauuuaucuacuaaaaacaaaaaaaagaaauggaucugauuucaacgacaguuuuaaaucauuuuauauaaugugagaaaugaguagagacucaaaucgggaagccaggauuugucaauugaaaagaacauauguuggauuugauggaugucacauacaugauuuaaaacaaagacuuguaagaaaugcauggauuucauucugggguacuaucugaucuuuuuaacccagucauucuuuuauaggauuucucuuccauuucuucuuugauccaucuuccacuggucaaucaugaaaacauuucugcauuuugucucaaugugaacuacuuuucuaguuuauagacuucuuuuuucaucuaguuuccugauagcucucacccuuucaaaauacaacugcucauuucagcaacagaacccuugguuuuugugaauuauguguugauguaaucacaaaugggcucuuauauagcaguagccuuggggcuaauacaaugacacucaauguucaugagaaccaaggcauaaugcauagaaagaauauaguagagagagaccaaaauuaggguauuuuaccuuguaaaauucaaucaaaauaugugacaauuucauuuuuacaugcaauuaacaauaucgguccuuaauuguauaauguaaaauacacuuaacacauuccaacuaagcuguagcuguuacaaaauaaacacaauuuccuaaaacaugccgcugcacauauccuuaguacccaaaagaaagacauuuaagcagauauuacauuugauacucuuuaggagaaaagagaacggcugaucaauuucuagucuauacaguuagaaaagacgcaaauaaagcauauuuaaguaggcaaaacacaguugaaguaucaaaggcaugaaagaaguguauauuacuugcagcgguacauuuggguggcagaggugauaguggugauaguguugguagugguggugaugguggugguggugguagaaguaauggaaagaaaaaaggaagaagaauaauucauuuaguauccauucuguuggauguuuuaaucccuagucuucuauauuuuguguguuaaugugaaacuauaaugacacaaaaauauaacuaaagaaaggcaaaaaaaauuccuuuuuaugcauaauaaauuauaaggggacacuugguuuuugaaauauuuuaaucucaaaaaaucaaguuugucaagaugaugcauugucagaggcaguauuuuugucaaaaugacaccuucaaagguagcauaaauaauaagaaucacuguucaacauuaugaggcaauaauguuauaaaaauaagggaacuaaaaaaaaaaaaauggaaagcaaaacauuauaauuauaccauuuccaaagcugaaguacaugguuagcucuuugaggucagaaucucaauuguucagcuccaccuguauagccacuagcagaaugccauggagauggucauaacaaauguucuucgauuuaagaaagaaaacaaagcaagcauaggacuuuauagucuacuggaauuaacuuuagagccuguauaugacauaaauugaaaugagaacauaugguacgguaucucuuuucuaaaguaucucacuaaagaaaaacaaauuguugauaaauguaacuaaaauauguaucugaggguuaguaaauaugaguaguuuuuuagcggagaaaacuaaguuacacaaggaccuaauuaguagugaaaaguagacuagccugaaauuuaggugguggggguauggaaggaaggauuaauauuaaagaacuaauuuuguagaauuuggucaugcuaacaguguuuuuuuaaaaacaaacaaaacccccccucccaaaaaaccaacaaggaagccauuucagcaagaccugaacaguuacugcuaaaucuguuuuguggguuggaaaauuauuuuacaugcugaccaagcugggccagagcuuccugggugaaaaaacacguucacaacuacuuaaaacauauauacuuccaaaccaauaaaauauaauuuauggaguggaauaagauucaauagcaagaucugccccauagauaaugaaaucuuuacuugaacagcuugaaaauauuuacaaugaguaguuucagaagcuuuauuguuuaauaugaaaauuuuagagagagacaagaaaggagagaaaaacauaaccaguugaagguuagguuuaacaaaauagccagaaugagcauucacucaguaacaacuuaaagacucuuaauagugaagauuaauaagaaagaaaugguaaaacuuucacuuauuucccauuuacaaagaaaaaacaaaacaaacugagcacaggagguuggaguuuuacaguacuguuucuuuaaauguugggguugguucaaggaaagaugcaaauaauuauuuuauuuaguaggaagugcuuuuuuuuuuuucuuuuaagcugaauuucauccuguugcugugaugauugagugacugucacuggaagacaucuggguuuuuguaucaaggccagaguuggcuauuacauuaacaagaaaauuaaaacuuacuguugcaggagcuggggugggagguggggcauaagauggucuuucuguuugaaagaaaauaaauaacuucuuguaaacaacugagauauaauacuaugcaacaaaacuaccaaugguccuguuuugaagaaaaaaaaaugagaguauuuuggaauucccacuugcuagggcauuagucucuuauuaacauagauugauaaauauaaaaauugaaacuuacuugacauuuuggaagauuaaguucucaguuccuuaagaaugaaucugagacacuaaaauaaaaaaaaaaggaaaaaaaaaagagaaucaaaacucagcaagcauacgagaauguuuuccuaaugaauaggguaauuuaauugguauuucugaguaaaauuacuucaccuuaauuccuaguaauuaagccuuuuguguauuuuaacuaguucuuauaggucauuugguugauuagaauuaaaugacuaaaauaaaguacuggggauauuuagaaauguacuuucagguuuuuucuugugauacuaagcuaccucuuguauggaaaacauuuugcugacgccauguaaacauuucaucagacugauacaaggaugagaauagaaagugauguauuaucaggguccaacgcaacaaggccuaccagauacugacagcucccugaucagcaacuguaucaugcuuuugggauaacaauuuuuauuaaaauuaggcagcauuuuauuccuggaagcagugcaaaagguaauugguaugacaaugaacuucacauucucuuauaaugguaaauagcuucauaaaugcugggaauaaauuuugagagucuaccugaaaaacuuuuauucaucauucacagcccauuucaaaauuuuucuccucaagggaacuuucuugauacauuaccugggcagaauuaacugcucccccaucuguauuccuauacaguuuacacagaucuauauuauuauaacuuuuuuuuaacuuaucaauauggcuagauuguaugcuacuuggaaagagggaccaugucaggaccuagcucaauucuuaggaaauuuuuuccuaguauuaccagcucacaacauaaccaggcacaugugagcuuguucuuuacaucaacauacaucacaaauagugagguacaaaaagacaaaaauucaucuuuggaaagaaggcaaauaaacuucuaugacuauuggagguauuugcaaccaaacauguggaauagaucugauuuuucgcuucuauuauuaauuuuaaggaaauucccuggagcauaaggaaugaguccugguguggaaagaaacagcucauuuucucaaugguccaaccugagucuuucccucuuaaagaacagccagaaaccuuugacucugguguagauuuccuuucugcucacauuaagggagcugucaacauccagcaggccucgcugcaggggacccugacaacuaacauaagcucccuguacguuauacuucauuguuaauacuuuaaaauuauugcucucuuuugcuagaauacaaaauuuaagagugggcuuguacauuuguccaccguuggauccaucuuuggugccuggcauaaaaauaaauacccgauaaauauuuguucaagaaauacuuuauacgggguacgcuuaugacacuauuucgcuuaacacucacaaguacuuuauauguacagcuauccccauuuuacagaugaaacaagggagucucggaaaguuuaaacaacuugucugaagccauaugcagccaggaagugccaaaguuggguuucaaacccaggccaaacuauuucagagcucugcucguccucaagucgcugccugaaccaaugggggaaccuucugcccggguggggggugaaccacggaccugccuugcccacggcuuccugaggucgcucucuuugucuuggagaauguacuuuacuagcaacuccccuaaaacgggguauucacaggugcuuugaccaauuucgggggacuggccuugccuccaaggagggggccccagaugggacucccucccaacccucgcucugcuaggccucaaggaggccucaaccggcuccuggcucuggccccacggccaaggcugaaccccagcaacccccgggaacucggggucuagccaagcggggacaccacgacuugcacccaccgacccgguccgucccacuuggaaacacucacccgcgggcagaaaaagcgcccgcagcuccggcuucgcuucccuuugucccgcgcucgccccgccccucgcguccggagcuuccgcacucgcacuuuccacacucuucuuaauuuuuuuuuuuuuccgggccccacccgacccucuuuagaaaaacuaaccuucuagugaagaugcggugaugcuuagcacacucagggauuuuuuucaggacccauuggauccucaaaacuccccgaauuuugauacuuucccagccgggcgcugauucgucacggcgaagagggccgaggaggcccgaccuaacacagaauaggccuggguuuagcggcugugaggagccggagccgccgcagcgaccgaggaaguggcgggaggugccgagccuugcggaggggcggugggggccgcggugggagacggcggauggcgcucagcgcgaggccgcggaaccacuguggcagcaagcaguucggccagacucccgcugagcccgcuccuggaggggcccuccccgacuccggucuugcuuuccuuuaggcugugggucagagucuacacuucacuaaaccugggauggaggcguggaggacuugcuucgcggcguuugcguccucgcaggcgccucgcagggcuuccugcccucacggcgggggaguagcuuuggcgaaaaucagcacgaguucugcaguuuuuccaagcgcuuuuaggguguaaucgucccagguuucuaagccaaggcccggagaguugacccccucgcaacagcuuguguguccuugcagcgccgcgggugccaccuggucuccgccucagcgcugccucggcuccuucgguucccaccagcgggaacgaccguccccacuuucagcuuaaacucaucuguccuucuggauccagcucagaggucucuuugugaugcccuccuggaacuuccccccuaguaauccuuccuuuguauucccguggcucuuugauaauaaugguuggaguccugaacccgacccuuuguaucggaccguguuugucaucuccagugcuuuaugaaggccuugaaagcaagguucagccgucuguauuggucaucuucc

SEQ ID NO: 16832 - RNA, 2022 nt, Homo sapiens
cgaccuucuguuucugccaaggaggcuuccagggauuguuucugaaacggauuuuuuuguggcuuagugacuuccuuguucaguugaguauggugacgcuuauuugauuauuuaguaaggcauuauauagaagaauaagaaaaugaacagaauuuguuguauguuuaauggcaccauuucaguuucagcacuuuuagaucaacacuaguaguacuuuuccuccauuaacaugagcuucacuuuguuuucucuuucuuaccuccaacucugcauuuuuuuguugcauugcauauucuuaggugagcaugaaacuuuguaugauaaaguugaagucauuucaugagaguuaacauaccaaggccaguugggacuguaguucuaucuccagagcuuguacauuacgucucaauucaguaaucucagauuuauagcuggauaucuguucaauguuauuaucaauuucuguagucaguuccuugcucuagaguauuaaaaacaaggaaaagggugaggaaauucugaaaugauaaaaccuccaugaguuucacuauaaggaagauuacuuuaccuuuucauugaaccaggcuucagcaucuuugcgguuuuguucagcaaguuguucauauuggcuucucauguuauucagaaguugagucagaucaacacccggggcagcauucauuuccacauucacaucaccaguggacacauuucgaaggucuuucauuuccuguuugaggaacagaaagauuuauuggcuacacgaggaccauaaugaacucucuuuuggcugggaaaaguauaacuuuugugucaccuccucgugguucuucuucagauaggccagcucuucagucaggcucucaauuugcaucuccaggucagccuuggucagggucagcucauccagcacccuacgcaggccguugaugucagccuccacgcucuggcgcagagcuaccucauucucauaccugaaacaagcaugauaucaauacugguuauaacuuauauaggggagauguaucugggcagagacuauuuaaaaagcagcuacauaguugaucucauguaauggcaauauuugucauguacaguucucuuagaaguaauagugguuuaauggaaaaaaccuuagcaguuacuuuaaaaugcauuuucuuccuuuaauauugccaaaaagguaacacugacauggaaaauuucucagauaacuccaauacuauuuaacuuugggugaauucagaaaaauguaaauguuauugagggcaucccaagucauuguuaaaaaccacugauguauucguugugauaguauuauacaacgaucacuuaacuuacuucagccugaagucaucagcugccagccuggcauugucgaucugaagcaggauguuggcauuaucaguuguuagguugagaaucuggagggagaggcacaguuauuugagaagaggucagaugcagauauggcuuuuguagugacauagaugcacucugcacuuuuauguuguucucuuacaaaaucuugggaaaauuuuuuauuuuaaauaugaaauauugcaggcuuacccauauacuuaacuuugaauuauuuguucucuuggaauuucuccagucuuguauuucuguacacgaauuauuccuuucugaaaacuaacuggaauuauauagauguauuccuguaagugugcccuccucuuuuagacuaugugauuuccauguauuucagccaugcuuuggcugacucacaccugcauuuguuuaacucaugauaaauacuaauaaauaaauacacucugaacugguacacaauagguacaauucagaaauuccuuagaggcaagcagugucccauuuucauacuggaaaauuuauuuuucuugccauguugguacugaauauggcuuguuaucagucugaauaacauuuuguucugauucauaucaugauuuuuuuuuucaguuucuacauuuguaaauagccuagcauauuuuaacuguggacucauuguaugcucau

SEQ ID NO: 16833 - RNA, 2022 nt, Homo sapiens
augagcauacaaugaguccacaguuaaaauaugcuaggcuauuuacaaauguagaaacugaaaaaaaaaaucaugauaugaaucagaacaaaauguuauucagacugauaacaagccauauucaguaccaacauggcaagaaaaauaaauuuuccaguaugaaaaugggacacugcuugccucuaaggaauuucugaauuguaccuauuguguaccaguucagaguguauuuauuuauuaguauuuaucaugaguuaaacaaaugcaggugugagucagccaaagcauggcugaaauacauggaaaucacauagucuaaaagaggagggcacacuuacaggaauacaucuauauaauuccaguuaguuuucagaaaggaauaauucguguacagaaauacaagacuggagaaauuccaagagaacaaauaauucaaaguuaaguauauggguaagccugcaauauuucauauuuaaaauaaaaaauuuucccaagauuuuguaagagaacaacauaaaagugcagagugcaucuaugucacuacaaaagccauaucugcaucugaccucuucucaaauaacugugccucucccuccagauucucaaccuaacaacugauaaugccaacauccugcuucagaucgacaaugccaggcuggcagcugaugacuucaggcugaaguaaguuaagugaucguuguauaauacuaucacaacgaauacaucagugguuuuuaacaaugacuugggaugcccucaauaacauuuacauuuuucugaauucacccaaaguuaaauaguauuggaguuaucugagaaauuuuccaugucaguguuaccuuuuuggcaauauuaaaggaagaaaaugcauuuuaaaguaacugcuaagguuuuuuccauuaaaccacuauuacuucuaagagaacuguacaugacaaauauugccauuacaugagaucaacuauguagcugcuuuuuaaauagucucugcccagauacaucuccccuauauaaguuauaaccaguauugauaucaugcuuguuucagguaugagaaugagguagcucugcgccagagcguggaggcugacaucaacggccugcguagggugcuggaugagcugacccugaccaaggcugaccuggagaugcaaauugagagccugacugaagagcuggccuaucugaagaagaaccacgaggaggugacacaaaaguuauacuuuucccagccaaaagagaguucauuaugguccucguguagccaauaaaucuuucuguuccucaaacaggaaaugaaagaccuucgaaauguguccacuggugaugugaauguggaaaugaaugcugccccggguguugaucugacucaacuucugaauaacaugagaagccaauaugaacaacuugcugaacaaaaccgcaaagaugcugaagccugguucaaugaaaagguaaaguaaucuuccuuauagugaaacucauggagguuuuaucauuucagaauuuccucacccuuuuccuuguuuuuaauacucuagagcaaggaacugacuacagaaauugauaauaacauugaacagauauccagcuauaaaucugagauuacugaauugagacguaauguacaagcucuggagauagaacuacagucccaacuggccuugguauguuaacucucaugaaaugacuucaacuuuaucauacaaaguuucaugcucaccuaagaauaugcaaugcaacaaaaaaaugcagaguuggagguaagaaagagaaaacaaagugaagcucauguuaauggaggaaaaguacuacuaguguugaucuaaaagugcugaaacugaaauggugccauuaaacauacaacaaauucuguucauuuucuuauucuucuauauaaugccuuacuaaauaaucaaauaagcgucaccauacucaacugaacaaggaagucacuaagccacaaaaaaauccguuucagaaacaaucccuggaagccuccuuggcagaaacagaaggucg

SEQ ID NO: 16834 - RNA, 959 nt, Homo sapiens
caaacucagaaaccucucuuaacacagcucucaacccaacuccugacaccauggccagcuguuccaccagugggaccuguggcuccagcugcugccagccaagcugcugugaaacuagcugcugccagccaagcugcugccagaccagcuccugcggaaccggcuguggcauuggugguggcauuggcuauggccaggagggcagcgguggaucugugagcacccguaucagguggugccacccagauugccacguggagggcaccugccugccccccugcuaccugguaagcugcacacccccauccugcugccagcugcaccacgccgaggccuccugcugccgcccguccuacuguggacaguccugcugccgcccagccugcugcugccacugcugugagcccaccugcuaaaagccagguugcugaucgcuuaagaaugaaaggggaagcacagcaaaauugugcugauuucugaagaacuguucgauuuuacuuggaugcuaaguaccaugauguuguuaagcugcucagagauaaugaaacuccuaguuaggacacuguggaugugccgaauucacuuacugaaagauguaucaaucaguguucuggauagcuugcguugcuugagcagaggaccaggauggaauaguucaucauuucagugacaucucugcucccccaacucucucuugaugcucaugcaucuucagaccugguuuuuccuugaauaucucugauuaauccaaauaaaauguuuuaaugugcaaagcaaacugaguuauguccuccuucuaccuuuaaacaugucuucuuguagcugguauucaagaguggauuugcaauuugauaauaauaccaaggcauaaccauaaagucuaaaccagaaagauuaaauacaaaguaaauuaugcuugaauccaucagcuuaaaaaugcuccaugaauuaaagaauuu

SEQ ID NO: 16835 - RNA, 2866 nt, Homo sapiens
gggcgcuuggggcacgacgcuguggguggggucaggacgugagggcagcgcgcuggcgucagaggcgcggcuauauaacuaaacacaggcaccgccccucugccccagucacugagccgccgccgaggauucagcagccucccccuugagcccccucgcuucccgacguuccguuccccccugcccgccuucucccgccaccgccgccgccgccuuccgcaggccguuuccaccgaggaaaaggaaucguaucguauguccgcuauccagaaccuccacucuuucgguaagcuaugggaaaggucgcgggcccggguggggcagcggggccuuccgggcccggagacguguuccgggaaguugccaagcgcuccgggccuucguaagcucgggcaggggaaacuugaccagggucgcagggcagcgggaucaaggccugggccccggggucggacccugagcgcgaccggaaggagcaggcgguaggucagcccuugggcgggcccggcgucucaguggcgcauuuacuaauggcuccugggccuccucgggccacacccgccccucccgucaccauugcgucacguccguuacgucaccacccguugucacggauccggagggaaaggcggugccagcccuaaguggcaagcgggugcaccaaugggggugggaggcuuagccccgccucgggagcucggguuccggcggguugcaucagcuggguggggcaccgccuggcagcccggacucccccgacaugugaucggcuucccagggagggcgggaggcccgggcguuccccgagccuggggaagcuggccgucccggacugaccugcucggggagagccagcaaaggacacauucggccuggcccaagcccugacgauuucaguguuguuuucugcacgcgcaaaacaccuggggaccgaggggauggcaguggcauccuaucuuugacagcucugaacgagcuuaaccuuuuuuuucagaccccuuugcugaugcaaguaagggugaugaccugcuuccugcuggcacugaggauuauauccauauaagaauucaacagagaaacggcaggaagacccuuacuacuguccaagggaucgcugaugauuacgauaaaaagaaacuagugaaggcguuuaagaaaguaggucuucagugagauuuugggaaagucauaauggauuuguccacaagggggugccagcuguguuguauguauuguuagcggaaggggugauaaaugcguucaugcucuugcuaggccuaauucguuuuccuuugugcuugcagaaguuugccugcaaugguacuguaauugagcauccggaauauggagaaguaauucagcuacagggugaccaacgcaagaacauaugccaguuccucguagaggugaguucagucacuacuugauuugugccucucugcuggcaaaucucagauccugucuguuagcuucugcuggggacauaaaaguuggcuuuguaaggcugagcaaaaccucaguuggguuuuaaaguacauagacuuauuucuguuuuauaggaaaaagcagaagggacuugucuaccuuugguuuacuguuucuguggaucuacuucacagaugcaaauuugaauagcauauagaugcauuguaaaauaagccaaaugcuggguuguuccuguauuuguaaggacaugaguuuuuaaaaaugaauuuccugaguauuaauacuaaaauacuguuacaugaucagcucuugauauaauugaagagauuucagauaccugaugagucucauucucacacuaauucagaaccuuggaaggcacugaguguucaaaaaagguagcucuuaacugaggacccucuguugaaccauugugcgcaccccuggcucuugggcaguguaguagcaggaagacaggguuguugccauuagaaauggaggcuuuaacucucccugucccccauuuaaaacuuugcccuuuugucuuuucagauuggacuggcuaaggacgaucagcugaagguucauggguuuuaagugcuuguggcucacugaagcuuaagugaggauuuccuugcaaugaguagaauuucccuucucucccuugucacagguuuaaaaaccucacagcuuguauaauguaaccauuugggguccgcuuuuaacuuggacuaguguaacuccuucaugcaauaaacugaaaagagccaugcugucuagucuugaagucccucauuuaaacagaggucaagcaauaggcgccuggcagugucaagccugaaaccaagcaauaccgucauguuucagccaagcccagagcccuaagauuacaaacaacuauggccggaaccuccucagcucucccucugcagaguucccuacccuaagagaauguuaccaccugaacaguccucggugaaucugagaggagaggaugggguaaggcagaagcaccagcuguacuacuagaagggagcuuuuggugguagauccccuggugucuccaaccugacuagguggacagagcucaaagaggcccucuuaccgcuagcgaggugauaggacaucuggcuugccacaaaggucuguucgaccagacauauccuagcuaagggauguccaaacaucagaaugugaggccaaccuucuaucagaguuaaacuuuugacaagggaacaaaucucaaacugauccaucagucauguagcuagcuguagagcuugcaacuuaauagcagcagcugcccaaugccaugugaaguaacaaacugguuuuugguuuuuuuuuccccuucaguuuuaauguuauguguaauguauuuaaacccuuauuuaaauaaaacuuguuuucagaaauaccu

SEQ ID NO: 16836 - RNA, 12053 nt, Homo sapiens
cggcggcuggcgcagguuauaaaggucccgccgcagcagcggacggcagacucgagaugcgcccgaagagguugggccggugcugcgcggggagccggcucggacccggggacccagcagcacucaccugugcaccuucgcccucagccagucccgcuccggagcccucugcgcagccgcaggcacggggcacuggacagagaguaggaucccgagccaccucuggaucccaguuccucucggaagcccgcaccggagcucgcccggccucggaggcuggagccaaggcaggagcccggcgcccguccgcauucucggccauccaaggggauguccggucuaugcccgacaauucggacgcgccguggacccgcuucguauuccaagggccguuugguucccgggccacuggccgggggacuggaaaggcagcgggcaucuggaagacgccagccgccuacguuggccggcgacccgggguguccggcccugagcgcgccgccuuuauucgggagcuggaggaagguaaaucgggcccccgggguccuggaccggguggggacuggggcaacuccagggaggaaguggccccaucggguccaggcaccccgcccccucuagcacucagugucacccguccaccacccccgcgaugucacugcggugucugucuggucgccccuucuccaucuccuccucugcucuuguccccugguuugugcccgugagucagguucuggggccugcacgcucgcccacccaccuccacgcgccucuugcugcggcagaucugcaccccuucagcgccccucuccugggucuaccgcagugccaggagaggggcggggggcugcgggagggcgcugucccgcgcgcucugagucugcgcuggccgaccgggcuugcgugcgauggaggggugggugggcgggcggagggggaaguuuugcccacuuuuugguugcggguaugggggcaaagucgcgcucuuuuccugccccuugucucuccuauccuccugcgggucgggggagaucucuggauugggccuagaggcucgagugucuccuaaucuggugaagucuuccuccuguccucugcacacgcaacaggugcagggugaguggcugcgucuguuuguaugacccaggagacuccauugcacugccuccuggguagggggugaugagccagucugaggcuguacuuccccuggcugucuccauucuaggcgccagggacccagguguccggagagcccaguuucugagccuggaggacugugacccccuuaccucaggcuccuccagggguaaaaaaaaaaaaaaaaaaaaaaaagccgggcgcgguggcugacgccuguaaucccagccagcacuuuggcaggccgaggcgggcggaucacuaggucaggaguucgagaccagccuggccaacauggugaaaccccgucucuacuaaaaauacaaaaauaagcugggcgugguggcgggcguguauaaccccagcuacucgggagguugaggcaggagaauugcuugaaucugggaggcagacguugcagugagcugagaucucgccaucgcacuccagccuggaggacaagagcaaggcuuugucuaaaaaaaaaaaaaaaccaaaaaaaaaaaaaaccaaaaaaaacccaaaaaccuaaaaacccuguccacuuggcccugggagcagggaagggaguguugagugccgagggguaaggggaggauguggggggcaggaggggagcccagucuucucucccgaugacccuuguuggagaacugacgauaggacgggaaacagcuguuugcugguagcaucugcuccuuuuuccugaccuggcugggccuuuucuccccaccugccgccuccugcagcacuguguccuaaccuaccuccgccagucaaaaagaucacccaggaagacgucaaagugauguuauauuugcuggaggagguguguacugccuuccugauccaggcaagcccuuauucuaguuuuguccuguaggggugggggucuuguuuauuuccugauuggcagucucucuggggccccagguuaggguccuucuuauggaagacaggucgaugugggauguucaggcuggaagagcucucagagccaaucuggucugaucuucuuuuuccaugaggggaaacugagccagguuccacaguggguuaauggcagacucuggucugguacccuagagaacuaggggauggggaagguucucuuaggggccuagccucucucugaccccugugucccccccagcuucucccaccugucugggagagcguuaccuaugggaugguccugcagagagagagggaccugaacacugcagcucgcaucggccagucccuggugaaacagaacaguguuuugauggaggagaacagcaagcuggaagcccugcugggcucagccaaggaggagguaaccggguggggaggagaggauagcgggccaaucuacaccugccucaugccaggacccucuccugucccugcccacucccaacccauggcuccucucucuuccugccagauuuuauaccucagacaccaggugaacuugcgggaugagcuccuccagcucuacucagauucugaugaggaggaugaggaugaagaagaggaggaggaagaaaaggaggcagaagaggaacaggaagaagaagaagcagaggaagaccugcagugugcucaucccugugaugccccuaagcugugaguuccugccuuugcaccugcaaguccuuucucugagccucaauuuccucauuuguuaagagggacacaggugaugugcuugcuggcaggguugcuggaacuaauugagaacacugcccuuagcccuggugggcugggaacugggaagccccacucccugcacccugacucccauuccucccuccccuaggauuucgcaggaggcauugcugcaccagcaccacugcccacagcuggaagccuugcaggagaagcugaggcugcuggaggaggagaaucaucagcugagagaagaggugagaaugggggaggagggcgucccugcuagcaggggguguugacuucccugucccuuccucuuugucucccuccaggccucucaacucgacacucuugaggaugaggaacagaugcucauucuggaguguguggagcaguuuuguacguaauguugucacucggggugggggguugucccaaggagcagagaaaagaacucaagauguggaguauggagauccaaguucaagucccagaucuggcacuccuagcugugugaacuuggauacauuccuugaccucucugaaccuuugucuuuagaauggggauuaauuuucucagccccacugaucucuccaggguuuaugaagauuaagagugucaacagcugaggaaguacuuugugcaaacuauaaagagcuauacagaaauugugggucucaggccaggcacgguggcucaugccuguaaucccaacaguuugggaggcugaggccggcggaucaccugaggucaggaguuugagaccagccuaaccaacuuagagaaacccuaucucuacuaaaaauacaaaaauuagccagaugcaguggcacaagccuguagucccagcuccuugggaggcugaggugggagaauugcuugaaccugggagacagaguuugcagugagccuagaucacgccacugcaccccagccugggcgacagagcaagacuccaucucaaaaaaaaaaaaaggugggucuccuccaagccugucuucucuuauuuggggcaggcaagagggagccaugagcugccagagaccaggcacccagggcugggacaguucagagucaugcacggggcaguggcugugccuggcaucguccuaggcacuguguguuuaugaagaugagugaggagcaguguuugugccugaggaguucaaguguagcuggugagaugcaaacgcaaaguggcaacagcugaacuccugcuguucccuuuaccccagaacugaccuuccuuccugcuggguucugcaacucccugaauggccccacugguccccaggcuacuggaguaggaaccaguccccaagcucuguugcuuuuaccuccuaggaauggcuuaagucuuuuucccccuccccacucgggcugccucuagcccaagauaccucuuaacuggucgcacugccucuacucgcgcccuaccaggaacuucugcacacagccuuaaugaguuuucuaaaaccaaaccuggccaggugcaggggcucccaccuguggucccagcuacucaggaggcugaggugggaggauugcuugagccugugaauucugggcuguaguacacuaugccgacagggucaguaugguccagggaguggaguaccacuggguugccugaggaggggugaacuggcucaggucagaaacagagcaggucaaaacucccaugcugaucaguaauaggaucgcaccuaugaauagccacuguacuccagccccagccugggaaccuggcaagaccucauuuuuucuuucuuucuuucuuuucuuuucuuuucuuuucuuuucuuuucuuuucuuucuuuucuuucuuuucuuccuucucucucucucucucucucucuuucuuucuuuuuuuuuuugagauggaguacaguguugcagucuuggcucacugcaaccccugccuccuggguucaagugauucuccugccucagcuuccugaguagcugggacuacuggugugugccaucacgccuggcaaauuuuuuuuuuuuuuuuuuuuugacggagucucacugucgcccagcuagagcaaugucaugaucucagcucacugcaaccuccgccucccagguucaagugauucuccugccucagccuccugaguagcugggauuacaggccugugcuaccgugcccagcuaauuuuuguauuuuuaguagagaugggguuucaccauguuggccagguuggucuugaauuccugaccucaagugauccucccgccuuggccucccgcagugcuaggauuacaggugugagccaccacgcccggccaagaccgcauuuccuuuuuuuuuuuuuuuuuuuuuuuuuuuuuugagaaggaggcucccucuguaacccaggcuggagugcagugguguggucuuugcucacugcaaccuccaccucccgaguuuaagcgauucuccugccucagccucccgaguagcugggauuacaggcaugcgccaccaugcacagcuaauuuugguauuuuuaguagagaugggguuucaccauguugggcaagcugguguugaaauccugaccucaagcgauccaucccccucagccucccaaagcgcugagauuacaggcaugagccacugugccugucccaagaccucauuucuuaaaaaacaaguagccgggugcaguggcucaccccuguaaucccagcacuuugggaggcagaggcagguggaucucuugaggucaggaguuugagaccagccuggccaacauggugaaaccccgucucuacuaaaaauacaaaaauuaacugggcgugguggcgcaugccuguaaucccaaguacucgggaggcugaggcaggaaaaucgcuuggacucgggcggcaguuacagugagccaagauugcacuauugcacuccugccuggacgacagagauucggucucaaauaaauaaauaaauaaaccaacaaacccaagucugaccacgucauuacugugccuaaaacucccaaauagcuuuccauuggccaaaggauaaaccccacccccuugcccacuacuguggucuggccugugugcacuguucugggcccuccccgucccagugucuuaugauggccucugggccuuuccagucagcuuggacccauguuuuuccuucuuugccugggugagcuucacuugcccuguggucuuagcuuagugguuccuuuuuccaggaauccuuccuuaccuugcaggucggguugggugcuguagcugugaugccccugcccuguacacccuugacauuugcccaucauggccuguaugaugugugacuguggucugucuccccaccaacuuuaccucaguguggcggcugggucuuacugaccacucacccuggugcccugcucaguaucagucaaugaacauuucuugaauggaagaccugagugaggaaugcaaagcccugcaggacccacuggcacagcgcagcagccgagggugggggagacagaggcaucugggagggccagagcuggucccugaaggccaggggagccagggcugaccuguccucugcccuccccagcggaggccagccaacagauggcugagcugucggaggugcuggugcucaggcuggaaaacuaugaacggcagcagcaggaggucgcucggcugcaggcccaggugcugaagcugcagcagcgcugccggauggugagucggguguguguggaacccucuugucguggccccaugggacccuagcuuccuucuuccugccuccacucggcuccaccaggccugaggucccuuucugugucagagucagagaccucagagagccccuuaucuugaccccuuguuaucuugaggagaccaaggcccagagaggguccuggagucuucuaggaaccaggcugcgugacuccccugccuucuuugcccuccuuccgugugacuugucauuucaugggcugccaaggacucacugaugugccugggaagacuugcuggaagcagggggugcccugaguggguaggccucagauggggguucacugguuuuggguccuuccaguauggggcugagacugaaaaguugcagaagcagcuggcuucggagaaggaaauccagaugcagcuccaggaagaggugagucucgcugccggcuucugcccccacccuggagagccgcuggcccagaguggggaccccaggcccuuggcagcuaccugacucuggagaggacuagcaggaacugagucuuguccguuuccacccccuccaugccuggcacagcccagcaggugacaguuccaucaaggucugagugguguggagugcagggaccugcccugggucccccacaugacacuuggaguccagaaccugggccucuggccucagccugagagcagauaggcaggagugcuggacugggugugccugggucccagcagagcguguggguggguucccagcugcaggaccugcgggagaaguacauggauugugggggcaugcugauugagaugcaggaggaggugaagacccuccgccagcaacccccaguguccacugggucugccacccauuacccauacagcgugccucuggugaggacccuccccuggcugcccacuuuccuacgucugugccugugucucagccuugguggcugauugagaucccaguucccuucugugccugagccuauggguggggguucuguggggguccucugguaacgucuguucucuccaccauaggagacucuuccugguuuccaggagacgcuggcugaggagcucagaacgucucuaaggaggaugaucucagacccuguguauuuuauggagaggugcguggcuggggcccucccuugccccauaggccauggccuuuccuguaguggggaggggguuugcccucacacucugaccuuccacgcuucccuauacccgccucguucacugcaucagccccuccacucauugcuucucuaugaauauggacccaucacuucccccugagguauuuuuuuuuuuuuugagauggagucuugcucugucacccaagcuggagugcaaugguaugaucuuggcucacugcaaccucugccucccagguucaagcaauucuccugcuucagccuuccgaguagcugggauuacaggcaugugccaucacgcccggcuacuuuuuguauuuuuaguagagacacaguuucacccuguuggccaggcuggucucaagcuccugaccucaggugaucugcccgccucagccucccaaagugcugggauuacaggcgugagccaucaugcccagccugagguuuuuuuuuuuuuuugagacgagucucacucugucaccuggacuggagugcaguggcgagaucuuggcucacugcaaccuccaucuccuggguucaagcgagucuccugccucagccuuccaaguaguugggacuacaggcacgagccuggcuaauuuuuuuuuuguuuuuugagauggagucuuguuuuguuguccagguuggcgugaucucggcuuacugcaaccuccgccuccuggguucaagcgauucuccuaccucagccuccugaguagcugggacuacagguggccaucaccacgcccggcuaauuuuuguauuuuuaguagagaugggccaguagagauguuggccaggcuagucuugaacuccugaccuugugauccacccgccugggccucucaaaguguugggauuauaggcgugagccacugcaccuggccaagcccagcuaauuuuuguaguuuuaguagagacgggguuuuaccauguuggcuaggcuggucuugaacuccugaccucaggugaccugcccaccucggccucccaaagugcugggauuacaggcgugagccacugcucauggccacuaccuaagguucuucagcuugaccaagccccagggacugcaguuucggcuuccauugucucauaaugaagguccuuuucucuuugaaggaauuaugagaugcccagaggggacacauccagccuaagguaagccugccaggggcuccccuacaaccugcccucagcuuucagcagccagacagcccaccugccucugguucugccacccugcaacuccggagaaggcccugcuaucucggcuggcugaacugagaacuguucugggaaggagcugccccacuuuuccuucaaaucuugcccccuggguggccgucugauuccaggcagcucugaguggggacugaagcuuucuuuucaacugacuaugggcugagaggugacaggcacuggcuuaggagcugggaacaccugggacuaaggcccagcguggucccuuuccugacuguguguccuugggcaagucauuugaccugucugagccugucuagaauggauuuguuccuauggcaaguagcuguggggugggcuaugaagguuaaaucaugcaggagggaggcagaaguggguguuaacccuguugguguauuccgugcagggucagggacauaaaagaagauggggccuaugcaguguuggugaccauucuuccucccucccaccagggggaugggcuggguauuugaagccuuggagcugguaccuagcuccccucuccccuggcugggacagaaccaggaggaaccaucaggaucuguguggagacgggugggggugggccugggggguuggacuuuccagccccucaaaagaugucgcuaucucccgcccagguaugauuuucgcuacagugaggaucgagagcaggugcggggguuugaggcugaggaaggguugaugcuggcagcggauaucaugcggggggaagauuucacgccugcggaggaguucgugccccaggaggagcugggggcugccaagaaggugccggcugaggaaggggugauggaagaggcagagcuggugucagaggagaccgagggcugggaggagguggaacuggagcuggaugaggcaacgcggaugaacguggugacaucagcccuggaggccagcggcuugggcccuucacaccuggacaugaauuauguccuccagcagcuggccaacuggcaagaugcccauuacaggcggcagcugagguggaagaugcuccagaaaggugagugcccccacggggcccucccugccgccagccggacaagcugcagaucgucgugccgaugaaaagagaggguggauaagcuccccgagugcucaccugccccagccuggcucuaccugcugugcuuauuugcauggacuuugcauaucauuugcauagacaccucugauccccuucagugggaaccguagugucagugcucauuuauguggcauuugcuuaggauuccagaucuccauccacuuuucuccugggggcugggcuggggguuagggcugggacugugcccccacacugcgccucagcuucccaucucugcccgcuugcuuccccugcccccaaccccugccuccucuaucccccaggcucuccaacucugcagcaguggcagcagcagucaaaacaaacacggggggcggugggugggaugguggagcagcccgggggcugacccaggcuggaggacagggccagccacccucccacggccugggaggaagagaggccuucugggacugcccaggcuauggggacaaaggccuucaccagcaagggccacaguuggaacaguccccugggugucagaaggugggcuagggccuccugcaggguugugggguggaacagggucuccucuccccagccagaaaccccaaagucugggagcugcaccuuccgagugcaggccaugugagcccugccucuuuaaggagccgcaggacaugaaagaugaccuugugacacucaugcacagcagccauugcacgugcaucagcucccaucagccucauuccguggcaggugauguguccccauugguuaggugaggagggugaggcucagagagcuaaggacacuuguuuggggccacacagccgggguagaucugagcccguccucucuacuccugugcuguagcaccuucacuggcccaucccuccccucuagugcuguccugguacccgucccagccuguccccauucucauggcccuuuggucacugccggguggaauagcacuggcuucagcaggcgugucauguaagcuugugcagguuauaaacugaaccaugaccuuuauggcgcaugcagggggcaaccugcauaauuaucaauggcgacuuuccguguccuucugauacaguugaucagaccccugcccaccgcccaggccaggccuguggucaucaaugccccaguucacauccaccugcuucucuuccaggcuuugcuguuccccagcagccugcagaggccccacagacagcuugaggccccuccuucugcugccuggccaagccccacacccgcagacccuccuucccauccucugaaaugggacccugugucugucaccagcccacccucuguguucaugaaccugggcuggagcuuggggaccccucccugccccuggcuuccucuuccauguucugcccuuucccacauguuggaggcuuuuccaacgucuucagggacaggcgguaggaaccccggcccucgcucugcagcuggugcaaaagcuguggcugccaggucugggccacauggcagcccagggggcaggagaagcccgggagaggcccacuggcuaccagacucagcccugagcagggaacagggcccagcuuccaccggcagggaguugugagcgccuucccaacaaugugccccucaccccuugaugcccaugcuaaugguagccacccugguucuuguugacuugagggaccuggcugucuucccuguucuucauccuuucuucucagucccuaccuacuguuuguaaccacaagugucucugugugugggugggugagggccccucugcccaguggugugucuccucucccucccucccucuucugccaguggccuggggguguccaggcucccauccguggcccagccccucuccccucugucuugaucccccccucccugccccuggcuuccucuuccauguucugcccuuucccacaccuuuguuccucaauagcugggggcugggacugaggccuccugcagguaccugccccccuucacacagcaccucucaaucuccuauugcuugucagccugugugcguguggugcaggaaauaaaggaucuauacccuccuggc

SEQ ID NO: 16837 - RNA, 554 nt, Homo sapiens
gagugcugagaccaagggcuaaagcugggagacugaaaaaaugcagaccaccgggguauuacucauuucuccagcucugaucugcuguuguaccaggggucuaaucaggccugugucugccuucuccuugaauagcccagagaauucaucuaaacagccuuccuacagcagcuccccacuccagguggccagacgggaguuccagaccaguguugucucccgggacacugacacagccgccaaguuuauuggugcugggucagccacaguugguguggcugauucaggggcuggcauuggagcgguguuuggcagcuugauuauugucuaugccaggaagcugucucucaagcagcaacuccucuucuaugccauucugggcuuugcccugucugaggccauggggcucuucuguuugaugaucuccuucuucauccuguucgccaugugaggcuccgugagggucaccugccugucccugcagcugcaacuccgcgccauuccuggugcuggggugugcuaagcuuuaccauuaaacacaacguuucucuaaa

SEQ ID NO: 16838 - RNA, 10524 nt, Homo sapiens
cacccccaaggcaggagcccgggccgacggagaggacuuaacgacacuaucggacccucugggaaaagaggggagacgucgugacccaggccccgccccaccuugccgccucgugcccggcgcuaagacccagcgggcgcgccgcccgcccggggcccggcccuguccccuuccguccgcggggcagccagcucagcuccggagagccggcggcgcggcgggcauggcucggguggcgugggggcugcugugguugcugcugggcagcgccggggcgcaguacgagaaguacagcuuccggggcuucccgcccgaggaccugaugccgcuggccgcggcguacgggcacgcucuggagcaguacgagggagagagcuggcgcgagagcgcgcgcuaccuggaggcggcgcugcggcugcaccggcuccugcgcgacagcgaggccuucugccacgccaacugcagcggccccgcgcccgcggccaagcccgaucccgacggcggccgcgcagacgagugggccugcgagcugcggcucuucggccgcguccuggagcgagccgccugccugcggcgcugcaagcggacgcugcccgccuuccaggugcccuacccgccgcggcagcugcugcgugacuuccagagccgccugcccuaccaguaccugcacuacgcgcuguucaaggugggagcccgcccccacccggggaccugucucgggcugggcgucguggcuccccacagaucggucgaaggagcguuaucuucacccaaggcacgaagcccgccgugcgcucggggccgcgagcuccggucuugcugacccgcucccccacccccuaccccccgaccaggcuaaccggcuggagaaggcgguggcggcggccuacaccuuccuccagaggaacccgaagcacgagcugaccgccaaguaucucaacuacuaucaggggaugcuggacgucgccgacgagucccucacggaccuagaggcccagcccuacgaggugggguggagggucaggaggaggcuuguagaggagggcuaguagaggaggggagauguugggggcgcccugacucccccugccacgccccuuccaggccguguuccuccgggcugugaagcucuacaacagcggggauuuccgcagcagcacggaggacauggagcgggccuugucagaguaccuggcagucuuugcccggugccuggccggcugugaaggggcccaugagcagguggacuucaaggacuucuacccggccauagcagguaucugccacccagaccacggugggcgguccucucacccacagggcccgguaaggcagauguccccuucaugcacguggagcacugcgaaugcggaggagccagccgggaggaaggccuugucuguugagaaagacgcugggugcaggggccccagcugggaguguccaaggggcuggaucagugaguagaggcagugacaucccuaaaggguuugggaagcuuggguucauaggccuuccaggcagagggcagugcagaugcaaaggugcagcggugagaaguaacccagcagaugugugcagaaagcaguugauaaccagaaauuacaccuagucuugggaucucuaacccuggggucccucgagcaggggcagaaaggacuguacuuggccaggugugguggcucacaccuguaaucucagcacucugggaggccgaggcaggcagaucacgaggucaggaguucaagaccagccugaccaacauggugaaaccccgucucuacugaaaguacaaaaauuagcuggucgugguggcgggcaccuguaaucccagcuacucgggaggcugaggcaggagaaucgcuugaaccugggaggcggagguugcauugagcccagaucgcgccacugcacuccagccuggucgacagggcgagacucugucucaaaaaaaaaaaaaaaaaaaaaagacuguccuuuagcuucucuguuuggacuucugccccauuucuggaccucaccugcugcucucccagaaugcccuggcucccucuggcuugggguggugguugaguggcagggguggugagucagcccagcccacagucaucuuccucaccaucacuugucauauaguaugccaagcacuuuacagacauucucuccugugauugcaacagcaacacauuuucuggacaagcagcuuggcuuaguaggcagagauuggauuuagagucuucuccacuggggggacggagauguucauugcaaugccagccucucacugcugccucccacccucagaucucuuugcagagucccugcagugcaagguggacugugaggccaauuugacccccaauguggguggcuacuucguggacaaguucguggccaccauguaccacuaccugcaguuugccuacuauaagugugagcccccugggugggcuggcuugggcaggggacgaggugauaagggagaggacuguaugggagccucccagaguuguggggagcuuuccuucaguauugaggacccugggugauaggaggaaagucuagggguggugggaauauggggaaggcacccugggagucuggggcaggugagaggcuucugagugagaacagacagcagccucagggagaagaagagggucuuuugggcaaaugacuagacaaccaacaacugcagagcacuugacaguuuauuuuuauuuuugaaacggaguuucacucuugcccaggcuagagugcaggggcacgaucucggcucacugcaaccgcugccucccggauucaagugauucucuuagccuccugaguagcugggauuauaggugccugccaccacacccagcuaguuuuuguauuuuuaguagagacgggguuucaccauguuggccaggcuggucuugaacuccugaccucaggugauccacugccucagccucccaaagugcugggauuauaggcaugagccaccaugaccggccaacacuugagaguuuauaagucacuuuaucuuaugugguccuuucaccaacaccaugcagcuggcauuacuggaccgauuuuucagauggggaaacugaggcuuauagggcaaggggcuguuggucuuaugacuaauaaaaaguggcaccaggacuuguggcucuccucacuggagagauccuggcauccacuggggcuggaauggacagccuccaguguuccugcagcucggagaugccaagauucagacagagccaggagucagagcagaggggcugagaacccaggggccaggagacccuuccuggguacacauagcagagaggcuaagggccucuaauucacuagagccaucauucuccagcugugugagcuugagcaauuuaucuaaccucucugugacucagauuucuugacuguaaaauggggaugacaguaauagguaggcauggcugggcacagugguucacacuuguaaucccagcacuuugggaggcccaggcaggcagauggcuugagcccaggaguucgagaccaaccugggcaacaugacaagaccccgugucuacaaaaaauacaaaaaguuagccaggcaugguggcgcgugccuguagucccagcuacuggggagacugaggugggaggauugcuugagcccaggaggcagaggcuguagugagccgagaucacaccacugcacuccaaccugggugacagaacaagacccugucucaaaacaaacaaaaacauacaaaaaauuagaugggugugguggugccugcuuguaaucccagcuacucaggaggcugaggugagaggaucaccuaagccugggagaucaagcuugaggugaccauaauugcaccacugcacucuagccagggugauagagugagacccuguuucaaaaacaauaaaaagacaauaacagugaggcuuagaugaguuagucagggccuggcauaggguaagugcccacuacaugcuagcuggcauuaugcuugggugggauaaggagcccauuagguauucugggagguggcuggguagcaggggugcuggacugaacuggaagauggaguugacucugaaggggaagugccagagcaauuccucaccccuguccugcugcagugaaugaugugcgccaggcugcccgcagcgccgccagcuacaugcucuucgaccccaaggacagcgucaugcagcagaaccugguguauuaccgguuccaccgggcucgcuggggccuggaagaggaggacuuccagccccgggaggugggcacugcuuucuggggcacuugcuggauaugcacuuuguaaaaaaugaacuccuggcggccgggcgcgguggcucaugccuguaaucccagcacuuugggaggcugaggcggguggaucacgaggucaggagaucaggaccauccuggcuaacacggugaaaccccgucucuacugaaaagaaaaaaaaauuagccaggcauggugguggacgccuguaguaccaacuacucgggaagcugaggcaggagaauggcgugaaccugggaggcagagcuugcagugagcggagaucgcgccacugcacuccagucugggugacagagcgagacuccgucucaaaagaaaaauaaauaaauaaauaauaaaaaauaaacuccuggcuuccauggaaggcaggaugggaaauggaaagaaagaauaugaguugagguuagaguccuggcuucagagcccagccccacugcugugugguccugggaagaccauggcccuuuccuaaucuauugccucaccugcaaaauggcagugauacugccaccucaccagcaguguccagacgagggagguaugaagguacacauccacuccuaccugcuccccucccuaccuucauuacccucacugcugaccuuugucccucuuucccaggaacacccuagguaaccaauggaggaaaucuguuggaguugagggccaggcuggcaaauauggggcacauggugccacuccugccuuccuugucaguggcagacauugcuaaucgauugagggacucuuugucaccaaacucucagaauccuuaacccaguguuccaagcagccacgaugaucugaugagcuugugagcugauaccuauucucugauccuugagcuagaagagggccagugggcccagauccuaggagcccuggcuucuugccaucuggcaacaggguauggcucaccccccaccccguccuucccuccuuccaggaggccaugcucuaccacaaccagaccgccgagcugcgggagcugcuggaguucacccacauguaccugcagucagaugaugaggugagugccuccugcuuuccaggauugggcugugauggggacaccuuggaccuuuuccuggggccaccagugugccagaauucagccccagccccugguggucagcugucgugaagaagagagguuugccuguuccuugucuagacuguccguuccuuccccagccuuaguauucucauguccuccuuuuguacaugucucaauccuguuccucccaggcccagcucacauggugccuccuccaggaagcccuugcugcaugcccuggcucuuuguucugggcuagcagugcccacucugaccugugugccucccuggccaccuguggccuggaccugggugauugcagcccucguccaucucagcccugggccccuucuccagccaguauccaggagaaccgcacugcaggacacagggccacauuauucccuguucucccacauccugcacagagccugggcucagaaacugaguuugaaugaaccagugaaugaaugaaugcaggaccucaggacagaaggaccguauuguauuacauugauuuauuuuauuuauuuauuuauuuuuuuuuuuugagauggagucucgcucugccgcccaggcuggagugcaguggugucaucucagcucacugaaaccucugccucccggguucacacgaugcuccugccucagccuccggaguagcugggauuacaggcgugcaccaccacgccuggcuaauuuuuguauuuuuaguagagacaguguuucaccguguuggucaggcuggucucgaccucgugaccucaugaucuaucugccucggucucccaaagugcugggauuacaggcgugagcagccgcacccggcccuauuaacauugauuucaagugaggguuugacagccuuaauuucucugagguguugcugcucagugcucauuuauguauccucuccuuuguucaugcccccacgcccccacccauccaaccccagaggaggagggcagaaucuacaccgucagcacccaggaugaggaacuagccagaccuggcuccauuacuuaccaguuggguggccuccaaacaagugucaggcaaccucucaagcuucuguuucuucauccauugaauggggagaaucaugcccaucucacauuguuguggugagaauaacacaagaucuggccggguaugguagcucaugccuguaaucccagcaauuugggaggccgaggcagagggaucaccugagaucaggaguucaagacgagccuggccaacauagugaaacccugucucuauuaaaaauacaaaaauuacucaggugugguggugggcaccuguaaucccagcuacuggggaggcugaggcaggagaauggcuugaaccagaggcagagguugcagugagccgagaucgcgccacuguacuccagccugggugacagauugagacucugucucgaaaaaagagaaagaauuaagugagaucaaguauguuuuuuuguuuguuuguuuuugagacagagucucgcucugucgcccaugcuggagugcaguggcgugaucucagcucacugcaagcuccgccucccagguucucacgccauucuccuaccucagccucccaaguagcugggaccacaggcgccugccaccacgcccggcuaauuuuuuuuguauauuuaguagagaugggguuucacuauguuaccccguauggucucgaucuccugaccuugugauccacccaccucggccucccagagugcugggauuacaggugugagccaccacacccggccucaaguaugcauuuuucuuuuuuuuuucuuggagacagaaucucacucugucacccaggcuggagugcaguggugcgaucucugcucacugcaaccuccaccucuuggguugaagagauccuccugucucagccuccgaguagcugggauuacagucaugcgccaccauguccagccaauuuuauuuuguauuuguaguagagacaggguuucaccacguuggccaggcuggucucaaacuccugaccucaagugguccgcuugccucggccucccaaagugcuagguuuacaggcgugagccaccgcuccuggcugagaucaaguauguaaagcacuugauaaagagccaguaccugguaggugcacagugaaugacagccgagucucacucugucauccaggcuggagugcaguggugcagucucagcucauugcaacuuccgccucccagguucaagcgauucuccugccucagccuccugaguagcugggauuacaggcgugugccaccauacccagcuaauuuuuguauuuuuaguagagacaugggguuucaccauguugaccaggcuggucuugaacuccugaccucaaaugauccaccgaccucagccucccaaagugcugggauuacaggugugagccaccacgccuggcguauggcagccauuuugacggcugucucuuauuuccugugguuugccagacaccagacuaggggcuggaguaaguuagugaaagucaugguccuggcggggcacgguggcucacaccuguaaucccagcacuuugggaggccaaggcgggcggaucacgaggucagaagauugagaccauccuggcuaacacggugaaacccggucucuacuaaaaaugcaaaaaauuagccaggaguggcggcaugcgccuauauucccagcugcuggggaggcugaggcaggagaauggcgugaacccaggaggcagagcuugcagugagccgagaucaugccacugcacuccagccugggcaacagagcagacuccgucucaaaaaaaaaaaaaaaaaaggaagucauggucccuuucacgugccgcucacagucuagugggggaagcacaaacugcugcuggagagggcagcacacggcaccaggggaggucuccagcccagccagagucaccagcaagggcucagccuggaacugaugccuggcuuuggagggauuagugcgggcuacgcaggcacaggggacagcaguaguuccuggcagggaaacaguaugagcaaauauuaugcauggacuagcaauauucuugccagggucuuuaugcuuaaaagguggggcugugcaggggcgauguuuaugcugacaccaaauucugcugguggugcccuaugcagccacucagggaggggcaguuugggaaaaauccucaggacugucucauuagaucuugagacuggggagggggaggggcuuuggggaccgagagaugggaugggaagucccauuggccaggaagggagcccauauggguuugggcguacugugacccgguuucucccacaaccguggcgcuacucuagauggagcuggaggagacagaaccgccccuggagccugaggaugcccuaucugacgccgaguuugagggggagggugacuacgaggagggcauguaugcugacugguggcaggagccggaugccaagggugacgaggccgaggcuggucagugacacgaguccuugggggguggggaugcagccugggauggagguuggggacagaugcauucacccgcugggcuccggagcccagggugugugugggugcuggggcccauccuccaggggccuccagccuguuggcaaccccugucccgcuugggggugguggugcagcaucuccccuggagcugggaccagcugagaccuguccgggggagccucaccccaccucccaucaggacagcaccuggacacccauugggagugggugggggagcaaccccagugcuuucuccuuuccuuuucagagccagagccugaacucgcaugagaaggggacaccccacaccgcucaagcuugggaagccuggugccgauggccccacccucaccagccugggcagcagcaagaacuauuuauuaaaaacuuaagaugggccaggugcgguggcucacaccuguaaucccagcauuuugggaggccaagguggguggaucacuugaggccaggaguucaagaccagccuggccaacaugaugagaccuccgucucuacuaaaauacauaaauuagccgggugugguggcaggcgccugaaaucccagcuacucaagaggcugaggcaggagaaucgcuugaaccugggaggcaaagguugcagugaacugagauugcgccaccgcacuccagccugggcgacagagcgagacuccaucuuuaaaaaaaaacaagacgggccggcacgguggcucacgccuguaaucccagcacugagaggccgaucacuugaggucaggaguucaagaccagccuggccaacauggugaaaccccaucucuacuaaaaaauacaaaaauuagccaggcaugguggcacacaccuguaaucguagcugaggcaggagaaucgccugaacccaggaggcggagcuugcagugagccgagaucgugccacugcacuccagccugggcgacagagugagacuccaucucaaaaaaaaaaaaaaaaacuuaagauggacacagcugacuggacccccauccugccucacccaugggugcugcaccccagacccauccugccacuucuaugucucuggaccacaggauggugguggcauugcagguuggcaagugggcugaugggguccgcccuccucacugcugagcuccucaccuggacagucuccuggacaaggaguuuccagcugcuggcuggagucucaggccaaauugcagaggguccuccaggguccugaagagcacuggacuaagagucuagugguuccagggcccugaccaguaggugcucaauaaauguuuguuguugaaugagucauaguacccguggucgucucccuggagcucaguuguaaggguacagguccuucccucccucucuccgcaccuguguccccucaucuguaaaauguggggcggaggggcaccaucugggcccuggcugguccucugcaccuggggcugaaggaugugugagagaggacgcagugugcagaucugccaccagggggcgggagaacacaguccuccccaggcgggaagacgaugguuucagauuucuaagaugggaaguccuguauuuuccuaguucaggaucacuucccucggggaauguggcaagugugggagggggccaaggacauuugcuccua

SEQ ID NO: 16839 - RNA, 10498 nt, Homo sapiens
ccuggccaggccccaggucucgcagccagggauggagauggggggagggggaaccuagaguucuuuguagugccucccucagacucuaacacacucagccuggcccccuccuccuauugcaacccccucccccgcuccucccggccaggccagcucagucuucccagcccccauuccacguggaccagccagggcggggguagggaaagaggacaggaagagggggagccaguucugggaggcggggggaaggagguugguggcgacucccucgcucgcccucacugccggcggucccaacuccaggcaccauguuccccgcgggcccccccagccacagccuccuccggcucccccugcugcaguugcugcuacugguggugcaggccguggggagggggcugggccgcgccagcccggccgggggcccccuggaagauguggucaucgagagguaccacauccccagggccuguccccgggaagugcagaugggggauuuugugcgcuaccacuacaacggcacuuuugaagauggcaagaaguuugauucaagguaaccccgguugggcgcccccggauucaccacuccguccccugaacccgggguccuguuuccuuguugccucuuuuaagcucugcaucccaauacucuaacccuagacagcaccccuggggccucccagacacccaucuccccaaagauacccuccugcccccacuuccaaacccucacuucucaaaggaucccauuucuuucucacaagcucuccacaucccggaaaggacucgauaaucaaggugaacugccuuguguaguuaccagggcuguauguaaugaccugauggagagggguguucugaucuacaguguuggggggaaggggguggucccugcugcuuaagaacccugggauggucuaucagccuggaccccguaccuuuccacccacccugacuccccuucugguuccacuguuuucagugccuuuguggucagagaagagggaauagaacuuuuuuuuggagggggugggaguuuucagcggcuggugggcagggaaaaaggcugguggguauuauaagaagacagccggcuggaccuggggguagcgcguggcucccugcggaggcccugucuacgugucacacagucggacaugccacccugggcuccuuggaggaauuucauuccucccucucugguucuccuggaacccucaucucucuccauuuuagguacaccaggccagaggcacaggccgcccauuuuugccagccuugggguuuguaagguggccuccuggucugacccaggccuuuggucugccccagcaaguccacuuuuguuagcggggacagggcagggcuguaugccagccucagggguaaaucuagggucccaguuacacacagaccccacagcacacugaaagaagucaguguuucuuagacccuccucugaaacacacaacucagcccacaggaaauuaguggccaugacuuuagaggcaggcauauauugggguaagccuacaaacuccaagagucccaagacccugguucaaauccaggcuaugaccauggacagagaauuuugucucuuuaggcaucacuuuccuuaucugaaaaguggagacaaaaacaggaccuacuugcuaaggcugauguuaggacuccaaggacauggaugaaugaacguaggcuucucacagggccuggcaguccuccagccaguucagcacacauuaacauugacccugaggaaaaccauaugaccugaugcuguggaacuuguagaaacuuaaugcagagcuuaagccuucauaacaacacugagaaggaaacaguccagacuuaaaaccugucugcuuggugggcaaauucagauauaggguaguagccagaagugcagcccugagcccuugacugcuaggagugaggcagggguugggauuuaggggaugucaucccugauggggacucugggagcccagcucaugaguguugagcuuggaaaacuuuuuguuuuuuagcuggaggcucacucugucgcccaggcuggagugcaguggugccaucucagcucacugcaaccuccuggguucaagcaauucuccugcuucagccucccaaguagcugugauuacaggcgcaugccaccacgcccagcuaauuuuuguuuguuuguuuguuuuuguuuuuugagacacagucucacacuguugccugggcuggagugcaauggagcaaucucaacucacugcaaccuccgccucugccucccagguucacgugauucuccugccucagccucccgaguagcugggauuacaggugcacaccaccacacccggcuaauuuuuuuguauuuuuaguagagagggguuucacuauguuggccagacuggucuugaaaaaggcggguggguauuauaagaagacagccagcuggaccuggggguagggcauggcucccugcggaggcccugucugucuacgugucacacagucagacaugccaccccagccucgugauccgcccaccucggccucccaaagugcugggauuacaggcguaagccacggcgcccagccuuaauuuuucauauuuuaguagagauggcguuucaccauguugcucaggcuggucacaaacuucugagcucaggcaauccacccuccucagccucccaaagugcuagaauuacaggcgugagcccccgcgcccacacaacuuagaaaacuuuuuuuuuuuuugagacagagucuugcucugucccccaggcuggagugcaguagcgcgaucucugcucacugcaagcuccgccuccuggguucacaccauucuccugccucagccucccgauuagcugggacuacaggcgccuccacaauuuuuuuuguauuuuuaguagagacgggguuucaccauguuagccaggguggucuccaucuccugaccucaugaucugcccgccucggccucccaaagugcugggauuacaggcgugagccacugcgcucggccagaaaacuuucuuaacccauggccccuucaauuaaaaaaaaaaaaaucucccauccucacuuuacuucugaaaacuuaaaauaaauuaaaaguguauauaauuggcugggcacaguggcucacuccuguaaucccagcacuuugggaggcccaggcaggcagaucacuugaggccaagagugaccagccugggcaacauggcgaaagcccucucuacuaaaaauacaaaaauuagccagauaugguggugcaugccugugaucccagcugcuacuucggaggcugaggcaggagaaucgcuuaaacccgggagguggagguugcagugagcugauugcaccacugcacuccagccugggugacagagccgagacuccaucuccaaaaauacauauguauaaguaaaaauaaauacauuaauuaaaaguguauaacuaaaaacaaacaaaagccauggcacuuuuagaauaggcuuuuuuuuuuuuuuuuuuuuuugagagggagucucacucugucgccaggcuggaguccaguggcacgauuucggcucauugcaaccuccgccucccggguucacgccauucuccugccucagccuccugaguaacugggacuacaggcgcccgccaccacaccuggcuaauguuuuguauuuuuaguaaagacgggguuucacuguguuagccaggauuguagaauaggccuuuucaaaaugugaaaccagcucccaccccaccucugcucucccgucuuuucuuggagagccaauaguauaauggcaaauuuuagaacucagcugacuacauauuagcugugugaccuugggcaaggcacugagucucucaagucuccauugcucucauuaagaaaaaugagaacaagaaugcccaccucacaggggagacaaagaagauacggaauguaaaaugccaagcauuuaaucccauauaguaaugcuccucugccccuccgugcuguacguaccacuccccacuugcugucagcaaauaguagcagccaucaggcccgggcaucccacccaaccccgucccagggcaauagcagcccuuguccuccucagggacuugccuuucacaacaguccguucucuuaaggugggcgucacggccgaccuaggagggggacuugaaaaggaggugagaagugugugugcguauccacaccuggcuauagggaggggggauugugugcgugugugcaggcacaccugugcaucugugccaccaugggcagugugugugugucugaggucacuguaucccaucugucccuccccccccagcuaugaucgcaacaccuugguggccaucgugguggguguggggcgccucaucacuggcauggaccgaggccucaugggcaugugugucaacgagcggcgacgccucauugugccuccccaccugggcuaugggagcaucggccugggugagaagggcuggggcacaggccggggguggaggagaccacgaggcagaaucagggauccuggggugagaaaacugaagugcggagaugaggagugacuugcccaaugucacacugugcacgcaguaugaagaguggcagcucuggcuggggcaguagcugacauauauggucccagaguuuugggaggccgaggugggaggauugcuugaacccaggaguuccagaccagccuaggcaacauagugagaccucgucucuacaaaaaauaaaauaaauuauccaggugugguggugugugccuguagucccaacuacucagaaggcucaggugggaggauugcuugaccccgggaggcugcagugagccaugaucaugccacugaauuccacccugugugacagagcaaaaccccucuuuuuuucuuuuucuuuuuuuuuuugagacagcaucucacucuguugcacaggcuggaguuuaguggugcgaucucggcucacugcaaccucagccuccugggcucaagcaguccucccucucagccucccaaauagcugggacuacaggugcacaccaccacacguggcuaauuuuuuguauuuuuaguagagaugggguuucgccauguugcgcaggcuggucuugaacuccugggcucaagccauccaccugccuuggccucccacagugcugggauaacaggcaugagccacugugucuggcccccuaucucuuaaaaaaaaaaaacaaaaauaguggcaucucugucccugguuugggucucuuggugcugggaugagaggaaggggaauaacagggcccuggcugggaucgugguuggcagagcagaacucugagaccuccacgcugcugcgcucucacagcggggcucauuccaccggaugccacccucuacuucgaugugguucugcuggauguguggaacaaggaagacaccgugcaggugagcacauugcugcgcccgccccacugcccccgcaugguccaggacggcgacuuuguccgcuaccacuacaauggcacccugcuggacggcaccuccuucgacaccaggugaggggcuggaggggagcccugaggcacuggggacuguggcauggggagcgggaauccggggcccagccugccucucccaccuccaccucauuuucugcagcuacaguaagggcggcacuuaugacaccuacgucggcucugguuggcugaucaagggcauggaccaggggcugcugggcauguguccuggagagagaaggaagauuaucaucccuccauuccuggccuauggcgagaaaggcuauggugagggugggcaaggacacaaggggaaauuccgcagaagagggaaaaaccaggccuccacauacaguugcucagguuguauacugcacgagggcauccaaccaaggacucaaggugggaugaaaucuacccuuggugcuacuaagaaggggugcuuuggccgggcgugguggcucacgcuuguaaucccagcacuuugggaagccaaggcgggaggaucacgaggucaggagaucgagaccacggugaaaccccgucucuacuaaaaauacaaaaaaauuagccgggcguggugggggcgccuguagucccagcuacucggagaggcugaggcaggaaaaugacgugaacccgggaggcggagcuugcagugagccgagaucgcgccacugcacuccagccugggugacagagcgagacucugucucaaaaaaaaaaaaaaaaaaagaaggggugcuuuauucugauucacacgaaggcucaguaugagccggugguggcccuggggaaaacccagcucaggucuuacuggaggagcaagaagcagggcugcugaugggcgggaaagggcucuggagaguggggcuagugucuugcauggugcccacugggccuuccugagucaagaaggagccucggcuugcuccccaauuuuaugguucaagcccuaucccuuccccagggacagugauccccccacaggccucgcuggucuuucacguccuccugauugacgugcacaacccgaaggacgcuguccagcuagagacgcuggagcucccccccggcuguguccgcagagccggggccggggacuucaugcgcuaccacuacaauggcuccuugauggacggcacccucuucgauuccaggucaggagggucuugaggugggagggcgggggcugggugaaacguggacgaagcugggggucacucugagcugccuggaaggggagggccccuuugacucccuuccuggcccucccgccuuguauugcagcuacucccgcaaccacaccuacaauaccuauaucgggcaggguuacaucauccccgggauggaccaggggcugcagggugccugcaugggggaacgccggagaauuaccauccccccgcaccucgccuauggggagaauggaacugguaggggcguuccccagccaccaccucagcuccuccuccgaacugcccauugugucuaggccacccccucccacagugggauuccaggcaccgcucggccccucucaucacaaaaacaugcaugcagcuuacaucuggucaccccaucugauuccugccacacagacuccaucgguuuccuccagggcagcgccccacuucgccccuuccgcaguggagaagggcagccaaguuuggggagggagggugguuauggaaaaacagaaccagcauacccccaggacccagcugugcugggagccucaguguccucaccugucaagugggcaagccaugcugauccgcaggguaaguuacugggaguuugcaagacggugaguggaaaagggcuuucuuacuggaaagcugccuuccccugcccccugccccagugaaaguuuguuagaauugacucuggacaaacaucccgucccauccuccuuuggauccucagggucgggaagggguaucaggucuggggaccuccauggagagaccucaaguagccucuccuagugcucugagcugaccacacucccccauucuggccucaggagacaagaucccuggcucugccgugcuaaucuucaacguccaugucauugacuuccacaacccugcggaugugguggaaaucaggacacugucccggccaucugagaccugcaaugagaccaccaagcuuggggacuuuguucgauaccauuacaacuguucuuugcuggacggcacccagcuguucaccucguggguccgggggggggccgggacugggcaggugggugggcacaggcauggggaguccuccucagugcacccccgacgccugcuccucccucuugguccucgagcgccaggggagcauucaaccucuugcugcuuucuguaaguccccaucucggagcaugucgaggagaugaaauucucugcuucgcaggggaagggaaggugaagccaacaguugggggagaacugcucuuucuauuucacagaggggaaacugacgcagggagccaugagcccucgaggccacacuuuagggggcagaggcaagaugagaagggaaccccacgucugcacagcugggccccugcacucugcugcguggcccaagucaccagugggaguaacuccggaacugagggcuuguucugggcccaccucagagggagaggggugugcgcuggcaggggacaggguggcugcugaccugggcaucugcucucccccaggcaugacuacggggccccccaggaggcgacucucggggccaacaaggugaucgaaggccuggacacgggccugcagggcaugugugugggagagaggcggcagcucaucgugcccccgcaccuggcccacggggagaguggaggugaggggcugagaccauaaucuuuuuuuuuuuuuuuuuuuuuuuuuuuuugagauggagucugacucugucacccaggcuggagugcaguggugugcucucagcucacugcaaccuccacuucccagguucaagugauucuccugccucagccucccgaguagcugggauuacaggcaccugccaccgugcccagcuaauuuuuguauuuuuaguagagacaggguuuugccauguuggucaggcuggucuugaacuccugaccucaggugauccacccgccuuggccucccaaagugcugggauuauaaucaugagccacugcgcucggcccgagaccguaaucugacuggcaucugucccuuuugcuccugcccacugugggucugaugacuggugggaggagucaggaaugccuucaggauggcuccuuaaacaucccaugccccacucuccagcccagccccaggaggggaaacuggccugugggcugggaaacagugaagccaggcccagaccccggccugacuaggaccccucccuucucuccugcccucccuccagcccggggagucccaggcagugcugugcugcuguuugagguggagcuggugucccgggaggaugggcugcccacaggcuaccuguuuguguggcacaaggacccuccugccaaccuguuugaagacauggaccucaacaaggauggcgaggucccuccggaggaggugggugaagguucaguccuaauagccaugcccacgcaauccccgcacccaggaagcaucgaggaagaagacgucccccguccggacugcccacccgcccuggugcuccugccugcgcugagucccacgccucaggcuccuugucccugcuuuuuccugggcacacaugcaggcuguucccuaccugagaccagucacagacuauccccaugccacgccuccaccccagcccccaccaggaccccagcaccagugccuuucccagcccuuccugaguuacagggugcgggggagccugggaaaaaagaagaaaaagaaagcacucacuggccuccacccggggccccugccccucccaaggccaugacccucacugcccgcucccccggcucuccccugccccaguucuccaccuucaucaaggcucaagugagugagggcaaaggacgccucaugccugggcaggacccugagaaaaccauaggagacauguuccagaaccaggaccgcaaccaggacggcaagaucacagucgacgagcucaagcugaagucagaugaggacgaggagcggguccacgaggagcucugaggggcagggagccuggccaggccugagacacagaggcccacugcgagggggacaguggcggugggacugaccugcugacagucacccucccucugcugggaugagguccaggagccaacuaaaacaauggcagaggagacaucucugguguucccaccacccuagaugaaaauccacagcacagaccucuaccguguuucucuuccaucccuaaaccacuuccuuaaaauguuuggauuugcaaagccaauuuggggccuguggagccugggguuggauagggccauggcuggucccccaccauaccuccccuccacaucacugacacagcugagcuuguuauccaucuccccaaacuuucucuuucuuuguacuucuugucauccccacucccagccccuuuuccucuaugugacagcucccuaggaccccucugccuuccuccccaauccugacuggcuccuagggaaggggaaggcuccuggagggcagcccuaccucucccaugcccuuugcccuccucccucgccuccaguggaggcugagcugacccugggcugcuggaggccagacugggcuguaguuagcuuuucaucccuaaagaaggcuccuuucccuaaggaaccauagaagagaggaagaaaacaaagggcaugugugagggaagcugcuuggguggguguuagggcuaugaaaucuuggauuuggggcugaggggugggagggagggcagagcucugcacacucaaaggcuaaacuggugucaguccuuuuuuccuuuguuccaaauaaaagauuaaaccaauggccuua

SEQ ID NO: 16840 - RNA, 10498 nt, Homo sapiens
uaaggccauugguuuaaucuuuuauuuggaacaaaggaaaaaaggacugacaccaguuuagccuuugagugugcagagcucugcccucccucccaccccucagccccaaauccaagauuucauagcccuaacacccacccaagcagcuucccucacacaugcccuuuguuuucuuccucucuucuaugguuccuuagggaaaggagccuucuuuagggaugaaaagcuaacuacagcccagucuggccuccagcagcccagggucagcucagccuccacuggaggcgagggaggagggcaaagggcaugggagagguagggcugcccuccaggagccuuccccuucccuaggagccagucaggauuggggaggaaggcagagggguccuagggagcugucacauagaggaaaaggggcugggaguggggaugacaagaaguacaaagaaagagaaaguuuggggagauggauaacaagcucagcugugucagugauguggaggggagguauggugggggaccagccauggcccuauccaaccccaggcuccacaggccccaaauuggcuuugcaaauccaaacauuuuaaggaagugguuuagggauggaagagaaacacgguagaggucugugcuguggauuuucaucuaggguggugggaacaccagagaugucuccucugccauuguuuuaguuggcuccuggaccucaucccagcagagggagggugacugucagcaggucagucccaccgccacugucccccucgcagugggccucugugucucaggccuggccaggcucccugccccucagagcuccucguggacccgcuccucguccucaucugacuucagcuugagcucgucgacugugaucuugccguccugguugcgguccugguucuggaacaugucuccuaugguuuucucaggguccugcccaggcaugaggcguccuuugcccucacucacuugagccuugaugaagguggagaacuggggcaggggagagccgggggagcgggcagugagggucauggccuugggaggggcaggggccccggguggaggccagugagugcuuucuuuuucuucuuuuuucccaggcucccccgcacccuguaacucaggaagggcugggaaaggcacuggugcugggguccuggugggggcugggguggaggcguggcauggggauagucugugacuggucucagguagggaacagccugcaugugugcccaggaaaaagcagggacaaggagccugaggcgugggacucagcgcaggcaggagcaccagggcgggugggcaguccggacgggggacgucuucuuccucgaugcuuccugggugcggggauugcgugggcauggcuauuaggacugaaccuucacccaccuccuccggagggaccucgccauccuuguugagguccaugucuucaaacagguuggcaggaggguccuugugccacacaaacagguagccugugggcagcccauccucccgggacaccagcuccaccucaaacagcagcacagcacugccugggacuccccgggcuggagggagggcaggagagaagggagggguccuagucaggccggggucugggccuggcuucacuguuucccagcccacaggccaguuuccccuccuggggcugggcuggagaguggggcaugggauguuuaaggagccauccugaaggcauuccugacuccucccaccagucaucagacccacagugggcaggagcaaaagggacagaugccagucagauuacggucucgggccgagcgcaguggcucaugauuauaaucccagcacuuugggaggccaaggcggguggaucaccugaggucaggaguucaagaccagccugaccaacauggcaaaacccugucucuacuaaaaauacaaaaauuagcugggcacgguggcaggugccuguaaucccagcuacucgggaggcugaggcaggagaaucacuugaaccugggaaguggagguugcagugagcugagagcacaccacugcacuccagccugggugacagagucagacuccaucucaaaaaaaaaaaaaaaaaaaaaaaaaaaaagauuauggucucagccccucaccuccacucuccccgugggccaggugcgggggcacgaugagcugccgccucucucccacacacaugcccugcaggcccguguccaggccuucgaucaccuuguuggccccgagagucgccuccuggggggccccguagucaugccugggggagagcagaugcccaggucagcagccacccuguccccugccagcgcacaccccucucccucugaggugggcccagaacaagcccucaguuccggaguuacucccacuggugacuugggccacgcagcagagugcaggggcccagcugugcagacgugggguucccuucucaucuugccucugcccccuaaaguguggccucgagggcucauggcucccugcgucaguuuccccucugugaaauagaaagagcaguucucccccaacuguuggcuucaccuucccuuccccugcgaagcagagaauuucaucuccucgacaugcuccgagauggggacuuacagaaagcagcaagagguugaaugcuccccuggcgcucgaggaccaagagggaggagcaggcgucgggggugcacugaggaggacuccccaugccugugcccacccaccugcccagucccggcccccccccggacccacgaggugaacagcugggugccguccagcaaagaacaguuguaaugguaucgaacaaaguccccaagcuugguggucucauugcaggucucagauggccgggacaguguccugauuuccaccacauccgcaggguuguggaagucaaugacauggacguugaagauuagcacggcagagccagggaucuugucuccugaggccagaaugggggaguguggucagcucagagcacuaggagaggcuacuugaggucucuccauggagguccccagaccugauaccccuucccgacccugaggauccaaaggaggaugggacgggauguuuguccagagucaauucuaacaaacuuucacuggggcagggggcaggggaaggcagcuuuccaguaagaaagcccuuuuccacucaccgucuugcaaacucccaguaacuuacccugcggaucagcauggcuugcccacuugacaggugaggacacugaggcucccagcacagcuggguccuggggguaugcugguucuguuuuuccauaaccacccucccuccccaaacuuggcugcccuucuccacugcggaaggggcgaaguggggcgcugcccuggaggaaaccgauggagucuguguggcaggaaucagauggggugaccagauguaagcugcaugcauguuuuugugaugagaggggccgagcggugccuggaaucccacugugggaggggguggccuagacacaaugggcaguucggaggaggagcugaggugguggcuggggaacgccccuaccaguuccauucuccccauaggcgaggugcggggggaugguaauucuccggcguucccccaugcaggcacccugcagccccugguccaucccggggaugauguaacccugcccgauauagguauuguaggugugguugcgggaguagcugcaauacaaggcgggagggccaggaagggagucaaaggggcccuccccuuccaggcagcucagagugacccccagcuucguccacguuucacccagcccccgcccucccaccucaagacccuccugaccuggaaucgaagagggugccguccaucaaggagccauuguagugguagcgcaugaaguccccggccccggcucugcggacacagccgggggggagcuccagcgucucuagcuggacagcguccuucggguugugcacgucaaucaggaggacgugaaagaccagcgaggccuguggggggaucacugucccuggggaagggauagggcuugaaccauaaaauuggggagcaagccgaggcuccuucuugacucaggaaggcccagugggcaccaugcaagacacuagccccacucuccagagcccuuucccgcccaucagcagcccugcuucuugcuccuccaguaagaccugagcuggguuuuccccagggccaccaccggcucauacugagccuucgugugaaucagaauaaagcaccccuucuuuuuuuuuuuuuuuuuuugagacagagucucgcucugucacccaggcuggagugcaguggcgcgaucucggcucacugcaagcuccgccucccggguucacgucauuuuccugccucagccucuccgaguagcugggacuacaggcgcccccaccacgcccggcuaauuuuuuuguauuuuuaguagagacgggguuucaccguggucucgaucuccugaccucgugauccucccgccuuggcuucccaaagugcugggauuacaagcgugagccaccacgcccggccaaagcaccccuucuuaguagcaccaaggguagauuucaucccaccuugaguccuugguuggaugcccucgugcaguauacaaccugagcaacuguauguggaggccugguuuuucccucuucugcggaauuuccccuuguguccuugcccacccucaccauagccuuucucgccauaggccaggaauggagggaugauaaucuuccuucucucuccaggacacaugcccagcagccccugguccaugcccuugaucagccaaccagagccgacguaggugucauaagugccgcccuuacuguagcugcagaaaaugagguggaggugggagaggcaggcugggccccggauucccgcuccccaugccacaguccccagugccucagggcuccccuccagccccucaccuggugucgaaggaggugccguccagcagggugccauuguagugguagcggacaaagucgccguccuggaccaugcgggggcaguggggcgggcgcagcaaugugcucaccugcacggugucuuccuuguuccacacauccagcagaaccacaucgaaguagaggguggcauccgguggaaugagccccgcugugagagcgcagcagcguggaggucucagaguucugcucugccaaccacgaucccagccagggcccuguuauuccccuuccucucaucccagcaccaagagacccaaaccagggacagagaugccacuauuuuuguuuuuuuuuuuuaagagauagggggccagacacaguggcucaugccuguuaucccagcacugugggaggccaaggcagguggauggcuugagcccaggaguucaagaccagccugcgcaacauggcgaaaccccaucucuacuaaaaauacaaaaaauuagccacgugugguggugugcaccuguagucccagcuauuugggaggcugagagggaggacugcuugagcccaggaggcugagguugcagugagccgagaucgcaccacuaaacuccagccugugcaacagagugagaugcugucucaaaaaaaaaaagaaaaagaaaaaaagagggguuuugcucugucacacaggguggaauucaguggcaugaucauggcucacugcagccucccggggucaagcaauccucccaccugagccuucugaguaguugggacuacaggcacacaccaccacaccuggauaauuuauuuuauuuuuuguagagacgaggucucacuauguugccuaggcuggucuggaacuccuggguucaagcaauccucccaccucggccucccaaaacucugggaccauauaugucagcuacugccccagccagagcugccacucuucauacugcgugcacagugugacauugggcaagucacuccucaucuccgcacuucaguuuucucaccccaggaucccugauucugccucguggucuccuccacccccggccugugccccagcccuucucacccaggccgaugcucccauagcccagguggggaggcacaaugaggcgucgccgcucguugacacacaugcccaugaggccucgguccaugccagugaugaggcgccccacacccaccacgauggccaccaagguguugcgaucauagcuggggggggagggacagaugggauacagugaccucagacacacacacacugcccaugguggcacagaugcacaggugugccugcacacacgcacacaauccccccucccuauagccagguguggauacgcacacacacuucucaccuccuuuucaagucccccuccuaggucggccgugacgcccaccuuaagagaacggacuguugugaaaggcaagucccugaggaggacaagggcugcuauugcccugggacgggguugggugggaugcccgggccugauggcugcuacuauuugcugacagcaaguggggagugguacguacagcacggaggggcagaggagcauuacuauaugggauuaaaugcuuggcauuuuacauuccguaucuucuuugucuccccugugaggugggcauucuuguucucauuuuucuuaaugagagcaauggagacuugagagacucagugccuugcccaaggucacacagcuaauauguagucagcugaguucuaaaauuugccauuauacuauuggcucuccaagaaaagacgggagagcagagguggggugggagcugguuucacauuuugaaaaggccuauucuacaauccuggcuaacacagugaaaccccgucuuuacuaaaaauacaaaacauuagccaggugugguggcgggcgccuguagucccaguuacucaggaggcugaggcaggagaauggcgugaacccgggaggcggagguugcaaugagccgaaaucgugccacuggacuccagccuggcgacagagugagacucccucucaaaaaaaaaaaaaaaaaaaaaagccuauucuaaaagugccauggcuuuuguuuguuuuuaguuauacacuuuuaauuaauguauuuauuuuuacuuauacauauguauuuuuggagauggagucucggcucugucacccaggcuggagugcaguggugcaaucagcucacugcaaccuccaccucccggguuuaagcgauucuccugccucagccuccgaaguagcagcugggaucacaggcaugcaccaccauaucuggcuaauuuuuguauuuuuaguagagagggcuuucgccauguugcccaggcuggucacucuuggccucaagugaucugccugccugggccucccaaagugcugggauuacaggagugagccacugugcccagccaauuauauacacuuuuaauuuauuuuaaguuuucagaaguaaagugaggaugggagauuuuuuuuuuuuuaauugaaggggccauggguuaagaaaguuuucuggccgagcgcaguggcucacgccuguaaucccagcacuuugggaggccgaggcgggcagaucaugaggucaggagauggagaccacccuggcuaacauggugaaaccccgucucuacuaaaaauacaaaaaaaauuguggaggcgccuguagucccagcuaaucgggaggcugaggcaggagaauggugugaacccaggaggcggagcuugcagugagcagagaucgcgcuacugcacuccagccugggggacagagcaagacucugucucaaaaaaaaaaaaaguuuucuaaguugugugggcgcgggggcucacgccuguaauucuagcacuuugggaggcugaggaggguggauugccugagcucagaaguuugugaccagccugagcaacauggugaaacgccaucucuacuaaaauaugaaaaauuaaggcugggcgccguggcuuacgccuguaaucccagcacuuugggaggccgaggugggcggaucacgaggcugggguggcaugucugacugugugacacguagacagacagggccuccgcagggagccaugcccuacccccagguccagcuggcugucuucuuauaauacccacccgccuuuuucaagaccagucuggccaacauagugaaaccccucucuacuaaaaauacaaaaaaauuagccgggugugguggugugcaccuguaaucccagcuacucgggaggcugaggcaggagaaucacgugaaccugggaggcagaggcggagguugcagugaguugagauugcuccauugcacuccagcccaggcaacagugugagacugugucucaaaaaacaaaaacaaacaaacaaacaaaaauuagcugggcgugguggcaugcgccuguaaucacagcuacuugggaggcugaagcaggagaauugcuugaacccaggagguugcagugagcugagauggcaccacugcacuccagccugggcgacagagugagccuccagcuaaaaaacaaaaaguuuuccaagcucaacacucaugagcugggcucccagaguccccaucagggaugacauccccuaaaucccaaccccugccucacuccuagcagucaagggcucagggcugcacuucuggcuacuacccuauaucugaauuugcccaccaagcagacagguuuuaagucuggacuguuuccuucucaguguuguuaugaaggcuuaagcucugcauuaaguuucuacaaguuccacagcaucaggucauaugguuuuccucagggucaauguuaaugugugcugaacuggcuggaggacugccaggcccugugagaagccuacguucauucauccauguccuuggaguccuaacaucagccuuagcaaguagguccuguuuuugucuccacuuuucagauaaggaaagugaugccuaaagagacaaaauucucuguccauggucauagccuggauuugaaccagggucuugggacucuuggaguuuguaggcuuaccccaauauaugccugccucuaaagucauggccacuaauuuccugugggcugaguuguguguuucagaggagggucuaagaaacacugacuucuuucagugugcuguggggucuguguguaacugggacccuagauuuaccccugaggcuggcauacagcccugcccuguccccgcuaacaaaaguggacuugcuggggcagaccaaaggccugggucagaccaggaggccaccuuacaaaccccaaggcuggcaaaaaugggcggccugugccucuggccugguguaccuaaaauggagagagaugaggguuccaggagaaccagagagggaggaaugaaauuccuccaaggagcccaggguggcauguccgacugugugacacguagacagggccuccgcagggagccacgcgcuacccccagguccagccggcugucuucuuauaauacccaccagccuuuuucccugcccaccagccgcugaaaacucccacccccuccaaaaaaaaguucuauucccucuucucugaccacaaaggcacugaaaacaguggaaccagaaggggagucaggguggguggaaagguacgggguccaggcugauagaccaucccaggguucuuaagcagcagggaccacccccuuccccccaacacuguagaucagaacaccccucuccaucaggucauuacauacagcccugguaacuacacaaggcaguucaccuugauuaucgaguccuuuccgggauguggagagcuugugagaaagaaaugggauccuuugagaagugaggguuuggaagugggggcaggaggguaucuuuggggagaugggugucugggaggccccaggggugcugucuaggguuagaguauugggaugcagagcuuaaaagaggcaacaaggaaacaggaccccggguucaggggacggaguggugaauccgggggcgcccaaccgggguuaccuugaaucaaacuucuugccaucuucaaaagugccguuguagugguagcgcacaaaaucccccaucugcacuucccggggacaggcccuggggaugugguaccucucgaugaccacaucuuccagggggcccccggccgggcuggcgcggcccagcccccuccccacggccugcaccaccaguagcagcaacugcagcagggggagccggaggaggcuguggcugggggggcccgcggggaacauggugccuggaguugggaccgccggcagugagggcgagcgagggagucgccaccaaccuccuuccccccgccucccagaacuggcucccccucuuccuguccucuuucccuacccccgcccuggcugguccacguggaaugggggcugggaagacugagcuggccuggccgggaggagcgggggaggggguugcaauaggaggagggggccaggcugaguguguuagagucugagggaggcacuacaaagaacucuagguucccccuccccccaucuccaucccuggcugcgagaccuggggccuggccagg

SEQ ID NO: 16841 - RNA, 12952 nt, Homo sapiens
uguagaaaagaauaauggacugggcacgguggcucaugccuguaaucccagcacuuugggaggcugaggcgggcguaucaccugaggucaggaguucaagaccagccuggucaacauggugaaacccugucucuacuaaaagcacaaaaauuagccaggcgugaugguggguaccuguaaucccagcuacucgggaugcugaggcaagagaaucacucgaaccuggcaggcagagguugcagugagccgagauugcaccacugcacuccagccugggcaacaugagcaaaaaaaaaaaaaaaaagagaaaaggaauaaugaagauucuauauaauaugcauuagagcaaaaauuaaaauggaaggcauugagugucgauugucauaggcauuauuuacacucauuaacauauccucaaauaauccugcaacuccugaaaaaaauguugaaaaaauuuuaaaugccuuugauuucccagucuacacuaauacuuuucuucuuagagaaacaaaguucacacauguaacuugcucuguauuuagucaauuagcuaaagaucuauacuuuugccaacuaccgucaccucagauugaaggcuuaaagucuauaaacagcugcuaaugaaaaauauucaaaaaaugcaugagccaguaaaaaauuucucaucagucacaucuucuaggaaggaaacuggcauuucuagauaaacauaagaaaauaucaaugcaaacauucucaaauuaucuugcugaaauauugaguguuuucauucaaauuucagucucacuauugcacaugccuccugcagaugagggcucaaugcagaagucagaucuugccaaaaccaaucauuuaauaaaaaaugaaaaagaauaucaaaguaaaugugcaaauaaaauuggugcuuaaagcauguucaaaacguaaguccucaagacaaaggagucauaacucguuggcaggaaaacagcuaagcaacuacaccugauuuuuccacuuguccuuaauaagaucuuauuuagcuagcacaaacaaacaaaccaaagacaaaaauugcaagcuaacaaaaugaccauguauugaacugagucucccauucuuuaguuuuuaacucuauuuccuuuauaugggguaauaaucaguucauguagaaaauaaguuaucgacauacuuuuuuaaauaacagccuggguaucuucagcuucacgaaacggguguaacaguuuuaaucggcacgcuugagagaaccuagcauucaaucugagagcuuggcacucgccucauguucagggcgugacgauguaucucuugcaucugucugaugcgguccuucugccacaucagguuuugaggcauaggguaucucugugugccaugcaaguaccgguaugggauccucacgugacaagcaguggcucuacaacgagguuguggcauaggaggaagaagcauccaccucuuccucuccgcacaauaucgguaggcuucuuuccgauacuguuuaucaauaucaucacuguuuuuccagccuccuauaaugaagacaucaucuuuguaauagcaaauggcugcuccuucgaugcuuaggacuucuggaggcaagcuuucaaggaucucaucagacacuuggcuggcaauuuuucuuacugccucuucguuuucuaaacaauaacucuugggacaacaugaugcugucugauaaaaguuugaauugaccacagacauuuggaaaaagcaguaauugucaauaagcggcaaagauuccacaucuugccacugucgagucucuguaucauagcaaguaauuacagccuuuaauccaucuucagugucccggucuacaggagugcgggcggcaauguauacaaaccggucuucaauggcuagugcuuugacaucucgaagaaucuuuggugccgauuccaaguugugccauuuaucaagcucaggauuauaaacagucacaucuuuaaaaccaggacuaaaguugccauguccuccaaugcuauagagcuucccuuugacuucuguuaguccaaaagaaugcuuucuugucaucagacuacaaacauguucccauguauucaaauuuggguuauaccuuucuacaguuuuagcaaacccuggcuccauugauccagcaacauacacguaggauucuguuacugcaacagcauguccaucgaggugauuaugaauauguggcagauuuacccaucuguccucaucaacaaaguaucccacacauucacuuaaauaguccccuccuucugacacaccuccaauaaccaugaucacauccauguuuugcccauaacgaggcaauagugacacaugagaaguggggugcuggcaugugccagauuguauauucucagcucucagagcaugucucuccacugcgucagcgaccaacuugacacaaacuucauuauuggcuaccagccucucugguuugacaugucgaguaagguagguagguuucaucugggacaaccugagcaauuuaaaaaguucuucaaaguaucucucucucucuucagcauuucucugaacccauuucaaaacgguuucaaagagaaccucuucagaaucaacuguaauuuccaaaucugaaagccagucucuaaugagauggaaagguaacguauaaaauucuucauccugaaucacuuuguggaaauuucuccguaucauaucagcagccuucagagcaaguuggcucaggguguacaugugugcuaagcuaugaauugccacacaauuugagagaugaaguuuuuucuugagaaauucuccacaaaauucuuuuaaacgaaugaguaggaaccuaaaaucaagaaaaagagaaaagauuaauuuuucaaaugugcauauuuuaugugguuacuuuuuucuuuuuuuugagacagggucucacucugccacccagguuggagugcaguggcgugaucucggcucacugcaaccucuaccuccuggguuccagcgauucuccugccucagcuuccugaguaguuggggcauaccaccauguccagcuaauuuuuguauuuuuaguagagacaggguuucaccauauuggccaggcuggucucaaacuccugaccucaaagugauccgcccgccuuggccucccaaagugcugggauuacaggcgugagcugccgugcccggccuacauuuuuuuuuuuuuuugagacagagucucacuuuaucggccaggcuggugugcaguggcacaaucuuggcucauggcaaccuccgucucccaggcucaugcaauucuccugccucagccucccaaguagcugggauuacaggcgugugccaccacacccagcuaauuuuuguacuuuuaguagagacagacaggguucaccauauuggccaagcuggucucgaacucuugacuucaaaguuauccgccucccucggccucccgaagugcugggauuacaggugugagcugccaugcccggccuacaccaucccccccccaaaaaaaaacuccaaaaaaacagagucucacuuuaucggccaggcuggugugcaguggcacaaucuuggcucacggcgacacccuucucccaggcucaugcaauucuccuuccucagccucccaaguagcugggauuacaggcgugugccaccacacccagcuaauuuuuguauuuuuaguagagaugggguuucaccauguuggccaggcuggucucgaacuccugaccucaagcauccacccaccucagccucucaaagugcugagauuacaggcgugggccacugugccuggccauggccuacauuuaaaaaaauuauuauuuuuuuguagagauggggucucacuauauugucuacacuggucuugaacuccuugcuuuaagcaauccuccugccucugcuucccaaaguguuugggauuacaggugugagccaccacacccagccuauggucacauuucgagagcaucuaaauuauacauauggaaauaguuagauuaaucucacuuuacacacaaaaucugaaaacaacagcaacaacaacaacaacaacaaaaaacaccaccaaauuagaaaauauugugcuggcaaaguauguuuaaaagcacauauacgcugggcaugggggcucacaccuauaaucccagcacuuugggaagcugagggucgcuugagccaggaguucaagaccagccugggaaacauggcaaaaccaagucucuuuaaaaaaaaggcacauggcugggcgcaguggcucacaccuguaaucccagcacuuugggaggcugaggcaggcagaucacuugaagucaggaguuugagaccaggcuggccaacaacauggugaaaccuugucucuaauaaaaauacaaaaauuagcugggcaugguggugggcaccuguaaucccagcuacucgggaggcugaggcaggagaaucacuugaaucugggaggcagagguuauagggagcugagauugcgccacugcacuccagguugggugacagagcgagauucugucucaaaaaaauaaaaauaaaaagcacauauagagcugggcagggagaugcaugccuguagucucaacuacucagggggcuuaggcaagaggauuggcugaggucaggaguucaaggcugcaguaagcuauaaucgugccugugaauagccacugcacuccagccugggcaacauagcaagacugucucuuuaaaaaaaagcguauacaggccgggcgcaguggcucacgccuguaaucccagcacuuugggaggccaaggcggguggaccaugaggucaggaguucgaaagcagccuggccaacauggugaaaccuugucucuacuaaaaauacaaaaaaauuagcugggcaugguggcgggcaccuguaaucccagcuacuccagaggcugaggcaggagaauggcuugaacccaggaggcagugguugcagugagccaggaucgcaccacuguacuccagccuaggcaacacagcaagacucugucucaagaaaaaaaaaaaagcauauauaaaaaucuuauuuauauauaaaauauaaaguauuauuuauauuaguuuauauaauuaccuaucauauaugugaaauacauacauauauacacacauauacauauauaaaaacacaaaauagaguuuuuauuuuaagagacaggguuuugcuaugcugcaguggcuguucacaggugcgaucacagugcgcuacagccccaaacuccugggcucaagcaauccuucugccucagcuuccagaguagcagggacuacaggcacaugcuacugugucuggcuggagguuuuucuucucuuuuguuuagagacgguguuucacucuugcugcccaagcuggaguacacuggcgcgaucucugcucacugcaaccucugccuccuggguucaagcgauucuccugccucagccucccgaguagcugggauuacaggcgcgcgccaccacaucuggcuaauuuguuguauuuuuaguagaaauaggguuucacuauguuagccaggcuggucucaaacuccugaccucaggugacccacuugccucgcccucccaaagugcugggguuacaggcgugagccaccacgcccggccacacacuuuauuuucacuuuaauuuguccuuggcaaaggcaaaucccuauccaaacuugucuuugccauccuuuccuaauuccuugcuagucaccagccucuuuuuuuuuuuuuuuuuuuuuuugagacagaucagauucucaccguuacccaggcuggagugcaguggugcaaucauggcucacugcagccucgaccucuagggcucaagugauucccccaccuuaacuucccaaguugcugggacuacaggaacaugccaccaaacccagauauauauauauauauuuuuuguuguuguuguuguuguuguuguuguuguuuuucuccccgagauggaguuucgcucuuauugcccaggcuggagugcaauggcacaaucuuggcucacugcaaccuccgccucccggguucaagcgauucuccugccucagccucccgagcagcuaggauuauaggcaccugccaccacacccagcuaaauuuuuguauuuuuaguagagacaggguuucaucauguuggccaggcugggcucgaacucuucaccucaggugauccacccaccucggccacccaaagugcugggauuacaggcgugagccacugugccuggccacccagauaauuuuuuuuuuuguauuuuuuuguagagacaagguuuugccauguuggccagacuggucuuaaacuccugagcucaagcaaucugcccacuuuagugcugagauuacaggugugagccaccaugcccagcccaccagccuccucuuaaaugaaacagggucuaagugaagggacuuuaugguauaaaguaacagccaggcaggaacuucuuuggggaucugcucagucagauaucagaaggaacgccccccuuacucagauuuaggcuuucugcuagagguuuuauuucauuuuuaaauuuuucuccaggaucauagauucaaguugcccugaauauauacucccugugucagagguuuuaaucucgucaccagagcuuuuucuuugggcagccagaggggaugggguacugagaagauuuguccugaauuggguucucaucaaagcagggaugcaaagcaaacucaaacaucugaagaagcagaaaacaaaacaaaaacacaacaaaaaaauuguguaggguugggcgcagugguucaggccaggugcaguggcucaggccuauaaucccaacacuuugggaggcugagguggguggaucaccugaggucaggaguucgagaccacccuggccaacaugaugaaaccccgucucuacuaaaaauacaaaaaauuagcugggcgugguggcagguaccuauaauccuagcuacucaggaggcugaggcaggagaaucgcuugaacccgggagguggagguugcaguaagccgagaucaugccacugcacuccagcgacagaaugagaugcuaucucaaaaaaacaaaaaacaaaaaacaaaacaacaacaacaaaaauuagcugggcgugguggcgugcaucuguuaucccagcuacucaggagccugaggcauaagaauugccugaaccuggggucagagguugcagugagcugagaucacgccacugcacuccauccugggcgacauaguacaaagcauguguagguuaaaaaacaaaagaaagugaucuggcauguagcugacuagauauugucugcucaccuaaauccauuuaaaguuuaauuuaaaaaaaccacaaucguuucagacaaauucauaaaucuggcagcaaucagccugaggauagccaauuugagaccacugcuuuaaaaagacuaaguccccagaaccgagaagaaccuuaaacaagauuaagaaucacuucaucaauucaggccucucgcaauucaguaaccguuuguuauuagugacugugcuuaguaacucucuuaacuaugauaugaaaaucaauaaggcaggcucccuucacucuuuuaagagaacauaucauuuuagagauaaagcaaagacaaaguagagugguaugggauauaguggcucccagacaugucugggugccagugucaccugauucccaggcugcccugggcuccuaguuuuagcaggcacuccagguaauuuggagacaaauucccuuaagugucuggaagcaaugcucuaugaaaauagcugucauacacuuggcaucugucaugugaggggcauugugcacauccuauuauuauauuucugauccuuacaaaugcccagugaggcaggcaugaucaucaacagacauauguacuuagggguuuuggggggggugggggcggguccugccucagagcugaugggaagauuaaaugugaugguugcagggcacuuugaacagugccugacaaaagccauuggcuuagcugcugacagauggagagaaguuaagaguuuuuaguaaaaugcccagaguaucgucuccucuccucuaacuccccaauagagcaggagcaaaucugacaaacucaagaugauaugacagaaucaaaccuagguuugagugagugcaaugacccuuuuccacccauuuucaugcaacaaaccucucucccucagagcuaugcccaucccacuccaccuucucauugaugacccagccucuugagaaaacagagacaaucaagcaggaacuucaucuucccaccacccaauccaccagcaguuguacccuauacuuugcaguccaaccauuccaauuuuaauauggauucuacacugaagaauaaccagaauauuucaccccaaaauauacucauuugacauauucagaggggccgaaaccacaggaauagcuuugaagagcugucuuuugugggggcgauuugcaucuguagagaaaaucuacauuaaugagguaaacagcaaggaaaacagggaugcaaacaggcuuucucugaggccuccccuuacucagaucgaggaaagacgcacucacaggaaaaacuaaggaggcuaaggucugacacuuuaaagaucugacagaaacuuuucccacaggcuacauccauuuuuucugacagcugcugcccgugagguuucaccugcauaacaggacagccugugcuugccaggcuuuccucuccuggcucucccauaaccugucuugaugcauuccaagccccuauuccuuucuauaaccacaggaugguauaaaaacuucagucacccuuagaguuuucauauuuuguaugacucucgagcacaaaugugccuguaauaaucugcuaugcuuuucucuguccuauauaaccugucuuuuauuauaagaaugucagcuguggccaggugcgguggcucacgccuguaaucccagcacuuugggaggccaaggcgggucaggaguucgagaccagccuggccgauacagugaaaccccaucucuacuaaaaauacaaaaauuagccgagcgugcuggcagaugccuguaaucucagcuacuugggaggcugaggcaggaaaaucgcuugaacccggcaggcagagguugcagugagccgagauugcgacauugcacuccagccugggaaacagagcgagacucuugucucaaaaaaaaaaaaaaaaaaaaaaaaagaaugucagcugugaccccuuuaugagagggaggaaagggaucaccccucuuccaucccgacaguucccuucuugguugcaaggacuuuacuccugcaauuauuccccugcuccuguaacaccaauuacucaucuucuacugaaucauuuucagcagcacacagacaugcucuaguaucuuuuaccuuggugggauugucccccaaaacauuuacacguuucugauccucuuuauaaagcaaggcuuaacagcucuugucaauggcaucucugaccugcaaccaucacuaauggguugacagaguugacacgacuggcuacucccuccuugauauccuucuuuucuacguuuccaugagaucagucuccucuuuaagauucuuuuuuuuuuuugagauccagucucucacucuguugcccaggcuggggugcaguggcguaaucucagcucacugcaaucuccaccucccggguucaagcaauucuccugccucagccuccugaguaguugggauuacaggcaccugccacccacgcccugcuaauuuuuguauuuuuguauuuauuuauuuuuuuuuuugagauggagucucacucuguugccuaggcuggagugcaguggcacgaccucagcucacugcaaccucugccuccuggguucacgccauucuccugccucagccuccugaguaccugggacuacaggcacccgccaccaugccuggcuaauuuuuuuuuuuuuuguauuuuuaguagagacgggguuucaucauguuagcuaggauagucucgaucuccugaccucgugaucugcccaccucggccucccaaagugcuaggauuacuggcgugagccaccgcgcccggccuaauuuuuguauuuuuaguggagaugggguuucaucauguuggccaggcuggucaagugauccaucugccucggccucucaaagugcugagauuacaggcgugagccacuucgcccagccggcuauuuuacauucuagagaaccccagggcucagucuugccuacucucuccccgcugccccuuuucuauguauacuccuuaaguaauaccauccagccccaaggcuuuaguuaccauuuauacgguaauuuuccccaaucuguaucucuagcucccaugcacuucccagggaucuccuuaaccaaauccaaaaacuccugaucuuacucccaaacaggcucuucugcaaucuuccacaucuuaauaauuccauccuucccauugcuugggucaaaaagguagcagucuuuucccuuauaccccacgucaaauccaucagcaaauucaucucauccacuuucaaaauauaucuggaaccagagcaguucucaucaccuuuacuucucccuccucaaucgaagccuccaccaccacugccacaaccuccuacacuagucucucugcgucugcccuuggugcccccuccuccccaaugccacauccuuuguucuuuuuuuuuuuuuuuuuugagacagagucuuguucuguccgccaggcuggaguagagcggcgcaaucucagcuuacugcaaccucagccucccaccucccaggcucaagcgauucuugugucucagccuccccaacagcugggauuacaggcacaccaccacgcccggcuaauuuuuguacguuuaguagagacagggguuucacaauguuggccaggcuggucucgaacuccugaccucaagcauccacccaccucggccucucaaagugcugagauuacaggcgugggccaccgcgccuggccgccacauccuuuuuucagcacagcacuauucaucaaaucagacugcaucauuccucugccccaaaccuucccauuucaaucagaguaaaagcucauguccuuccacaggccaucaaggcccuacgggaucuggaucccugcccauuaccauccuggggcuucuccuguuccucucauccugcaucccuuugauacagccacacuggcuccccacuguucucuaacauacaagcuccaccucagagccucuguaccuguguccccuaccugacacagucuaccuuaccuccuucgguucuuagcaaaacgucuucuucauagggcauucucuauccacccaauuuggaaaacacuuccucucccccagcaguuucuauguacuccccccaugcuuuauuuuucaucagugaugacaaucauccaacaggcuauacauuuaacaaucauccaacaggcuauacauuuuacuuauuuaccguccaucuaccaaccuaagugcgauaaggaaaaggacuuuugucuguuuugaucacugcugaaacccuagcaccuuagaaucccgcaucugagcugaugcguaauaggcgcucaauaggcauuuuuguuaauguaucuguaagaugauaauugccaaaacaaacgccucuccaucucuauaaacgguauuaccugccuucuaaccagucucuggagcauuccugcucccuacaauccguuuaacacaguggcagaauaauauuaaaauauuuaaaugagcuauuucuuuacccagcuuccuaucacacuuagugaaauccaaacuccuuauuccaacgcaucucacgcauccuucuccccuucauccacuagauccagccucacuggacuauauuuuaauucucuucucuaagccaaacuggauccugccugagggcguuugcgcugucuggaauauucauuccccaucuuugcacggucaguuauuuuuugacauucagaggucgaucuaaacuucaccucuucagaaagaucuuuauucaaucccuagccuuucauuccuuuugaacgucagcacaacaguuaccacauacugacuuuccuuuucaucacuuuugucccaucaccuaguaucugagcuccuugggcgcggggcgcccucgccggaccugauggugcauccuccucgcccaccgcgguggcugcccccaagcaggcgcucagcgagugugaaaccaaugcauucacucaggacucgcgagcugccguggcaggcacugcccuccccuccgccagcgagcaucucccccucuccgcgcccgccgcccuccgcgcucccgccucccucgccuaccugucggccaacuccagcaccucgugcacgcugcccgugcugacgcggaugcgcccgguguacauguacucgauuacggcuuccacugugucggguucgggccccggcucggagcuccacuugcgcaucuccacccgucccgagcgggacucggaaaacuggcccgagagcaggggcgugaaguacucgguggcggcagccaguaccgagcggugggcccggaacucgcggccuccagccccgccgaagcacaggguaaugucgcagaagaggcccuggcgccgcugcucguucugccgccaggacagcucugagcagugagagcugcacucgaaauccucggcuucugggcccggaucgcccccgcucgccuccauugcagagauccccggcccaggcccgaaguccaccgugccgcugccucggaccucggcggccaguccugccgagccggcggcggccgucuccaugcucuccaucuccaguaccugaagagaugcagccgcggccgccgccgccgccgccgccacugccgcagccgccaucuugacgccgcugcgcccggccuccacagccucggaacgaugcggcuguugguacgacacagagggauucug

SEQ ID NO: 16842 - RNA, 8261 nt, Homo sapiens
acagagaaauaaaaagcuuuauuauucccucuaagggauuaaugccagggaaugaaugguccccauaccccccaccccugggggagacugacagaacagugcuggacaaggcauggcccccuucaguuugggcugaacuuccaaccccugaagccaucacucaagcuaaaaugagcaguucugguccucagggaaacagccaccugggccaggcccaggaauccaagccuccaaagcucuuggggaccaggccugggggccaccacggcugggcaagguucaucccuggccaccagcuacucuagaggggcugggccccaacccaggagaccucucacacacagugaaggcugggacagagcugcacgcuugggggugccugaagguccagaaagagcugcaggaucggguccggaggacccuuggcuggagugucucaagcugagucggguccguggggccagggcacccccuaaggaucagaucagaauccgagguggagacauuccaggucagggcugcggcccaaagaugggccuacuugucaaugaggccucccuccuugagcuugaaguagaagaacuucuccagggcgcuggcacagcggcaguacucgcuguccgggggguuguacucgcgacaguuggcgaugacccgcugcaggucggccacaaagagcuuccgggucacguaguagcggcuucgcagccgcucagucauggucuucaggucuggggcagcaggagacggagcacagcuuuaagaggcugaagaccacggcagggcuguccaccagggugggcccccuggggcugcagggcgcagugagggcaggagcagguguggggacagaagaggagggaaggggauggaauggaagguccucaccaauggggaagcggaugaccucguaguagucaggggccuccgacuucuucacaggcuccaugaagggccaggcacuggggugagacuggagagaagagccgggcuggggacagcccugcugcgcccacgccagcccgagaccacuacccaccccacacugcaucaagaggccacagccauuggugcaggggcccuggaaaggaaaccuggucuccccaccuugauuugggccagcagguuuuugaggguuguguagagcuggucgggguccuucagcuccuuccuggggcgagagacaccaagucugaggcuccaagucccucugccccacccccaacccggcuccuuugacacucaccccuucuccuuccccaauggcuuccagccugucucuccugcaaagugggaagugggagaaugucucuaagaaugccaguccacaccccaagcaucgugcccccacuacccugcaacugagaccccugcuuacgaaugccaggaacgcucuccacagggaucugccucacgcccuccuugaagcagcugagccccggguagaccuugcggaucugggccuguuugcgcucaaucagcuucuugaugaucugagggaaggaagggacugaggggccaacuccagccccaacaacaaccccucccagggccacagucggagccacuggcugcacccacccagcugcaacgccaccuaauccagcaccuccccucauaacuuccccaagggagcagagcaagagccaagauccuggccugccccuccucacucacacacauauaugcauguagacguagaacaggucuacacacgugugcucgcccucugcaugcccauucaugaaaaaucccacagaugcgcaugugugcacaccaccucuuucugcuucuugaugaugugggacagcuccguguaggggaugcggggauucagcucacacuccaucagcgucgcucccucguaguccuugauguagcccagguagcggcucuugggcaccuugauguccuuggagaaacccugggggguggauggucaugacccaguccauccauaaguauuucccaacuucugucgucccucaccugggagcaccagaggaguagcacgugccacuugccaccuccugcuccugaaccuccuccuggggcacugugaggguucaaacugucccuggaaaggucccaggucagcugcccacuccugacucaucccgaagagucccccaguuccuccagccugcucuacuggccccccaguuccucuagccuccucuacuggccccccaguuccuccagccuccucuacuggccccccaguuccuccagccugcucuuggcccccaguuccuccagcuugcucuacuggccccccaguuccuccagccugcucuacuagccccccaguuccuccagccugcucuagugccccccccaguuccuccggccugcuuuacuggcccccuaguuccuccaggaugcucuacugacccccaguuccuccggccugcucuacuggccccacaggcccucauucuccccuggggcaauggcagcagaggaaagaagauaggcauggagacucuccuggcaggugucaggugaaguaggggacgcaaagggacuccuacuccauccacagaggggcuggacagaauuaccccagccuccaggcaaaggaccggugugggacgaggcuacgggucaccugcuuuuugaaguagccgauggcguacucgucggcguaggugaggaaguagagaauguugugcuugaugugauacuccuucaggugguucaucaggugggucccauaacccugcgggggagggaagcaggacucaccaggagcugaggaugggccuggugcuggagaggucucagagaccagagaagagcggguagauuggaaaggagguagagagagcgagagcauccaggcaaagaggaagaaaggcagcugacagaggaaggggagcuuauggggagaaagugaagggugcgggcuuucuaagcucacucugggcuaggugcagugcuuccuguuuuacagaccgauucucaaauuaaccccagaggcgaguauuaccaccuuuauuuuacagaagagaaaaccgaaacucagcuacguuaggaaauguguucaaggucaggcugccagccguggcagggccggguccaaacccaacacaggccacugauucccagucccugggccucagaguugggagaagcgggagagggagucaccagaggucugagcagcaggagcaaugccucccacacgucagggccaaugaggcaccacacagaucugagguaugcgacacacagagccagagacccuacgagugggucuguuguaacaaaggacagaagccaaaacuaucagcauagggcuacuguaauaaugauuaguuuggcugggcgcgguggcucaugccuguaaucccagcacuuugggaggccgaggugggugaaucacuuaaggucaggaguuagagaccagccugggugaaacccugcaacauggugaaacccugucucuacuaaaauacaaaaguuagccagacguaguggugcaugccuguggucccagcuacuugggaggccgaggcaggaguaucacuugaaccugggagguugaggcugcagugagcccugaucaugccucugcacugcggccugggugagagagacccucuuucaaaaaaauaaauaaaaaauaaaaaguaaaguaauuaauucccccauguauguaaauguucuugugaugcagaaaacccaaguccacagguccaccaaaguguggcugcugcuugggcuccgucugucaacaggugguuuccuaauccacaguuaucaaaguacggcugccaccuuguggggaugugaggaacgggccgcuaacuaagagaagagcaacgggcugcugcaugccacacauccugcugcuccgaacuggcccaaacucaggagugggccguggacuggggcuggggccggggagccgcgcucaccuugaccugcucauucgaggugacagcacagaagacaaucuccgugaagcccugggugggaaacaugcggaagcagaugccaccgaugacccgcccauccuugaucaaggccagagucuugugcuuccuaagagagaggggggcaugucauagccccugacuguccccuucagguccccagagcccuggaagucugagcuguagucaggguugggcagugagaaguaagaaugcucaaaggaugaaccucagaaguggggagcaggggauccccaauuuugaggagugaagaggccgaggaggaagggaacugggugugcugcccugggggaggggcucucugggggacgcacgggucaaagacgaggcgggcgauauacuccuuaggcaugcgcggcagcuggugggaaaagacauucugcagccccacgagccacagcaacacccgccgguuggccuugggcgucagugaguugccgaugacauggaacucgaugaugccgcggcgcuccuccaggcgggcugucucaucccgggccgcauuggccgaaagcaggcucgucugggcacagaagagggguggugagccggggucucagguuggugggggucccccaacuggucagcaggucgggcugcccaccucaggccccagcauggcagcagggucagugauggucagcaugaccucauugaccagcuccauggggaugucacccaucacacggagccgcuuggcauccuccagggucagguucucugggagcguccucuucucgccuauuggggaggcaggcaagguugcucaggaucaguaaaaaagguuugggaaggagugaaugagggucagaggucaggggucaaguauccaccuggcauaggcucggccccugcagaauccagacucagggagcuguugcugcccccacccaugcuggggcugaagaugggggugcugggaacaaccgcugcacugacugaagcugaggagagagagagacgucagggauggggggcugaagcugaggagagagagagagaagucagggacgggggcugaagcugaggagagagagagucagggacgggggugcugaagcugaggagagagagagagaaggcagggacugggggggcugaagccgguggcaggucccucagugggauccagggccuccggcccaggugagcucucuuccacccaggaggcuuagcucagccaggcaggccagacacccuacagagcguaccauggcacauaccuggccggggaaccagcuguguccccucugaggguggcauggugaagccugacucccagauuggagaguuugccccauagaucuccuccuccagcauggacaggaaucuguagggaggacacagucugucccacaacucuguucuccagggugcagccugggccaggcagcagagggacuggaggcuggucagagacagacccugcucuuagggaacuggggaccugagagaggggacagccccugucuucugggagccuccaauugaagguaagaggacaggacacauccaggacagagaucaaacaggcucaguuucaccacgcuguguggcacagggagacaggucugagcugaugucauccugugcuguguggccaggcagggcaccuugucacccugagcccccucacugcccucaguaucaaaaugggcucagacuccaccccaccuugccaucucuuguucccaccugauggcagggggcacuagagagccaggauuagucagucaggguuuuuugaacaggggaguuauggccuagauuuuaaaagguguggccgaacagaagaaaaugguacagaaaagaccagaacaggaguagaaauugguuucacuucaagcuuaaggucugguuucuuggagaguugugcagggaaggagucugaggcuguguccaggcccccaugggaaacaauuaguaacaucuacuggggcguagggucgggugggggcagcguuagcuugggcuauguaccugccauccccagacuaguacuagcaaguugcuucugggccaugggcaagucugccagguagacgcccagaucccaaaaggcccauggagggagaggagggaccaauccaggaagccuuccuggaaaaaaggggacaacagggaggaugugaacuuggggccaaauccugguaggccagaaggagccuuacuuggggaagugagugaggaugaggguccucuucucgggcaccaauuuguccuucuccacucggaacuuuuccagcagcugccggcggguaacggugaaaauggaccggagaaggcuucgcccaaagacaugagugguuucguagcgggggaggcuaucacagcucuggggcacguggcaguaacagagccaucuggaguagggggucgagggggagacaggugagggcggaaaccacugaacccaggcugggccugcaagccucccccgaagcugccccuggcugggccuaccugguguaauugaccuuguagguagccacguccucagccugagaccucugccgaaacugggcaggugucucaagcuuccaguaguuaaggcagagcaagaacaucuuugagagcucgaacaucgucugccgcucccggggagccaggugacuaaacuuguacugcacaaaguucagcacacccugagaaggggugggugggggauaaaaccaggaaugaggugugagcagcccgcagggccuucuuagacaaaggaagaugcucccuggccagggacaagguucuccuucuccucucucucucgggugcucucuauagaaaagcucugcccccucccuaccaccaugcccacccugagguuagcacaaaacacccuuccuucucugaaccuccccaguguucucagcuugaggagaauggagaacacaggcuccccacuccuccaagcuguccccaauucuccuauccgcuaucuccaauuccccuaucucaccugcucaauauuagguuucucaaauggagggcugcccagggaccccuccaccacaggccgggucaucugcaggaugcauuuccgcaguagcuagagagaagaggaagggggcauagaggggaggggggcagagcugcagacaaccccucaaggccccaccuccuucacucacacccuccuuuaguggaagcucaccuugaagagguagaaauagaccugcuuggugucuguguccucuuccuugugaacagacaugaagagauucuccacauccaccaccauccccagcagucgguuuaucucauccucugacacauucuccaagugggauacguggucagcugcaagacagauggcagaguuaggaaaaauugauagaagaaaucaacaaggcuucuugacccucuucacagccaagcaagauacacacucuguuccuccaaccagugugaccaacagugagacugacugcuccgauaucaaccguuggguugccugggccuguucugggcugagagauuuccuuucuccccccuuggugcacacccccccccaacccaaucccuccuucgaggcaucuuugauuuuuucagagaugaagcuuuguggcacuugucacccuguccaagcaggacccagcaccugcccccagcuccaagggcgcugccugccuuacccaaggggugcucacaacugcggcacagcucacucagguuggcagcuggcugcugcagauccaugcggggugcaguggggggcuugggguuuuuccagccauuacacuuacagguuucauuggccuggagguggaaggaucagucaaugaccuauaccucuggggcaagagccgcuccgcagccagagcuuugaccccauucccaccagagcccugggaugccccaagccccgccccuucaccccaggccccgcccccaccuugcaagccgagaagaccccuagcuucucaagcuucuuggcgcgcggcagcccccggacuugcgccuuccucugacuggcgcgcugcugcuggcucaggccaggucgagccggaucccccccgcucccggcccccccacuuccuaccccgggccccccagucccugugcugccggcuggggcugcagcuggggcaggggcuggugccggggugggagucggaaucggggcugaagccgggcugggugcaggagucggaguuggggcaggggcuggggacugaaggggccggggcugcgcagccggggccggggucggggccugggaagguuccgccauggccucccccgcagcggagagcggcgccgcgcucccagcccuagggccgcaugggcaaccagcgcuca

SEQ ID NO: 16843 - RNA, 20812 nt, Homo sapiens
auccuuuuagaaaagcagguuuauuggucgggcugcucaccaggacacagcaacgugagagguuccccaagcccacagaaaacugcaucugcccacagcucaggccccuucaggccaucagcaccaagggaccuugucccacaauccccaaccucccucggcagaggggucuucagccauucagaggagagaagagaaccgagaaagggaaaaggaagaaaaaaaaaaaaaaagcaaagcuuuguauuguauaaaagguuuguguccccaggcucccucccccaaucccuuaaaacaaugaacugcaguucuaaaaagcagggcagagaagguaaggagcagguggggggaaggaggaagcucucggggccucccuucaggcugugacuggggagaggggcuguucuugcuucugacaaacccccuuuaauggggaggaacaaggggacucgugucuugagaaccuggucgugucuugagaacccaguccaaacagaaucaggccucuggacugggagcaacacucccuucacccgcaaagauucaggaaaagcaccccaaggacaaggaaaccaaugaggucugggcuagcucugcagcuuuaggauacuagcucuagggaaggauuuuuuccuuuuuaaacagcguaucacucuguugccuaggauggagcacagaggcacccucauagcucacugcagccucaaacuccugggcucuggcgauccucccgccucagccucccaaguagcugagaccacaggcacgugccaccaugcuccuagggaaggagcuugagaagaaacugccaggagugaaccagggcuggcugcucugugauguucucuccccaccuccccuccagcucucaacuugguggcagggccggcacccugcucucccuccuaacucccagccugcugcugcccccuucugggacccuaauuuucuggacuuugagaaaugggcugccccugggggugccuccaagagcccauuugagggaucggguggggcugaccucucugucuucuuuggaucaucgccuucucacacuguccucccucuugauucugaaaaaugguccugcugcccauggagaaccacaguaagauagauuucucaugcagcuagugaggggacuucucucuucacccauuuccaccuucuccuauuuuccuuuuuuuuccuucuguugagauggagucucacucugucacccaggcuggagugcagugucgcgaccuuggcucacugcaaccuccaccucccagguucaagcaauucuccccaccucagccuccaaaguagcugggauuacaggcaugcgcaaccaugcccagcuaauuuuuguaauuuuaguagagauggguuuucgcuuaguagagaugggguguuugccaggcuggucccgaacuccugacuucaggugauccgcccaccucggccucccaaagugcugggguuacaggcauaagccaccaagcccggccgaccuucuucuauuuuuccauucuccuuuccaaagccauggccaugcgcuccuguguacaggugcauaaacacaucagugugccaucccucacaugcaugucguuccccaccccuccuucccagggcuucucuuggcuccagcguuccucugggacccucugcagauacagccugugcuggacccccagccagggugagggcucauucugcucugucuuccccacugccucaguuucccccaaaagcugcuuucacguccuucuaguagggggccucccaugggggcagggauccccuuuaggauucaaucuuuccucuuugggcaguuuuggcuuugagucccccagggaucagggugagaaugaagaagagcucagugagcggaaugacagcagcugggugggugguguggggagaggcugaggggaaggcagcccccccaggggggccuaaccguggaaucacugcaauuuccucugagaucccgacuuggacaaccaggacagggauugaccauucccuucccauuccacucggacuguguccaagcggggguuguccacugcgggggcugccuccccaucggguccuaacagcucuaagacugggaguggaguuccuggagguguggggaggggggcguguuuucaauuuagaaaaaucucagccagcucgagccgagagagaaugcgaaagaggaaguucggaaggagcgaggaaugggguggguggcagcgggggcggcucagucgcugucgcucuuguccaccagcacggcguccgacuccucggugaucuccagcagcgcgugcacgucggggcugcucccgcgccgcaggucgccggccuccccgcgcuccgcgccgcccucgucgucgucggcgcccaccuccaccaucucgguggccuugagcacuuccaccuggcccucgcggaucuucuugacguggaaggugaaggguggcaccuuguagaccgcggucuuggagcgcgcguacaccacguggucgggcgugaaggauuugcgcaacuugucccgcgacgucuucaguuucucgcgccgcucggcgggcaccaggcgcgugcccagcuuguucaugcgcuucuccagggugugccgcgucuucuccagguuuuccuuggucuugaggcgcgucuucuccagguucucgcggguacgcaccuuggucuucuccaucuucuccuuggagaaggccuucuugaagucguccacgcgccgcaggccgcugcgcuugauacgcucugcgcgggacuccucaauaaccuccucaaccuccaccgccucguccgacgaaagcuccagcgccgcugcguccuccucgggccgcucgcccucgcccagcuccucgcccuccuucucuggcagcgccuccgacucuuucagcgauuugcugaugcucaguuuggccggcagcuucacuucauccuaagggaagaggagaagggacaugagaggcgucggaggaggcggaugugggcgagccugagucaggguggugacgauccuggagagaggggagcaugggacgcucgugguccccaggaaacuggcgggcgcucaauaaauguguguaggcucacgccuguaauauuagcgcugugggagaccgaggcaggaggauggcuugaguccaggaguucgagaccagccugggcaacauaucacccaucuccggccccccaaccccgcgucgccauucuuucucucucucucuccuuguuuuuuuuuuuuuuuuuuuuuuuaaacggagucucgaucuguugccgaggcuggagugcagugggcgcgaucuuggcucaccgcaaccuccgccacccggguucaagcaauucuccugccucagccucccgaauagcugggauuacaggcgcccgccaccacgccggcuaaauuuuguaucuuuaauagagacgguguuucuccauauuggucaggcuggucucgaacucccgaccucaggugauccgcccgccucggccucccaaaguucugggauuacaggcgugagccacugcgcccggccucgcgccgccauucucuaaaaaacauguguguugaacgaauggugacuaaacagaccgcgggagcaggggaccaaacuucgggucggagaugggguugcguaauaauugcacuugggcuaaaaucucuguggucguccaacccuguccugaucccuuuccacccguagaugauauuaaaccacuacggcccucgggagacacagcuccacuuuggaaaugggcggagcgcccucuggugccgcaaaucgcacacugcccgagccaggccgaaaagcaaguggugggagugucuaaguugaaagcggguagggguuugagcccacagcugcaccuacccacccaagcagguaaaguaaaggaagugcauuuccuagacucaagcuauuucuuuuuuuuuuuuuuuuugagauggagucucgcuuugucgcccaggcugcagugcagugacacgaucucugcugacugcaaccucugccucccagguucaagcaauucuccugccucagccuccugaguagcugggacugcaggcaugcgccaccacaccuggcuaauuuuuuuguauuuuuaguagacucgggguuucaccauguuggucagauuggucucgaaccccugaccucaaaugauccacccgccuuggccucccaaagugcugggauuacaggcauaagccacugcuccuggccucaagcuauuucagaaccagccuuagagauggagaacugugguccacccucccccaccuccaccuucuuugacuccuucauacuguuuggcuccaccaguggucauucucccccucccccacauuuagaaauugauauuggaaagaggaagaagcuggcugggagccacggacauguuuucuccccagucuggacauuucuucugguugugacuucccuacuuugggauagaagagagauuacuuuucaauucuugcuuucccuacccccugcccccagcacaaagccugagcucaggggucuaggaguaggauggguggucucagauuccccaugacccuggagcucagaaccaguucuuugcuuuucugucuucuccuuggaggacuuagcaccagaacugcuuuccauuccgggaagauuuuccaagaucuugacucuggccaacauuucagaaucucuggaucacucccucccccaccuccacccucaucagagagcaggggaggcugagcacagaaagggaaagggcagaccaagaucaucaauaggaucucuuuggcccagacucccuuuagugacuucaaaugaaggaacgagagauagucgcuuuucuaaaggguuuucugaagaccauuucccagaauuauaagaaaaauccuguccccuaagaaauuaaggcaacauaaacugaguccucucacugacaccacacacacacaccccuauacauaggcugcucgguaucucugcaccaccugcuacagaaauuccuuccccagcccccaaccucuuuccucuucccucccaucaacauccccccagaguuuccugguuuacacugaaaacuaggaacacccucucccaacuuccuucccuucuugucaauagcauuagcagggacaaagagggaaugcuggcuccaccucuucucucaucugggcaucagcucugcugggcaccaagccaccuccagcucucuguuacccaacuacaccucccagcaggcaaggugaccugggcacagggcaugcugggacuuguagucucuaccugccauagacggcuuagugcagaucaugggcaauccuagggcauuuuguuuaucccucugccucuuaucauucacugaggcauugaaggguguuuuccuuguucugaguguaggagagucucaacuucucuuugcauucccucugauuuccagucauucacuuuggggcuccuacaaucacccuuacccugccugcuacuggagugcauaucauuuaagacuuauacaucauuguaggaucuaaacccucuucauccaucuccacccagaauuuaccugcagccccaguauauauauauauuaaaaaaaauucagcucugaucuuuccuucauaaccucccagacuuaaaaacccacccacgccccaccaaaggguggagagagccccuccuuucacuaaacucagacaaugugaauaggcuagggagggauuaagggugacaggcagggaauagucaggaaacagccccagcugcuggaaaacaaauccacuuugucucucugcccuacccccagcaucccccgcuucuccccuaccccugcugccugcuccaccccaccccuaaaggcugagcuggcugguuuuccuggccuguggcuuccuagauaaaggucuuugccagcugaacuuggaagugaaugggacuggggagagagcugcagacuucuuauagccaaugccaucuuccuagugccucaugaaaggucucaaacuacaacauaaggaagcaauccuagugagaggagguuuuuguuuuuuaguuuuuuuguuuuuuuugagauggaguuuugcucuugcuccccaggcuggagugcaaugacacgaucucggcucaccgcaacauccgccuccuagguucaagcaauucuccugccugggccucccaaauagcugagauuacaggcaugugccaccacaccuggcuaauuuuguauuuuuaguagagacgggguuucuccauguugaucaggcuggucuugaacucccaaccucaugugauucgcccuccucagccucccaaagugcugggauuacaagccuaagccaccgugcccggccuuuuuuuuuuuuuuuuuugagacauggucucacucugucaccuagguuggagugcaguggcgcgaucucggcucacugcaaccucugccuccuggguucaagcaguucuccugccucagccucccaaguagcugggauuacaggcaugcaccaccacaccuggcuaguuuuuguauuuuuugguagagacaggguuucaccauguuggccaggcuguucucaaacuccugaccucaagggauccucccaccucggccucccaaagugcugggauuacaggcacgagccaccgcaucuggccauuuuuguguuuuuguuuguuuguuuugagauggggucuuguucugucaaccaggcugaagugcaguggcaugauuacaggucacuacagccucaaccuccugggcucuagugauccucccaccucagccucccaaguagcuggaacuacaggcgcacgccaccaugcccagcuaauuuuuguaguuuuuguacaggcagagucucacuauguugcccaggcuggucucaaacuccugggcucaagugauccccuugccucggccucccaaagugcugagauuucucgcaugagccacugugccuggccaaggggagguuuauuccuggauuuagaaaucucuccagaccaguaagggaucugggggcucuaaccccauucaucguaggcuuccccuggagugacggcuuacaccauaggagcugccuucuugguggaaggucaggggacaggagacgaaacaacuugagcugaauccugggaugauguccaauaggcuggcucuggagaggguauuucaccauuagcuuuuccucuccacuccaggccagguuucccccaugacucacagccuuggagugcugucuuggucccacccaucugcuugcugguacaaccaccacaaacacaauccaaaaucaucucccuccacccugggcacacaggccaggcacccuugucccaccccuacuucucuggcagagcuccuaagccaaaggaaggaccucaggggauggcaaggagggacggcucugcuuguucuguuucucguuuuuauuaaacaaaaccaccacucccaauaggcuugguuuccagaguuaccuuuaaugaccagcucugaacaaaagcauuacaguucccccugcccuuugccaagcacacauagcuccucaauccucgauggaugcagaggagccacagggaggcucccagccucuuccacuccaccccccaacccugcugucuaaacucgagaucuggcuuaggaagauuuuuauaagauuauaaugucauugagcaccuauuacacaucuggcccuuggccaggcacuucacauuuguuagggagaagggacagaugccacaugggucuggguaggaggcucucuugacuuaaggcugaccagcucuagguccccaaccacugccugggaauggcuggaggagacuggagagguaauucagagacccaggaucugcuuagaguguauguuagaagagggugcagaggaggggagaggugaaggggagagaacgucuuuaaaauucaggaccucugcuagagguugcuaagacaaggagaugagagaccccaagggcagaagugucccucccuucugcucuagcgugcauucuuggcaggggugaaauugcauccaaaagggugaaaacugauucuuggagauugggaggggacuuagauaucacaaugauuugugccacucccaagagccacaguacauaaacagauauacaguuuaucuauuguuuuaacauuucgugagggagaugaacagcuugguuaaaaauaucugaaaggggccgggugcuguggcucaaggcuguaaucccagcacuuugggaggccgaggugggcagauuacgaggucaggagaucgagaccauucuggccaacauggugaaacuccgucucuacuaaaaauacaaaaauuagcugggugugguggcacgagccuguaaucccagcuacucgggaggcugaaccagggagguggagauugcagugagccgagaucgugccacuguaauccagccuggcgacggagugagacucugucucaaaaaaaaaaaaaaaaaaaaaaaaaaaaaaaaaaaaaauugaaagggccaggggugguggcucaugccuguaaucccagaauuuugggaggcggggcagaucaccugaggucaggaguucgaaaccccgucucuaccaaaaaauacaaaaacuagcugggugugguggcacaugccuguaaucccagcuacuugggaggcugaggcaggagaaucacuugaaccgaggagguggagguuguaguuagccgagaucacuccacugcacuccaaccugggugacagaguaggacuaugucucaaaaaaaaaaaaaaaaacuaaaaggucuguauaugggagugauuaugaaaacaacaacaaccaucaacaacaaaaacuggcugggugagguggcucacaucuguaaucccagcacuuugggaagcugaggugggaggaucacuugagccccaggaguucagaaccagccugggcaacacaguccaaccccaucucuaaaaaaaauuuuuuuaacauuuuuuuuaaguugagaaacacucugcuauaggaaggccagagguccugagccagagccagcuagaaugucccccuccuggcaucugugaguuggcagcuuuugggcaccccacccaaggcaggaucuggcaaacauaagcgaucucuuugcaaagcauuuucuaaaagaaacuggagaaaauacguguaaauguuuuccucagcugcagggaguggguggagagggcacagaacagaccccaggccugagccucaugauggcccucuccaaagaggcuuugagccaaacuggguugucccucaggaggaggcagcagggggaacggcagaaccagaagccaugcgccuucaugcuaggcagccuucgggugcagcuuaagugugggggagcauuuacuacuaaaaacagaaaccaagaaguggggaggccccuuccauuccccucccauccccacuguauacaucccauucuccugaacuuugcauaacgccaguguucucacaguacccggcacccguccacagugggcagugacuggggaugguggcccuccuggcagugaucaccacuaggcugugggcugacaguggacugaagagauaccccacgcccacagaacgggauccgggagacccuaaacacucccaccggcugucagcuccucuggggugggccggggcccaggcucuggguaauauggcagugcccuaggcgucuggucaaaaggugggagcucaggcacugucucaggcuucaggucaaagggcucagucucaggcaggucaaaaggcacgaucuuggguguggccaggucagagggugcauucggcuucuucuugggcuaagaugaggaaaagggguuuaaauggggcuuggggugggugcaaaaggaguugagaaaaaagggccuugguggcaugcagaguaggggcuggugaguagggaggggagcacaauguauuaggauggaaauaaaccacuuuuuuuuuuuuuuuuuuuuuagaaaugggggucuugcucuguugcccaggcuguagugcagugcacaaucauagcucacugcagccuccaacuccugggcucaagcaaucuucuuaccucagccucccaaauaucuaggacuacaguuguguaccaucaaacccggcuaauuuuuuuuuuuuuuuugauagagacaaggucucacuauguugcccaggcuagaaacuauuuuauuuuauuuuuuugagacagagucucacucuguugcccaggcuggagugcaguggcacgaucuuggcucacugcaaccuccaccucccagguucaaguaauucuccugccucagccucccgaauagcugggauuacaggugcaugcuaccacgcccagcuaauuuuauacuuuuaguagagaccggguuucacuguguuggccaggcuggucuugaacuccuggccucaagcgauccucuugucucggucucccaaagugcugggauuacaggcgggaaccacugcgccuggacuauuuuauuuauuuuuuugagauggagccucucucuaucgcccaggcugcuaaacuguagugcaguggcgugaucucugaucuugguucaccgcaaccuccgccuccuggguucaagcgauucuccugccucagccucccaaguagcugggauuacaggugggugccaccaugcucagcuaauauuuugaaauuuuagcagagauaggguuucaccauguuggccaggcuggucuugaacuccugaccucaagugaucugcccuccuugggcucccaaagugcugggauuacaggcaugagccaccaucaugccuggccuagaaacucauuuuaaaugcuucaucaagagggcccugggagcugggcacaguggcucacgccuauaaucccuguaaucccagcacuuuggaggccaagguggguggaucccuugagcccaggaguucaagaccagccucagcaacauugcccaggucucugcaaaaaauacuguuaguggggccuguuggcacaugccugaaauuucagcuacucgggaggcugaggcaggagaaucacuugaaccagggaggugaaguuugcagugagcugagguccagccacuucacuuuagccugggcgacagagcaaaagucugucucaaaaagggaaaaaaaaaaaaaaaaaaaaaaaaaaaaaaaaagaggucccuggggccaaaagggguggggcaaacucaagcccaagaauuaauaaacacagcuucaauugagccccucccuuccucccucuacaauauuccccagucccauucuugggcuuccaucuccaauccuuccccagccauaaucauaggaagacuauggaggcuacuagggguggauaaggaguuuucuaaggggcuaguuguuggauuauaacuggggaggcucagaugaguaaauacaaaggcacacaacuucacugucuucagagucagacucugccaaucccaguuuugugguuguuguuuuuuuuuagacggagucuugcucugucacccaggcuguggaguauaguggcgugaucuuggcucacugcaaccucugccuccugaguucaagugauucuccugccucagccucccuaguagcugggauuacaggugugugccaccaugcccggcuaauuuuuuuuguauuuuugguagagacggaguuucgccauguuggccaggcuggucuugaacuccugaccucaagugguccacccaccucagccucccaaagugcugggauuacaggcaugagccagugugcccagauuaaucuguuuucauucuucccugggguaggguggacacaggaugcuaccccaaaugaggagagggauaggcauggaagagggacauccuggcaauuucccuuuggccacguccccaccuucugucucccuugccaccccucccucuugcuaccacuuaagauaucauacacuaaaaugcacagagaaaucaggauccaaaaccaagcucuauuuuuuuuuuuaagauagagucucucuaugcuguccaaccuggcuucaaacuccuagucucaagcaaucuuccugccucaacuuauugaguagcugggacuacaggcacacaucacugugccuggcaaaaccaagcuauuuuuaugacaggugagccuauguccugggaccucuggaccucugcggcagcccccaacucucucuccugaggggcugaguuguggaagacuauaggcuucuugcuuugagcaaucagaugccaggcgagagggacacuuggcggcacuauuggacucaggcaauagcaguauuugauaaagccuguagucucaaaaaaacaaagcagcaggucccaaccuccccugcaggguacaaggaggaggugggaguggcagagaggcugaagagaaagggaaacaacaugucccucuccuagguauguguggagucccugccagggcacaccacggcugaccaggagcuccacuccuccccuacgccccuccccuccccaacaccccuccuuucccccacuuuucuccccuacaccccuccccuccccuacaccucuccccucccacugucaccaggccaggugaccacacauugccucuacuucagcacuuacaaggcuaagcagccaauggccaccaaugcuggccacucauagccaacgccacacacacaaacacccauacacacgcaaagcagccccagggccaggacugugcaacuaacucccucagcaagugucggagccacagcuagcccuagcuuugucagggcuagucuucacucagcuuucugcugcagagcccagaacggaaggaggggguggggagcagugaguguagcggaaggguacaccuggguucuggcuccaguuugacucccaaucacuugagugacaauaggcuagugacuuccccucucugggccucagcuuccuaaaccacaaaaugaaggaguugaaguugauuauuugcaaagugucuucuagcucaagaaguguauaaugaggccgggugcgguggcucacgccuguaaucccagcacuuugggaggcugaggcagacggauugcuugagcucaggaauuggagacccugggcaauguggagaaaccccaucuccaccaaaaaauacaaaaauuagcuggaugugguggugcaugucuguaguccuagcuacuugggggccuaaggcaggaggaaugcuugagcccggacgacaggggcugcagugagccgugacagcugccacuacauuccagccugggcaacagagugagacccugucucagaaaaacaaaacaaaacaaaaaacaaaaaaaaagaaaaaaagaaaagaaaaauuuaaaaaaugcuaaugacagaaugaugaaauauucacaauguuauauuuccaaaaaaaaauggcccaagccacuccuacuucugagguuaguugcuuagcaauaauauccccuccccucuugcuaucaguugcccacucuuugcugucuccucaugcuuuugacuuugaucuuuacaauaugaaaaauaaaaauaaaaaggccgcguggcucacgccuguaaccccagcacuuugggcggccaaggcaggaguaucacuuaugcccaggaauucgagaccagccuaagcaacaguggggacccucuagaaaaaacauuuaggcugagcacaguggcucccaccuguaauuccagcacuuugggaggcugaggcagguggaucaccugaggucaggaguucgagaccagccuagccaacauggugaaaccccgucucugcuaaaaauacaaaaauuagccaggugugguggcacaugccuguaaucccagcuacuuaggacggugaggcaugaaaauugcuugaauccaggagguggagguuacagugagcugagaucacgcuacugcacuccggccugggugacagagcaagacucugucaaagaaagaagagagagagagagagagagaaaagaagaaaagaagaaggaaagaaggccggaaggaauuuaaaaauuagcugggcaugguggcuugugccuguaguaccagcuacuugggaggcugagauggugagaugggaggauugcuugagccuaggaguuugaggcugcagugagcuaugauaccaccacuccagccugggcugcagagcuaagauccuuucucaaaaaaaaaaaaaaaaaaaaaaaaagggagggaggaacccagggauagcaugauuuccuuucgucuugggaauaccccuaaaaauacccucccugcuuuggacccagugaccaggaaaaacaacccaaacucaguuugggaggaagggauguacuaugcauacucuccauggccgcuggguuuuagggaugaaagggaccaaagcccuggguugagaauauuuuuggacaaagguuugggguucuucuagagcaagguagcccuaauuugcguugaauccaggaaagagguacagguuggauugcgauuuggggaggagaagccaucaggcucucguuccagcccuggugcccuacccuuuaaugcccaugagacaccuaaucccuuaaaugcuuccuggcccuuauccccaggcacuuggagcaggucugaugggccuuugcugcugguccauauguaggucacugacuuugccuccucaaaacugcuccagaacacauuuuuagucaugagccgcauagcaacguuucagucaacagacggcauacacaaccguggucccauaagauuguaauggaggcugguugugguggcuuaugccuguaaucuuagcacuuugggaggccaaggcagguggauugcuugaggccaggaguucgagaccagccuggccaacauggugaaacccugucucuauuaaaaauacaaaaauauuagccaggcaugguggcucacaccuguaaaucccagcuacucggaaggcugaagaagaacaauuguuugaaccugggaggcagagggguugcagugagccaagauugugccacugcacucuagccugagcaacagagcgagaacuugucuccaaaaaaaaaaaaaaagauuguaguggagauaaaaaauuccuaucaccuaauaacauuguagccaucauaauguguuagugaaaugaauuacucaaguguuuauggugauugcugguguaaacaagccugcugcacuaccaguuguauaaaagucuagcccauacaauuauauacaguacauaauacuugauauugauaagacaugacuguguuacugguuauguauuuacuauacuauacuauuuuuuugagacagucuugcucucuuguccaggcacaaccuccaucucccagguucaaacgauuccccugccucagccucccaaguagcugggauuacaggcacccaccaccacacccaccuaauuuuuguauuuuuauuuagagaugggguuucaccauguuggccaggcuagucucuaacuccugaccucaagugaucuaccugccucggccucccaaagugcugggauuacaggugugagcuaccgugccauggcuauugcaccuuuucuauguuuagacacauuuagauacacaaauacuuaccauuguguuauaguugccuacaguauucaguacauuaacaugcuguauagguuuguagccuaggagcaauaggcuguaucauauagccuaggugugcaguaggcuauacuguuuagguuuauguaaaguuacucuaugauguucacacagugaggaaauggccuaacacugcauuucucugaacauaucccagucauuaagcaaugcgugacuguauuuccuuuuuuuuuuuuuuuuuuugagaccaaguuucgcucuuguugcccaggcuggagugcaauggugcgaucucggcucaccgcaaccucugccuccuggguucaagugauucuccugccucagccuccugaguagcugggauuacagguaugugcaaccacgccuggcuaauuuuguauuuuuaguagagacgggguuucuccauguuggucaggcuggucucgaacuccccaccucaggugauccgcccgccucagccucccaaaguguugggauuacaggugugagccaccgcgcccagccccguauuuccauuuuauccccacuuucuggaucuaaaagagcccuacucuccaaauuguugccuggagggaugguuaauggguacaaaaauacaguuagauagaaggaauaagaucuaacguucaguagcacaauagggugauagaguuaacagaaauuauugcguauuucaaaauaauuaaaggaguggaauugggauguuccuaacacaaggaaaugauaaaugcuugauaugacggauacucuaauuacccugauuugaucauuauacauugcauacuugucucgaaauaucacauguacuccaaaaauauguacaacuauuauguauccauaguaauuaaaaauaaagccuuuuaaguuuaaaaauaaacaaacuggaugcacgugguagcucaugccuguagucucagcacuuugggaggcccagacaggagaacuguuugaacccaggaguuugagaucagccugggcaacuaagugagaccccggacucuacaaauaugaaaaaaaacaauuugccgggcacgguggugggcaccuguaguccuagcuacucgggaggcugaaccaggaggaucacuugagcccaagaguucgagacugcaguaagauaugacugugucacugcacuccagcuugagcaacagagugagaacuugucugaaaaacaaaaccaaaaaaccccaaaaaacaaauuguugccuggaagaauugguucuuuaaugaucauaguuccacucaucugcauggcauuuuauuuuauuuauuguuguuauuauuauuauuauuauuauuuuugagauggagucucacucugucgcccaggcuggagugcaauaacacgaucucgcucacugcaaccuccgccucccagguucaagccauucuucugccucagccucccgaguaaccaggauuagaggugcucaccaccaugcccggcuaauuuuuguauuuuaguagagagggguuucaccauguuggccaggcuggucucgaacuacugaccucaagugauccaccugccucagccuccuaaagugcugggauuacaggcacgagccaccuagcccggccucugcaugguauuuuagagcaacugccucuauauucacaaucuggccugaucguccugcaacccucaguccauuaacuccuauaacuaguagaauucacuucucucauuuacuagcuguugcuagccaagugucgccugauagaaugcaaugucaaacugcuagguuuuguuugggagacagggaaggaaaugccagagaagggcaguaaugacucagaagugaguuuaagaugagggcugugauaccuuggggugggaggugcugaauuucguguguguguguguguguguguguguguguguguguucaaaugcaaacuuaaagcugugaaaucauuaagucuagaaguucccugaauuugggguggggccauacaagggauucccuccuuuucuccccaggaauaggguauggaaggccagaugucuccaucccacaacgggggccuucccaucccuugguguucucugccccgcccccacugccacaucaucaccucccaccccuguaguggggaauacagcaucccuuccccuauggccccuccagagaauucacaccaucccaggaaacuuucuccaaaucucugucucuuugccuggccacccaacauccucccccuucagccggacuuuaccauaaaugcugcugcccccaaucuucccuaauaggccugccaaggcacagagcuauuuuuaccuccuucccuucucaggccugcagaccucugggaggagcaggagcagccucugcuuuccuccagcagccggguccccaccuggaacaucugcucugcagcucagggaaguucugcuuucccaagccucaccccauuugcuggaaucuuuuccuuacgucugaagucuuccccagguugggaccauuucaguucuuaguuauucccucuguggguuugggacuccauuugagcuacucuuacuaccucaacucucugucacccacuggccuugguuuagugcagauucauuugaagccaccugugauuagaacacauucccucccacccccuaaaauauagacauaucccugcagauugcuggagagggcagaacagagggaugccaguggccucugcagauaagucuuucucccuccauaccuuucccucuucucucagaaucuccaucuuuggcauagggaaguuuaccuccaggccaagacuuuucccagguucuauggucugggauaguuagcgugagaagggucaccccucgagcucuucaugguggcucucggccacaccaggcucuggaggaaauauagagcuggcuugcugucccagaccccugucuuguuccgcuccucucaauguccccaguacuaagcaggucucuuaaaaaacgucaaaagccccccucucauccugcguccuccaagcaguuagacuaaguggaaauagcucugggcaaacauuuucuaucuaaauagugcuuaaguaggggaaguaaagcuuuuaaaagccacguauaugccuccugggaggagucugucauccguggguaaggguggggagggggacaagugccacuucugccucugucccaccaccucagauagguaccagcugacccaccuuucugucucuacucuucccagauacuuguccugauuugcaucuaucuuaacuccuccuggggaaaccaagccaaggacccccucgccucaccccagauggucacucagaacccggcucgaccaggccccagagcagucagcagagccacaacucccggaaaggggucuucuaacuuggagggugugggaaauccagccuucccuuucuuuccauucccuucagcagggagaggaaggggagaggggagcauagacuaaccccccugccccacacgaucccgccucccugggguuaggagcaucagcaggccuuugggaggcggggaggagccaggcuggaacacuugccgcccagcccaaaaucucauccccgauggcacugcggaagcggcguggagaggagcagcauagaaacccgagacucccagguuuauuggggguuaugauccaaaagcuacauuuuuauccaagugugaagaauggggagagcugcaaagaaagcaacaaguggccccgggcggagccggggggugggggcgccagccuccucccgccggcugcgcugcugcgccuggcccccgcccccgcaggcaugcggggugauucaccucgcccagacugcgcccagaccgccggaccccgcaggggcuguccacccacuccaccagccccucuugcacuccugacgcccacucuuccccgcccagccccgcccgcuuccaggaggcccagggugccagcgcgccgcgggugaggguguccucaagggccugaaaaugccugguggccaggagcagagagcagcgaggggacaggggugggccgccgaggccgaugugggggcgcgggggcgcagggucuggggaggagguuggcggucgcguuccccgcuuggcacagcccccgcuggugcgugccugagcccugaaucacccgcuauaucaggcccgcaggcgcagaggccccaggcccgggccccgcagccaguguccgcuuacagcggaccccaacgaucgcgagggaccccugacuuuccuagaaacuucccccaaguaggaagaaguuugacagagccaauuagggagggagcggucugcgaggggcagcguccucgaguccacccgcuaauucgguucugcuacaaguuugggacccgagggaaggaucugaguggggaggugcgaggugcagagcgcgccccucuacgcgccccaggaguccgccgcucccuccaccccauccuaccccacccaaccccaccccagccgcgcucaccggaaggaggguggaucugccgggcgcccgggccaggcugggaggggagcagcgccacgggcaggucuccccaccccaacucccaggcaggggacgcgggccgggcgcgggagcucugggcgccuuccgcccugugggcucaccugguagaucaugacuuuaaaguugcggcgccgcagcagcucggccucguugaccuccagcuucuugaucugccccgccuggcgcuccaggcugccgcgcacggucuucacguugacgcugaccuugcgcaccuucuccagcagcuugcucaccguauugcucgugguggcgugcgccuugcccagcuugcucagcucgcccuggaugcucugcacugcgcccuccaucuccgccugccgcuccuccagcugugcuugagucagcuggaucuggucuacggccccgaugauuuuguccaggaggcucagcaccagcacgccguucaccugguccgacuugaucagcucuucugagccggcccccgacggcuccuccgcugccugagccccagcggaggaaggcuccggggccucggcgucgggguacccgggaagcggccgcucgacaauauagagcgugggguccuccauggcuacccggagccgugcgggaccggccggguggggcuggagcuggagcgggagacccggagagaagcaggagcggaagggaggagagcuagcgggcgagagcggagagcagaggaaacucgagccacguccgugcgcaccgggacagcggccagaacugcu

SEQ ID NO: 16844 - RNA, 20812 nt, Homo sapiens
agcaguucuggccgcugucccggugcgcacggacguggcucgaguuuccucugcucuccgcucucgcccgcuagcucuccucccuuccgcuccugcuucucuccgggucucccgcuccagcuccagccccacccggccggucccgcacggcuccggguagccauggaggaccccacgcucuauauugucgagcggccgcuucccggguaccccgacgccgaggccccggagccuuccuccgcuggggcucaggcagcggaggagccgucgggggccggcucagaagagcugaucaagucggaccaggugaacggcgugcuggugcugagccuccuggacaaaaucaucggggccguagaccagauccagcugacucaagcacagcuggaggagcggcaggcggagauggagggcgcagugcagagcauccagggcgagcugagcaagcugggcaaggcgcacgccaccacgagcaauacggugagcaagcugcuggagaaggugcgcaaggucagcgucaacgugaagaccgugcgcggcagccuggagcgccaggcggggcagaucaagaagcuggaggucaacgaggccgagcugcugcggcgccgcaacuuuaaagucaugaucuaccaggugagcccacagggcggaaggcgcccagagcucccgcgcccggcccgcguccccugccugggaguugggguggggagaccugcccguggcgcugcuccccucccagccuggcccgggcgcccggcagauccacccuccuuccggugagcgcggcuggggugggguugggugggguaggaugggguggagggagcggcggacuccuggggcgcguagaggggcgcgcucugcaccucgcaccuccccacucagauccuucccucgggucccaaacuuguagcagaaccgaauuagcggguggacucgaggacgcugccccucgcagaccgcucccucccuaauuggcucugucaaacuucuuccuacuugggggaaguuucuaggaaagucaggggucccucgcgaucguugggguccgcuguaagcggacacuggcugcggggcccgggccuggggccucugcgccugcgggccugauauagcgggugauucagggcucaggcacgcaccagcgggggcugugccaagcggggaacgcgaccgccaaccuccuccccagacccugcgcccccgcgcccccacaucggccucggcggcccaccccuguccccucgcugcucucugcuccuggccaccaggcauuuucaggcccuugaggacacccucacccgcggcgcgcuggcacccugggccuccuggaagcgggcggggcugggcggggaagagugggcgucaggagugcaagaggggcugguggaguggguggacagccccugcgggguccggcggucugggcgcagucugggcgaggugaaucaccccgcaugccugcgggggcgggggccaggcgcagcagcgcagccggcgggaggaggcuggcgcccccaccccccggcuccgcccggggccacuuguugcuuucuuugcagcucuccccauucuucacacuuggauaaaaauguagcuuuuggaucauaacccccaauaaaccugggagucucggguuucuaugcugcuccucuccacgccgcuuccgcagugccaucggggaugagauuuugggcugggcggcaaguguuccagccuggcuccuccccgccucccaaaggccugcugaugcuccuaaccccagggaggcgggaucguguggggcagggggguuagucuaugcuccccucuccccuuccucucccugcugaagggaauggaaagaaagggaaggcuggauuucccacacccuccaaguuagaagaccccuuuccgggaguuguggcucugcugacugcucuggggccuggucgagccggguucugagugaccaucuggggugaggcgaggggguccuuggcuugguuuccccaggaggaguuaagauagaugcaaaucaggacaaguaucugggaagaguagagacagaaaggugggucagcugguaccuaucugagguggugggacagaggcagaaguggcacuugucccccuccccacccuuacccacggaugacagacuccucccaggaggcauauacguggcuuuuaaaagcuuuacuuccccuacuuaagcacuauuuagauagaaaauguuugcccagagcuauuuccacuuagucuaacugcuuggaggacgcaggaugagaggggggcuuuugacguuuuuuaagagaccugcuuaguacuggggacauugagaggagcggaacaagacaggggucugggacagcaagccagcucuauauuuccuccagagccugguguggccgagagccaccaugaagagcucgaggggugacccuucucacgcuaacuaucccagaccauagaaccugggaaaagucuuggccuggagguaaacuucccuaugccaaagauggagauucugagagaagagggaaagguauggagggagaaagacuuaucugcagaggccacuggcaucccucuguucugcccucuccagcaaucugcagggauaugucuauauuuuagggggugggagggaauguguucuaaucacagguggcuucaaaugaaucugcacuaaaccaaggccagugggugacagagaguugagguaguaagaguagcucaaauggagucccaaacccacagagggaauaacuaagaacugaaauggucccaaccuggggaagacuucagacguaaggaaaagauuccagcaaauggggugaggcuugggaaagcagaacuucccugagcugcagagcagauguuccagguggggacccggcugcuggaggaaagcagaggcugcuccugcuccucccagaggucugcaggccugagaagggaaggagguaaaaauagcucugugccuuggcaggccuauuagggaagauugggggcagcagcauuuaugguaaaguccggcugaagggggaggauguuggguggccaggcaaagagacagagauuuggagaaaguuuccugggauggugugaauucucuggaggggccauaggggaagggaugcuguauuccccacuacaggggugggaggugaugauguggcagugggggcggggcagagaacaccaagggaugggaaggcccccguugugggauggagacaucuggccuuccauacccuauuccuggggagaaaaggagggaaucccuuguauggccccaccccaaauucagggaacuucuagacuuaaugauuucacagcuuuaaguuugcauuugaacacacacacacacacacacacacacacacacacacgaaauucagcaccucccaccccaagguaucacagcccucaucuuaaacucacuucugagucauuacugcccuucucuggcauuuccuucccugucucccaaacaaaaccuagcaguuugacauugcauucuaucaggcgacacuuggcuagcaacagcuaguaaaugagagaagugaauucuacuaguuauaggaguuaauggacugaggguugcaggacgaucaggccagauugugaauauagaggcaguugcucuaaaauaccaugcagaggccgggcuagguggcucgugccuguaaucccagcacuuuaggaggcugaggcagguggaucacuugaggucaguaguucgagaccagccuggccaacauggugaaaccccucucuacuaaaauacaaaaauuagccgggcaugguggugagcaccucuaauccugguuacucgggaggcugaggcagaagaauggcuugaaccugggaggcggagguugcagugagcgagaucguguuauugcacuccagccugggcgacagagugagacuccaucucaaaaauaauaauaauaauaauaauaacaacaauaaauaaaauaaaaugccaugcagaugaguggaacuaugaucauuaaagaaccaauucuuccaggcaacaauuuguuuuuugggguuuuuugguuuuguuuuucagacaaguucucacucuguugcucaagcuggagugcagugacacagucauaucuuacugcagucucgaacucuugggcucaagugauccuccugguucagccucccgaguagcuaggacuacaggugcccaccaccgugcccggcaaauuguuuuuuuucauauuuguagaguccggggucucacuuaguugcccaggcugaucucaaacuccuggguucaaacaguucuccugucugggccucccaaagugcugagacuacaggcaugagcuaccacgugcauccaguuuguuuauuuuuaaacuuaaaaggcuuuauuuuuaauuacuauggauacauaauaguuguacauauuuuuggaguacaugugauauuucgagacaaguaugcaauguauaaugaucaaaucaggguaauuagaguauccgucauaucaagcauuuaucauuuccuuguguuaggaacaucccaauuccacuccuuuaauuauuuugaaauacgcaauaauuucuguuaacucuaucacccuauugugcuacugaacguuagaucuuauuccuucuaucuaacuguauuuuuguacccauuaaccaucccuccaggcaacaauuuggagaguagggcucuuuuagauccagaaaguggggauaaaauggaaauacggggcugggcgcgguggcucacaccuguaaucccaacacuuugggaggcugaggcgggcggaucaccugagguggggaguucgagaccagccugaccaacauggagaaaccccgucucuacuaaaaauacaaaauuagccaggcgugguugcacauaccuguaaucccagcuacucaggaggcugaggcaggagaaucacuugaacccaggaggcagagguugcggugagccgagaucgcaccauugcacuccagccugggcaacaagagcgaaacuuggucucaaaaaaaaaaaaaaaaaaaggaaauacagucacgcauugcuuaaugacugggauauguucagagaaaugcaguguuaggccauuuccucacugugugaacaucauagaguaacuuuacauaaaccuaaacaguauagccuacugcacaccuaggcuauaugauacagccuauugcuccuaggcuacaaaccuauacagcauguuaauguacugaauacuguaggcaacuauaacacaaugguaaguauuuguguaucuaaaugugucuaaacauagaaaaggugcaauagccauggcacgguagcucacaccuguaaucccagcacuuugggaggccgaggcagguagaucacuugaggucaggaguuagagacuagccuggccaacauggugaaaccccaucucuaaauaaaaauacaaaaauuaggugggugugguggugggugccuguaaucccagcuacuugggaggcugaggcaggggaaucguuugaaccugggagauggagguugugccuggacaagagagcaagacugucucaaaaaaauaguauaguauaguaaauacauaaccaguaacacagucaugucuuaucaauaucaaguauuauguacuguauauaauuguaugggcuagacuuuuauacaacugguagugcagcaggcuuguuuacaccagcaaucaccauaaacacuugaguaauucauuucacuaacacauuaugauggcuacaauguuauuaggugauaggaauuuuuuaucuccacuacaaucuuuuuuuuuuuuuuuggagacaaguucucgcucuguugcucaggcuagagugcaguggcacaaucuuggcucacugcaaccccucugccucccagguucaaacaauuguucuucuucagccuuccgaguagcugggauuuacaggugugagccaccaugccuggcuaauauuuuuguauuuuuaauagagacaggguuucaccauguuggccaggcuggucucgaacuccuggccucaagcaauccaccugccuuggccucccaaagugcuaagauuacaggcauaagccaccacaaccagccuccauuacaaucuuaugggaccacgguuguguaugccgucuguugacugaaacguugcuaugcggcucaugacuaaaaauguguucuggagcaguuuugaggaggcaaagucagugaccuacauauggaccagcagcaaaggcccaucagaccugcuccaagugccuggggauaagggccaggaagcauuuaagggauuaggugucucaugggcauuaaaggguagggcaccagggcuggaacgagagccugauggcuucuccuccccaaaucgcaauccaaccuguaccucuuuccuggauucaacgcaaauuagggcuaccuugcucuagaagaaccccaaaccuuuguccaaaaauauucucaacccagggcuuuggucccuuucaucccuaaaacccagcggccauggagaguaugcauaguacaucccuuccucccaaacugaguuuggguuguuuuuccuggucacuggguccaaagcagggaggguauuuuuagggguauucccaagacgaaaggaaaucaugcuaucccuggguuccucccucccuuuuuuuuuuuuuuuuuuuuuuuuugagaaaggaucuuagcucugcagcccaggcuggaguggugguaucauagcucacugcagccucaaacuccuaggcucaagcaauccucccaucucaccaucucagccucccaaguagcugguacuacaggcacaagccaccaugcccagcuaauuuuuaaauuccuuccggccuucuuuccuucuucuuuucuucuuuucucucucucucucucucucuucuuucuuugacagagucuugcucugucacccaggccggagugcaguagcgugaucucagcucacuguaaccuccaccuccuggauucaagcaauuuucaugccucaccguccuaaguagcugggauuacaggcaugugccaccacaccuggcuaauuuuuguauuuuuagcagagacgggguuucaccauguuggcuaggcuggucucgaacuccugaccucaggugauccaccugccucagccucccaaagugcuggaauuacaggugggagccacugugcucagccuaaauguuuuuucuagaggguccccacuguugcuuaggcuggucucgaauuccugggcauaagugauacuccugccuuggccgcccaaagugcugggguuacaggcgugagccacgcggccuuuuuauuuuuauuuuucauauuguaaagaucaaagucaaaagcaugaggagacagcaaagagugggcaacugauagcaagaggggaggggauauuauugcuaagcaacuaaccucagaaguaggaguggcuugggccauuuuuuuuuggaaauauaacauugugaauauuucaucauucugucauuagcauuuuuuaaauuuuucuuuucuuuuuuucuuuuuuuuuguuuuuuguuuuguuuuguuuuucugagacagggucucacucuguugcccaggcuggaauguaguggcagcugucacggcucacugcagccccugucguccgggcucaagcauuccuccugccuuaggcccccaaguagcuaggacuacagacaugcaccaccacauccagcuaauuuuuguauuuuuugguggagaugggguuucuccacauugcccagggucuccaauuccugagcucaagcaauccgucugccucagccucccaaagugcugggauuacaggcgugagccaccgcacccggccucauuauacacuucuugagcuagaagacacuuugcaaauaaucaacuucaacuccuucauuuugugguuuaggaagcugaggcccagagaggggaagucacuagccuauugucacucaagugauugggagucaaacuggagccagaacccagguguacccuuccgcuacacucacugcuccccacccccuccuuccguucugggcucugcagcagaaagcugagugaagacuagcccugacaaagcuagggcuagcuguggcuccgacacuugcugagggaguuaguugcacaguccuggcccuggggcugcuuugcguguguauggguguuuguguguguggcguuggcuaugaguggccagcauugguggccauuggcugcuuagccuuguaagugcugaaguagaggcaauguguggucaccuggccuggugacagugggaggggagagguguaggggaggggagggguguaggggagaaaagugggggaaaggagggguguuggggaggggaggggcguaggggaggaguggagcuccuggucagccguggugugcccuggcagggacuccacacauaccuaggagagggacauguuguuucccuuucucuucagccucucugccacucccaccuccuccuuguacccugcaggggagguugggaccugcugcuuuguuuuuuugagacuacaggcuuuaucaaauacugcuauugccugaguccaauagugccgccaagugucccucucgccuggcaucugauugcucaaagcaagaagccuauagucuuccacaacucagccccucaggagagagaguugggggcugccgcagagguccagaggucccaggacauaggcucaccugucauaaaaauagcuugguuuugccaggcacagugaugugugccuguagucccagcuacucaauaaguugaggcaggaagauugcuugagacuaggaguuugaagccagguuggacagcauagagagacucuaucuuaaaaaaaaaaauagagcuugguuuuggauccugauuucucugugcauuuuaguguaugauaucuuaagugguagcaagagggagggguggcaagggagacagaagguggggacguggccaaagggaaauugccaggaugucccucuuccaugccuaucccucuccucauuugggguagcauccuguguccacccuaccccagggaagaaugaaaacagauuaaucugggcacacuggcucaugccuguaaucccagcacuuugggaggcugagguggguggaccacuugaggucaggaguucaagaccagccuggccaacauggcgaaacuccgucucuaccaaaaauacaaaaaaaauuagccgggcaugguggcacacaccuguaaucccagcuacuagggaggcugaggcaggagaaucacuugaacucaggaggcagagguugcagugagccaagaucacgccacuauacuccacagccugggugacagagcaagacuccgucuaaaaaaaaacaacaaccacaaaacugggauuggcagagucugacucugaagacagugaaguugugugccuuuguauuuacucaucugagccuccccaguuauaauccaacaacuagccccuuagaaaacuccuuauccaccccuaguagccuccauagucuuccuaugauuauggcuggggaaggauuggagauggaagcccaagaaugggacuggggaauauuguagagggaggaagggaggggcucaauugaagcuguguuuauuaauucuugggcuugaguuugccccaccccuuuuggccccagggaccucuuuuuuuuuuuuuuuuuuuuuuuuuuuuuuuuucccuuuuugagacagacuuuugcucugucgcccaggcuaaagugaaguggcuggaccucagcucacugcaaacuucaccucccugguucaagugauucuccugccucagccucccgaguagcugaaauuucaggcaugugccaacaggccccacuaacaguauuuuuugcagagaccugggcaauguugcugaggcuggucuugaacuccugggcucaagggauccacccaccuuggccuccaaagugcugggauuacagggauuauaggcgugagccacugugcccagcucccagggcccucuugaugaagcauuuaaaaugaguuucuaggccaggcaugaugguggcucaugccuguaaucccagcacuuugggagcccaaggagggcagaucacuugaggucaggaguucaagaccagccuggccaacauggugaaacccuaucucugcuaaaauuucaaaauauuagcugagcaugguggcacccaccuguaaucccagcuacuugggaggcugaggcaggagaaucgcuugaacccaggaggcggagguugcggugaaccaagaucagagaucacgccacugcacuacaguuuagcagccugggcgauagagagaggcuccaucucaaaaaaauaaauaaaauaguccaggcgcagugguucccgccuguaaucccagcacuuugggagaccgagacaagaggaucgcuugaggccaggaguucaagaccagccuggccaacacagugaaacccggucucuacuaaaaguauaaaauuagcugggcgugguagcaugcaccuguaaucccagcuauucgggaggcugaggcaggagaauuacuugaaccugggagguggagguugcagugagccaagaucgugccacugcacuccagccugggcaacagagugagacucugucucaaaaaaauaaaauaaaauaguuucuagccugggcaacauagugagaccuugucucuaucaaaaaaaaaaaaaaaauuagccggguuugaugguacacaacuguaguccuagauauuugggaggcugagguaagaagauugcuugagcccaggaguuggaggcugcagugagcuaugauugugcacugcacuacagccugggcaacagagcaagacccccauuucuaaaaaaaaaaaaaaaaaaaaagugguuuauuuccauccuaauacauugugcuccccucccuacucaccagccccuacucugcaugccaccaaggcccuuuuuucucaacuccuuuugcacccaccccaagccccauuuaaaccccuuuuccucaucuuagcccaagaagaagccgaaugcacccucugaccuggccacacccaagaucgugccuuuugaccugccugagacugagcccuuugaccugaagccugagacagugccugagcucccaccuuuugaccagacgccuagggcacugccauauuacccagagccugggccccggcccaccccagaggagcugacagccggugggaguguuuagggucucccggaucccguucugugggcgugggguaucucuucaguccacugucagcccacagccuaguggugaucacugccaggagggccaccauccccagucacugcccacuguggacgggugccggguacugugagaacacuggcguuaugcaaaguucaggagaaugggauguauacaguggggaugggaggggaauggaaggggccuccccacuucuugguuucuguuuuuaguaguaaaugcucccccacacuuaagcugcacccgaaggcugccuagcaugaaggcgcauggcuucugguucugccguucccccugcugccuccuccugagggacaacccaguuuggcucaaagccucuuuggagagggccaucaugaggcucaggccuggggucuguucugugcccucuccacccacucccugcagcugaggaaaacauuuacacguauuuucuccaguuucuuuuagaaaaugcuuugcaaagagaucgcuuauguuugccagauccugccuuggguggggugcccaaaagcugccaacucacagaugccaggagggggacauucuagcuggcucuggcucaggaccucuggccuuccuauagcagaguguuucucaacuuaaaaaaaauguuaaaaaaauuuuuuuuagagaugggguuggacuguguugcccaggcugguucugaacuccuggggcucaagugauccucccaccucagcuucccaaagugcugggauuacagaugugagccaccucacccagccaguuuuuguuguugaugguuguuguuguuuucauaaucacucccauauacagaccuuuuaguuuuuuuuuuuuuuuuugagacauaguccuacucugucacccagguuggagugcaguggagugaucucggcuaacuacaaccuccaccuccucgguucaagugauucuccugccucagccucccaaguagcugggauuacaggcaugugccaccacacccagcuaguuuuuguauuuuuugguagagacgggguuucgaacuccugaccucaggugaucugccccgccucccaaaauucugggauuacaggcaugagccaccaccccuggcccuuucaauuuuuuuuuuuuuuuuuuuuuuuuuuuuuuuuuuuuuugagacagagucucacuccgucgccaggcuggauuacaguggcacgaucucggcucacugcaaucuccaccucccugguucagccucccgaguagcugggauuacaggcucgugccaccacacccagcuaauuuuuguauuuuuaguagagacggaguuucaccauguuggccagaauggucucgaucuccugaccucguaaucugcccaccucggccucccaaagugcugggauuacagccuugagccacagcacccggccccuuucagauauuuuuaaccaagcuguucaucucccucacgaaauguuaaaacaauagauaaacuguauaucuguuuauguacuguggcucuugggaguggcacaaaucauugugauaucuaaguccccucccaaucuccaagaaucaguuuucacccuuuuggaugcaauuucaccccugccaagaaugcacgcuagagcagaagggagggacacuucugcccuuggggucucucaucuccuugucuuagcaaccucuagcagagguccugaauuuuaaagacguucucuccccuucaccucuccccuccucugcacccucuucuaacauacacucuaagcagauccugggucucugaauuaccucuccagucuccuccagccauucccaggcagugguuggggaccuagagcuggucagccuuaagucaagagagccuccuacccagacccauguggcaucugucccuucucccuaacaaaugugaagugccuggccaagggccagauguguaauaggugcucaaugacauuauaaucuuauaaaaaucuuccuaagccagaucucgaguuuagacagcaggguugggggguggaguggaagaggcugggagccucccuguggcuccucugcauccaucgaggauugaggagcuaugugugcuuggcaaagggcagggggaacuguaaugcuuuuguucagagcuggucauuaaagguaacucuggaaaccaagccuauugggaguggugguuuuguuuaauaaaaacgagaaacagaacaagcagagccgucccuccuugccauccccugagguccuuccuuuggcuuaggagcucugccagagaaguaggggugggacaagggugccuggccugugugcccaggguggagggagaugauuuuggauuguguuuguggugguuguaccagcaagcagaugggugggaccaagacagcacuccaaggcugugagucaugggggaaaccuggccuggaguggagaggaaaagcuaauggugaaauacccucuccagagccagccuauuggacaucaucccaggauucagcucaaguuguuucgucuccuguccccugaccuuccaccaagaaggcagcuccuaugguguaagccgucacuccaggggaagccuacgaugaaugggguuagagcccccagaucccuuacuggucuggagagauuucuaaauccaggaauaaaccuccccuuggccaggcacaguggcucaugcgagaaaucucagcacuuugggaggccgaggcaaggggaucacuugagcccaggaguuugagaccagccugggcaacauagugagacucugccuguacaaaaacuacaaaaauuagcugggcaugguggcgugcgccuguaguuccagcuacuugggaggcugaggugggaggaucacuagagcccaggagguugaggcuguagugaccuguaaucaugccacugcacuucagccugguugacagaacaagaccccaucucaaaacaaacaaacaaaaacacaaaaauggccagaugcgguggcucgugccuguaaucccagcacuuugggaggccgaggugggaggaucccuugaggucaggaguuugagaacagccuggccaacauggugaaacccugucucuaccaaaaaauacaaaaacuagccaggugugguggugcaugccuguaaucccagcuacuugggaggcugaggcaggagaacugcuugaacccaggaggcagagguugcagugagccgagaucgcgccacugcacuccaaccuaggugacagagugagaccaugucucaaaaaaaaaaaaaaaaaaggccgggcacgguggcuuaggcuuguaaucccagcacuuugggaggcugaggagggcgaaucacaugagguugggaguucaagaccagccugaucaacauggagaaaccccgucucuacuaaaaauacaaaauuagccaggugugguggcacaugccuguaaucucagcuauuugggaggcccaggcaggagaauugcuugaaccuaggaggcggauguugcggugagccgagaucgugucauugcacuccagccuggggagcaagagcaaaacuccaucucaaaaaaaacaaaaaaacuaaaaaacaaaaaccuccucucacuaggauugcuuccuuauguuguaguuugagaccuuucaugaggcacuaggaagauggcauuggcuauaagaagucugcagcucucuccccagucccauucacuuccaaguucagcuggcaaagaccuuuaucuaggaagccacaggccaggaaaaccagccagcucagccuuuaggggugggguggagcaggcagcagggguaggggagaagcgggggaugcuggggguagggcagagagacaaaguggauuuguuuuccagcagcuggggcuguuuccugacuauucccugccugucacccuuaaucccucccuagccuauucacauugucugaguuuagugaaaggaggggcucucuccacccuuugguggggcguggguggguuuuuaagucugggagguuaugaaggaaagaucagagcugaauuuuuuuuaauauauauauauacuggggcugcagguaaauucuggguggagauggaugaagaggguuuagauccuacaaugauguauaagucuuaaaugauaugcacuccaguagcaggcaggguaagggugauuguaggagccccaaagugaaugacuggaaaucagagggaaugcaaagagaaguugagacucuccuacacucagaacaaggaaaacacccuucaaugccucagugaaugauaagaggcagagggauaaacaaaaugcccuaggauugcccaugaucugcacuaagccgucuauggcagguagagacuacaagucccagcaugcccugugcccaggucaccuugccugcugggagguguaguuggguaacagagagcuggagguggcuuggugcccagcagagcugaugcccagaugagagaagagguggagccagcauucccucuuugucccugcuaaugcuauugacaagaagggaaggaaguugggagaggguguuccuaguuuucaguguaaaccaggaaacucuggggggauguugaugggagggaagaggaaagagguugggggcuggggaaggaauuucuguagcagguggugcagagauaccgagcagccuauguauagggguguguguguguggugucagugagaggacucaguuuauguugccuuaauuucuuaggggacaggauuuuucuuauaauucugggaaauggucuucagaaaacccuuuagaaaagcgacuaucucucguuccuucauuugaagucacuaaagggagucugggccaaagagauccuauugaugaucuuggucugcccuuucccuuucugugcucagccuccccugcucucugaugaggguggaggugggggagggagugauccagagauucugaaauguuggccagagucaagaucuuggaaaaucuucccggaauggaaagcaguucuggugcuaaguccuccaaggagaagacagaaaagcaaagaacugguucugagcuccagggucauggggaaucugagaccacccauccuacuccuagaccccugagcucaggcuuugugcugggggcaggggguagggaaagcaagaauugaaaaguaaucucucuucuaucccaaaguagggaagucacaaccagaagaaauguccagacuggggagaaaacauguccguggcucccagccagcuucuuccucuuuccaauaucaauuucuaaaugugggggagggggagaaugaccacugguggagccaaacaguaugaaggagucaaagaagguggaggugggggaggguggaccacaguucuccaucucuaaggcugguucugaaauagcuugaggccaggagcaguggcuuaugccuguaaucccagcacuuugggaggccaaggcggguggaucauuugaggucagggguucgagaccaaucugaccaacauggugaaaccccgagucuacuaaaaauacaaaaaaauuagccaggugugguggcgcaugccugcagucccagcuacucaggaggcugaggcaggagaauugcuugaaccugggaggcagagguugcagucagcagagaucgugucacugcacugcagccugggcgacaaagcgagacuccaucucaaaaaaaaaaaaaaaaagaaauagcuugagucuaggaaaugcacuuccuuuacuuuaccugcuuggguggguaggugcagcugugggcucaaaccccuacccgcuuucaacuuagacacucccaccacuugcuuuucggccuggcucgggcagugugcgauuugcggcaccagagggcgcuccgcccauuuccaaaguggagcugugucucccgagggccguagugguuuaauaucaucuacggguggaaagggaucaggacaggguuggacgaccacagagauuuuagcccaagugcaauuauuacgcaaccccaucuccgacccgaaguuugguccccugcucccgcggucuguuuagucaccauucguucaacacacauguuuuuuagagaauggcggcgcgaggccgggcgcaguggcucacgccuguaaucccagaacuuugggaggccgaggcgggcggaucaccugaggucgggaguucgagaccagccugaccaauauggagaaacaccgucucuauuaaagauacaaaauuuagccggcgugguggcgggcgccuguaaucccagcuauucgggaggcugaggcaggagaauugcuugaacccggguggcggagguugcggugagccaagaucgcgcccacugcacuccagccucggcaacagaucgagacuccguuuaaaaaaaaaaaaaaaaaaaaaaacaaggagagagagagagaaagaauggcgacgcgggguuggggggccggagaugggugauauguugcccaggcuggucucgaacuccuggacucaagccauccuccugccucggucucccacagcgcuaauauuacaggcgugagccuacacacauuuauugagcgcccgccaguuuccuggggaccacgagcgucccaugcuccccucucuccaggaucgucaccacccugacucaggcucgcccacauccgccuccuccgacgccucucaugucccuucuccucuucccuuaggaugaagugaagcugccggccaaacugagcaucagcaaaucgcugaaagagucggaggcgcugccagagaaggagggcgaggagcugggcgagggcgagcggcccgaggaggacgcagcggcgcuggagcuuucgucggacgaggcgguggagguugaggagguuauugaggagucccgcgcagagcguaucaagcgcagcggccugcggcgcguggacgacuucaagaaggccuucuccaaggagaagauggagaagaccaaggugcguacccgcgagaaccuggagaagacgcgccucaagaccaaggaaaaccuggagaagacgcggcacacccuggagaagcgcaugaacaagcugggcacgcgccuggugcccgccgagcggcgcgagaaacugaagacgucgcgggacaaguugcgcaaauccuucacgcccgaccacgugguguacgcgcgcuccaagaccgcggucuacaaggugccacccuucaccuuccacgucaagaagauccgcgagggccagguggaagugcucaaggccaccgagaugguggaggugggcgccgacgacgacgagggcggcgcggagcgcggggaggccggcgaccugcggcgcgggagcagccccgacgugcacgcgcugcuggagaucaccgaggagucggacgccgugcugguggacaagagcgacagcgacugagccgcccccgcugccacccaccccauuccucgcuccuuccgaacuuccucuuucgcauucucucucggcucgagcuggcugagauuuuucuaaauugaaaacacgccccccuccccacaccuccaggaacuccacucccagucuuagagcuguuaggacccgauggggaggcagcccccgcaguggacaacccccgcuuggacacaguccgaguggaaugggaagggaauggucaaucccuguccugguuguccaagucgggaucucagaggaaauugcagugauuccacgguuaggccccccugggggggcugccuuccccucagccucuccccacaccacccacccagcugcugucauuccgcucacugagcucuucuucauucucacccugaucccugggggacucaaagccaaaacugcccaaagaggaaagauugaauccuaaaggggaucccugcccccaugggaggcccccuacuagaaggacgugaaagcagcuuuugggggaaacugaggcaguggggaagacagagcagaaugagcccucacccuggcuggggguccagcacaggcuguaucugcagagggucccagaggaacgcuggagccaagagaagcccugggaaggagggguggggaacgacaugcaugugagggauggcacacugauguguuuaugcaccuguacacaggagcgcauggccauggcuuuggaaaggagaauggaaaaauagaagaaggucggccgggcuugguggcuuaugccuguaaccccagcacuuugggaggccgaggugggcggaucaccugaagucaggaguucgggaccagccuggcaaacaccccaucucuacuaagcgaaaacccaucucuacuaaaauuacaaaaauuagcugggcaugguugcgcaugccuguaaucccagcuacuuuggaggcugagguggggagaauugcuugaaccugggagguggagguugcagugagccaaggucgcgacacugcacuccagccugggugacagagugagacuccaucucaacagaaggaaaaaaaaggaaaauaggagaagguggaaaugggugaagagagaaguccccucacuagcugcaugagaaaucuaucuuacugugguucuccaugggcagcaggaccauuuuucagaaucaagagggaggacagugugagaaggcgaugauccaaagaagacagagaggucagccccacccgaucccucaaaugggcucuuggaggcacccccaggggcagcccauuucucaaaguccagaaaauuagggucccagaagggggcagcagcaggcugggaguuaggagggagagcagggugccggcccugccaccaaguugagagcuggaggggagguggggagagaacaucacagagcagccagcccugguucacuccuggcaguuucuucucaagcuccuucccuaggagcaugguggcacgugccuguggucucagcuacuugggaggcugaggcgggaggaucgccagagcccaggaguuugaggcugcagugagcuaugagggugccucugugcuccauccuaggcaacagagugauacgcuguuuaaaaaggaaaaaauccuucccuagagcuaguauccuaaagcugcagagcuagcccagaccucauugguuuccuuguccuuggggugcuuuuccugaaucuuugcgggugaagggaguguugcucccaguccagaggccugauucuguuuggacuggguucucaagacacgaccagguucucaagacacgaguccccuuguuccuccccauuaaaggggguuugucagaagcaagaacagccccucuccccagucacagccugaagggaggccccgagagcuuccuccuuccccccaccugcuccuuaccuucucugcccugcuuuuuagaacugcaguucauuguuuuaagggauugggggagggagccuggggacacaaaccuuuuauacaauacaaagcuuugcuuuuuuuuuuuuuuucuuccuuuucccuuucucgguucucuucucuccucugaauggcugaagaccccucugccgagggagguuggggauugugggacaaggucccuuggugcugauggccugaaggggccugagcugugggcagaugcaguuuucugugggcuuggggaaccucucacguugcuguguccuggugagcagcccgaccaauaaaccugcuuuucuaaaaggau

SEQ ID NO: 16845 - RNA, 1176 nt, Homo sapiens
ccgggccaggcugggaggggagcagcgccacgggcaggucuccccaccccaacucccaggcaggggacgcgggccgggcgcgggagcucugggcgccuuccgcccugugggcucaccugguagaucaugacuuuaaaguugcggcgccgcagcagcucggccucguugaccuccagcuucuugaucugccccgccuggcgcuccaggcugccgcgcacggucuucacguugacgcugaccuugcgcaccuucuccagcagcuugcucaccguauugcucgugguggcgugcgccuugcccagcuugcucagcucgcccuggaugcucugcacugcgcccuccaucuccgccugccgcuccuccagcugugcuugagucagcuggaucuggucuacggccccgaugauuuuguccaggaggcucagcaccagcacgccguucaccugguccgacuugaucagcucuucugagccggcccccgacggcuccuccgcugccugagccccagcggaggaaggcuccggggccucggcgucgggguacccgggaagcggccgcucgacaauauagagcgugggguccuccauggcuacccggagccgugcgggaccggccggguggggcuggagcuggagcgggagacccggagagaagcaggagcggaagggaggagagcuagcgggcgagagcggagagcagaggaaacucgagccacguccgugcgcaccgggacagcggccagaacugcugggcgggggaucggugagcuccccagcucccgggccaaacuccggagucugaucgcugauuggcuggccccaccccagaaagggagggaccggggcagaaggggagaucgacgaggcggggcggcggagggggacccaagagccgagcgccccacccuucccgggaugguuggaauaguuggagcgggagacuagggccuccgcuggcggcgggagcgggacgggcggaggaaugcgagcugaggaacggaaucagguucuaagaguguugcucucuguuucccucucacuugaauugcucauccgaaaauccucaagaucugggagccggguggaccaggagauucugaaauuauaggcaaaaucuuguauuugccuuuaccuagauuuugagcacaaaaggacccuugcccuuuacaauauuuuc

SEQ ID NO: 16846 - RNA, 1176 nt, Homo sapiens
gaaaauauuguaaagggcaaggguccuuuugugcucaaaaucuagguaaaggcaaauacaagauuuugccuauaauuucagaaucuccugguccacccggcucccagaucuugaggauuuucggaugagcaauucaagugagagggaaacagagagcaacacucuuagaaccugauuccguuccucagcucgcauuccuccgcccgucccgcucccgccgccagcggaggcccuagucucccgcuccaacuauuccaaccaucccgggaaggguggggcgcucggcucuugggucccccuccgccgccccgccucgucgaucuccccuucugccccggucccucccuuucugggguggggccagccaaucagcgaucagacuccggaguuuggcccgggagcuggggagcucaccgaucccccgcccagcaguucuggccgcugucccggugcgcacggacguggcucgaguuuccucugcucuccgcucucgcccgcuagcucuccucccuuccgcuccugcuucucuccgggucucccgcuccagcuccagccccacccggccggucccgcacggcuccggguagccauggaggaccccacgcucuauauugucgagcggccgcuucccggguaccccgacgccgaggccccggagccuuccuccgcuggggcucaggcagcggaggagccgucgggggccggcucagaagagcugaucaagucggaccaggugaacggcgugcuggugcugagccuccuggacaaaaucaucggggccguagaccagauccagcugacucaagcacagcuggaggagcggcaggcggagauggagggcgcagugcagagcauccagggcgagcugagcaagcugggcaaggcgcacgccaccacgagcaauacggugagcaagcugcuggagaaggugcgcaaggucagcgucaacgugaagaccgugcgcggcagccuggagcgccaggcggggcagaucaagaagcuggaggucaacgaggccgagcugcugcggcgccgcaacuuuaaagucaugaucuaccaggugagcccacagggcggaaggcgcccagagcucccgcgcccggcccgcguccccugccugggaguugggguggggagaccugcccguggcgcugcuccccucccagccuggcccgg

SEQ ID NO: 16847 - RNA, 8451 nt, Homo sapiens
cugugagggccagcggguccccuucggcccuggagccggggucacacgcuccccaccgcgugcggucacgagacgcccccaagggaguauccugguacccggaagccgcgacuccuggcccugagcccgggcuuagccuucggguccacguggccggaggccggcagcugauuggacgcgggccgccccacccccuggccgucgcgggacccgcaggacugagaccauggaggcgguggcgguggccgcggcgguggggguccuucuccuggccggggccgggggcgcggcaggcgacgaggcccgggaggcggcggccgugcgggcgcucguggcccggcugcuggggccaggccccgcggccgacuucuccgugucgguggagcgcgcucuggcugccaagccgggcuuggacaccuacagccugggcggcggcggcgcggcgcgcgugcgggugcgcggcuccacgggcguggcggccgccgcggggcugcaccgcuaccugcgcgacuucuguggcugccacguggccugguccggcucucagcugcgccugccgcggccacugccagccgugccgggggagcugaccgaggccacgcccaacagguaccgccccgaagcuuccccgcguccgcccgaggcgcuuacccccucccggagccgcugccacccaaaucgggaggcugagcggggagcgcuggccggaaggcccagcugcgccgccuccagcagcuguguggccuugagccagccacucugccuuucagagccucggcuggcccaccugaaaaacggaaagaagacgccuaccgugcaguguuauugugaggauuugcacgaugaugggcauagaauuuguggugcacaauuggugaugagugaauuuucuugccuuccucccccaccuucucuuugaaccugcggacugaggaaggacgccuccaucccccacccuacaggccuguguuccagcgccugccacacuauggagugauguguucacacagcuguccuccccugcccaucuguuagacugugggggcagggauuccccguuccaggaaaacaccgugcagaggaggggcucuggcaguguggcaugaaaguggaauaugccacccaaauacccgccaggcuagagggcccugggagagugcaggggacgagugccucagaagcccagccccgguaccuggucucagcuccaccuggggugggucccagugugcagcagaagggccgaguuuggagccccuccccucuccucuaggugggggaugggggauuuguuccagggccguggacccuccagggugggaugcgccccugcucaugacacugcccgcagguaccgcuauuaccagaaugugugcacgcaaagcuacucuuucguguggugggacugggcccgcugggagcgagagauagacuggauggcgcugaauggcaucaaccuggcacuggccuggagcggccaggaggccaucuggcagcgggugcgugcccacugucccuuccccacccuccucuauggcgggagccaccguagguguuuucacccgccccccagcaugggcgcagugucucucucuagaagugcuuucagcgugcacaguggcuugggccuccuaaaaacugaggcuuccggccgggcgcgguggcucacgccugucaucccagcacuucgggaggccuaggcgggcggaucaggaguucaggagaucgagaccauccuggccaacauugugaaaccccgucucuacuaaaauacaaagaaauagcaaccugggcaacagagcgagacucugucuaaaaaaaaaaaaaaaaaaaacugaggcuuccaguuugaggaguggggcuccuucccccaucuccccuaugcagccaaucaccuggucccuuggauccaacucaugggcagcucuagaucugccucccuggaagcuucugugcugcaauggcugcuccaggcucugcuuaagcucuucacacaguugcccugcccuuccaucuggcacucuugcuccaugaagccuucuaaggccuuccuguugggggaaagccccuuugugccccaucuccucacccaugcgacaaaggcaacacagugaacucaccuacucacaggucucuuuccucugggcugugggcuccuugauggcagcguucggauuuugucucaguagcccuagcacccagcacaaagaagcaaugagugaaugguuguugaaugaaugaaugaaugaaugaagaugaauauauuucuaugugugggcccuucuuccucagguguaccuggccuugggccugacccaggcagagaucaaugaguucuuuacugguccugccuuccuggccugggggcgaaugggcaaccugcacaccugggauggcccccugccccccuccuggcacaucaagcagcuuuaccugcagguaaaaggauggaaaagggaaggggcagaaucggugauagauggucaugggcccaggaagggugguauuaggccggccccagggcucuuaacugaggcggggggcugcguguauccugggagaugagggccuucucauaggacagcaguggccaugcucaccacccuuccuucuguuccuccagcaccggguccuggaccagaugcgcuccuucggcaugaccccagugcugccugcauucgcggggcauguucccgaggcugucaccaggugagguuccgcucacccccuccacuuagcucagagagggaauuuuauucccuucuagaacaugacuuaaaaacuuaagcucugggccgggcgcaguggcucacgccuguaaucccagcacuuugggaggccgaguugggcggaucaccugaggucaggaguucgagaccagccuggccaacauggugaaacccugucucuacuaaaaauauaaaaauuagcugggcaugguggcacgcgccuguaaucccaucuacuuaggaggcugagacaggagaauugcuuaaaccugggaggcagacguugcagugagucaagaucacgccauugcacuccagccugggugacgagcgaaacucugucucaaacaaacaaacaagcucuggacguaggccuggguuugauuucugacucugcuacuaauuagcugugugacuucgggcagaugacaugacugcucugugccucaguuuccuuacuuguaaaaugggaucucuacccacuucgcuguaggguuuguaauuaucucucgaucuaucugugacuuugcacagagugcuagcaaauggcagcccuugggaguggcagcaggggugcuccagugucccuugucccuccuguuccucugugcuucccagccauccucucacaugugguugggaaaagucuucaaggcucaccugagaccuccccuccuucaggaagccuugcuagugccccgcaugaccuccuuugcaccugcuaaugucuggcucccauacucucguaggacuuaaugcaugccaguggccucccugcccgccucuuugcccccaucaccagguggcaggaaacucacucauucauucaauaaacuugguccagcugucugaggcugccagaacuggcugugcuggguccugggaggcggcaagaaaggugcccaagggcuuaccccugauaggagagauauguuggcugaaggauacaauguggggacaaggacaggaauauauguggguuccgcucuccucugccgggagagaggggcaggaagggcucagggcagagcccagccuugaaaaaugaguguugcuuggacggacgcuuggcuaaugcuuguaauccuagcguuuugggaggcugaggcguauggaucaccugcggucaggaguuaaagaccagccuggccaacauggcgaaaccccaucucuacuaaaaguacaaaaauuagccaggcgugguggcgggcuccuguaaucccagcuacucgguaggcugaggcaugagaaucucuugaagccaggggccagagacugcagugagccgagaucacaccacuucacuccagccugggugacagagugagacuccgucucaaaaaaaaaaaaaaaaaaaggaaagaaaauuaaacaccucauguucucacucauagugggaguugaacaaugagaacaacauggacacaggaaggggaacaucacacaccggggccuuucgcggugugggggucaaggggaggaguagcauugggacagauacuuaaugcaugcggggcugaaaaccuagaugauggguugaugggugcagcaaaccaccauggcacauguauaccuaugcaacaaaccugcauguucugcacagaacugaacugaaaguauaauuaaaaaaaaaaaaaaaagcugggugcgguggcccacaccuguaaucccagcacuuugggaggccgagacgggcggaucacaaggucagcagaucgagaccauccuggcuaacacagugaaacucagucucuacuaaaaauacaaaaaauuagccgggugugguggcgggcaccuguagucccagcuacuagggaggcugaggcaggagaauggcaugaaccugggaggcagagcuugcagugagcugagaaugcgccacugcacuccagccugggggacagagugagacucugccucaaaaaaaaaaaaaaaaagaaagaaaaaggagcguugcuuguuucaggccacaggaaggggagagauagugaaaguuuuucagagaagguggccagggaaggagaagaaaggacuguaggcagagagcauagccuguacaaagccauagaggcaagagaaaccaggagcuguagagaaguuggcaaggcuguugaacacuauggugaacacuauggcggcuuccaugaaauaucugagcuuuugcuccccacuaggguguucccucaggucaaugucacgaagaugggcaguuggggccacuuuaacuguuccuacuccugcuccuuccuucuggcuccggaagaccccauauuccccaucaucgggagccucuuccugcgagagcugaucaaagaguuuggcacagaccacaucuauggggccgacacuuucaaugagaugcagccaccuuccucagagcccuccuaccuugccgcagccaccacugccgucuaugaggccaugacugcagguacagugccuggguggggugggagagccccccagacccucaaaaagaagggaguagcagaugucaguagggguaggcagagggacuggaauaaugccucgccauaacacacaguacuucauaguuuaccaagcacguguacacaugcguugucucagugaaucccacugugguugagaggugagcucuggaagccaacaaccugggucacaccucgcgcuccuauuuccuggccgugugacuuaugacucaugaccuccuucccagugucucguuugcuuuuccuguaaacugggacuaccucauagguagaauaacgccuggcccagagcaaaggccacuaagagcuagcuaugaacaaggauuuuguuucaucucugcgugguugcugaaguaggcacugcaggcaggaggugaguggaugugccuaaaggcacuaagugcgcauccugcuacaaaacugugaagccagggcuccuuccugccacuuaaaggaggaguggagcagagggcgcccaagucaggaaugacuuaguggagaggcgucuguguuggccaggaagggaacagaucagcucagccuuucuugagcaguacugcuccaagugugacccaaaaccagcagcagcagcagcagcagcccgagcugugagauggcaaauucucaggcccuacccaagaccugaaggagaagcuacauuuuuuuuuuuuuugagacagauuucacucuguugcugaggcuggagcacaguggcacaaucucaucucacugcaaccuucgucuccuagguucaagcgauucuccugccucagccucccgaguagcugggacuauaggcacccgccaccacgcccggcaauuuuuguuuguuuugagauagagucucgcucugucacccaggcuggagugcaguggcacgaucucaguucacugcaaccucugcuuccugaguucaagcgauucuccugccucagccuccugaguagcugggauuacaggcgccccccaaccacacucggcuaauuuuuguauuuuuaguagagacgggguuucgcuauguaggucaagcugguuucaaacuccugaccucaaaugauucgcccacuucagccucccaaagugcugggauuacaggugugagccaccuugccuggccaauuuuuguauuuuuaguagaaacagguuucaccaugguggccagacuggucucaaacuccugaccucaggugaacugcccaccucagccucccaaaguacugguauuacaggcgugauccacugcgacuggccuugauuuuguuuuugagacagaaucuuacucugucgcccagacuggagugcaguggcacaaucucagcucacugcaacuucugccucauggguucaagugauucuugugccucuaccucccgaguagccgggauuacaggcaccugccauuacgcuaggcuaauuuuuguauuuuuaguauagacaggguuuccccacauuggccaggcuggucuggaacuccugggcucaagugauccaccugcuucagccccucagaguacugggauuauaggugugggccaccacgcccauucagaaaccuccauguuuuaaggagcccucuggguaacucucauguucacccaagcugcugaacccuguccuggaguuuucagagggacgcguaugugccacagagcgucccgcuggugggggucaugggaagccaugaccugggauagacagucgucuguagaguggggugaacauucccugggcccucuguuucaucacuccucuucucuguucccccuaccuccuguccacaguggauacugaggcuguguggcugcuccaaggcuggcucuuccagcaccagccgcaguucugggggcccgcccagaucagggcugugcugggagcugugccccguggccgccuccugguucuggaccuguuugcugagagccagccuguguauacccgcacugccuccuuccagggccagcccuucaucuggugcaugcugcacaacuuugggggaaaccauggucuuuuuggagcccuagaggcugugaacggaggcccagaagcugcccgccucuuccccaacuccaccaugguaggcacgggcauggcccccgagggcaucagccagaacgaaguggucuauucccucauggcugagcugggcuggcgaaaggacccagugccagauuuggcagccugggugaccagcuuugccgcccggcgguauggggucucccacccggacgcaggggcagcguggaggcuacugcuccggaguguguacaacugcuccggggaggccugcaggggccacaaucguagcccgcuggucaggcggccgucccuacagaugaauaccagcaucugguacaaccgaucugauguguuugaggccuggcggcugcugcucacaucugcucccucccuggccaccagccccgccuuccgcuacgaccugcuggaccucacucggcaggcagugcaggagcuggucagcuuguacuaugaggaggcaagaagcgccuaccugagcaaggagcuggccucccuguugagggcuggaggcguccuggccuaugagcugcugccggcacuggacgaggugcuggcuagugacagccgcuucuugcugggcagcuggcuagagcaggcccgagcagcggcagucagugaggccgaggccgauuucuacgagcagaacagccgcuaccagcugaccuugugggggccagaaggcaacauccuggacuaugccaacaagcagcuggcgggguugguggccaacuacuacaccccucgcuggcggcuuuuccuggaggcgcugguugacaguguggcccagggcaucccuuuccaacagcaccaguuugacaaaaaugucuuccaacuggagcaggccuucguucucagcaagcagagguaccccagccagccgcgaggagacacuguggaccuggccaagaagaucuuccucaaauauuacccccgcuggguggccggcucuuggugauagauucgccaccacugggccuuguuuuccgcuaauuccagggcagauuccagggcccagagcuggacagacaucacaggauaacccaggccugggaggaggccccacggccugcugguggggucugaccuggggggauuggagggaaaugaccugcccuccaccaccacccaaagugugggauuaaaguacuguuuucuuuccacuuaaacugaugaguccccugggucugucaaaaugagaaggucacugcugccac

SEQ ID NO: 16848 - RNA, 7015 nt, Homo sapiens
uggugauaaaggauaagaacaaaaguaaagcagaguaagggagcuauaguggagaagcugagaggcuauuuuagauaaggugguucaggaaaacagcaaaaaucugaaggaagacauagaaucagagaucagggaaugugacccagagggggccaaguacaaaggcccugaggcaggagggcugaacugggugauguagauggagauuggugggagaugagaucagaaagggggcaggaaccagaucaaagaaggucuuggagagcuuuggggagaaccuuggugcuaugguucgaaugucccugccacaacucauguugaaauaaaaaauucaauugcuacugucuuaagagaugggacuuuuuuucucuuugagacagggucucacucuugucccccaggcuggagugcaguggguugaucauggcucacagcagccucaacugccugggcucaagcaguccucugccuuggccuccugagcagcuggaacuacagaugugugccaccacaccuggcuaauuaaaaaaaaaauuuuuuuuuucauacagacaggaucuugcuguguugccugggcugguuuccaacuccugaacucaagcaguccucccacuucagccucccaaaguguugggauuacaggccugagccacugcacugggcaggguggggccuuuaagagguaauuaggucagcugggcgagguggcucacuccuguaaucucagcacuuugggaagccaaagugguggaucucagguggaucaccugagaucaggaguuugcgaccagcccaaccaacguggugaaaccccgucucuacuaaaaguacaaaaauuagcggggugugguggcaugcgccuaaaaucccagcuucucaagaggccgaggcaggagaaaaaaaaaaaagauaauuagaucaugagggcucugcccucuugaauagauaaauacuguuaucaugggaguggcuccugauggauggacgacauuuggcccaauuucgugucucucauuugcuuccaccuucugcccuuccauccugggacagcccuuugccagauacugcaugaaguucuugcacuuuccagccccuaaaacugugaagcucugagcaaaauaaacuuugcuucuuuuguuuuguuuuaagacagagucucacugucacccagguuggagugcaacggcaugaucucggcucacugcaaccucugccucccagguucaagugauucuccugcuucagccuccugaguagcugggauuacaggcacccaccaccacgcccagcuaauuuuucuauuuuuaguagagacaggcuuucaccagguuggccaggcuggucuugaacuccugaccucaggugauccacccgccucggccucccaaagugcugggauuaaagacaugagccaccgcacccggccgagucucacucuuuacccaggcuggagugcaguggagaaaucucagcucacugcaaccuucgucucccggguucaagcgauucuccugccucagccucccgaguagcugggauuacaggcacaaacuaccacgcccagcuaauuuuuguauuuuuaguagagacgggguuuuaccauguuggccaggcuggucucgaacuccugaucucaagugauucaccggccuugggcucccaaaguguugggauuacaggcguagccaccacaccuggccucuuucuuucuuuuaugagacagggucucccucucuugcccaggcuggaaugcaguggugugcccacagcuuacuguggccucaaccuccugggcucaaacagucuucccaugucagccucccaagaagcugggacuacagaugugugcaaccacacccaacuauuuuuuuuguuuuuucguagagacggggucucacuuuguugcccaggcucccuuuuuuauuuuaaauuuuuuuuaauuuuauuauuauuauuuugagauggaguuucacucuuguugcccaggcuagaguacaauggcgcaaucuccacucacugcagcguacgccuccgggguucaagcaauuccccugccucagccgccugaguagcugggauuacaggcacgugccaccacgccuggcuaauuuuuuggguuuuuaguagagacaagguuucacccuguuggccaggcuggucuugaacuccugaccucaggugauccacccgccucggccucccaaagugcugggauuacaggcaugagccaccacgcccggccaauuuuuauuuuuuugagacaaagucucuguugcccaggcuggagugcagugucccaaucuuggcucacugcagccuccaccucccugguucaagagauucuccuuugucagccucuggagcagcugcgauuacaggcgcccaccaccaugccuggcuaauuuuuauauuuuuaguagacacaggguuucaccauauuggccagguuggucucaaacuccugaccucaagcaauaacguccgccucagccucacaaagugcugugauuauaggcaugagccaucacgcccggcccugucauuuuuaaaagaucauuuuaaaugcacugugcuaauuuuacugcugaugggcaagaguggaaucaagaaaacuaguuaggaggcuacugcuguaauugaagggaaagaugacagugugcagucucgaauagggugauuuuggaauaugcuuugaugagcaaagguagagcugucaguauuugcugcugaauugguugaaaggugagagagacuggagucaaggacuacuccaggguuuuuaaaaccaguauugggaaaaauggaguugucauacaguaaaguagagaagacugggggaggagccgguaggaggacuggaaauguggaauugggguuuagacacauuaaguucauugcaucagguggacguguuguauugaguaggcaguuggagauacagaccuggagucugugggagacagugggguuucuuuggugggggggucaucggcaucuaagugcuauucgaagucaugggacugcagaagauuauauuaacaaugugaauauucacaagcuugaaaaaaugaauguacggaagagagggggucacacuuuaccucuuauuaucccacccccaggggugaccuugugagccacaccacacagguacacacaugcacgcauauguacacacacugucacagaggggcaaaggggguuggcgagagcgggacugagagcagaucccaggccucagaaacccaugccaccugggcccccucccuguggccuuccuggaugcuguagggauagcagaucugucugggucagcaggucagggcgacuggcaggaggggguggcugggaggccucuuccuccaagagcaggggcagcacaucauccaacaggcagagaagacccucauccgagguaggggcaggucaggguggagugccugccuccuucccccagugccccacacaaagcuccaagagcuccaacaggcuccugucuguuuccacuucccaggcuuucuguggucaugucccugcccacuccaaagggccaucccccucagccuugccucccucucagacccagcugaaucccugccucgguaccgcccccuccuggggcacuccugcccccuuccucugcugcauccucaccuagccuccuaucuguucacaccuccccugcaccagaccuccacagaaguucagacaguggcucuacaacccuacuggccccuaucaaugacuccugccccccugggacccuccacugggcucaggaaagacgggccauuguagcaaaguagccaguccuguagccccagcuggaccuccuggugaggcagcuugccagaugguggggaucgcucaguccucuggggcagaacagggugaguggggcugucucccuuugauucacuuagcccucuuucuucuuuacacauuugcaaaaugugacaguagucauauuacuauucauucuaauaacaguccuugcuggcuauuaaaccucuauacuagcacuuucaggcauuaucuccaccauuacuaaaaccgauuagauagguauuauuauacccauuuuacagauaagaaagacucagagggccggucgcgguggcucaugccuguaugcccagcaaucugagaggccgaggcgggcggaucaccuaaggucgagaguuugagaccagccugaccaacauggagaaaccccgucucuaccgaacauacaaaauuagccgguaucccagcuacuugggaggcugaggcaggagaaucacuugaaucugggaagcggagauuguggugagccgagauugccccauugcacuccagccuaggcaacaagagcgaaacucugucucagaaaauaaaaaaaaaagaaagaaagaaagaaaagaaagacugagagaaagcaaggaacuugccugaggucucauggcuaaugggguccaagucacaaccugacucuaccccaagccaauucccaccuaacuccuccugcagaugccccuugguuauccagagacugugucuggccuuuaauauggacuugaggugugauccugggcuggcuucuuucuggaccuugguuucugaguuuuucgguugguugguucauuugauuaauugacagggucucacucugucacccaggcuggagugcaguggccccaucaugcucacugcacccuccaacuccugggcucaaggaauggugccacugugcugauuuuuaaauuuucuuuauuuuuguagagaugggggucucacuguguugcucuggcuggucuccaacuccggggcuugagcgauccuccugccuccgccucccaaagcgcuggcauuacaggcgacagccaucgcgccuagcugcgcugguaaaacuggcuaacgcgaucuaucuuaauuagccacccacagcugcuaccgccgccccauccccagggaccacacagacccaggggacaaagaagggcgcgggagacagcggcugaggaagccuuuacugcggggcggccggaggaucgccgagcucagggucccccaccgcaccgcgcccggccucguccucugccccaggcccggccccgcccccagccucggccccagccucggccuuugccggaacgucgccgaacacuucccggugcauggcggugacguaguuggagccgcuggggucguccaggcgcauccgcagcaggggcaggaagcgcucgguggugaaguagcgcagggucggcuucggggcgcgcaaagcggugaggaagaccugcggcggcgggaggagagcuguggccaccgcugcgcgccggaggacgcaccgcccccacuccuggaguccagcccggcgcucaccuccgccaccuccucaggguucugcgccgccucgcgaaagacuugcuugcugugggcgagguauugguagaagcgguggaagguguggauguccgugcgguccagcaccuccucugggcugcccaacaccuucuccaugaaggcggugugcacugggccgcacucgaucaggcucaagcugcuggccggagagcaacgagugggagggggcggacgccagccaggccccagucccagccccaaccccagucccagccccaaccacgucccggcccccgaccgcgagcagcaccgcugcgcugggaagugaggcggaaagggcgcuggggauaaccagaacauuugaaacgcggguuccugccggagcagcccucccaaauccaucugaggcuacaagggagcccuggugucaggauucgaaucuagcggggucccuggccgcugugugaccuugggccagucaccuaaccucucugggcuggagcuuccccauaacaauaccaacacuucagcagcuaggucagcagguggcacaaugcgugccaugcgcccagcccaagugccuggcacacagcuaaugugagccgggcagagagggccagggagaucgccccagagcggcucccgcaggacagggugcucggcgucucuaggucagaguuaagaggguucggggaacggggguguugacucacuggaccccaaagggcagcagcagaaccgccagacucucgcauaagccuucgagcgcgaacuugcuggcgcaauaaacgucauugaaaggcagcccuuagguggggagacgagguuccugaggcgcagcggccagggggucauccccgggcagacggugccccuccaagcugacggcaccccacuccaccccccccgcggaaccugccuucaaggcucagcuccgcacacaaagaaucuggagcugccgaggccacucccuaccacucacccaucaauccucccacgcucccggucaccaacacgcgucccgaaccgcgccucuucaugucuggcaggaaggccugcagcauccgcacagucccuacuacauucacguccagcacagaggccacggcguccucccccagcgccuccagcggccccagcaggcccaggccugcguuacacacugcggagacaagaggcccgaccagcccgccucagcaucacccucagcacggccuguccccucgugcucccugggccugggaacauguugguuucaacgcagggcggagaaggcuccuaggagcccauaugcuuccaggaggcucacccagcacguccacgcggcccucagucacgcguucccgggcagcggccacggauuuugagucccuuacguccagcugcaacgucuccagggaucccggagggcaugccagggcccgggccgccucccacagccggcccuguguuuucaggucccucaacguggcauacacuggagguuuugggagaggaggaagaucugacuucccuucuggccuccaagggcuccucccuucucucccucccugucccugccuaucuauaccuuugaagcucugggauggaucugaagccagacguacggccaagugcaggccgaugcccgaggaacagccggugaugagcaccacggugcgggccaugg

SEQ ID NO: 16849 - RNA, 4236 nt, Homo sapiens
cagcccaugccacuggaaaucucgcgagaaucccgcgcugaagcgaagucgagacguuugaccuuccuccguuuccguaguuccgaguugcgguuucuccguuagugcuuccggguugcagccagggaagccuccgcgguggugcaaguggaacccaagccuugagguuucagugaguagggggccgacgugagcuuuagcgucccccuuuagccucccucuucgauuccuugaagacccuggugcagcuuagcaagagggcccaggauuuuuggauccccagcccugugacaaggguuccuguccaguuucccccucccaggauuucgacucaguucagcgaagucaccgccccgucugagaaaugaggacaccaaggcuuagagcacagccccgaggcgccgucuaccaggccccguccccucccccggcuccugucggucagcacugaaaccccgucccugcuccaggccuccuucucugggguccaaggucccauacaggccucugccucggccgcaggcccuucagucaccgucgccucgucucccugacuguccgcaggccugggcagcauggccguauuccggucgggucuccuggugcugacgacgccgcuggccucccuagccccucgccuggccuccauccugaccucggcggcccggcuggugaaucacacacucuauguucaccugcagccgggcaugagccuggagggcccggcucagccccaguccagccccgugcaggccacguuugagguucuugauuucaucacgcaccucuaugcuggcgccgacguccacaggcacuuggacgucagaauccuacugaccaauauccgaaccaagagcaccuuucucccuccccugcccaccucaguccagaaucucgcccacccgccagaagucguguugacagauuuccagacccuggauggaagccaguacaacccggucaaacagcagcuagugcguuacgccaccagcuguuacagcuguuguccgcgacuggccucggugcugcuauacuccgauuaugggauaggagaagugcccguggagccccuggauguccccuuacccuccacgaucaggccagcuucccccguggccgggucuccaaagcagccggugcguggcuacuaccguggcgcugucgguggcacguuugaccgccugcacaacgcccacaagguguugcucagugucgcgugcauccuggcccaggagcagcuuguggugggaguagcagacaaagaucuguugaagagugaguaagagggacccuggacuaggguggaggauccccaaaucuccccacccccgacccuuaugccgagaucaaggaaggguagggccauucauuacuucccacccuucccaaaugucacagugguugacacucaauuggugcuaaggccauuuugucaaaugaacagcuuucucagcaugugguccagucaccacucaaucagaauaccccaaaugugaagcaaagggaucugcauuuuagcaaguuuuccaggugauacacccuaaugagacacugggaaugaaugggugagugagcugcagguagcagugccacagacaggaggaggaaacucaagcauggcaugggucuuggaauuuuccaucugccucugaugcccucuggcacugcucguucucuggagugguuuccugguggcuuauucucuggacacaugccagcccuuggagugacuauugugcuugccuguuucuucaccuucaugcuccccucaccaucaccauaggccuuaccaguugaacccuuucugccacccccucuggggauacuguacuuagggacacuuuuucccaaacuggcccauacucuccuccccaauaaaaagaucucacuguucuucugggcuccuuccccaggcaaguugcucccugagcugcuccaaccuuauacagaacguguggaacaucugagugaauuccugguggacaucaagcccuccuugacuuuugaugucaucccccugcuggaccccuaugggcccgcuggcucugaccccucccuggaguuccugguggucagcgaggagaccuaucguggggggauggccaucaaccgcuuccgccuugagaauguaaccccugagggagacuggcagagggaguggaugggggacggggaaggccauuuugagggggcuguuggaaguaccauggccccagaggagagaagugggggcucaggguggugggaagaagcaaggaggaacugguucucaguuugcccgcugagucggaggaggaggagccuggguaggaaggggaggaugggggggcagguuggaugucagggucuuccucucacucccuccuucccucuuuuuacccuuuccucuuuaccccaggaccuggaggaacuugcuuuguaccagauccagcugcugaaggaccucagacauacagagaaugaagaggacaaagucagcuccuccagcuuccgccagcgaauguuggggaaccugcuucggccuccauauguaagcuccucucccuccuucccuccugcuugguguccuggcaaugcuggagaguagaagcugaggggcucagccccaggcaugaggcugagggccccaguaacuguggguucccuuucaccuauccccaggaaaggccagagcuccccacaugucucuauguaauugggcugacuggcaucaguggcucugggaagagcucaauagcucagcgacugaagggccugggggcguuugucauugacagugaccaccugggucaucgggccuaugccccagguggcccugccuaccagccugugguggaggccuuuggaacagguaauaacuggggaaggcugaaaguggccuggagugaggagcuagccaggccucugugcucaguugucugucuguguuguccagauauucuccauaaagauggcaucaucaacaggaagguccuaggcagccggguguuugggaauaagguaaacaauaacuuccuaagggcuccuaagccgcuacuagacccaggggucaggguccaguggaccucucuggucuggcccagaaugccauuuccauugaucuguucccaacaccaccuugcucgggcuggcugccucuucuagagaagguaaccucugcccucuguuccccuccccagaagcagcugaagauacucacggacauuauguggccaauuaucgcaaagcuggcccgagaggagauggaucgggcuguggcugagggugagugggagggaggauggcaacagcuaaggggacaguuaagcuguuucuuccccugggagcuucccugcccaacgugggacugucuguucacccugggacuguguucugccugggagaacgucggcacugcuggcggugacuggggucuccccacaggaaagcgugugugugugauugaugccgcuguguugcuugaagccggcuggcagaaccugguccaugagguguggacugcugucaucccagagacugagguaucucgccccaccccccacaccaucccuacugcagauccuauccugugagcuggaauucuuccugacaaaugucucgucugugcucaggcuguaagacgcauuguggagagggauggccucagugaagccgcggcucaaagccggcugcagagccagaugagcgggcagcagcuuguggaacagagccacguggugcucagcaccuugugggagccgcauaucacccaacgccagguuggugcccagggcaaggccggguuguggggaaggagucuccaguggguacugccugacccugcccucucuuccucccaacauccuggccugucugaagguggagaaagccugggcccucuugcagaagcgcauucccaagacucaucaggcccucgacugaaaaguucucaguggggccagacuggcuccuggagcugacaagcgaccccguggugaggagaaaugggggccuugaugcucacccugguucaggcccagagguccaagcuauacugugcaggacauggccaggccugguggacacaggaagccuacccaacacgcugguauuuggccaacacugaggaugugguucaugggggagcaguccccuccccacucuugcccaugggugacucuuacccacagcugacuagggccagcgcaaauacuggaaccuguaacagaauuaaaggugaauguucugagauguugc

SEQ ID NO: 16850 - RNA, 6709 nt, Homo sapiens
uucccuguggucuuauccuggugacaucucauucacuugucucccugucucacaggaggaaguugggauagagacggaugaagauuacaacgucacacucccagaccccugaggggcccacggucaggacugguggggacugcaggaugucagaagagugagaugucuugcacuggcuaccuuguuuuugguuggcuuuuguuguuguuccugcuacuuucaccuuuaagcagagcagucaggagacaagcauaaaccagagcacuggguagagaggaugagggcugguggcuggggguagacccagcccauuucauugucuaaauugcaguagcuugagguuaacauuuagacuuggaacaaugcuaaaggaaagcauuuggcaauauuuauuauaauuuaauuuuauauaaaaauauuuaauuuccucuggauagucaaaccugccagauaucaaaccugaggaaggcagaagugaauuuggagaacuaggguagagagagguugcuauaaaacgagcauuuggagggcccacggcuucacucaggaccugcugggcuuguguaccccaggagcccuuuuaaguaucuuuuguacgcuuuucaccccacccccaaguccugggagaaaugcaggcaacacugagacaugggagaggccaagauaugcuugacagaaagggugauuuugaggcucaguuaauauuucaaaauuguaaccguagcaaaacugcauugguauuuagaaaaauaaaaaauuuccaauauguagugcuguguuauaccugccucugccaugcagcaucauagccugugggaaccgggagggcuucccuuaccacccagagcagaggaggaaggugauggaauauggggugaggggaggaaccugguggccccucccugagauggccagaaagcccuuggccucaccugggacugaccaggcagcccuagucuaggcacaaggugcccuuucacccuucauggcugugggaauauuuccucuuacucuuuuucucccauacagcuacugccaaaaugcccaaacuugggccaaauguugcccaaacuugggccaaaaauguugcccaagagaccaaaacagaggaaaacaguuuccaaaucuauguagaucaugagcagaaaucugaggcuugaauaaagggcugagagggcaggagcucuuugggguguccagagcagacgcccaucccaaggacuuccauggaguggggggaaggcuggguagguuugaguuuuaucgucaauauaauaaauuaaucagaagcuuucacaaaacaaacaccgcggcuccgcugaagauaaaauggggcugggaaaaaccaaacaccaaguagaaaccagcugaccagugugagguguuguaguccagucucccgggcccagcaguucaguggccacguagagauucaagggccucuuguuggcuguucuccagguuuccaagaaccggucaguaaagcugguuuuucaauuggugcaggacgccaaucacaaucucccgcagggucuggcgagggcagcagaggaagaaauagacaaugcccaagucaacgcagaguaguuuccaagaugccugccuagaucagccauguacuuuagaaaagugcuuuaaaaauagccccccgggggccaggugugguggcucacgccuauaaucccagcacuucgggaggccaaggcggguggaucaccugaauuucaagaccagccuggccaacauagugaaaccccgucucuacuaaaaauacaaaaauuaggugugguggcacaugccuguaaucccagcuacacaggaggcugagguaugagaaucgccugaacccaggagguggaaguugcagugagcugacaucacaccacugcacuccagccuuggugacagagugagacuccgucucaaaaaaaaaaaaaaaaagcccccaggaaguacugaugucugcaguuuaauuugaggugcuccugaagcaagauggagagauggaaauauaguaaaauguuucgguaaaauuuagggagcggguauacgaguguucacugugaacuccucucaacaucgcaauauguuuaauguguuucacaauaaaaauguugggaaacgaggccaggcacaguggcucaugccuguaaucccagcacuuugggaggccgaggcggguggaucacaaggucaggagaucgagaccauccuggcuaacacggugaaaccccgucuuacuaaaaaauacaaaaaauuggccagguaugguggcacacgccuguagucccagcuacucgggaggcugaggcaggagaauggcgugaacccgggaggcggagguugcagugagccgagauugugccacugcacuccagccugggcgacagaacgagacucccgucucaaaaaaaaaaauguugagaaacaaacaagaaaucucagacacaaguuuaaaaccucagaaaaagcaaccagacuucaauuagaagacuuagugcaauaccauuagcacaucuccauuauaaauaaauuuuuaaaaagcucuuggggcaacuacuuuagggggccuaaagguagggucccagaauuugcguuuccaauucugcugcagaugccuggggcuuccauacaggggcagcgauaacaugggcuagacaaaagccaagagcuggacuucacauugagcucacgucacacuugccgaaugaaaccguaacaugaagauguggguuagacagcaaagaaaagggaaaauaccagggcccucaaagcuguagaaacgcccuuaagaucuaaaagcagcugccacgcuuuucucaacagcugauggcuugggccacuuugcuugaugguagagaaaaccgcagacccugugccuauuguugccccauaccugaggcuuacagugcuccucgauccagcugaagacacacgcugacagcuccuggaagcuggccacugagauggaggcauugaaggacuggaacagggaauccaugaugccuugaaacacguugaacuugaccuggucagagaccugguccuccccuucauggggguuguccuggugugccuucacaaucugcucauaguuccuaaaagcaugcaggccagggcugaggugcugcagcagcuccgcccacccaagaagaaugacgggacuauccuguguacucccaggaauggcagccccagagagcuucugggugggguucaguaucagggagauacugcuuccaggucaggaaagguggcccucucucuccaaccuuccuuacauuaauccaacaggcauuuccugagugucugccauguguaaggacaguuggggauacacaguccuacuggcuagcucaggaacuaagaguauuaucuguacagcaguaacugauguggccuuugaacaagggagggugugcaaugaaguugccucagaaguucugguuccccccauucagcaccccucuuacacuuucaugaucuuuagggcggugacauccuugcguaacguggacaccuccuccuccugcuuuuucuucuccuugugcaaaaacugaauguagucaauggcuagggugggggcaagaaaaaaaggacagguacagaaguauucucaaccaagaagauaaggcugacuuuguuccccuuaccccagaccccaacuaucccauggcaaucaccacaccaaggccgagccauggguggguaggaggcacuggccucuucacagccccgcuuggcuccauccccuccagugcuuucccuagccauacucuuuuguagaacgauggcuuugcugagcuuuugggagccaauggagaaguccugcugcuggcaaguggggacgauggucugaaggucaucauagccucucuguggaaacagcaggggaaauggguucuuuaacccugagagauuaaagcaaaauggcacaaaguuccuccaugacaccaaguucuaugcucacaaacucaauggggugggaaggcugcaagggagguguuugugccugggacuauacuaccugcccacccccuagggugccugggacugucugagugggucagggcacagggaagcuaaacuaugcagggcccucccgcacuggcugaggcacaggccucccuguucaccuugauggcgucccuccucuucugcucagccugagugugugcgcgccgccgccggucuuuguaggacuccuuguaggccuccuggugguaaucacuguccucaucaucuacgcucagagaugggggcagggaaaggucaucuuggggcccagugggguccagcuagcccaccuuuccccagcugggaagaaccugguguccagagaaggcagauggacagaaccaccuaauguuccagaugaggugaaagauggugagaccuugugucugauacuuuggcuccagcaccccuguguggauggcuggggcuucccugucuaggaaagguacuacaauuaugacauaucugagccccccgaggucgggggggauguuacugccuaccuguguuggggacagaagaggcacugguggaaccgaugcuauuagcucuggacacuacacuccccuugcgggugcuuucuacaaaaagcccuggaaaagagaggccccaaucacuaaggggugggguggggaacauugccagacccucagacaccuguaggacacaauggcuuucuuuuauuuauuuauuuuuuuuuuagacagagucucgcucagucgcccaggcuagagugcaguggcgcgaucucggcucacugcaagcuccgccucccagguucacgccauucuccugccucagccucccgaguagcugggacuacaggcgcccgccaccacgcccggcuaauuuuuuuguauuuuuuaguggagacgggguuucaccguguuagccaggauggucucggucuccugaccucgugauccgccugccucggccucccaaagugcugggauuacaggggugagccaccgcgcccggccacacaauggcuuucuuaaaugcugaccucuucccuucaacccaaagccaaccauacugggccccccacuuccugccagaccacgcugcagugcucugcucccuagugucuacacugcuccauaggccugcaugauaccccccuggcucacaaacgggcauguggacgugaugagggugugagugaucagcugcuccacugaguggugagugaucaguuccaccacuucccuguuccagagcagagggaacuaggugucacccucaguuguuuucugcccuuguccuucagcuccugcugucucaagccaggaacucugcucagggagaguggacugugcucaggcgugguuggcaacgccacaagaaucuagagagccugggcgggagugucccucuagagcuuaagauggggcagcuacucaccgggguccaggcuguugucgcuguaggcauacuccaccugcggcacagagcacgggaagggcccgucagaccuccgccccuagggggaggcgccccuuccacugcaggcacgcacagcgcgccccccauuccgggaaggcgccucugucacccugcgcgcuugcacacacacagcccggggugcgcgggcagcuuaaugagucccccgagacuggcacaggcuagggcgugcgagugccuccccuguguaugaucccuuccgccccuacuccaccccagugccccguucccccgacucgcgcgcacacgccucguuugucuccccaccuuggcacacgcggggugagagcugucuucucugcagccccggggcacggagagcgugggggacuuuggggacaggagggaagccccucgucuuccggccccccuacgugcacgagcccgacccgcccuccccucgccggcgugcgcgcccacggggcuugccuugacccaaggguccucgggagaggcgcccggcuccgucaucuuguacccaccggaccggaaacgggccagcgggcgggcccccugcggcgaggaagcggguggcgugcccacgugacccgcgcccgccaauccgcgaccgagagguggggcagggcgaagcaucgcgcaugcgcagcccaaagacuuuacuccacgguuccagccgucaaggcccggcgcuuggccuggcgccagccuccuucgagacugcuccccgccgugccugcccuccccggguuaggcaguggaauggcggcgacaugaagcgcguuuuguaagauggaguccccucaauuggcuugucagcacaccgccgcagauagugugugcacgcgcacuguccggccggccggcuccccacguuacccugagggcggccuccccgcgcucaccggaccugcacugcuggccggugugucaggaaccgggcagagaagcccccagccacaucguccgaccccaccaggcugcaagcucugugagggcagaggccccgccuggcgcgcggaaggcugaucuuccaacacccagcccagugucuggcaggaugcauguggaaugaacccuugcaaagaaccugcuagcuagguuaugcggccucucauauuaaaaacaaaacaaaaacaauaaaacacggcaguaccuagaaagucuacaccuuacucagaagaacacagcuggucagugggagggccaaagcucgccucuggcuagccucaaaggccauucucuuaaccacugcauugcccaggcu

SEQ ID NO: 16851 - RNA, 5100 nt, Homo sapiens
uccagaggaaauuaaauauuuuuauauaaaauuaaauuauaauaaauauugccaaaugcuuuccuuuagcauuguuccaagucuaaauguuaaccucaagcuacugcaauuuagacaaugaaaugggcugggucuacccccagccaccagcccucauccucucuacccagugcucugguuuaugcuugucuccugacugcucugcuuaaaggugaaaguagcaggaacaacaacaaaagccaaccaaaaacaagguagccagugcaagacaucucacucuucugacauccugcaguccccaccaguccugaccgugggccccucaggggucugggagugugacguuguaaucuucauccgucucuaucccaacuuccuccugugagacagggagacaagugaaugagaugucaccaggauaagaccacagggaagcaaagaaggaagagagcuccacuuacaaagaacugcuucuugcucuugggguauccuucaaguauugcaucagacagcucuguagccugacaagaaauaaaaccacccguuuucagaugggcagcacugggcacugccugucaguuuaugauauuguguagcggcugaucuggugccugccauuuucaaaggcaccuccagggccugucucggagcucccacacacuuaccauccucuuccucuuccuccacuccuuacaguacuucugccucucucuguacaccuagaaggaaaaagcaaguuccucuaacuccucagaaccacagcagcccucuggggcucagcccugauguucacucuggaccugcacagcgguccuacagccuuccagcucaccugcucuuucucuucuggagucacaugauugguagcugcuuuaauguucuucaaucucucucuguagccagcgcauuccuucuuuaacuccuggauuucuuucugcaucucugguguggucagggcacuagauaauuccuugagcucugaaaccacauccgccuggggucacuugcuaccccugaggaaggaguucugucuuucccagugggugcucccugagguguuccaccuugcucuggaucuaucaucucacauggaaacuaagccauacaggauuauuuauucuucuaauuuucuuuccuccuccaucuacaaguggcgugggugugagguugaacacuuacuuaggcguagccaguuaaagaagcaggaauaaagggaaacguggggacaguguacugauaaucguggcagggagaacaaaugcguaucuuguccauuuguugguacacaaaagccguuaguuauccuacauuucuuuuuaugccuaagggagcccagcaaaggggucuuagcugcaacaagaugcugcagucauugaaccauucauuuaguaauuccugaccucuagaaugaaccuaagccuaugggcacuuuggaggggcuacccaguccuaccagccuccauguagcggcagcucugcugcaagcucugcaccuuagcagugagggccacgauuuugccaucuaggacuugaaggucagcaucacucaccaugucaaacugguccugccagacaaagagggaaaauacaagugaacuguugugaggcacaaagaugggaacacacaccugggaaggcaccauuuggauaugcucaggaaccagccacaccccaaagucuccagagggucugcagaaauagugggagaguacuuuugagaaauuguuuucaguuaaggagcggccccacuaaaaagguaggaaagaaaagcugaaaucuaaugcuuguccuuaagcuacuagguugacaggauacugauuaggacagaaaucuucccauuuagugauaaaaccacuaccugggcugaagcaguuaaguaacauuguucccacgguggggaaaccuagaucauggguuuccauaauagauagaaacuggacaggugaagaagcaugauggaugggauggauggacuucuuuucuucuuccuuccuguccuuucuucccauccuucuuuccaccuuccucucucccuccuuccuuccuuccuuuuuccucccucccucccuccuucccccucccuuucccucucucuuucucucucuuucucccucccuucccucuuuuccucucuuucuuucucugucacccaggccagagugcaguggugcaaucuuggcugacugcaaccuccgccuccuggcuucaagcgauucucaugccucagccuccuaaguagcugggauuacaggcgcgcaccaccaagcgcagcuaauuuuuguauuuuuaguagagaagggguuucaccacguugcccaggcuggucucaaacuccugggcucaagugauccauccgccucagccucccaaagugcugggauuacaugcaugagccacuaugcugggucuugggauccauguagauaagggauuccaguaagucugaggagcuucucucaugaggggccauugcuagaaaagaacugcacuggggaucagugugggggugggggaggucacaucaguuggugauggggagcagguugaaaaaguaugccagccagugcagucuggacucuacacuugggcaaggugaaccuauagggcagaggccagcaaacuauggccagcaagccaaauccugccagaugcauguuuuugaaaacaaaauuuuauugaaacagccccacccguucauuuacauagucuacagcugcuucuguucuacaguggcagaggugaguaguuguggcaguuguacagccagccaugacaagagauacauauggcccacaaauccuaaaaauacugucuggccauuugcagaaaaaguuugccaaacccuccuuuagagaauuaucuuuagaugaguaacacaaugcagccuguuuuaggaaagucagccuuaaaagugguuugguucaguuuaacgaguaauaucugcuggauguuagauacugcggaggugcugaucagauaaaaaugaauugagaaauggggucugcccuagaggaacuucaguugaauaaaggagacaaguaaaaauuguaauacagcaugccucaaaagagguaagggccaggcugggcacaguggcucaugccuguaaucccagcacuuugggaggccgaggcggguggaucacgaggucaggagaucaagaccauccuggcuaacacgaugaaaccccaucucuacuaaaaauaccaaaaaaaaaaaaaaaaaaaaauuaggcuucguggcgggugccuguagucccagcuacucugggaggcugaggcgggggaauggcgugaacccaggagguggagcuuauagugagccgagauugugccacugcacuccagccugggugacagagcgagacuccgucucaacaacaacaacaacaacaauaacaaaaagagauaagggccugaaaaagaaacaauuagcucggagcauucaaggaagauuucuggaaaaggugaugucuaagugaaauccucaaggaaagaaagagcuggccaggaagagaagcagguacagggaagacaacaugcaaaggacagagcaguaaaacacaccagaauuaucuaguguucguggauagaaaaauaaugaggauuggugaggccagaggcuggcuggggcgucuuccggugccuuuuacauguuuuuugcagcacuagagagccauugaagaguuuuaaauagggaaggugcaugaccagaucuauuuagacagaucauucugacugcaauguuuaagaguuuaagauauguuugaagagccaagaucuguuaggaggauacugcaacaaauaaagagggcgugaacuagagcaaccauggcagauggaaaggagaguggauucaagaauggaaaaauuagccaggcucugugguucacgccuguccucccagcacuuugggaggccaagacaggaggaucacuugagcccaggaguugggaccaaccugggcagcacaguaagacccaucucuauaaaaauuaaaaaaauaaauaaaaacggaaaaaucagcuggacuugaugguugacuaguaaaggaagucaagaauugcucccaauuucugguuugggugaagaguaauuccauuaggggaggagaauguuagaaagaaaccaguccgggguggggggaagaugaggcauucuacuguggcaauuuugacucugauauuaaugccugacagauuccagcuggaggucugggcuggagaauauaaauuugauauguguguuuagagaaucggauggaggcaggaggaacaucauuuggcagaggguguugcuaauguagaugauaaggaauaagagcuuuggagcggaaauggaucuugguagcaacaauacagaaucuucugucauccaucauauuguaaaucuggaaaccucgugaaguugggauccuaacaagaggaguacacaccuugauuuaaggaugguggccuaagacaggugaguuuuccauggggggccuuguccccaaagaguucacaccaggaguagauucacccguugucgggcucucaugggugacaaucggcgcaaguucuccucaccugauccgcaaaauagaucuucugcuugccguacaucuucucuuugaucuugccuuguugcgccagcugcuccagcgucuucaccaccaccuggcagaggagagagaaggagcaaucagaggagucugagccugggucuggggaaauccagccagugauguggaaaacgcccaaggcuccaaagggcacgaccccagccugaauccagggaguccgacggagagggaaucccgggagaagguccucaccgccuugcccaguccguguucccgcuguagguucccgaacacauccugggagcuguagggccgguucugcuccugcagguaccucaggaggaucccggcggcuacggagagaaaggcaggggagggggccacucaaccgaccuccucacccacugcccucccgggucuuccccgcgcccacggcgccguuaccucccgccgcagcuucugcccggccuuuacucaucgccuuucccgccacccaacucagaaagccggacguuguaguugcucggggcgacggcu

SEQ ID NO: 16852 - RNA, 9133 nt, Homo sapiens
guuuguguaaauaagaaacuuuuuuuuuuuuuuugcuucucuucuacaaauaaauuaagaaacaaacuagaaaauuacccacacccauuguagcccuugggugugggaugugcccugucccugcagggccaaaaggguccauguuucccucaaaucucagagcaguccuggcccaggcugcaggcaggagggaagucgugaccucuuggcaggcucaguccugcagcugccccaagcagccagacugucccuggggcucguccaggcccgggcgcuggcugggaggggaggugucuggcaggucuuggcauggaggagaagagcugcugcagggccucucgggggagggguuggccaaguaggcauucaccagcugcaugaucucuuccaccuaagagagggcagaggucagugugcaacaggggcugccagguucucuucuuuuucucauccuuucuccaggcucuagggcuccagcuuccccaccaggguccuacgugcucuggcccugcaaccuuuccuuccuuaucaccacucucuccuucauuucuuuuuuguuuuuugagacggagucucgcugugucccccagguuggagugcaguggcgcgaucucagcucacugcaagcuccgccuccuggguucacaccauucuccugccucagccuccugaguagcugggacuacaggcgcccgccaacacgcccggcuaauuuuuuguauuuuuaguagaaacaggguuucaccguguuagccaagauggucucgaucuccugaccucaugauccgcccaucucggccucccaaagugcugggauuacaggcgugagccaccgcggccggcuucucuccuucauuucuaugugccaguuauacuugguucuuucugcucuucuaacauuuuuuuuuguuguuguuguuguuguuguuguugagacggagucuugcucuguugccaggcugaagugccucggcucacugcaaccuccgccugccggguucaagcaauucuccuaccucagcuucccgaguagcugggacuauaggugugcgccaccagccccagcuaauuuguauuuuuaguagagaugggguuucgccauguuggucaggauggucucgaucuccugaccucgugaucugcccgccucggccucccaaagugcugggauuacaggcaugagccacugcacccggccaccuugcaauucuuucuaccuggaaugcuguucucccaggucuucccuggcuagcuuaaauggcacccuuuuugagaacccuucccuggcuuccugucacaucacucuuuccuuuguagcauuucucacugucuucauagccugggauuccuuguuuauugucugacuccacucuaguguaagcuccuucagcuugucugugaucacugcuggauccccagugcuuagagcucuaccuggcccagguuugguguucuguaaaugcuuccugacaucgcuucccuucucuccuccucccacaacuccucuucucacucaccugggggcucugcaggaggagcuggcucucucccacccucaaggccagggugugggggcccauuagcuggcaggcggccacauggccauagcugacacuguggaugggcuccgucuccccuggccgggagagggacauggccuuggcucccaagcccaggcacagcuucuguggagcaccccgaccaggcuccugcagacagagaggcagagucaggguggaaggaggagcccagcguuauuuuugguagggggagaugggugucugugagcaggaguauccugaucccccuaugauucacagcacguguguggagggggcugaggcuccagggaugugagggcccaagggcuggugacuccugggguuugagauggguagcuguucuggauguggggaauuacgugacacuccgugggaccuguggcucuggggcaaagguguggggcuugggccgccagaguccccuucucccuucucccccucaccgugcucagcuccagaacgucauaccgagcagcgccgaaccccggacacugcgccgccagggccagguaggcggccauggccucagcucggcccaugccccguagccgcuuccagccgcccagcacggcagcugccgugccggcgccgccuccucccucgcgggcaaugcuucccgcagugcggccggccccgccgcgccgggcccgcuccgcccgccucuuggccaggcccgggcuccagagcgccccggccagcagggcagcggaagggggcggccugggggucgggcggggcgggucuucgcgcggcggggccgggggcgggagcaggcgguccaggcggggcaggggcacccgcggagagaagucccgcugcaggcucugcaggcgcagcgccgccagggcgcgcagcgugucgucgggugggggcggccggccccgcagcagcagagcgugagccugcaggggaggcacccggcgucaguguacgagcggcggcggaaccgucgcgaaaacgccucgcggaaucugagcaggucuagguuccagucaagccucccgcggggcugccauagugaugaaaugagacggccuagaaaaccagggguucaggcuugggggucuguuuggaggcgugaacgccggagagccucaccugcucaaagaggaaaggcaguucgugaccgucuggggacagccccucagggugcagagguccgugaagacgcagacauagucuccacccggagucgggcgaguccuccaacccagcuuccuccgcggccaagcugcagaagaggagcggacgaagcgcuagggagaagccggaccccuacggcgagggcagcuuggggugggggcggggccauguguuuggggcggggccugggcggagccgacagcggaggugaugcugcagucggacugcaaaccugcggcgggcagguccgucuguaaaccagcgaacaccacagcgcagggccaggggcaagcgcuggauaauguccgcuuagagacugaccucagcugagaaguggaugggcuaauagagagcagggcuggggcuggacauuuacuucucaaaccuggugagcacgucggccacgaggguccccccagccagggcucgcuccugggccccucgcugcucguacagcgcgaaugcguugcggcuccgggccaagcccagccgccccaccagcucucgagccaccuagaagaggagggugaggggagaccacucagaggucuugccaggauucugggagggguugauucaauuggaaggggucucuuaguccugucaccaccacucccucccuuaccaaaauaaucuagacucggggcaaaccuaggguccaggaagagggagagacaggcgugagaagcuggcaggguggguuggaggucauggggccuuucucuggccucaccucccccgccguggugugggagucgauggccacagcacaggcaccagcccccggacagugcacgguacacagcagcuccugccguuggcucaacgcggaaaucuccgccagcgagggcaccagcucucugccgcgcguccggcccagcgcuuuccggaugaagcgcgcauauuccgccaguuccgaguccgggagugccugcucgguccuggguuaggaggaacccagggaucaauacuccaagggcuuucuucucccccucccucuugccugcuucucuuauaguuuauuuuaucuagccgauuuccuccccgccccaacucaaguucuuugaaggcucuucuaaaucucuccccagugcuuugcauagagcugaauuacuuuucaaguccccuggcagcuuucucccaacugccuccaccacuuccaaaagucuucgugaucuuccuucggccugaaaucgaaauccagccacuuuacuacauuuuccuaagcccuggcgcuggccugcaucagcuggaggaaaagcagccuuuucauaacuccucagcccaaggggggcguuuuauuguaauucauccgcucacaacugcgauaggaucuuguaucucccacaaaggcacuguauguauuacucgguucuuuaccuaccaagucuuuugcaaaagaccuuucauucucucccagcccgguagcuccucgccuaggccguaacccccaccucgccccucucaccucuccaagugccccaggaggugcccccgcacagcucccccaggucggaaggugcagcucaugcaggugaggaguugccaguaccgcagggccgcagggucuuggguagccgggagcccggggggaccugcagggcccgaggucugcuuagccagcugcaggaagaguucaucccggagcgcgggcaagucccggcagguuuggagcacacccugcaucaagggcccggggcgccgcgcccccuccagcgccugcagcgccaagaacagccgcaccgccuccucgcgcaggggugcauagcccggaccugugggagggugggggcggagggacgguuuggagaggggacacagagcugcgcccugggaggaaggcaugaaccaggggaaggucagagggaauauaaggggaugggguggcagggaggggaggguacgaacgacaggaagagugaagggaaagcaguggucccacggagccagacucucaaccucugccucccaggaauccccuucccaaucccacuaagccugcauuuggacuuagggagacggacggccgggaagggcuguagauucacaccccagauucuguaacuccauacugaggcucaccaccauaggucagaaaacaggcuggacuaggagucagaaaaccgggguuccucucccagcacccuuuaauccucuaacuuuaggaccugggccagucacuacaccguuuagggagaaguacaguuggaugaggccagcacauucuacaaaagugguagcuuuucuaccacuuguaaagguaauauggcauagucucaagaggauaaugaaaaaauaggggaguguacaaacuccugaaggaacaucaguagucagaaugagacccauagagaagguggccaaagggggcccuuuugugugugcuggcuuccucuccuccacccuggccagcuuccaguuucaccuucauccuucgaaaagugaggagcuggcagguccaugaaggaugcuuagaucccugccaguuaagggauucagauucuuaccucugaaccaccccaucccauccaggggacuugggccaugggaccacucaccuggggcgcugacuccauagggcaggggcaggaguggggcauacaaggcuccacuagugugucucagaaucggguuccucagguaaaugagggcaacggccucuggguccccgcaacuuuccuagggggccagggagagggucaccuugauggggaagggaguuccucacaaccccagaaagcuuugggguccaccacucuccuggcucucccugguguguaccuguaugucccugagcaguagcugggugggggucuccaggggugccuuggaggcgaucacuucccgcaaugccaccccccagcgcucagccucugccuggcguggggagcagaggcggacacuguguuuccgaccagacacagucacugaccacagaccuggggaaaagagaggccagggagggccauuagggucugccggggccccugccuaggaagguaggagaguccccaggaggucucaccugucuccuuacgccugcgcucugggccggucaccgagcacaggcuggugagcacgaggcucccgagacgccgcgccccuuucccgcugcugcugaacugauccagggagucccgcgugagcacaaaccaggcucggcgcgggggcagccagggccgcgccccuccuccgcggggcucccgguacagccaaccugggggccggagagggagggaagggacaucaguagagacauuaaucccuaggggguugggauugggggccuccagagugcacugaggggggucucuaccuuucacaacgauguccgggucguccuccggcagcccuuucuccgggaugaggcuccaagucuccucccagcucugcagccugggccagaggggagggaagguugggucuccacucugccucuagggggcuccucuguaggggcuccccagaccgcacgggugucugcucccaagcugggcaccccucccccaggcugugggaaccgcugggccauucugaccucgaaccagaaauagccccgaccccccucuuucuccccgcgcccccagccggaccgccccccgggaccccagccaaaccacagcguccggcauagggccucucccuuauugcacaaccgcuaggggagacagagaggaugggggucccgggaacaugcuggggucgccagacuaugggacguaggggcguagcucaccuguuggagacaggcccgcuccucacuggcugagucagcgucacuuccaggggacccuggggagacaggcggggaagcccucagggucagagcccuuccugcgcaagguucgugccuucugcccucaggacagggcugcucaggggauugaggaaggaggagucacagaguggggucgugacuaggguggagcacgcuggagccccugggcucgccccucccgccagucuuaacaggacaagcucuucagaacagcaggagcuaaggagccaaggcuccucucaguuacccuuugaaaauacaaucagggguaggguaggguggaaagagcacugggcagagagucaggagaccuggguuccaauucccgccccaccacuaacucacuguggaaccuugggcaagucucuucccgucuccgggccuuaguuuccccaucuuugaaacaggagaggugagcucguucugccaggcuccaaggcacccucuccuccucauuuucccuucuuccacacugccucccuggccaaggcaggacaggugguaggcacagaggugaaugaagggcagagggacccuuucaguauagggcuuucuccaaaagcgucuuacauucucccauagacacuccugagacucaauggugagcagagacccugccccuuugcuggggcuuaggaagggcgggccagacugaggaauggcacacccucuggaggcagguguaguucaggguuuugcccucccccucccccuccuccucccuucccccuguccuggaacuucaacuguagacuggggucugagagaggccacaaacccaacccggaggccagucaggcgggaaccgugccauccucauauugcucccagacugcuagagccaagagggggaggugggggagggggccagggacaccuguccccaggcucagggaaggggggaguugagguggagcaugagggaggcaauggccugguaaagccgacccugcccaagcuggaagcuuggggacgccuggguccugcacccuuccuacgugaaccuccaccuauuuucuggaaggucugaguggggcugucagccacaccacauguggcagguacugaccacccucuuaggcuaacuccccuaaucgcagugcccugcuucccucccuccccccuccucuauauuuauccacccuccgccuccgccaggugcuggcgccggccccggcggcgcagcccgccccacccgggcaccgagccacugggccugcuggggaccccugcgcgggggaugggagccugacccgggccacagcacacgggagucuggccgccagugugcaggagggaugggggaggagacgucaagggauggaggucucccacaccaaucgugccuccguuuccccacggggagauucgacaaaaccaggcagcagcccagugucccucaccauccauccccucagggguuucccaggagccucacccgggaaagccgagaguucuguccugaguggcaggguaaugaggagggguccucaaagagcucccaccucccucuccuugggguccccgccacagaccccaauccugggaugacuucucccccucguccaggucuccgcagcgggagcucucgcaucuggccuccgcacuugcgaacugggagcggagggggacccaggcguucgagccgcccagccggccucgccacauuccucggcgcuggcggaggcggaaggagacgggaugggacgcgggcccagcggggaagggagaggcagggccaggucgggccacgcgugacgccuccccugccucagggcccccagcagguggauagcgcccagccugcagcgggaggcccacaggcacaucccgaguagggcugcugcuccgagagcucccgggggcuuuggcccccaggcaaaaaacucucccucaucccuaguucgccaagcgcgcagcguguggcuggaggcuggagcggaucagcgugacggccgguuacagcgagagugauugagacgaggcuccgaacccccgggacuuacccucccgccgcccgcuggacucgggguccgcagcucaaagguuuccucguccucguccucguccccguccccgcuaagcucgccguccccguagucccggugcagaagagugaagccucgacggcagcagagaagccaccauagucccccggggagaggcauccgggcgaggagcugcggaugggggcgcgggcagccgcggccgagcaguagggggucggaggaacuggcggggcuccgacccgagcaggggaaagaugaggugggaggagcagaagggagaagaggacagggaggaggcaguguccugggcuggggugcaaggggacgcuagccagacgcugaggggggcucagugucugggcccccggaggggggagggggaaaagcguccagggccccgggagaggagggagcaauguccggagcugggaaguaguguccguuggaguguccagcccuguggggggcaguguccggugcagcguccgaggugggcaguuguccaagcuccagggagggucguguccgguagggcguccgguggccggggcccgggccgcgcgcgcugcgcucccugcagccccgggacuggcgcgcugggggcgcgagcacagagcugggaccccgcccccccggccccc

SEQ ID NO: 16853 - RNA, 1136 nt, Homo sapiens
gaucuuugaggucuggaagcuuacgagaaucaguuggcagggaaauguaccaggaaagcuugguacaacggcgcuugucuuuuucgcucuagccuaaacacuugagccucggcaaacgggcagaggcagcgggaaucagggacuacacccccgaacccaguacccggguccccgacuuccccgagccuacgucacuggggcgcgacggcguuguccccgggagugcagcggcugagaaggucccuucggugaaggcgaguuccgggacaacagagagggccgcaccguuuccgagucucucggaggcucaguucucagcgcaccauuccccacagcucuccuuuuuacuuuaccccuacccgacacuugaccccggcagugugaaccccgcugggagcguccaaagccaugccucaucgcggcugcgcagcgcacgugcacagccucgcaggagucucggcgauuggcugugacgcaguuuccggcgugagcggcgaaagccgggagggcgagcgagagagcaagcaggcagcaggcugccggcgggcgggcggacggcacagagggagggagcgagcgagcagugaguaagccagcaagggcggucgggucccgaggucagccgagauuucucaggucccuccggcccccucccuggaguccacagcgccuccgguguccagaggaucggacacggcccggcccggccauggccucguugcugaagguggaucaggaagugaagcucaagguagcggcaccgguccggccuuuuugccccucgcuuugaucccccagcagucugaccggcuuccuacuccccauggcgucuuugucucccuggggauaccagcucugagcuuccgcucggcucagcccagcccccaacucccggggucggcuucgcgggagaggaaaauauaggauggcuuucuguaccgcgucugaugauggagagucccggggacaccuccgcggacacguguuggacucagggcuuuaggcccgugacagcugguaaucccccagcccaacaacgucccuggacacugccccugcccuuggcggcuggccugccuaguaucauagacuaggucuggguggggguuggcacguuugugagcucacaucuuccc

SEQ ID NO: 16854 - RNA, 1136 nt, Homo sapiens
gggaagaugugagcucacaaacgugccaacccccacccagaccuagucuaugauacuaggcaggccagccgccaagggcaggggcaguguccagggacguuguugggcugggggauuaccagcugucacgggccuaaagcccugaguccaacacguguccgcggagguguccccgggacucuccaucaucagacgcgguacagaaagccauccuauauuuuccucucccgcgaagccgaccccgggaguugggggcugggcugagccgagcggaagcucagagcugguauccccagggagacaaagacgccauggggaguaggaagccggucagacugcugggggaucaaagcgaggggcaaaaaggccggaccggugccgcuaccuugagcuucacuuccugauccaccuucagcaacgaggccauggccgggccgggccguguccgauccucuggacaccggaggcgcuguggacuccagggagggggccggagggaccugagaaaucucggcugaccucgggacccgaccgcccuugcuggcuuacucacugcucgcucgcucccucccucugugccguccgcccgcccgccggcagccugcugccugcuugcucucucgcucgcccucccggcuuucgccgcucacgccggaaacugcgucacagccaaucgccgagacuccugcgaggcugugcacgugcgcugcgcagccgcgaugaggcauggcuuuggacgcucccagcgggguucacacugccggggucaagugucggguagggguaaaguaaaaaggagagcuguggggaauggugcgcugagaacugagccuccgagagacucggaaacggugcggcccucucuguugucccggaacucgccuucaccgaagggaccuucucagccgcugcacucccggggacaacgccgucgcgccccagugacguaggcucggggaagucggggacccggguacuggguucggggguguagucccugauucccgcugccucugcccguuugccgaggcucaaguguuuaggcuagagcgaaaaagacaagcgccguuguaccaagcuuuccugguacauuucccugccaacugauucucguaagcuuccagaccucaaagauc

SEQ ID NO: 16855 - RNA, 7082 nt, Homo sapiens
ugugcacgcuuggacacccaccuccauggacaccuagccacccuguuguguguccuuaugccaguugagcugaaucuuuuccccaguauaguggaaagacugaggcuucugccuacugagcaagguugggugcuucauuuguguucagucugaauuaugggaaaguuagcucuucccagaccuaagcugccuucucucccuacuuucagaagauccuaguuccuuccuucccgagugauacccaugaacugccaguagaggcugcuaucguuccauguguaaggaaugaacugguucaaggcgcguccuacccagucauuuucuuuaccuuauacuaauucuuccugaauaaugucuucaguuucuugaggagacuccuaguuuugguuuucaaauuacuuggagggcugccuaggaaucuaucucccucugaaauaaaguuuccucaucuuccaccuugcaaguagccuucugguuuccaaugauccccucguugucucuguaaaaagaguuuaaggucuugaacaauggaggagcagcugcucuguucuguuucagagaugacuaccaaaagcuagcgguuugugagugccuccccugugccaggcuguuaaguaccuaaugugcaugaucacauuuaaucuucaggaaucuauaggauaguuguaucuauuuguuacagaugaggacacugagacucaggauaaguauuuccgcuaagguuacacagcugagggaacugggauugguggacaaaccugauuacuaagcccaggcccucagccacuccacugguuggaaauggccugacuacaaaucaagggcuuggcauuaggcaacaaguagaauucagugcuuacugcugaacauggcagugaauccuggagcuguugggaugcaguuccugccaggagguaggaaaauggacagcuuagugcuugcaugcaggcugcagaacuuaauugggcaucugagguuuguacucuuccugagacccauuccagguggaaacuggagguuagcaucguuaacccagauucccuuucaucuggucuaaaugauggaaaucaguaguugguacugacugcuaccagugggaguucaggggcaaggaagaggcuaugcauguggaagcagugcccugggccaaaccacaggacagaaaauuggaacagaauuacauaaaucaaggucagaaauuuccugcccaacccaugggguggaguuuucucccuuccuauccauccuagcgaauauaaaccccgacuugaugucaguaacuggaaggagcagcuguuagaauucugauuucagcucucagcauccaccaugcaucucaagauaguccuggcguuccuggcacugucccucauuaccaucuuugcccuggccuauguuuugcugaccagcccaggugguuccagccagccuccccacugccccucuguaucccauagggcccagcccuggccacacccuggccagagccagcuguuugcagaccugagccgagaggaguugacagcugugaugcgcuuucugacccagcggcuggggccagggcugguggacgcagcccaggcucagcccucggacaacugcaucuucucaguggagcugcagcugccccccaaggcugcagcccuggcccaccuggacagggggagccccccaccugcccgggaggcacuggccaucguccucuuugguggacaaccccaacccaaugugagugagcuggugguggggccgcugccucaccccucguacaugcgggaugugacuguggagcgucacggcgggccccugcccuaucaccgucgcccggugcugagagcugaguuuacacagauguggaggcaucugaaagagguggagcuacccaaggcacccaucuuccugucguccaccuucaacuacaauggcucuacccuggcagcugugcaugccaccccucggggcuugcgcucaggggaccgagcuaccuggauggcccucuaccauaacaucucagggguuggucuuuuccuucaccccguggggcuggagcuacuacuggaccacagggcccuggacccugcccacuggacuguccagcaggucuucuaccuugggcacuacuaugcagacuugggccaguuggaacgggaguuuaagucuggccgguuggaagugguuagagucccucuaccuccaccaaauggagcuucaucccugaggucucggaacucuccagguccucuucccccucuucaguucucgccccaggguucccaguacagugugcaaggaaaccuggugguauccucccucuggucauuuaccuuuggccaugggguguucagcggccugaggauuuuugauguucgguuccagggugagcgaauagccuaugaagucaguguccaggaguguguaucuaucuauggugccgauucacccaagacgaugcugacucgcuauuuggauagcagcuuuggacucggccguaacagccgaggcuuggugcggggaguggacugccccuaucaagccacgaugguggacauccauauauuagugggcaaaggggcaguccagcugcuuccaggggcuguguguguauuugaggaagcccagggacugccccuucgaaggcaccacaauuaccuucaaaaucauuucuauggugguuuggccagcucagcccuuguggucaggucugugucaucugugggcaacuaugacuacauuugggacuuuguguuguacccaaauggggcacuugaagggcggguccaugccacggguuauaucaacacagcuuuccugaaagggggagaggagggccuccucuuugggaaccgugugggggaaagagugcugggaacggugcacacacaugccuuccacuucaagcuggaccuggauguggcaggugagugcugaggggaugaggauggagacuugggggcggggucaggugggguggagggaagggaagggaaucucccaggucaagcugaaauaacaaguggcaagagcaggguguuccaacaccacagcucuaguggcaacagggcagggacuguuugagcauauucagugcagugagucugguacugggcuacuggguaucugguaaaaggugaaaagaguucccccgcccagccccucugacuugcuaugauugugaaacuaguuuaaauguaauggcugggcaugauugccuuagccucaagugacacugggugggugaacuggcccaauggggcuggaguuggagcacuuugcuucuuccuaauucugagggucaguagggguggggagggcaggguccugagccgaggucggaagaagucuguccagagucuucagggugggggucgaccuggggcuuaggaaggagaggguagcaaagcugggguugcuccccaggauagggccacuccucaucgggagggccaucccauuccugucaucacaguugacucauggcaggcacacagcuugcugcaaguauggaaagagauuucucaagcacaaagggcucaaagcacacagaggacuugcuguuccugacagacuuugucaaggacagaaaggaacuuacagacucacacacugauccacaaagaaaauuagaaacucaccagacccucuccauuuuaagggaaacuaaggaggguggcgggagaugggacaggaaaugacugcccaaguauaaugcaacauaaacuaguauuucuugugaaauguuuucuuauccucaagucuaaagacauggcacgugcgugccugcgugugucucugugcaugcacuugcacuuguguucgcagugguguggaggguaggaaggacuaauagcaugauugaaaugaucauauuaacuagauuacucuuugacauacuuggauuuugacuugucuucugauuggaaguuuuucuucagcaucuuuggcauuaaagaggcuuguuuugggaaguaacauuuauuggaccccuagcgugugcagcaugggcugcugcugugggccagagaggcugugucaggcaccagcucacaggauggcugcagaggcaccagcuucagugcagugccucccgugccagguaccuucauauaggucucguugaacuuacaguccagaccugcagaaaguguaugaccaagugcugaguuaggcagugcagguuauggaugcuguagaauuccaaggaacucccagacaaagguaugaaugugcuugcuucugaaaaacacugacaguacuucccaccuugcugagaucaaaagugaagucucagagcugggaggaguaugcaggggaccaugggaagggauuggguuuucuuuuuuugaggcagugucucacugucacccaggcuggagugcagcggugcaaucacagguuacugcagcccugaccuccugggcucaagcaauccuccugccucagccuccuuaguagcugggaugacaggcauacacuaccacgcccagcuuuuuuuuuuuuuuugaagacagagucucacucuguugcccaggcuggagcacgguggugcaaucucaguucaccgcaaccuccaccucccagguucaagcgauucuugugucucggccuccagaguagcacaccaccacaccuggcuaauuuuuuuaaauuauuuauuuauuuaaguagagaugggguuucaccauguuggccaggcucaucuugaacucccggucucaagugauccacucgccucggcuucccaaagugcugugagcuaccaugcccggccuuuuuuuuuuuuuuuuuuuuuuuuuuaagaggcaguguuucauuccguuaccccagcugguguccagcaccuggguucaagggaucugcaucacccugccaccagccuccugaguugcaagcugccacacccggcucaggagucaguuuuucagcuagcuucuccaagacaaauaucauuaucccuuucauaguuaaaagaaugucacuagucagcugcaagugcuuuucuguuuauugggcacagccauagaacagcuuuaauuaugcccaguguagggauucagaaagugaaucagagaagcaaauugguccagggacuguuugguaguccagugcuaauagaacuuucuguagugauagaaauauuccguauuugagcuguggcucuaaacaauagucacuagccauguguggcaacugggcacuucaaguguggcuagugugacagaggaacugaauauauauauauauauauauacauauauauauauauauauauuuuagacagagucuugcucuguugcccaggcuagagugcaguggugugaccucagcucauugcagccacaaccuacugggcucaagcaauccuccuaccccagcuucccaaguaacugggaccacaggcauguaccaccaugccuggcugauuuuuuuauuguuuguagagucaggguuucaccacguugcacaggcuggucucaaacuccugggcucacaugauccacccgccucagccucccaaagugcugggauugcaggugugagccaccucagcuggcccuaaguuuuaauuuucauagccacguguggcuagugguuacccuaucggauagggcaaguuggaagaagauaggagcuugcucuugcccagaccuccuggcucccagcacagugugcucugaugcucucucugccuuuugucacaccagugcaguggacaucauggggaagacagggaccuggcccagagaccuuaccugguguggaacucaucuccuuucccucccccuggcagggcugaaaaacugggugguagcugaagacgugguguuuaaaccuguggcugcccccuggaacccggagcacuggcuacagcgcccacagcugacucggcagguccugggaaaggaggaccugacagcuuuuuccuugggaagcccccuaccccgcuaccucuaccuggcuagcaaccagacuaaugcguggggucaccagcgcggguaccgaauccagauccacagcccccuuggcauacacauaccccuggagagugacauggagagggcccucagcugggggaggugaggagggcccuggccuggguggaaggaaaggacagccccuccccugccccaguccuuggagacaaacucccuucccacggcuaccauucaucccuguaccuccccucaaacccaaguuagauacacggugggaaauggucucacacagaaucggaucuaagggacuccugggccaguaaaggcacuugacauuucccaaaaccaccuucuuaugauuccuggccagauaccagcuuguggugacccagagaaaggaggaggagucacagagcaguagcaucuaucaccagaaugacaucuggacacccacaguuaccuuugcugacuucaucaacaaugaaacccucuuaggagagguugguugcccuagggacauaggaaagggacaccugugggcauggcaucuuggcugcccagccucuggccaaagguuagagggaauggcugauuuccaguucgcagauucagaggccauggaguuuucugaugaccaacacaggucaucccuccuggggugagauuagcucugggacacuggcuccccccucuccccgcacagcugcuuacauggauugcuccacguguuguaugggcaugaggcuggggagaguggaagccaggcugagacuggaggcugggauugugacugaagggugguucuuugggucacgcuuccauaguccuccagcuccuccuucuucuugcaggaucugguggcuugggucacagccagcuuccugcacauuccccaugccgaggacaucccaaacacagugacucuggggaacagaguuggcuucuugcuccgacccuauaacuucuuugaugaggaccccuccaucuucuccccuggcagugucuacuuugagaagggccaggaugcugggcucugcagcaucaauccuguggccugccuccccgaccuggcagccugugucccggacuuacccccuuucucuuaccacggcuucuaguccugaggguguggcgggcggcgugguuagg

SEQ ID NO: 16856 - RNA, 277 nt, Homo sapiens
auggugaaggaaauugaaaucagccagcacaccaaguacacuugcucuuucuguggcaaaaccaagaugaagagacgagcugugaaaaucaggcacuguaauuccugcaugaagacaguggcuggcagugccuggaccuacaacaccacuucggcugucauggugaagucugccaucagaagacugaaggaauugaaagaccaguagaugcuccucuacucuuugagacaucucuggccuauaacaaauggguuaauuuauguuaaaaaaaaaaaaa

SEQ ID NO: 16857 - RNA, 2547 nt, Homo sapiens
ugaaucauaugguaugugaauuauaucucaauacagcuauuauuaaccagaaaaaggaaguccagcuacauccuggguggcucuugccuucaugugagacccagcauguggcucagacugaucucagccugugauuuguugaguguagcucugugccaucauggccucucacugaugagccacugucuuuucuaagcagcaaaggcagaggaugugaagaaaguccgggagacggggcugcaccugaugcggcgagcgcuggccgugcuccagaucuuugcuguuagccaguuugguugugccacaggccagaucccuccaacccuguggcagaggguccaggcugacagagacuacucucccuugcugaagaggcuggaggugucaguggacagagugaagcagcuagccuugaggcagcagccacaugaccaugucaucaccucugccaaccuccaggaccucucucugggaggcaaggaugagcugacuauggcugugcggaaggagcuaacgguggcugugagggaccugcuggcccauggacuguaugccuccuccccagggaugagccuuguuauggcuccuauugcuuguuugcugccagccuucuccucggccccagaggccaugcacccgugggagcucuuuguaaaguacuaccaugcuaagaacggccgugcuuauguggaauccccagcccggaagcucucccaguccuucgcccuuccuguuacgggaggcacuguugucacccccaaacagagccuacugacagccauccacauggugcugacagagcaugacccuuuuaagcgcagugcagacucagaauugaaggccuuggugugcauggcacugaaugagcagcgucugguguccugggugaaccucaucugcaaguccgggucacucaucgagccucacuaccagcccuggagcuacauggcacacacaggcuuugagagugcccucaaccugcucagucgccucagcagccucaaguuuagccucccuguagaucuggcugugcgccagcucaaaaacaucaaagaugccuuuugaugagagugcccuaaccccagacaagcuccuuguucaguagggauagaugugcuagucuucuagcauaggagcaaggaaucagaggugggguuaaaggcauuuuucccagacccugcucaggcagucggccaaaugagugcaaagucuguuuuccccaccaacuuagcucucggaaagaugugcuggagggacccucuuguuaagaagguucugccaggccgggcgcgguggcucacaccuguaaucccagcacuuugggaggccgaggcgggcggaucacaaggucaggaguucgagaccauccugucuaacacggugaaaccccaucucuacuaaaaauacaaaaaaauuagucggacaugguggcaggcaccuguagucccagcuacucgggaggcugaggcaggagaauggcgugaacccaggaggcggagcuugcagugagccaagaucgcgccacugcacuccagccugggcgacagagugagacuccgucucaaaaaaaaaaagaagguuguacccacaguauacgugugggcacuugugcuugagccuguauuaaaggaaucaggccaggcacaguggcucacgccuguaaucucagcacauugggaggcugaggugggcggaucaccugaggucaggaguucaagaccagccuggccaacauggugaaaccccaucucuacuaaaaauacaaaaauuagcuaggcgggguagugcaugccuguaaucccagcuacucaggaggcugaggccggagaaucgcuugagcccgagagguggagacugcaguaagccaagaucaugccauugcacuccagccugggcaacacagggagacuccaucucaaaaaaaaaaaaaaaaaaaaaaagacauucaacuugaggcuccuguuaguuaagcuaucuucuuucacuugaagcagguuugagaggccuaggccagaauuuaaauuccuuuuaugaauagauuucccuuucuuccugaccccaaggucagaggagacuauauauuccauggcugccucuaagacuaggaauaggaauaucugaaaacagcauuucuaagggugguaaccacaggucgauuuuaauacgaguccuuuuucuuguagagguaaguaaaaucuuccugacaagguaguccucuuuucauggcacagacaaugggcuuucuguuuaugaggggugagaagugauguuuguuacuauguucuccagcaaguaaacauuccucugcucaccucccaacaagacuaacagucuuuuuagaaguaaauauauucaagacaaacgagaaaauccuggcuacccaagucgaguauauacaggaauacaaaucgguaaccagcagcuguuccucagguugugacucacugagcaccacuuguccuggaggcuggaugauggaggacaucugguuauagguacuguagcagggauaggugccacaggaggauaggaacuacagcagaucgc

SEQ ID NO: 16858 - RNA, 10250 nt, Homo sapiens
ccggcgccccgccccucccgcuggaucccgcagccgcggcucuucccgacgcguuccgccuuccccagcugugcacucuccauccagcugugcgcucucgucgggagucccagccauguccgacgagagagagguagccgaggcagcgaccggggaagacgccucuucgccgccuccgaaaaccgaggcagcgagcgacccccagcaucccgcggccuccgaaggggccgccgccgccgccgccucgccgccacugcugcgcugccuagugcucaccggcuuuggaggcuacgacaaggugaagcugcagagccggccggcagcgcccccggccccugggcccggccagcugacgcugcgucugcgggccugcgggcucaacuucgcagaccucauggcuaggcaggggcuguacgaccgucucccgccucugccugucacuccgggcauggagggcgcggguguugugaucgcagugggcgagggagucagcgaccgcaaggugagcggguugcguagggcagggcagggcugcgcaggccacugggcaguggggcacgagugggcgagcgccggggguguggcagggcgggagaaacuggcgcggaccugggugcacgagcguggaaagcguagccaaggaacuuguguuugggggcuccuggagagcggcauuuauguggggaggggagacgaaauuaucgccccuuccccaaccauuuuuaguuguggccgccgcccagaagcugugcuggugggggggaaaacaauaaggugcccaugcgcaugcgcacaaccacacuaccguccccaccccccccccccccccccauuaaaaccacaccuguaccccuacccaccaaacacucucuggguaauuguggucugugacuaugagugacgguuagugcccccuuuccccgagggagcuugaggggcuaugucgucgggguugggcgggggcacagcggccgugccagaguccuggucacaugcagccccguggucugugggggugugaggcggccccucccaaagcaaggccaaagagacgagacacgcccaucacggaggagagagagccuuugcuaccccaccgccaccagccuuacaccgccgaucugauuuuggggugggggaggcgggauugggucauccgaucuuugucuugggcucugugucucccgugacugcaguaucuccuccuccugugacucagcccucagccuucgggccacgacccggggcugcccuugggaaugccuggggcggggaguggaaggggggacccaccucugccuuccuccugcagaggacccccacuucagaaaccccagugccagggguuuggacuggaacggagaggugcggcgccuugaacugguuggccaagucugcaggccuguuucuccuucucauuuaucauuaaucuuggccacaacccuggacaccagagagcucaaaaugaucagcuuuuugagagaccugggaugaggccucagcacgccauuuguuuagagguuucuuuuuuuuuucuuuuucuuuuuuuuuuuuuuuuuuuuuagacggaguuucgcucuuguugcccaggcuggagugcaauggcgcgaucucggcucaccgcaaccucugccucccggguucaagcgauucuccugccucagccucucgaguagcugggauuacaggcaugcgccaccaugccuggcuaauuuuguauuuuaguagagauggguuucuccaugucggucagucuggucucgaacucccgaccucaggugaucugcccaccucggccucccuaagugcugggguuacagacauaagccacugcgcuuggccaggaguuuccuuuuuaaaucagaccccucaaugagaggccccacagaugcagccucuugcagaccugccagcccaauucuggagccagguuuguuggauucauccuguaugcaaacagcuucuccuuaaggcuuuccucugaauucagcucuggccccacccucaaacugacuucuaaaugaucccacucuugagcaggcgucuaagaggaauauuuucgggagguaguuguaguucauguuacugcugaaggccacccaccucaccuccccuccauacacuuuccgccugguaaauacaggauauccuguccagggcaagaaucugauguaagagccuggauucugcggggagggcccuucccucucucucccuccuccuccuuccuggugucuggguuggggaggggucauggcccugauuuggauggccugaggguuagcaugagccaggguaagugagacuuguucugggucaaaucugggacuggccaugacccuaaaugaccaaugcacuccucgcagcucuccuggguuguucuguaucugcuaguccugagucccuggguggagggcuuccguucuuguucuccagaccucaucucaggccagaacuuggaaggaaagaccccagcaugcccucaguucucguauucaguggagugugggggcuugaggacaugaaaaagggcguaaguggcagucccaucccccuuccccauggacccuaacucuuguuaauauacagaauucccaucauuccuggcagggaucaagacagacccagauugucccagaacagcacccacaccucccucuucaugcucuucagagagcgcagagaagucuuuucuccugacgcucccuccuuuucccugcccuucccuugaccccacuugcuaagcuggagagaaagguucuguuaucuuuguccccuuucccuccugcacagaggcucucgugggggugggggggaagccuuuuacugcugcguaggccucuguagcccuucuugucuguugccccuccugcaccaucucugagugaagauguuuucugggcucccagugcuggcucaaacacacuucucccgaggugaccacacccugcuguaagcgcucagagaacuuugccugcacuuugguauggcccugaccacacagugccgucuucuuuugguugugugacuuccuugcugcuauuauauuauuauuauuauuauuguuagcuaacauuauuaagugcuuauuaugugccagacauugugcuaaaauuuuuuuuuuccauuuggaaaaacugcccuaauugacagauaagaaaacuggagcuggaaaaguggagcucaaaaagauuaaguaauuuuuaugcauccgaagucacacagucaguaaacaguugagaccgcuuuuguaaccacagcaguuugaucuuuuccacaauacuucaugcugcccuaacuguaagcuucuugcauucagggaucuuacacaauagugacauguaagaucuguaagaagaugauaaggauaguaucugccucaaagaacugauguaaggguuaauuaagcauuauauauaaagcacuugaaaucgggcucggcccucagucagcacucaguaaaggugaguuguuauuguuguugaugaugauguuauuauuauuauuauuaccaugacuauugcugcuucuccugcuacuucauuuggaagaagguagccuuguaccuagggggaaaucaguaaauagccugugggugaaugaaugagugacugaaugauacucuucuguucuucaaggcaggagaccgggugaugguguugaaccggucagggauguggcaggaagaggugacugugcccucgguccagaccuuccugauuccugaggccaugaccuuugaggaagcugcugccuugcucgucaauuacauuacagccuacaugguccucuuugacuucggcaaccuacagccuggccacagcgucuugguacacauggcugcaggugacagguccccucacuuuaucaccccuuaccccacccagauuuccuuccaggccccuucccugcagccugucuggguuguugucauggcaacaccaggcugccuuggccuguggcucccagaggccucugcuguguaguugccgugguaacauucaggcaccaggucuagucuggugugcuauccuuagcaacgugcccucaccccacacccccaccucucuagcuaccuuccccaccacuucucagucauggaaauuagacacggcccuaaaaugagcguaggcaaaaugaaggugacaggcugagucccugggaggcuagaauggagugguugguggccagggcaacuccauauccccugcuuaugggugucuugcugcaggggguguggguauggcugccgugcagcugugccguacaguggagaaugugacaguguucggaacggccucggccagcaagcacgaggcacugaaggagaauggggucacacaucccaucgacuaucacacgacugacuacguggaugagaucaagaagauuuccccuaaagguggggggcauaauaugggaggggguagggaggcacaggacagggaggggagcuccagaucuguggauccuaauguuguucuuggguuccccuacucuaugacaggaguggacauugucauggacccucugggugggucagauacugccaagggcuacaaccuccugaaacccaugggcaaagucgucaccuauggugaguuagugggccagggauggagagagcaugugagggcaggagggagggucuaaggggugggauauagaggccagggcuuuugaaugaagaagggguagggacucaggugcucuguagacgaucaggguuaggaaugguccuguaugcugcauucagauugcugacucuuggguaccagcucuuuucauucucugucacaacuuuucauaugagugauaguaaauucuacauucuuuuuuuuuuuuuuuuuuuuuugagauggaguuucgcucuugucgcccaggcuggagugcaauggcaugaucucgaucagugcaaccucugccuccuggguucaagcgauucuccugccucacccucccgaguagcuggaauuacaggugucugccaccacgcccaacuaauuuuuguauuuuuaguagaggcgguguuucaccauguuggccaggcuggucuugaacuccugaucucaggugauccagccgccucagccucccaaagugcugggauuauaggcgugagccaccacgccuggccaaauucuacauucuuguuuggggauuauucuugaacaaccagccugccuucuuucuguccuaccucccugagcaucuuaggcagggugcauuuucauuuaaaaaaguauuucauacaacaaaauaagccaggcaugguggcucaugccuguaaucccagcacuuuggaaggccagggcaggcagauggcuugagccuagaacccgccucccggguucaagcgauucuccugccucagacuuccugaguagcugggauuacaggcauguaccaccaugcccagcuaauuuuguauuuucaguagagacgggguuucuccauguuggucacgcuggucucgaacuccugacguccagugauccgcccaccucggccucccaaagugcugggauuauaggcgugagccaccauacccggccaacaccuggcuaauuuucguauuuuuuaguagagacaagguuucaccauuuugggcaggcuggucucgaacuccugaccucaagugauccccccaccuuggcuucccagagugcugggauuauggaugugagccauagcacccagccccuagagcaauuuaaagucagccaggguugguuugggccugguaaccagcaguuugagaauuauccaaucacucccuggcacugguguggagaauugcaaggggaucacagggaacagagagcacagaugcagacacacagggaugugccuggggggguucacaggcuaugucaccuuguccuucaggaauggccaaccugcugacgggccccaaacggaaccugauggcccuggcccggacaugguggaaucaguucagcgugacagcucugcagcugcugcaggccaaccgggcuguguguggcuuccaccugggcuaccuggauggugagguggagcuggucaguggugugguggcccgccuccuggcucuguacaaccagggccacaucaagccccacauugacucagucuggcccuucgagaaggugaaugugaggacuuugcagggagggcuuggguaggacucaugaaggcuggggucccaaggggcagauuccuggggaagaggagggcugccugcaucacacuggcucuuguuggaugaggguuggauagcacugggagccgcaucuuuccuuccuccccagguggcugaugccaugaaacagaugcaggagaagaagaaugugggcaagguccuccugguuccagggccagagaaggagaacuagggcaaguggcugugagacccuagagaccagcgaagggagaaguugggaagcuacguucuguuggccaccagacuugcauuucagccucugucauaaugcucugcccucccucccccgaaggucucuguggugaugaccgcucuccccugccccuccccgcuuccugaccucugaagagguugggaagugaccauuuggaugucugggcccugccaaggcgacagggagggucagagggaggccggcugcuuccugcccccacccuuuccccgggccugcugugcugcuuuugugccaagguuagccaguccccccuguuguguuccaugugcuuucaccucugccucaucuuuccucccgucccugccccgccaccuccccaaagaauugaaacgucagcucaggauauggggccaaucucugugaguccagcauguaccugucucucccuagugucccuucagccugggcugaccagugcccgccucugggcuugaccaguucccaaucucguccucuguccccaacuucuuaagcacaauugggcuucuuccaucuccagguuuucugccauucuuaaccaaggcugccucuuccaacagggcgggaaucagaccuacuccccuaggucacaacucugggaaggauacagagcccccacccuucacugaguucucuggauuuguucucagugccuuagcaacgaaaaccugugcuuguguguguguggcggcggggagggaggauccuguuucccaccuccuucuccuccccuguacuccccagugccuuccuuguucugguggagcugggguuucucuccuccccagucccacaacacugccaaaaaucuguguaugugccauuggguggggcagccccaagccuccuggggaggcagggcaaaaacaggugcccucaucguggucugugccaugucccgucucuauggugguugaggagaaaggcggggaagcuuccucagccuugcagauauguguggcauuuacuagccagagcucugaaaggcagugcugucuguuucuuguacugggaccaaaguaaaaauccaagcacauuccccuugcaguuaggggaggcccuacugccuucucaaagcagagaggcagcuuaucaaacucagcccaaaacucuguuuacauggguggggagauggagcagggaaguacagagugggauggucaggaccugggccauugcaaccaaaauggggacuuccuggguagggaggucacucccucuacucacugagcuaggauuagggaggguuauugccccaaccauugcaaugggagguggagggacaggcucagccuccucauugucuaaaugaggccuaaaugugugaagugcgauuucugcuuuuguguaccccaccaccccauuaccacagcugccuuuguguguuugugucaauaaaaagccaaacccuggguccugcuuguugccucugagaguggagggaaggugagcuccuggaaggcuagugcugccagcagaagaucugggcugcuuccugcccccugccucuuuccaugcccaaaucacguuuccuuucaugagugaaaugaggaagaacaucauggcaugcaggcucuuuuuacuguucugggcaguguuuugcaaugugugaccccuccgcacuguuggugaacauacagaccuccuauaugggcacccaagcccaggccagugugagaaccuuggcggggggguggggaggaugagaaggggaggccccuagccugacucagaggugaagacugcuaggcccugcuguccuugggguacgacugucagggccucuaccuccccgcccccgcgggugggcuucuggaaguggaucuccaggacgucaugcagcuccgggccauccaagauaucaggaauguugagcaccaguaccgagcggggaacuggcugcgaccugaucuggaaaaggagccaggagauggcaaaggcucaugggagaagggcugggggcuggggguagggcaggcagugccccauggggguaugaggucgggaggccuggagaggcugaugguggguagguaggucagugggguuuggggccucugauccuucauugggcaaguuccuggcaggcagacagguuacccagcccagccccuguucuucaccccuccugcuuaccucagccuucuggaucuccccguucacauacggagagacucucagagggacuugcugcccacccaguggcacugugaacuggccgauuuggcacagacgcugagccacuguggggagcaaggaggggugggccuuuagcaucaagcccucuccucucccugcaccguaaucuugcacacccuauacccucuccccugcaggaggccugcauagcccucaccuccaucccuagcaaaccccagcaugacacucccuggcaguagcucccgaacguccacaucgccaccuccguuccuagucuugccaaagaagaucucuagcuuguccagcagcuccuccucacucagccugaggcuggcaggaaauccagugaccaacacccuccggccacucaacuggcuggacaucuagggggagacagcaagggguggucccagacacagcuccacuuccccaugcccaggugcauggcaugcuuugcaugccccaggauucugucauaccaucaccuggaugguggugaccaugggcagcuccaagggcuggaccugcacccgcagccggcacuccuccauguugaucgugugcuccuuuuguugcagcaccugcucagccacuggguggugggaaacagggucaguacugggaacccuccccaccucccuccugaggcuccccaugagcuuaccuuuggggucaucaaaggugaucagagcagagcccgcaagcagagggcaguggauccgcaaauuggaaacuaaagacuuaggcacuuccggguccugcuggguguguccucggaauaccagggggaucuugggcacugaaaaugggaccuggaaguaggggaggggaguaggaguguuccucacucccaccuaggaggaaggcaucuccgauuccauuccauugaugcugagugccggagauaaauacauuuacugaaagaaaagcuggauaaaugaguggaugaaugcaggucugguccauacagggcaauuuacauacaacaucuuaauuuguccugggagguggguagcucuacuuuacagauguucaaguaacauaauggaggucacacagcaaggaaguagcagagccaggaauaaaaccgagaacuccccagcucuuuuuuguguuucuuuguuuuaaagggagucuugcucugucacccagcuggaguguaguggcaugaucuuggcucacugcaaccuccacuucccagguucaagcaauucggacucagccucccaaguagcugggauuacaggcaugugccaccaaacccagcuaauuuuuguauuuuuaguagagacgggguuucacccuguuggccaggcuggucucaaacugaccucaggugauccaccagccucggccucccaaagugcugggauuacaggcgugagccacugcgcccggccuaauuuuuguauuuuuaguagagaugggauuucacuguguuggccaggcuggucucaaacuccugaccugaggugaucaggcccccuuggccuaccaaagugcuggguuuacaggugugagccaccgcacccggccucgccagcucguuuuuaccaaacaacaccagaucucccaccuuaccuugucuuugggggaguccccgagcuccuuucucagcugcugcaggucccacagccucaucuugagucuggccugcuccuccugaagggc

SEQ ID NO: 16859 - RNA, 41062 nt, Homo sapiens
guucgccguaaagcgcccgcccucucgccucuacgcuuccaguugcggcuuauuacgucacaguaauugcuguaccaaggucagaaucgccaccugaggccugaauaucagcguaagauaguguccaaagcagucuuaagaagaggucccauuaccccacucuuuccgcccuaauggaggucuccaguuuagguaaauaaaaggauuguugggagguggagggaaagaacuacuauuuccaacaugcauugcggaacgaaaggccuuggccacacuguuccuuggaaacuguagucuuauggagaggaacauccaauaccaaagcgggcacaauucucacggaaauccaguggauagauuggagaccuccgcgggcuuauacaugucaacaguaauggauuggaguguuguuauguucuccuaucuugagagcagagacuaggccaaaaaaagauaccuacaacuccuaggaagacuacgauucccauccagccccacgagucucgggcaaguaguccucuaaggucaguggccugcggggacgcagugggcgccgaauuugccuggggaaggggaaauccgcucuggcccacaucugcgcacuccuaguuccgccccucagccucaauguuuguuauuguuguucggguucagguugcuucugccccgccccaucgacgcaaucuccaccaaucaauggcguggucguuuugagggacaaguggugagagccaaucaucuuggcgaacacucggagaaacaggggacuaguuacugucuuuauccgccauguuagauucaccccacagggauagcggcagagccgguagcggacgguccuugcauuggccuccggcaggcgccccccgggggcgggaagcugguaaggaagcagcugcgguuaccuagggguggggucacgucacgcuaagaggguuuggggaaguucaagggaggaauccugcaaagaagaggggcgacuuuuuccguguuucgggacagcuaaucuuuuuagugacaggaugagagagcccuucauguucagagggaccgaguuggcgagaagcgccggagaguuggagagucugugggucagaacauccggcuucuacugauggaaggccacgacuccccaguggaaugagggccuaggcaaagaaaaugagagagcccucgggguagugacacugucuugggaacauggagugcuaggaaacgaaaacuggaagacuaggaugaacucugcaaguaaaaaaaugacacuacuuacacauccuucucaucccauccucguuuuuucgagaccuuaaagagaucuccuugguuagggaccuucgguuuuggaaaggcacuguuuuuccuuuuugucaaacacucagcuuucaggccacacuuuuuugagacagagucuugcuuucucaaagaccaacccaggcugggcuugaacugcugagcucaagcgauccucgugccuuggccucccaaagugcugggauuacagguauaagccaccgcucccggccucaggucacacauuuuaaagccuggauaacuuggcuuguaaaggccucugguggagacaguaaucaaagcucagguugccaggucuguuucauuaaagggauuuuguugaggcugaaaaaaaaaucgacguggaggaaaagcuaacuugugccaagcaaaggugagucaguggcauggacuuacaauaaugccaguuaugaaagcugaaggccuaagacccagcuaucugacucuacuggcuguagaccuaaggggcagauaggguuaaccauagcuuugguguuuacacacguuuaagauuaaugcuccugcugaaagaauuuuuuuacaugucagccaaagagaguuccuuaugaagaccuggauaugguccagccaagcuagaaucucccacuuccuguuuucucuuaguuggcccaccagcuggaggagcuccagaguaucuaaauuuccaauuguguaauuugagaaaaagagaggaagauucauuuccuucacaaguagggaaguguguuucuugaaguuggaaagugauauuucagaauacccacuuuuggcggacugagucacuucauuuccuugauuuuuugccuaagguccuggggaauugacaaagauucucaaauuuuaaggaccccaauaauuacauuucauaugaaugaauacuagaugucagcaggauuguuguuaagagacuaauauuauuuugguggugaacuugguucuugguagaaacaaagaauggagaaaauugggggauaauugucuuaggguuucaaaaaagugccuuuaaaugacagucuuaauuguaguauuuuacagggcagugcauuacauuguggaaaacaguacagguuuaugguucuaaagacugguuuauuauuauuuauuuauuuauuugagauggagucuugcucugucgcccaggcuggagugcauuggcgcgaucuuggcucacugcaagcuccaccucccagguucacgccauucuccugccucagccucccgaguagcuggaacuacgggcgcccaccaccacgccuggcuaaauuuuuuguauuuuuaguagagacgggguuucaccguguuagccaggauggucucgaucuccugaccucgugauccacccaccucggccucccaaagugcugggauuacaggcgugagccaccacauccggcccuauuauuuuuuaaaauguuuaauugaacuuaauuuuuuuaaggagacagggucuggcuuuguugcccaggcuggucuugaacuccuaggcucaugauccuuccgccucagccucccaaagugcuaagauuaccagcaucagccaccacacccguccaguuuuuuauuuuauuuuauuuuugagacagagucucgcucuaucacccaggcgagagugcaguggcaugaucuuggcucacugcaaccuugccucccagguucaagcaauucuccugccucagccuccugaguagcugggauuaaaggccugcgccacuacacgcagcuaauuuuuguauuuuuaguagggacgagguuucaccauguuggcuaggcuggucucaaacucgacucaaacgaucugccugccucugcuucccaaaaugcuggaauuacagacaugagccacugugcuuggccuuuauuaucauauuuuuuauauuugaaugacauuuugaaagaacuugcguacacauuuuuaauuugauccuuaugguaacacugugagauagucaaagcagacguauuagaccuauuuuauagguuaaagaaccgaagcucaaaagcgaacugaccugcucacaguuuuaugucuaguaaugggccggagguaugucuggaagcuaagucuucccaguuugugugcuccuccgccuccccucugccccccacccccacccccgcagaccacgcuguaaaucccugggacuuaaucuuguuccucucaaccuaagcuauuuuuucauaucuuguuccucucaaccuaagcuauuuuuucauaaagucauaaaaaccaguuaaacguaaccauucaucaguaaacaaaauccuuaauuaaaaacauaaugaucagaauagaaaucugauuaaggaauuguuaacuuguuaggcaugauaaugauaucuagacuguuuuuaaaaaauucuuaucuuuuagagguacauacucaauucuuaauggauaaaagcauagaugucugucaaaauaaucuaguagggaaaggguauugcuguaaaccuuugguuacagcaaauugguccugaguugauaauuaugaaagaagcuagcuuauggguccauagggauucauuauauucucucuacuuuuguauagauuuaaauuuucccauaaaaauauuuuaaaaaauaguccgggcaugguggcucacgccuguaaucccagcacuuugggaggccgagguggguggaaucacgaggucaggagaucgagaccauccuggcuaucacggugaaaccccgucucuacuaaaaauacaaaaaaauuagccaggcgugguggcgggcgccuguagucccagcuacucaggaggcugaggugagagaaucgcuugaaaccagaagguggagguugcagugagccaagauugugccacugcacuugagccuggacgacagaacaagacucuaucucaaaauaaauaaauacaauaauauaaaauaauuauauuauuauaguuugguuaaaacauuaguugacuauggucaguucauuguuggggcagaagugggagaugcggggguauaugugaaugaggauagccuugaguugauuguugguuuaacuaaguguuuauuacucuccacuuuuauauauguuugaaaucccccauuuaaaaaaucaguacaaggccaggugcgguggcucaugccuguaaucccagcauuuuggaaggccaaggcaggcagaucaugaggucaggagaucgagaccauuuugccuaacacggugaaaccccgucccuaccaaaaauacaaaaaaaaaaaaaaaaauuagccggaugugguggcgggcaccccagcuacucgagaggcugaggcaggagaauggcgugaacccaggagguggagguugcagugagcugagaucgugccacugcaccccagccuggggcgauagagcgagacuccgucucaaaaauaaauaaauaaauaaaauaaaauaaaaaaucaguagauugugaaaaaacauaguaacuuggauggagggcauugaaugcuaccucuguguaguuucuuggcuaguguuuuggccuguaaguucguaaaacugguagaaaaccuagguucucaaguuaggacaacccuccuucugcaagaaaaauguagaaugucacucucaagucauacaagaauacaaguucccugagggcagagaccuuaucucucuuauccauguugguauguccugcuacuaguaaguauuuguuuaguuaaccagucaucauaaaguaccguaaggauuuuacaaaugcuagaugauuucugggaauguggucaaaauuuaaauacuuucagcauacuucuguuuccacauguuuccaacauguggaaguuccuaauaacuucaagaauaauuuuugugacuuaaguacaagucuuuauggcaugguuuuagccuaucuuucuuuccugaaacaauuccuauuuaacagugaugguaaguuucguaagaacagggacaguguuucuuuuguucauugcugucucccaagcccagcccauauuggguccucacaaguauuugcugagugaacuuuuagugcaacuuauagaacccuuucuaauguguuuuucucucucucccaccaaccuucucaacccuagccucacagcauggaaccacagguuacucuaaaugugacuuuuaaaaaugaaauucaaagcuuucugguuucugauccagaaaauacaacuugggcugauaucgaagcuauggugaguguuacuuuauuuuguuucuccuugguuuaagcaugguuauuuuuuccaaagguagcuauuuuuagcaguguuguuucauagcugugaagucugucauaguuaccauuucugggccuuuuggaaaauugcuuuugauaggguuucaguauucauauaugagaugugccccaauaaagggaaccaacacauaaauuuccuuuugaacauuuuagaaagggaagguaaaauuguuuuuagugagauaggauuuagaaaaccuauuaauuuuagaaccaguaugaggagugaauugguguggacuccacccaaccagaucccaaggaaauguucucuugugugaggauaugacuuguguuuugcacaaggauauaacuuguguuuugcaagagccuaucaauuguuuuuauugcuaggucagagguugaguaucucagaguugagcaggaaaaacuuucauaccugcuuagacagcaguucaccuguuccguuuuuuugcuaaggcuuuuccuccucuugguuugcccuuuguacucuucuguuuuuguucaguuugcaguggugaauguuuuacuuccuguguugacuguguuucucucugaaacccuuugguaaaaaucuacguuuaccugguuauaucugaugauaacuaaaaagggaaagaaaugguagaucuuaaaagaugaucugagguaguugucugccuuccagcaaauaccuguucauacuguccuaucagugacagugagacccgucucaaaaaaaaaaaaaagauuggauucagaaagaaguuagaucuuguuugccaaaagaugugaaaaucaguuaucuuucuuuuccuaguaguuaaaugagcugacagcuugccuuuuuucuuccuuguaaauuuuaaauuguauaaguauaauacaugcccauuuuaagaagagaaaccaucucaagcaguuaauagcccuccauucuccccccccucaucuguuacucccaccuucuuuggguaaccaauguuaacagcccuguauguacuuuaaauuuuccauguucaugcagauaucauacuaggaucauacuauaaacauuauuuggccaggcacaguggcacacgccuagaaucccagcacuuugggaggccaagauggguggaccacuucagcucaggaguuugagaccagacugggcaacaugguaaaaccccaucucuaccaaaaaaauacaaaaauuagcugggccugguagcaggcaccugugguuccagcuacuccggagguugaggugggcgaauugcuugagugcuggagguugaggcugcagugagccaagaucaagccacuauaauccagccugagcgacagagugagacccaucucaaaaaaaaaaaaaaaaagauauuuuucguuuuuuuuuuuucuuaucuugaaacuucaggagauauccaucuauacacauaacuuauacacuguucuacaggauaaacucuguccuauacaaaugugagauuaaugggucacaaagcauuuuauuugaaauuuuaauagauucugccaaaugcuuugcagaacaauuguagcagcacacagaaauacaugacaguguccugaaguuuugacaacacuggauguuauggcuuuaaaaaacauuugcuguucccuaccccacaccccacccaaaacacacacacacacacacacacacacacacacacacacacacacacacaguuugguauucugaugagaugucaucucauugcuucaauuugcauuguucugaccaccagaaaguuugaaagucuucugauguauuuguuagguguucugauuuccucuuguaugaauuuuauguauauuuuuaccuggguuguuaauuguaucauuagcaguuuugcugguacucuggguguguugcagauauuaacccuuuguuauggguuauuaagguuguuuguuguuugucuuuugauuuuguggguuuuuuuuacuuugacuucuguguacauuauaaccugccuuuaaauauguaucucuuuuauagguaaaaguuucauuugaucugaauacuauucaaauaaaauaccuggaugaggaaaaugaagagguaaaauauauuauggcacuuauugcuagguguucagaauagggaucuuauuucuccagugauaugggcuuuaauaauucaaaauaguguuuagcuuauuuguguggugguuuaaauauauuugauaacugaauauucuaagaagacuugcagcaucugagauggaguugagaaauggagaagcaacacugaagaauaucucagagauaacuuucacuuaaaaaaaaaaaaaggaaacagggucucacuauguugcucaggccagucuugaacuccugggcccaagcaguccucccaccucagccucccaaagugcugggauuauaggugugagacacccaccaugccuggccuggccugagagaaccuuuuuuuuuuuucuuuuuuuuuuuuugugagaugaagccucacuccauaaccuaggcuggagugcaguggugcgaucucugcucacugcaaccuccagcuccuggguucaagugauucuccugucucagccuucugaguagcugggauuacagguguauaccaccacgccuggcuaauuuuuguauuuuuaguagagacgguauuucaccauguuggccaagcuggucucgaacuccugggcucaagcgaucagcccaccucggacucccaaagugcugggauuacaguugugagcuaccacaccuggccaagauaacuuuuaaaauuauauagugaccuuaaguucacauauagcacaagcuaccacuuaguuuauaauaauacaaauauaauggcuaagcuuuuuuuuuuuuuuuuuuuaaagagggucucacucuguugcccaggcuggugugcauuggcauagcuugcugcaaccuagagcuccuggguucaaggaauccucccaucucagccuucuggguagcuaggacauaccucucugcaucuggcaaaauuuuuuaauucuuuggagggauggaaucucacuuuguugcucaggcuaauggcuaagcuuuauugagugguuacagugugucagacuagccacaguaccauguauugaguacauuauuaucaucacuauuuuacucaugaggaaacugaggcacagagaggugaaaauaacuuguccaaaugcacaaaaacuuggaaguaguaaaguagccguucaguccauacccucuggcuguagaacucaagcuccuaacuguuauauugcacugccuuuuaauguaucugaaauaaaggagggcacaguagauaagcaauaaaauuucuuaaguguuauucaugacuagcaagugauauggaaaagcugaacgcuuggccugaguuuuugucuguccuauggggcugguccuaguaacagaaaugcucaacugaugagacacuuauaauucacuguugcuuuuuuuccuuuuauagguauccaucaacagucaaggugagucccuaagagagucuguucagccuuguuuaaaaaccuuaaucugcucauugaggcauuucuauuuauacucaaaccuuauugcaguauuaauuuuagagugacauugcacugauggacauuaguuaccuaggggauuuuauuguauagcaguuuuuuauauauaggaugaugccuuugaauggacccuaaggacagcuuuaaugggagguucucauauuuaagaugccaguccucugaaauuaauaugccucccaguucaacacauauaaguauucccaugguguugcauuuguuucugacuugguauauauguuaauaucaacuuauaaaacaagugguauuccaaaaguuuauuuaucagauguucagagcuuggagugcauuuucccauaggaaccauguuauaguugaagauuaguuucccacgauagccccuaaaaucuuaauuuaaucaggugaaaugauaguauuaacauugaacucucagugcguaaaugugagggaccuggguugagauuuuguaacuggaagauucccaguagugaugaaggagggauuuaaggggaagaacugaucuacaguagaugcuguuugcaacaaaaagggaguuugucagcaaaaagauaguugcuguucauauauaauaagcuaagaauucuuuaaagucaggauuagcuguacauuuaacaaauuuuuauuguauauauugaaggugcacaacaugauguuaugaaauacauauacaguaaugcaucgcuuaaugacagagauuuguacugagaaaugcaucaauuaggugauuuugucauuauauggacaucauagaguguacuuacacaaaccuagaugguauagccuaguacacaccuaggauauaugguauaaccuauugcuuauaggcugcgaaccuguagagcauguuacugugcuguauacuauagacaguugaaacacaaugguauuugcauaucuaaacauagaaaagguacaguaaaaauguggcauuauaaucuuaugggaucaccaucauacacaugguugaccaaaauguuauguggcaaugguuacuguagugaagcaaauuaacauaucuaucaucucauuauaguggcccuguggugcccugagcccuccccagaaaccagccauaaucuacucauuuagcaaaaaucaugaauauaauuuacgauuauuuaacuauaauauguuccucauguuguacaguccaucuuuaggauuggcuauccuuaaucuuauggaaucuuugguucuugaaugaaugaauggauguguacaaaauaaaaauaauuuuaaaauaauagaaucuuuuggggugugugaagaaguaucaugguguauauuuuuuguucuuuuaggagaauaugaagaagcgcuuaagguaaugauuauuuaaucucauuuuuaaauaauuuaaaaaauauuauuauggguugguuuuuuuucuuuuuuugagaugagguugugcucugucauccaggcuggugugcaguggcacaaucugggguugcugcagucuucaccucccaggcuuaagugauccucccaccucagccucccgaguagcuggaacuacagaaacacgucaccacgcccggcuaacuuuuuauauuuuucuuagagacaggguuucaccauguuucccaggcuggucuggaacucuugggcucaagcaaucugcuggccuuggccucccaagugcugggauuauaggcaugagccacugcgucuggccuaaaauauuuauugacugaaacucaaaccugaauuccauuaguuauggggagagacuaguacguauaaacacagugaaaccuguuuauagggagacugaugaaugggcacgacacucagcaaaaggcaauucauaauaaaaagguccuucucaguuacagucccaucucuuugcuggucuuugugcuacuguucuaguguuuaaaaauacaaauaacuggccaggcgugguggcucacgccuguaaucccagcacuuugggaggccgagguggguggaucacgaggucaggagaucaagaccauccuggcuaacguggugaaacccugucucuacuaaaaauacaaaacagccgggcgugggcgggugccuguagucccagcuacuugggaggcugaggcaggagaauggcgugaaccccggaggcggagcuugcagugagccgagaucgugccacugcacuccagccugggcgacagugagacucugucucaaaacaaaaaaaacaaacaaaccaaaaaacaaauaucuuggccgggugcaguggcucaugccuguaaucccagcacuuugggagacugaggcaggcggaucacccaaggucagcaguucaagaccagccugaccaugauggugaaaccucaucucuacuaaauacaaaaaauuagccaggugugguggugcaugccuauaaucccagcuacuugggaggccaaggcaggagaaucauuugaaccugggaggcagagguuacagugagcugagaucacgccauugcacuccagccugggcaacaagagggaaacuccaucucaaagacaaaaaaaacccaaaaaacucuugaugccccccuuuuuuuuuuccuaaagaggcugggucuugcuauguuacccaggccagccuugaacugcugggcucaagugauccugcugccucagccucccgaguagcugggacuaugggugugcaccaccaugccuguucuagaacuauguuuacugguucacauuuuucaccucuuucccucacucuguucucuccuuuuuuuuuuuuuuuuuuuuuuuugagacagagucucacucugucgcucaggcuggagugcgguggcgcaaucuuggcucacugcaaccuccaccucugggguucaagugagucucaugccucaguuucccaaguagcugggauuacaggugugcgccaccacacccagcuaauuuauuuuguaguuuuuaguagagacaggguuucgccuuguuggccaggcuggucucaaacuccuuacccaagugauucgccugccuuggccugccaaggugcugggauuacaggcaugagccacugugcacagccuaugucacucuguucucuauagcccauacaauguuauguuuaaggcagagaugacagccacuuuuuggacauggaaugcuuuuuuuuuuguuuuuaguuucuaauuuuuaaaaauuuguauguuuaaauauaaaaauguguauaaaaugugauguuuugaaauauguauacauugugaaaugauuaccacaaucaaguuaauuaacacauccaucaccucagauguaguuacccauugaaugcuuuuuuucuuuuuuuuuugcgacggagucucgcccuguugcucaugcuggaguacaguggugcgaucuuggcuaccagcagccuacaccucccagguucaagugauguuccugcuucagccuuccuaauagcugggauuacagguguaugccaccaugcccagcuaauuuuuguauuuuuaguagagacggcguuucaccauguuggccaggcucaucucgaacuccugaccuccggugauccucuugccuuggccucccaaagugcugggauuacaggcgugagccacugcgccuggcgucuuuuuuuuuuugagacaggguuuuaccauguugcccaggcuagucuugaacuucuaggcuuaagcaacccauccaccucagccucccaaagugcuaggauuagaggugugagccaucacgcccggccucuuuuuuucuuugacgugugugucauuccuuuuguuguuguuuuuugagauggagucuugcucuguugccaggcuggagugcaguggcgcgaccuuggcucacuguaaccuccaccucccggguucaagcaguucuccugccucagccucccgaguagcugggacuacgggcaugcgccaccacacccagcuaauuuuuguauuuuuaguagagaugggguuucaccauguuguccaggguggucucaaucucuugaccucaugauccaccugccuuagccucccaaagugcugggauuacaggcaugagccacugcgcccagcgacacgugugucauucugucauagaggcuggagcacaguggugcaauuauggcuuacugcccccucaacgucccaggcucaagcaguucucccacuucagccuccugaguaguugggaccacaggugugcaucaccacacuuggcugguuuuguuuguuuguuuuugagucuugcucugucacccagacuggagugcagugguacaaucucagcucacugcagccuccgccuccuggauucaagcaauucucauaccucagccacacuaauagcugggauuacaggcaugugccaccacacccaacuguuuuuuguauuuuuaguagaaauagggcuucgcuauguuggccaggcuagucuuaaucuccuagccucaagugaucugccugccucagccucccaaagugcugguauaacaggugugagccacuguacccagcuaccacaccuggcuaguuauuuuuauuuuuaaaaaguuuuuuuucacugacagcacuuguuaaaaaaaaucacuucgauauauuuuuuugagacgggaucucacugucacccaggcuggagugcagugguaugaucacagcucacauagcuggagugcaguggugugauugcagccuugacuuccugggcucaaguggucuuccuaccucaggcuccuguguagcugggacuacaggaaaauaccaccaugcuccgaugauuuuuaaacuuuuuuuuuuuuuuuaauagagacagggccuugcuguguugcccagguuugucuugaacuccugggcccaaguuaucugccucagccucccaaagugcucggauuacaggcaugacccaccucucaucgccccaaaauacuauucuuuuuuuuuuugagacagagucucacuuuguugcccaagcuagagugcaguggcgccaucucagcucauugcaaccuccgccuccuggauucaagcaauucuccugucucagccuccugaguagcugggauuacaggugcaugccaccaugcccagcuaauuuuugcauuuuuaguagagaugggguuucaccauguuggacaggcuggucucgaacuccugaccucaggugaucugcucagcucagacucccaaaaugcugggauuacaggcaugagccaccgcgccuggccccaaaauacuauuuuuauuggaaaaguaaaugcuuaauuauaggacauaucuuuaaguuucuugaguuuuguuagucuagaauuaaccuuuuuggaaaccugaguuaagauuccauagagagagucuuguauaaaaaccaauuagacuaggcgcaguggcucacaccuguaaucccagcacuuugggaggcugaggcggcagaucacgaggucaagagauugagaccaucuuggcuaacauagugaaaccccaucucuacuaaaaauacaaaaauuagcugggugugguggcgugcgccuauagucccagcuacucgggaggcugaggcaggagaaucgcuugaacccgggagguggaguuugcagugagccgagauugcaucacugcacucuagccuggugacagagcgagacuccaccucaaaaaaaagaaaaaaaaaaaaacagaaaaauaguaacccaguuaaggagaaucuuaccuaauuugccaucuuaaaaccuacuuuuauggguuuuuuuguuuguuuuuguggaauaaagcaacacaauacuuuugugguuuuaauaacaaaaccaaguucaugaccggccuggguaauguaugacaaaaaauuuuuuaaauuagccaacaggcauagugacccaaaccuaugauacuagcacuuuggaaagccaaggugggcggagcccgggaguucgagacuagccugggcaacaucaugaaauuucaccucuacaaaaauacaaaaguuagccagguaugguggugcgcaccuguagucccaguuacucaggaggcugaggugggaggauaguugaacucagguguccaagaccagucugggcaacacagugagacuccugucuccaaacuaaaacaaaaaccuuagccaggugugguggcaugcgccuguaaucccagcuacccgggaggcugaggugggaagaucgcuugagcccaagagacaggcugcagugagccaugcacugcauuccaacaugggugacagagcaaauugccaucucaaaaaaauaaaaauaaauuucuaggcugggcacgguggcucaugccuguaaucucagcacuuugggagggcgagguggguggaucaccugaggucgggaguucgagaccagccuagccaacauagugaaaccccaucucuacuacaaauacaaaaauuagcuggguguggugguuggcaccuguauguaauaccagcuacuugggaggcuuaggcaggagaaucguuugaacccaggaggcggagguugcagugagccaagaccgugccauugcacuccagccugggcaacaagagcaaaacuccgucucaaaaauaaauaaauaaauaaauaaauaaauaaauaaauaaauaaauaaauuucuaguuaacauucuuaccaaagaaauagcaaguugaguguaaacauuacauuuguuguuggauuuaauaaagcaaacacaaauccuaguauuuucuagcauaacuuaccacacucuucuguuuugaugucuuugaaauguuauuuaggagaagauaaucacgucgcauguuuuuguuucauaauguaugcucuuagauggcaguuaaacagggaaaccaacugcagaugcaaguccacgaagggcaccaugucguugaugaagccccacccccaguuguaggagcaaaacgacuagcugccagggcagggaagaagccacuugcacauuacucuucacuggugagagucuugggaucagacaugaagaccccagaggauccugcagugcagguaugaaggguauggcccagucuauccaauaucguuucuuuuuucuuuuuuaaauaaagcugaacagguuucuuuauuuuauuuuuuuauuauacuuuaaguucugagauacaugugcagaaugugcagguuuguuauauagguauacaugagccauggugguuugcugcacccaucaaccuaucaucuaccuuagguauuucuccuaaugcuaucccuccccuaucaccccacccccugacaggcccccgugugugauguaccccucccuguguccauguguucucauuguucaacucccacauaucagugagaacaugcuguguuugguuuucuguuccugaguuaguuugcuaagaaugaugguuuccagcuucauccaugucccugcaaaagacaugaacucauccuuuuuuauggcugcguauuauuccaugguguacaugugccacauuuucuuuauccagucuaucauugauaggcauuuggguugguuccaagucuuugcuauugugaauagugcugcaauaaacauacguuugcaugugucuuuauagcagaaugauuuauaacccuuuggguauauacccgguaaugggaucgcugggucaaaugguauuucugguucuagaucccugaggaaucgccacacugucuucaacaaugguugaacuaauuuacacucccaccaacaguguaaaagcauucuauuucuccacauccucuccaacaucuauuauuucuuuuuuuuugaaacggagucucacucuguugcccaggcuguggagugcaguggcgcgaucucggcuuauugcaagcucugccucccggguuaacaccauucuccugccucagucuccugaguagcuaggacuauaggcaccugccacuacgcccagcuaauuuuuuuuauuuuuaguagagacaggguuucaccguguuagccaggauggucucgaucuccugaccucaugguccgcccgccuuggccucccaaagugcugggauuacaggcgugagccaccgcgcccggccuccaacaucuauuauuuccugacuuuuuuuuuuuuuuuuuuuuuuuugagacagagucuugcaccuucgcccuggcuggaguacaguggcgugaucuuggcucacugcaaccucugccucccagguucacgugauucuccugccucagccucccgaguagcugggauuacaggcacacaccaccacaccuggcuaauuuuuuguauuuuuagcagugacaggguuucaguauguuggugagacuggucuggaacuccugaccuugugauccgcccaccucggccucccaaagugcugggaguacaggugugagccaccaugcccagcccuguuuccugacuuuuuaaugauugccauucuaacuggugugagaugguaucucauugcgguuuugauuugcauuucucuuuuuuuuuuuuuuuuuuuuuugagauggagucucacucugucgcccaggcuggagugcaguggugcaauccgggcucacugcaagcucugucucccggguucacgccauucuccugccucagccucucgaguagcugggauuacaggcgcccacuaccacgccuagcuauuuuuuuguauuuuuaguagagaugggguuucaacauguuagccagaauggucuugaucuccugaccucgugguccacccgccucagccucccaaagugcugggauuacaggcgugagccacugcgcccggccugauuugcauuucucuaaugaccagugaugaugagcuuuuuuucauagguuuguuggccgaauaaaugucuucuuuugagaauugucuguucauauccuuuacccacuuuuugaugggguuguuuuuuucuuguaaauuuguuuaaguuccuuauagauucuggauauuagcccuuugucagauggauggauugcaaaaguuuucucucauuguguagguugcccguucacucugaugauaguuucuuuugcugugcagaagcucuuuaguuuaauuagaucccauugucaauuuuggcuuuuguugccacugcuuuugguguuuuagucaugaagucuuugccccugccuauguccuaaaugguauugccuagguuuucuucuaggguuuuuaugguuuuagaucuuauguuuaagucuuuaauccaccuugaguuaauuuuuguauaagguguaaggaagggguccaguuucaguuuucuacauauggcuagccaguuuucccagcaccguuuauuaaauagggaauccuuuccccauugccuguuucagucuauccaauuucuagauuuauuucucauugucuuuguuguaagauuugcacauuuaucagagauuugggaauuagugugcuccucucucugacuuuugaaacugguaauaguuuacuucuguagaaggggagcaggcuagagacuuuguuuuccuuuaguacgccuucauacugugacuuuuuaaaaaauuauauacuuguaugauuucacaaaagaaaccucaaaauaauacacuccaggaaaaguauuuuaaauagaaaaaguaaccucuaacaucucggcuuguguuuucucccagucguuuccacuuguuccaugugacacagaccagccucaagacaagcccccagacugguucacaagcuaccuggagacggugaguguucugucucgcuuggguuuuaacugcgguguuggcacagguggaauguggaagaaauagaaaacugaacccagguggcugcugccucuaguaccggugaagagugguagcuuauaauuuccaaacuuagaacaguuccagucgagaaagcucuaaccuuugcagugaagugucagaaaaagagggagucuaauucuaagcauguaagggagagggacaacucucugcuugagaaaaaguuagaaauuuacuuaucaaaaggauguuuugauauuuucuucgaaccaguuuagcuguggaaggaauagaccuuuugcuauguuucugucuauucaguagcaguuguuuauuguguuuuuguauuauaccagagacaguuagguuucagaucuauugauaucuucacauuuuuuucugauauuggaacugaguuuuuucccuaccuucugcuccauauucuaguucagagaacaagugguuaacgaaacgguugagaagcuugaacagaaauuacaugaaaagcuuguccuccagaacccauccuuggguucuugucccucagaagucucaaugccuacuucagaagaaacauuguuuuugccagaaaaccaguucagcuggcauauugcuugcaacaacugccaaagaaggauuguugguguccgcuaccaguguagguaagcaguugcuugggaguagcuagcuagugauagaccuuacagcuuuuaccucccuggcuuucuguguagguaaagggaaauuaauuguacccuguuucugagcauuagauguuguagcugugaguuggaagcacaagcuacucuucacccacaugcuuuguauguuguaacuauucagauuguuguguucaaaugugcauuuggauuagcaaagccaggcaaaauuauguuccccugaacggacaaaauuagaucacuaaggguaguuccucgguuguuccaaaugccuuuuuuuuuuuuuuuuuggugacagggucucugucacccaggcuggagugcagggugcaaucaugguucacugcagccucacccucccaggcucagacaauccucccacuucagccugccaaguagcugggaucacagacugccuuuuaauuauuuuuuuggagauggggucucccuauauugcccaggcuagucucaaacuacuggacucaaaugauccucuucuccauggccucccaaagugcugggauuacagacaugagccacugugccuggccccauguacuuucacaucuuaccuuccucccauagauuuucauuuaaaauggauauggguuaaguguuauuauccucauuuuauuaaugaggaaaauugaggcauggcauagucagauggcaugcucagguuaccugcuaguugguacuggagcaaacauagaaguauggucuuauaucucccuaccccagguacuuccuauucugccauuguguauugugccauucuuuccccacagccuaugcccauccuacaauaucugugaagauugugaagcagggccauauggccaugacacuaaccacguccugcugaaguugcggagaccuguugugggcuccucugaaccguucugucacucaaaguacucuacuccucgucuuccugcugcucuggaacaagucagguaaaacccucuacauggagaugcuuauucucugauugacuucuugguucuggugacaggguaugaaucacaaaacuacagauagucuccuuaguucugcucauuuucaauugaugugcaauaaugaagacaguuauccaaaguuagugaaauagaaauaauagcuauaaaaagaaauuaagaaacuaaaguaggcugggcacaauggcccauaacuguuaucucagcaacuugaggggcuaaggugggaggagugcuugaagccaaauauuugagaccagccugggcaacauagcaagaucccgccucuacaaaaaaaauuuaaaaauuagccaggcgugguggugcguaccuauaguuucagcuacuugggagucugaggugagcagauugcuugagcccaggaauaugagguggaagggagccaugauuagaccacuguacuccagccuacaugacagagugagacccuaauucuaaaacaaaaaaagaaauuaaacuggaagcugacacugauggaaauugcaauuggcuccacauagcuucagaauuuauuugugacuuucuuuuaagacuugcuuuuauuaucucacaggcuccagaaacagguugauaagaacuuucuuaaagcagaaaagcaaagguugcgagcugagaagaaacaacguaaagcagaggucaaggaacuuaaaaagcagcuuaaacuccauaggaaaauucaccuguggaauucaauccauggacuccagagccccaagucuccuuuaggccgaccugagagcuugcuccagucuaauacccugauguaagcccaggacuggggugggagccaaaacuuuaggcccagcucucugaaacuggaacuucaaccaauuuccgucuuauuuauugguagcccuuaacaccuaaaucuuuaaaacuuuccauuaucuggucuuaguauuuuuuguuuguuuguuuuuugagacagagucuugcucugucacccaggcgguagugcaguggugcgaucucggcucacugccagcucugcuuucggguucacgccauucuccugccucagccuccugaguagcugggacuacaagcacccgccaccacgccuggcuaauuuuuuguauuuuuaguagagaugggguuucaccguguuagccaggauggucucgaucucuugaccucgugauccgcccgccuuggacucccaaaguguugggauuacaggcaugagccacacagcacccggcuuuuuuuuuuuuuuuuuugagauggagucucgcucugucgcccaggcuggagugcaguggcaugaucuaggcucacugcaaccucugccucccggguucaagugauucuccugccucagccuccugaguagcuaggauuacaggugcaugccaccaugcccggcuaauuuuuguauuuuuucaguagagaugggguuucauccuguuggucaggcuggucucgaacuccugaccucaugaauccgcccgccuuggccucccaaaauggugagauaacaggugugagccacugcgccugccuggcguggucuuaguauuauuaaagggugguuugguaguuuuuuguuuguuuuguuuuugagacggagucuuggagucucgccuguugcccaggcuggagugcaguggcgcgaucucggcucacugcaagcuccaccuccuggguucacgccauucuccugccucagccucccgaguaacugggacuacaggugcccgccaccacacccagcuaauuuuuuguauuuuuuaguagaaacaggguuucaccguguuagccaggauggucucgaucuccugaccucgugaucuaucugccuuggccucccaaagugcugggaugacaggcgugagccaccgcgccuggccaaguuucguaguuauuuuugacacuuguuuuguuuccuucuucagaaagauagaaaccacuaaaguucaaaauggcggggucccucucuucauuggaggcaaucuggaauugaagcaaaaggaacaaauguguuaaaagccugacucucuagguguuguauuuauaggcccuuuuaauuacucuuaccaugacuuuuuuagcucaggagugagaccuauccucuguuuuguuuuauuguuuuaaguuugucagaaaauuuauuguuucuaauaugugguccuauacuaguaauaucaguauuauuuuuaaggcaaauggguuagcacauuuucaagagucacagucagacucucaagcuagugugagguauucagaagccuucacacccaacagcaagugacuaagcaucugaauuucuguucaggcucccuuugcagcccuguaccuccguuaugccaaugcucagugcagcauuuguggaugagaauuugccugaugggacucaccuucagccaggaaccaaguuuaucaaacacuggaggaugaaaaauacaggaaauguaaaguggagugcagacacaaagguaauuuuucccacaaaaugcaaagaugaggugauuugaaguggcagagugcucagcugacaagcuugcuuucucuucuuacuguucuuuucagcucaaguucauguggggaaaccugacuuuggcuuccacagaaaagaaggauguuuugguucccugccucaaggccggccaugugggaguuguaucuguggaguucauugccccagccuuggagggaacguauacuucccauuggcgucuuucucacaaaggccagcaauuugggccucgggucuggugcaguaucauaguagauccuuuccccuccgaagagagcccugauaacauugaaaagggcaugaucagcucaagcaaaacugaugaucucaccugccagcaagaggugagcauugacugacaggcuuuggccuaguauccaaaucuuaguuagagaggagauggcuaaaacuaaaagaacccacucauagcugguuguuuuccagaaaccuugaaagguuagcaucuccccccgccccaacacaucucuaugcugauauuuggccucuuccuuaggguguuuguuuuagcgucuuuagggucuugcugcauacugaauacuuuuguaccucuuugugauguugcauggucagccuguuggcugcacaagggaaaaagggacuccuggccugggcuggccuguggaacugcugaacugauagcuuuacuccuuaacauccaucucuccugaaauacccuguguauguucccuaaauacuaaugaagucuugcccugguugcuacuuagugaacaguuuuuuaaugcaauuucucuguauuaguggggcagaguguuuacugcuuaaaguuauccaauguuaauuuucugguuuugacuauuauaguuaauauaaguuaucgucauuaggggaagcuggggaaugugaauucucucugcuguuuuuacaacuuuuucuauaacuguaaaaauauaucaaaaacauuguuuuuuaaaauauggagguacagcagcguuuuuauuuuugggggcauugucagccugccucuucaguucuguugaaggccuaaaauuugucucaaugguuugucucuauaggaaacuuuucuucuggcuaaagaagaaagacagcuuggugaagugacugagcagacagaagggacagcagccugcaucccacagaaggcaaaaaauguugccagugagagggagcucuacaucccaucuguggaucuucugacugcccagguggaagauucagcacuuugaagggcaagggacagagggagagagcacaggagagaaggugguagagccauaggcaguaaucaggaaaucagagauaugcccacuuugaucuagucagguauauuuaaugggaaggagaucacccauggaagcaaguuuguaaacuagauguuuccucuuugaauugggaacucaauccuguacuuccccacaaacucccuuuaguugccucuucaccuuggccuagcuaauucuccuucauaccugcugcauuuucucuuuccugcuauuggguuauuucaacaucuaauucccauuuaacucuucuuguuuucacuugucuggggacaggcaugaauuugaacagaguugaauacgaaaugauguggaaauggucuacaggucccaucaagacauggcuccagcaugcacuccaaacagccuaacauugucuuuuuuuauaggaccugcuguccuuugagcuguuggauauaaacauuguucaagaguuggagagagugccccacaacaccccuguggguaagaaugucacucauuucaucuuguucgucuuacuaauaggcacaaaaguaccacagccuagacacugguaguguuuuauucugaggaaauggcaaggauuucucccacaguaggauaguaaagcagcaaucauggauccguuuuucuucuuuccuguccuuugucaaaaguaacaacaugcugggcaugguggcucgugucuauaaucccagcucuuugggaggccaaggcaggaggaucacuugaggccaggguuugagaccagccugggcaacauggugaaacccccaucucuacaaaaauuacuuuuaaaaauuagcuggguguggccaggcacgguggcucacgccuguaaucccagcacuuugggaggcugagacgggcagaucaccugaggucgggaguuugagaccagccugaccaacauggagaaaccccuucucuacuaaaaauacaaaauuagcugggcaugguggcacaugccuguaauccgaacuacucgggaggcugaggcgggagaauugcuugaacccagaaggcggagguuguggugagcugagauugcaccauugcacuccagccaggacaacaagagcaaaacuccgucucaaaaaaaaaaaaaaaaaaaauuagcuuggcaugguggccugcaccuguggucccagcuaccagggagacugaagugggagaaucuccugaucccaggaggcagaggcugcagugagccaggauugugccauugcucuccagccuggaugacagagugaaacccaaucucaaaaaacaaacaaaaaaaagaggcugggcacgguagcucacgccuguaaucccagcacuuugggaggccaaggcugguggaucacaaggucagaaguucaagaccagccuggccaagauggugaaaccccaucucuacuaaaaauacaaaaauuagccaggcaugguggcaggugccuguaaucccagcuacucgggaggcugaggcagagaguugcuugaaccugggaggcggagguugcagugagccgagauugugccacugcauucuagccugggugacagagcaagacugcaucucaaaaaaaaaaaaaaaagcaauaaaacaaguucgugcaaggcuuuuccacuauaaaggaauccucuucucuuuuuucccucuagauacuuguguccuuuuguuccuuuauguucaugguuuugugucuuggccacagcuuuccaggcuaaauaacugugauucuuccugcauugauugaucugagauauuuugcuuacuuauuggucuggagaaauuuuuuguaacagaccucaaagcauaucuugguuuauuuuagcccugcgggaggcaagaagccuacaaacugcuacuucuggacacugacuguugaugauaugaugcuuucucuugauugaugguucuccugucuucauucuccagaugugacucccugcaugucuccucugccacaugacaguccuuuaauagagaagccaggcuuggggcagauagaggaagagaaugaaggggcaggauuuaaagcacuuccugguaagggauuaaacauuuguaaaguauuugcauccucccuuuccauaucauacccuauuuuacagcuauccccuacugacccuaccuuagcauguaaaugggcuugcuuucuguagcaucucauguuuugaagucuccucaccuucacauggcacagauagcagcuauuccuugguuuaguuuuagcauggguaaugacuggugaauguucuucagcacuuuaaacaccaagugcagacaaaguuuagauagcagcuauuccuugguuuaguuuuagcauggguaaugacuggugaauguuccucagcacuuuaaacacccagugcagauaagguucgugugucuuucagauucuauggugucaguaaagaggaaggcugagaacauugcuucuguggaggaagcagaagaagaccugagugggacccaguuugugugugagacaguaauccgaucccuuaccuuggaugcugccccagaccacaacccuccuugcagacagaaguccuugcagagugaguguccuugcauuuccccuaccuagcaggguggcaccugaauugugacugccagacuugacuaguuagaugugcucuucuucacugagacugaagggagagugaucuuaguuagaaguucugaucuuggcggggcgugguggcucaagccuguaaucccagcacuuugggaggccaaggcaggcggaucacaaggucaggagaucaaguccauccuggcuaacauggugaaaucccaucucuacuaaaaauacaaaaaauuagccuggcgacguggcgggugccuguagucccagcuacucgggaggcugaggcaggagaauggcaugaacccgggaggcggagcuugcagugagccaagauugcgccacugcacucuagccugggcgacaaagcgagacuccaucucaaaaaaaaaaaaagaaauucugaucuuguuugugucuuuagacucuacguaugcuaccugacuguucuaauuagagcaucaggaguaaagaagccaucauacucauuucuccaucuucucaggggcagaauuacagcugcauuccacaguggaauagcagccaguugugcugccuggauucugcaguaaggaaucuuccuguaauuugacagagcuccuuagcagagaccccuauggguagcugaguugucugcuuucuccaagggcagcagucccagaaacaguggauagaagcaggaguaccaacaaaguuucucaagguuaaauucugcuguaauaaauaccuuuauaggccgggcacaguggcucacccuuguaauccuagcacuuuaugaggcugaggcggguggaucaccugagguugggaguucgagaccagccugaccgacauggagaaaccccaucucuacuaaaaauacuaaaaauuagccaggugugguggcuacaugccaaggauuacaugccuguaaucccagguacuugggaggcugaggcaggagaaucacuuuaacccgggaggcgaaggcugugguuagccgagauggcgccauugcacuccagccuggcaacaagagugaaacuccgucucaaaaaaaaaaaaaggaauaaauaccuuuauaacagaaacuucuagguaucagauagauagaaccaauagcauauauuuuaagaaguauccaaaaauucaaauauacuaugucaaaauaauauuggagaaucucuuuauuauaaucaaauuugaccuauaucuuuaaauauuauuuaucuuacuuuuguuuaaaguauacauguaaggccaggcgcaguggcucacgccuguaaucccagcacuuugugaggccgaggcggacagaucacaagcucaggaguuugagaccagccugaccaacauggagaaaccccauuucuacuaaaaauacaaaaauuagcugggcgugguagcgugugccugugauccagcuacucaagacgcugaggcaggagaacugcuugaacccgggaagccaagguugcagugagcugagaucgcaccacugcacuccagccugggugacagagcgagacuccgucuaaaaaaaaaaaauaauaaaguguacauguggccaggugcgguggcucauaccuguaaucccagcacguugggaggccgaggugggcggaucaugaggucaggagaugaagacuauccuggcuaacacggugaaaccccaucucuacuaaaaauacaaaaaauaagcugggugugguggcgggcgcaccuguaaucccagcuacucgggaggcugaggcaggagaauggcgugaaccugggaggugcagcuugcagugagcugagaucaugcuacugcacuucagccugggcaacagagugagacuccaucucaaaucaaucagucauguauaucuuuauauuuuuuuccacauguguguacaaauacauaacaaaaaggucuggaaagacaguaccaaaauguucacagcuguuauucugauaggauuuauggguaauuuuuuuuuuuuuuuugagauaaggucucacucgcccaggcuaaagugcgaguagcaaguuuauggcucauugcagccacaacauccuggggucccccuaccucuguuucccaagcaacugggaccacagccacaugcuaccacaaugagcuaaauuuuuuuuuuuuuguagagaugggauuucgccacguugcccaggcuggucccaaacuucugagcucaagcagucugccugccuuggccucccaacgugcugggauuuuaggcguaagccaccacaccuggccuggguagcuuuuuuuuuuuuugggacacagucucugucacccaggcuggagugcagcagcgcggucucggcugacugcaaccuccgccuucccagguucacaccauucuccugccucagccucccgaguagcuggcacuacaggcgcccgccaccaugcccggguaauuuuuuuguauuuuuaguagagaugggguuucaccguguuagccaggauggccuugauauccugaccucaugaucugcccacguuggccucccaaagugcugggauuacaagcgugagccaccgugccuggcccuggguagcuuuuuucuauccuuuuuuacccucucaaacaugauuggccaguuuucucccaugacugcaucaucuuuguaaagaagaggaggagauagacauauaauccugcaauacucaucuccuaacuuuuucucuuuuuauagcacuguuaguguaucaguuuugguuuaaacucuacucaguauauuaaccaucacauaaaaaggaaaaaagggauggagcugccuccuuuuaugauucauagagcuucuuggaaaccugaguguuucugccuaccuuguuucugugagcuuugauucuauuuuguuuugcauagucuucaaacuuagaauauggucauaguuccagaaccagcccuucccuuuaguucuucccucuccucuggcuuucauaauucuagcuuaugauccacaaggcuuuaccaaguaaggauaguacuuaggccugcuuuuagcuuccaccuuaaaauugguugcuuucauccuuuagugacauuugccuugccugaaggaccacuuggaaaugagaaggaggagauuauccauaucgcugaggaagaagcugucauggaggaggaggaggaugaggaggaugaggaggaggaggaugagcucaaagaugaaguucaaagucaguccucugcuuccucagaggauuacaucaucauccugccugagugcuuugauaccagccgcccccugggggauucuauguacagcucugcgcucucacagccaggccuggagcgaggugcugaaggcaagccugggguugaggcugggcaggaaccagcugaggcuggggaaagacucccuggaggggagaaccagccacaggagcacagcauaagugacauccucacgaccucacagacucuggaaacagugccccuaaucccagagguaguggagcuuccaccgucacugcccagguaccacucacagcccccucagcugggguguucuucagaggugaaauaaagagaggaaucgaccugaucucaaaaccuguuuuuuccucaguauggaaagagacuauuuuccauagcaaagucugaauuuagaugaauaaaaguuguauuucccaguauuuguggauucuggauuuaaagaaauauuuguuuuaguuggccuuaaauuaucugaguauagucugucugcuuauauuuugauuauugagagcugguuguguuuuuuuuuuuuuuuuuuugagacagggucucagucuguugcccaggcuggagugcaguggcacaaucuuggcucacugccaccucugccucugaggcucaagcaaucuucccaccucagcccccugaguagcugggacuauaggcaugggccaccacaccuagcuaauuuuuguauuuauuguagaagcgggguuuugccacguuguccaggcuggucuugaacugcuggccuuaagcgauccaacugccugggucucccaaaaugcuggaauuacaggugugagccacuaugccuggcugagagccaguuuuuaaacacaaacaucccuggaccuucccuccuuguuuuauugacucuucaguaaaggcagcaaaaacucaacccaaacagucauaauuaggaaguuaaauccauuaugggaaaaaacacuauaaaaccaaacuaauuauuuuuaauucucuggugaaucuaucugaaucauucuugucuccuaauaguagggaaaaugcuggagccuugacuauaauguaaaccauucuccccaaaagcuagacauuuccguuuauugacaccacuugauguagguggggacaugaccagacugaagccaacauuucuagcuugccuguggcuaaagaggaaaaugggguagaauguagcccuuaugauggaacccuaaauccagacaugugaucuggaucagaaaugugaagccucuguagagaauuuggcacugcugugcuguguuuacuauuucuccacuguugccauaagugccuuuucaauuuacuuuccauauugugucuuucugaaaggagcucuccuuguguacaucaucaugguuccccaggaguggauuuaccaguuaccauaccagaaguuucuucagucccugaucagaucagaggagguaaugaucagccuaagcuuuuucucuuuuucucugcuccugucuaauggaaaccagguauaaauagccucucucucuucgugauucuuggugguuuuuugaaacuugcccuucacaggccaggcgugguggcucacaccuguaaucccaacacuuugggaggccaaggcaggcggaucauagggucaggaguucgagaccagccuggccaacauagugaaacccugucucuacuaaaaaauagcaaaaauuaaccaggcaugguggcgggcaccuguaaucccagcuacuugggaggcugaggcaggagaaucacaugaaccugggaggcggagguuggagugagccgagaucgcaccauugcucuccagcccgggcaacagugcgagacuccgucugaaaaaaaaaaaaaaaaaaacuugcccuucacucucuccaugcuccuccugcauacucuaauuucuauucucuggcugaauauauuguuagaccucauagagguaguggaaagaacacaggcuuuggagccaaacaaucuagguuccagcuccaucucccccuuuccugacuagcaguucagcagguuucuaauggcugugagucuguuuucuuacuacaaaauauaucaguguguuaggauuauagaguugauuuuucugauucaauaaacaaucaucuugcauugcauuucuggacaguuucuccuuaucacuuaaacuacccuuaaaacuucccaaauacuuuaaaaaaaaaaaaaaagacuucaaacacugugaucagauugccaccugccucaauaauagccuugcugugaguuaggaaacaguaggugcuuauggaugcugcaucuaaccaacagcucuuuugcuuuuagagcccagaggcucaucaggacuuguaaacagcagacagaagagcuaugaccacucaagguaacaaccuugugcagucucuuuuuucagaagcagguggauauucuuguauuccuucugcuuaaaagagccucucacaguauguacccaucuucagagagcagagaaggggagccuuuguuccgucuuauucuuguuucuucuaaaggcuuugagcaacacugaacaaacggcuaaagcugauguuuaagaguguucuguuugggaggccgaggcggguggaucaugaggucaggaguucaagaucagccuggccaacauagcgaaaccccaugucuacuaaaaauacaaaaauuagccaggcaugguggcgggcaccuguaaucccagcuacucaggaggcugaggugggagaauugcuugaacccaggaggcggagguugcagugagcugagauugcaccauugcacuccagccuggcugacaagugaaacaacaucaaaaaaaaaaaagaguguuuuauguuucagacaaggaaauaguguccacaaauuaccucacucuuagcacuggggaaaagguagaaagguuaagcccaguauacauuuaaauaauuuuuucuuggacauaccugguucucugcuuccacucauauuaggccaguguccagaaaaucacauuuccuuugcaagguguuuucucugagagaauaauugagcagacaaacuguugauauccuuguguguccucgaucacauuaauuuucagcuaggagugagagccaucaugguuaccagagugguguguuuccugcagugccccuaucuugcuugcaccaguagagcugggcccuccaucaaaccaugaucuguagcuauaaagcugauaaugaaagcaauuguguucucuuuuuccaucuaauuuuuucucuuaaggaaaucuuauuccaaggauuagagcccagauuaucuuguaaaaagguaaugauuuguguuuguuuggggagauaauuugguuuuccucugcaggcaccaucaugggagcagcauugcuggaggacuggugaagggggcuuugucuguugcugccucugcauacaaggcccuguuugcugggccaccagucacugcacaggucaguguguguguuuuauuuuccugaaucucaacuccaugucaccagugaaagugauggcaucugucuggguugaagaguaacauggcauuguggaaagggcauaggcuuuagauuuagucuuuaguuaacacacaacacaacucugccacuuuuuuuuuuuuuuuuugagacgaagucucgcucuguugcccaggcuggggugcaguggcgcgaucucggcucacugcaagcuccaccuccuggguucacaccauucuccugacucagccucccgaguagcugggacuacaggcgccugccacuacacccggcuaauuuuuuguauuuuuuaguagagacgauguuucaccguguuagccaggauggucucaaucucgugacuucaugaucuucccgcuucagccucccaaagugcugggauuacaggugugagccaccgcaccuggccaacucugccacuuucuaacuauaugacuuuagccaaguuacuuaagggaagaaaagagaagaauguauuauugaugaucuauuaauauuuucuauagagagaagcuauuccagguguuggcacuauggcaugaauaaaacaccaguucuuggccggguaugguggcucuuaccuguaauccuaguacuuugggaggccaaggugggaggauugcuugagcccaggaguuugagaccagccugggcaacauagugagacccccaucucuacaaaaaaauuuaaaaauuagauaaguauggccgguacaguggcucacaccuguaaucccagcacuuugggaggccgaggcaggccggaucacaaggucaggagaucgagaccauccuggccaacauggugaaacccugucucuacuaaaaauacaaaaauuagcugggcgugguggcaggcaccuguagucccagcuacucgggaggcugaggcaggagaauugcuugauccagggagucagagcuugcagugagccgagauggcaccacagcacuccagccuggcgacagaacaagacuccaucuuaaaaaaaaaaaaaaaaaaaaguaugauggcaugcaccuacagucccaguuacuugggaaacuaaggugggaggaucacuugagcaccggagguugaggcugccguagugagccacaauggagccacugcacuccagcuugggugacugagcgagacccugucucaaaaaacaacaacaaaaaagacacugagucuugcccagaaacuaugggaaacaagugaggugcauggauacuuaaaguacauaguaagauacuaugcuggccgggugugguggcucaugccuguaaucccagcacuuuggaaggcugaggcgggcggaucaugaggucaggaguucgagaccauccuggccaacaugaugaaaccccgucucuacuaaaaauacaaaaauuagccaggcauggugaugugugccuguaaucccagcuacuugggaggcugaggcaggagaaucacuugaaccugggagguggagguugcagugagcugagauugugcuacugcacuccagccugggcaacagagugagacuccaucucaaaaaaaagaaagauacuaugccagugcuaucagacagaugaaacacuucagccuggugugcccaaguaaggcuuucugguagaugaugccugaacugaguccuaaaggacggaguaaauguucaucaggaaagagggagggaaaggguauuguagacaguguagccaguaaaaaagacuuggaaaugugagcauggagugugaauccggucuaagaagaggaguaagacgaaaaaagacuggcugggcuugguggcucacaccuguaaucccaacagguugggaggccaaggcuggucgauuauuugcguccaggaguucaagaccaguuugggcaacagggcaaaacccugucucuacuaaaaacauaaaaaauuagcugggcauggugguauacgccuguggucccagauacucaagaggccgaggugggaagaucacuucagcccgggaggcagagguugcagugagcugagaucacaccacugaacuccaaugugggugacagagugagaccaugucucaaaaaaaaaaaaaaaaaaaaggcugggugugguggcucacgccuguaaucucaacacuuugggaggcugaggcggguggaucaugaggucaggaguucgagaccagccugacccacauggugaaaccccaucucuacuaaaaauacaaaaauuagcuaggcguggugacgugccuguaaucccagcuacucaggaggccgaggcaggagaaucgcuuuaaccugggaggcggauguugcagugagccgagauugcgccacugcacuucagccugggugacagagcgagacucugucucaaaaaaaaaaaaaaagaaaaagaaaaacagaccaaauauguaggcaggaugcuguguuaugagguuuggauuuuauuuuaaggcuaauuaauaggaggagcaauugaaggguuuuaaggaagugauugacaugaugagaucuguuuuuaguaagauuaccggcuacauuguagaggcugguagagccaguaaagaaauccaguugggcgugguggcucaugccuguaaucccagcacuuugggaggccgaggcgggcagaucacgaggucaggaguucaagaccagccuggccaauauggugaaaccacaucucuacuaaaaauacaaaaauugccgggcgugguggcacgugccuguaguccuagcuacucgggagucugaggcagaagaauugcuugaaccugggaagcagagguugcagugagcugaaaucaugccacugcacuccagccugggugacagagcgagacuccgucucaaaaaaaaaaaaaggaaaucccuaagagaauccauguauugguggaaaggaaggguagaaaagauaauuaagagauggaaauggcauaacuuugagaugaugauuaaguggcuaaaaagaaggauaggcugggcacgguggcucacaucuguaauuucagcacuuugggaggccaaggugggcagaucacuugaguucaggaguuugagaccagccugggcaacauagugaaaccuuaucucuacaaaaaauacaaagaaauuagccggacuugguggcgcacaccuguagucccagcuacuuggggggcuuaggugggagaauagcuugagccccagaggcagaggcugcagugagcugaggucaugccacugcacuccagccugggcaacaaagccagacacuaucuugggguggaggggaaaaagucaaggauaaaucccaaguuucuggcuuaguaccauucauuaagagcagaagaagagaacuaggucaguuuugcuggacaguguugaguuuguggcauauccagguaaagguaaagauauccagagugcagcuggauauauaguugucccucaguaucuaugacgguuggcuccaggacccccugugggauacugaaauccauagaugcuuaagucccuuauauaaaauaguguaguauuuauauauaaccuaggcacaucuucuugcuugcuuguuuaguuuuaguuuuuuagauacagggucuugcucugucauccaggcuggagugcaauaacuagauuguagcucacugcagccuagaacucuuggauucaagcaauccucucaccucagccucuugaguagcagggacuacaggugggcaccaccaugccuagcuaguuuuuuaaaaaucuuuuugaagagaugggguuucacuguguugcccagggcaacuaacuccuggccucaaaacaauccucccacuucagccucccaaauugcugggaugagaaacuugagccgcugcacccagcccaucucauauacuucaucucuacauuacuuacaauacccaauacaauguaaaugcuaucugaauaguuguuauacgguauucgggaauaaugacaaaaaaguuuguacguguuccuuuuuuucuccccaaauauuuucaguccuuuggugacugauccauagaugaggaacccacagauaauggcaagccaacgguauccauccagaucacaggggagggauuuggccuggugauacaugcuugagagucacuugccuacagauuauagcagaagccaucugauggaaugagaugauccaggaauaauggggaaagcaagaagcaaccuuuaaggaucagggaaaggaauacucugaaagaaagcugggaacuaggaggaaaaugaagagagagaguucuaugcuggaacuuaaggaaggguguuuuaauaagggggacauggucaacgguguuagaugcuacagagagauaugaacugguggugaggaauuugagaguagaaguaugccacacuuucaaauagacaggcuacaacaggcagaagcuaggauacauaagacaagaggaagcauuuuuaaaguugggugagacuuuagagaugggcaagccagcagugaaagagguuaaugauaaagaugagaagacagauuggagauggagaaagauuucugaaguggugagagguaauaagauacaaugcaagguacauuccauuaaccugcaaaggaggauggauaaucuauucugaaauaagaagguagaauggaacaguggaaucagguuuggagggaaaugcuuaacauguuugcauacuguucucaucuuuacauacuuuuucaacaacccugcaaaguaggagguaugauauaucuucaguucauaaaggaauugauagcacaguugguaaguaaauggaagauuaggguuugagucuaagccuaucugccucccaaguuaauaaucuuucugcugcacaguuucaguauccccagucugugaaauugggauaauaacagaaccagaggccaggcgagguggcucacaucuauaaucccagcauuuugggagaccaaaguucaaggaucacuugggcccagaaguucaagaccagccugggcaacauagggaaaccucaucucuaguaaaaaauuuaaaaauuugccgggcgugguagcgcagaccaguggucccagcuauuuggaaggcugaggcaggaggaucacuugagcccaggagguugaggcugcaaugagcuguguucacaccacugcacaccagccuggggaacagagugacacccugucucaaaaaacaaacaaaacaacaacaacaacaaaacaagcguuuaaggauuuaggaagguaaugcuuccaccacagggcuugaaugaaugaauguuaacuuccucuuaccuauucuuguuuuuuuuuuuuugagauggagucucgcucugucacccaggcuggagugcaauggcgcgaucucggcucacugcaagcuccaccuccuggguucacgccguuguccugccucagccucccgaguagcugggacuacaggcgccugccaccacgccuggcuaauuuuuuguauuuuuaguagagaugggguuucacuguguuagccaggauggucucaaucuccugaccucaugauccgcccgccucagccucccaaagugcugggauuacaggugugagccaccgcacccagccccucuuaccuauucuuuuggaggagaaaaaaucaagaagccuucccagguuguaauuucccaagcuguuuuuuuuguccagcuccucugcauaucugacaaaauuucccauagcaucuuucaguaacacuuuuaucuugcucauacuucccccaucaucacaauuacacuuauguucacagggucucuggggcuugcugucauuccuucaucuggccaaaaaaugcuucuuccugaaagccccgagugaagcauucuccugguucuaaguacaguucauuagcuccccgguuucccuuuucuccuccuucaaguacacagauaacuaaucuaaaauagggccuucccaguccgaaccguugguaucaaguacacaggagugccauagccuugaaucuaauuaccuaguacuuugaauaaaucuggaaagacuaguaugcuugcaagaugauacaaauguauaaaauaaacauuuaaauuauacagaauuuuuuuuuuuuuuuuugcuuugcuugucucuacacagccaauaauuucugaagaucagacagcagcccugauggcccaucucuuugaaaugggauucugugacaggcagcugaaccuacggcugcugaagaaacacaauuacaauauccugcagguugugacagaacuucuucaguuaaacaacaacgacugguacagccaacgcuauugaggagugaccuuguauuaaauaacugccugcugcucagagaugaucuuuauucugucauugggguaugggauagaagcccuugcuuauuuuuaaucugaugaaucuguauagagcccaucguugaguuaccaagacaauaccugcuacaguauuuuggggagcaaacuaaagaccagaacuuaaauuuucacuuuagacauuggaugaauaguaugaagacaguuuuucaguugauuuggauaaaacuauuuuagugcauugacaaguguaacuucaacuucauauagaaccauuuuucuuucugcuuuuauugaaacugaguauuuuucuuuggcuaauguggauuuuuuauggggauaucuguuaauuuucagguuuugaaagacauuaaccucggaaguuguuuuuaagaauuauucucauaauucuuauucucauaauuucuguaauccaccucaagcuucauaguuauuuggcauugaaauaacacccagagcaugauagaaauguuguuacucuuccucucucaaggagaaaguaauuuuccugcaauacuuaauaauuggcaccguugcuuucuaaagacuccauggugcauucaagaguauccaacuucaagggaaucuccgcauuucaaugaaaggaggaagagugugcugauaaaccuaccagcaccuauugagcaaugucuauuauaguaauuuugcauacauuuuuauuuaagggaaaaaauauagguauugugaaauauuuugcuaaucuuauagaaaaggaaaaaaucccguuauuuaaagggaaaaguaaauuuaacaguugccuuuuuucuuaaugucagggcagaucuuauuuuacaguacagugggggaaauagaaacaugugaaaggcaaaaggcaggcuccuaaauuaaugucagugaaguucagggugggcaaaugagugugugugagguauaggaaaugcugaugacuucuuuaaugcuugaaguccguucacagguaucuagcccuagaaugccuagaacaggaagaggcagcugguguucugcaaaacuuggacaggggcaaaguugcugaaaaaguuuugguuuaacccgaagauaaguggaaaagagcuuguccaugaacccagguucucacucuguuuacagaaguguguugaguacaguuggugaaggaagagguaacaaaaaaugcuaaauauuuuauccaugaaaaugacuuccagaaaaggaagaauaugaaccccagaccgaaggggaaaagauaguuaauaguauuaucuaaccugguugguauuuguaaugaauggugauuuuaauuagucauuagccauaaugauguuuauuuacaguauaacuccugaaugcuacuuaaauaaaccaggauucaaacugcaagccagcca

SEQ ID NO: 16860 - RNA, 1487 nt, Homo sapiens
uucaccccacagggauagcggcagagccgguagcggacgguccuugcauuggccuccggcaggcgccccccgggggcgggaagcugguaaggaagcagcugcgguuaccuagggguggggucacgucacgcuaagaggguuuggggaaguucaagggaggaauccugcaaagaagaggggcgacuuuuuccguguuucgggacagcuaaucuuuuuagugacaggaugagagagcccuucauguucagagggaccgaguuggcgagaagcgccggagaguuggagagucugugggucagaacauccggcuucuacugauggaaggccacgacuccccaguggaaugagggccuaggcaaagaaaaugagagagcccucgggguagugacacugucuugggaacauggagugcuaggaaacgaaaacuggaagacuaggaugaacucugcaaguaaaaaaaugacacuacuuacacauccuucucaucccauccucguuuuuucgagaccuuaaagagaucuccuugguuagggaccuucgguuuuggaaaggcacuguuuuuccuuuuugucaaacacucagcuuucaggccacacuuuuuugagacagagucuugcuuucucaaagaccaacccaggcugggcuugaacugcugagcucaagcgauccucgugccuuggccucccaaagugcugggauuacagguauaagccaccgcucccggccucaggucacacauuuuaaagccuggauaacuuggcuuguaaaggccucugguggagacaguaaucaaagcucagguugccaggucuguuucauuaaagggauuuuguugaggcugaaaaaaaaaucgacguggaggaaaagcuaacuugugccaagcaaaggugagucaguggcauggacuuacaauaaugccaguuaugaaagcugaaggccuaagacccagcuaucugacucuacuggcuguagaccuaaggggcagauaggguuaaccauagcuuugguguuuacacacguuuaagauuaaugcuccugcugaaagaauuuuuuuacaugucagccaaagagaguuccuuaugaagaccuggauaugguccagccaagcuagaaucucccacuuccuguuuucucuuaguuggcccaccagcuggaggagcuccagaguaucuaaauuuccaauuguguaauuugagaaaaagagaggaagauucauuuccuucacaaguagggaaguguguuucuugaaguuggaaagugauauuucagaauacccacuuuuggcggacugagucacuucauuuccuugauuuuuugccuaagguccuggggaauugacaaagauucucaaauuuuaaggaccccaauaauuacauuucauaugaaugaauacuagaugucagcaggauuguuguuaagagacuaauauuauuuugguggugaacuugguucuugguagaaacaaagaauggagaaaauugggggau

SEQ ID NO: 16861 - RNA, 8241 nt, Homo sapiens
gugggcccuuaggggcuggggcgggacuucccugggcacugagucaaagcuugaggggaguguucgcucccgcauuuucgauuccacucucuuccguuucugucgcugcagucguccgcggguaaggcccucccuagacccuuuauaccuacuuuaccuuucggaggucaagacaccuccuguugccgccuccucgcccaacacacaggcgccccccgcacggguaccaagcuugacuaacggccucuagggguguguggugggacuugaaauccucccuuaaugaagucacaccuucuccguccgcuuccacccggucggcccauggcagagcccccauguagcccaggaaucggcuuggcccuucggggaggucagcguccuuacuguccccacucuccagugcggcacauucguuccccuaggacuccggccgguugccggccccaggcggugcuucuccccaccaccgcccagcucagcucagcccagcccagcccacucugcccuuagaggcccuucuccccaaagacgcacuccagaagucucgcccucgugcggcugaggagccugggaucccagaccugaacaaggugagcaucccuauauuuuagcccagaaagaucuguguggcucacuugccggccucguucugucacacagaguccagauuuagccuugaguuuuccuagugaaagacagacccugguaucacuaugacccuccucaggcuuucuuaccccgccucagaaagcagugaggugucugcuuucucccagggcuucuuuagauaggggucuuaaccacaccugugaccagucuggccuccucucuccuugauucaaagaaucucuuuucugcccuauccaacuuccuucccuuaaacugaaugacagcucagcaacuuuuccagagaaaaauuaaaugcucugacaaucacuuauggaaguuccuuaaagugaaguaacuucugcuuuucuuuuguuuucccuuuuguaggcagauuggucucuuuuaaaauaaugaaaggagucgaaaugcauugagacuucugagagucccaugugaccacccaguuuuucacauccuaucuuccuuaggcuugagcuugcuuaaacuguggugaagcuccuugccagucuugagaacuucaaaccaaaauuacaucuggcgucagugcuaacaagcuuagcacugaacuuuggucuuuucucauuagugaaacccccgccccugaagaauggguaagacguuuucccagcugggcucuuggcgggaggaugagaacaagucaauccuguccuccaaaccagccauuggcagcaaggcugucaacuacuccagcaccgguagcagcaagucuuuuuguuccugugugccuugugaaggaacugcugaugccagcuucgugacuugucccaccugccagggcaguggcaagauuccccaaggugaguggcccaaggcucuggaaauagccuggaauccagggaaaguucuuagccuguuggccuggggcagccccucugagucuccuuggaugggguuagaucugcucccagcucuugaccucccagucucaggcuggccagggagauacuuaacuauccuuggguucccugcaaaaaccugcccuccuucccugguuguauucuccagccccuugugggaaagaaggauucuagccacugugcuucugagcaacacuguguguccuaggauucauucaguucaggaaguuacaaaugaacuuuccaaagaugcugggcaucucugauuugcuggugacuuucagagauucuucauaccuauuaguggaaaucucacuuccauucuagagauggcaaagcugagcugccaacuuugguagcagaguccagugcuuccaguccugcucuggggcagauguggcauguuucuaacauugcucuaugguguggguggaggcgugcuucugggaagcuggcacaguaaauauuugucacaguugcaucuuggcccucccucucaccuucucucucucuagagcuggagaagcaguugguggcucucauucccuauggggaccagaggcugaagcccaagcacacguaagccccccuuccuccccuagcuucacaagccauugccccugggggcugcucccuuugucuccccuguuuugaucucccuuaauuucuuccuauuaguucuuccauagaaagccugagccucagagguaccagcuccuuacguccaaggauuuuuuccugauuuagaagcuccuggaccgggugugguggcucaugccuguaaucccagcacuuugggaggccaaggcaggcagauuacuugagcucaggaguucaagaccagccugggcaacauggugaaaccccaucucuaucaaaaaaaaaaaaaaaaagaaaaaaaaaaagaaaagaaagaaagaaagaaaaaagcagcagcugugggcacagcagaugucacuugaggccaccuggugggcuuccuuaagcaucacugcuuccagaaagcauggcccccucuccaagacaggaaggaucugguagcucugcaaguccucccaggaaggagggaacaagcauguggcccuggcugcaauugauuugaaaauguuauuuuucuuaagcaccucccuugcugaggcaguucagauuugcuuguuuuucuucuaguagagaugaaaaaccuauuguccgcuguucugggauacuucagaaccucaggcagaccuggggccuacuguguuugugaucugaguccaucugacauggagcucccucaaccuccucccaagguccuggugucaaccugggagucaccaccaagccgaacccucuccgccaccccacuauaccagaauuagaaaucaggcugggcguggugguuuaugccuguaaucccagcacuuuggggaggccaagacaggcggaucaccugagguuaggaguucaagaccagccuggccaacauggcgaaacccugucucuacuaaaaauagaaaaauuaucugggcgugguggcagacaccaguaauccuagcuacuugggaggcugaggcaggagaauuguuugaacccaggagguggaggcuucagugagccaagaucaugccacugcacuccagccugagcaacagagcgaggccucaucugaaaaaaaaaaaaaaacaaaaaaaaacccuguaaucccagcacuuugggaggccaaggcgggcagaucacgaggucaggaguuugagaccagccugaccaacauggcaaaaccgccucuacuaaaaauacaaaaauuagccgggcauaguggcaggcaccuguaaucccagcuacucaggaggcugaggcaggagaauggcgugaacccgggagguggagguugcagugagccgagaucgugccacugcacuccagcuugggcgacacagcaagacuccaucucaaaaaaaagaaaaaaaaaagaaauuagcagugcacaucauaagauacuaacaaaguacuaucucuuuaaugcauaucugaauuuugaauuggauggaugguguccuguucugaauguuaaaauucagaacuuccaaauacggacuuauuucuucuagugauaauaacuagcauucauugugcuuuugccaugugcagggaccugugauuaguauuuuuucauauauuagccgauaacaaauucugugaggucaguacaauuaucugccuuuuaccaacaaggaaacugagacuuaaggaggcuaagugggcugcuccauguuauugggucaaugggaacagagaucugggaguggaaaccaggcugccugccugccaauccugugcuccuacucauuccgggccacaucuggggagcuaaauguuguugggguagugugcaggggaaagcuuuguauauggagaggagugucugaacccccucuccgaguuuccuugguguucagacuuuuccauuccuccauccuggguccugcuuucccacaggaagcucuuuguguuccuggccgugcucaucugccuggugaccuccuccuucaucgucuuuuuccuguuuccccgguccgucauugugcagccugcaggccucaacuccuccacaguggccuuugaugaggcugauaucuaccucaacauaacggugggugggugcccuuggcuccaaaccccccuuccuagcaauacuucgcuguaaccuuuguccaguguuaugacccugggcaugggaagccagagaucuuauggcacccagaggguguugggagccugaagagaaguaggagcaaccaugagcuccaugacagaugguaaggauugggacucuacacaguaaggggucagaauccgggccagauaaguaaaccacagggguggaguggggugacagugccugagacucucuggauggacaggacugaauggaaagaagcuguacaggauggaccuggauccugaggcagcuuaacuucguaaaguugaccccucaccauucaaugccccuccaaggggcucccaguuuucauccucugcaccugaagcuugucaugguagauggggcucaggccagacagccaggcuuuugcaacuguuuggcuuuuccuaaggaugggccaucuucacuccucccuucccuugucuucauccccagaauaucuuaaacaucuccaauggcaacuacuaccccauuauggugacacagcugacccucgagguucugcaccugucccucgugguggggcagguuuccaacaaccuucuccuacacauuggcccuuuggccagugaacaggugacuccccucucccuggccagcccugcccacugguguguggaugugugguagugggaaaggggcagcuggaguuggggcuaacccugugcccauuugguugacagauguuuuacgcaguagcuaccaagauacgggaugaaaacacauagugaguaccccuugaucucuucuccccuagccacuugccuggcuuagggacccaauuaauacccaccagcuuuccugauugcuuagcaaauucuucagccagcaucuggccugcccucccauggccgagaauguaauaagcaaggguucaggguccccagccucugcuuguuuggaccuugauuagaaugaaaaacaggcuggaauuugguuaaucuuuacaauaugugaccuugggcucuucagccugcauugcugaggaagaagaauguuuugucugucuccugaauggggguccagcaugugccugggccaagugaguggaggucagagugauagugcagccaugcugcuacacucaccugaagggugggaaggggugggagugacauuuugggggcaccugauggaaggaaagaguucugugggguaaggaaacugggaccugcaggcaucuucugagcugacaggcugcuccaugugacacguggucccacguucucuuuucuucucucucagcaaaaucuguaccuggcuggaaaucaaaguccaccaugugcuuuugcacauccaguaaguagagcuuggagcucugguaucccugcucucacuucugacuucauucucacucagcuacaccucaugggcagagagucuuccaagcugaccccaugaaucuuuguuggcucuugggaauagcaagucuagccccuuuucugagucucaccuugccuauaaguuauuaggggcaacaggcauagggcugucuggaagcugcuggaaaacagguggggcagcugucccagguaccuuggcagaguggggagccagagggaagggcaaaugagggagcuccccgcuccccacccccagacaguauaauggggccagagcuuuccuuuuccucccagccauggcaacaaggccugcuuccucuccaggggcacccugaccuguucauaccugagccauucagagcagcuggucuuucagagcuaugaauauguggacugccgaggaaacgcaucugugccccaccagcugaccccucacccaccaugaccugucugcugucccuguacuccaggcaccugcaacccuggucuauaucucccacaacucccuggugacuaaggaaggacuacagaggcuuugccaaaggagaagcccugccucaucacacccuuaccucccacccccucagcacaggaagcuugcuuugaaguuaacuucauacacacacacucauauccuccaguuucccccagauucuuucaggggcugccaucagauucugcccuugguuaguuuuuuguuuuuuuuuugguagagacagagucucacuguugguccagguugguuuugaacuccugggcucaagcgauccucccuucuuggccucccaaagcacuuggauuacagaugugagccugugccuggcuggucuuucuugaggaaaaucugaccuggcauuuucuugaggcaccuuagauucccuggaguggcaccuggccuuucuguacugagcaccuggucagucugaagggggcauuucaccccagcuccaucagggcuggcagucccgucugaauguggagagagcuguaguuuuaucuggcuuuuaaaacauggaccugccggcugggcgcaguggcuuacaccuguaaucccaguacuuugggaggccgaaguggguggaucacuugagggcaggaguucgugaccagccuggucaacauggugaaaccuugucucuacuaaaaauacaaaaauuagcugggugugguggcaugcgccuguaaucccagcuacucgggaggcugaggcagcagaaucacuugaaaccggaaggcagagguugcagugagccaagaucgugcaacugcacuccagccugggcaaaagagcaaaacuuugucucaaaaaaagacucuuuucaaguuuucuacccucugauaagaaaauuuggggauauccagugccaucuccaaggacuuucaggggaucauagaugcuuuucugugccuaucugcuuugaccaugugaaaaagugauagucugcuucucucugguaacuugucugccacccaucugauaguaagauuagccaaggcccuuuagcccucuguccuuucugguuauugacugucccugguuccuaggaagacagaguuguucuccagcuaaagcgucuccucucuauaaaguaguuuuacuauucuuuucauagcaggagccaaaauaguagaggaggggagagaggcaccuggcacucugcgggccugcacaggaaaaacagagccaaagacagaaucauuguauaagauauuuauuaaaggagagccucuaaguccacauccugagcccaugugaguggacacagguagguaaaacgguggguccagcugcugucaucugaaagccuucaggagaugaagcuaucaguauccagcugaaggcugcuggguucuguuccaccaccaccuuagcaccagggcccucucuggucccagaggccucaucucuccuugggcuuugacaauguggagcagcacaucagcagggacuggucuagacccucccuuuccugucacuuagcuggagcuaagcuccagauaaccccuagguucccacuggcuccuaguagaaauaguuucuguacuuuagcagaacaggaaggauauuuguucauuaaagguggcuuggucuuacagcugggugcagugguauauaccuguagucccagcuacucaggaagcugaggugagaggaucucuagagcccaggaauucaaguuuaacaugagcagcaacauuagcaagaccccguuuaaaaaaaaaaaaagagcugggcguaauggcgcacaccuguaaucccaccuacucaggaggcugaggcaggagaaucacuugaacccgggaggcagagguugcagugagccaagaucgcaccacugcacuccagccugggcaacaagggcgagacucugucucaaaaaaaaaaaaaaaaaaaagauggcugucucuuuaucauucagacagaacgaugaacacaggugagcagggaaagcuaauuuugaaguaggaugcauggagagggagaaguggugacagaacuugguaacuagcuggcugggggaacgaggggaaggaaggagacugcugucuccaagcugaggucagggugguguuggcaagagugcaaaaguccagggaagccaggcuggagcugcuguguauagacugccaaaugugaaguauuuauauuguauucaauaaacuauacuuaagaguguucaaaaaa

SEQ ID NO: 16862 - RNA, 18615 nt, Homo sapiens
aggagaacuaaugggagaagugggggccuuuauuaaggucuggcagaugugguggagguggaaguacaaacccaggccugggccuaggaaagggcagaagaaaggcaaagggucccuuggagcaggaacccaucccucucugcuuauacccagcaccccucaucccagguuccuuucuucaaccuccgccugccucugggaacacagagcaccaagaacugacaaaccgggacccuccagggccacagcguggggcagaguccaggcuucugucuccccgcagugggagaucuggggagcucagugaaccuccucacccuccugccaguaugaaguugggaagcgccuucucugucccccagaacagaacaaacucuuguucucugugguuggggaaaagguguggggggcuuggaccuaggaagaagcugagcugaauuccuccagggcccaggugaaacccccaggggaguuucugagacucuagacuugccauuucuccacuuuuccuucccaaugacuccggugagcagcucagagucugggcuagggcaacugguaggacaguggggaucugccccagagacaucuguggguuucagaugaagguuuccccaacaccagauucauuuauauguacacagggcagcacccaccugcggcagggggaacagccgcugggggcuaguaagaguagccacccuuggggccaaauggcugggcggggccagccagcucugggagguaggcggggcucucauccaagugggacaaagggacuguguccuccucacugacaggccggucaaacucagccuugagagcuggacgcugauuguccgggaaggccaaagagaagagggccucgggcucacacacaaacuuguacacguaacgcucaccagccaccuauggggagagagaaggucuggucagccuggcuagccgcccagccuuuguaugggguaaggugggggaguggggaauguggcccuucuaccaguacaggcagaugcucggggcauuucucucccaugcugguuccugagaagcugacucucccuucacaguucuuacuccuuuuucaucucaacuucuccaugcuugggcuucucaguuacaguguugcacuuuuuugggggaggagaaccuugggauucuccacaauuucuugucucucugacugauucauuaucugauccuacaaaguugcugagaacugcccugcugacccucuccccagucagcuucucacagccacugccccccaccaccuugucccuagacccacagcccccaccuucugcaugaugccuuucucauaauaguaucggagcgagcggcucagcuugucguaauucauggcuggccgguucuucuggaugccccagagccuggcgaccugggaacaaaacaguuuugggguagagaugcuaccuuggcagaggaaaaaauggggguaaggucagaaagagcacuugagauucuuggugcaaagugccaagcuagcucugcaacaaagcaucagcccacagacuuaggcuuggcaagaauucagguuagguaaagcaagaaucaugauggaggcacgugccaccauuucccagguucucccaccuccaggcuguaaacuuuggaaaggagggcugggaacauccgagaggcccaccuccucaggcucaaugagcuugaacuccauuccccggcccguccaggcaaugaaaugggcauuuguugggucauccagcaaggccaccagaaauugccacagcugcagggcaccccggcgcugguagggcggccccucucgaaaugcaccgaccccuuccugcuugaugucuccuggggaacacgaaaauaggaggugugggguuugugucuuuuggucccccaagcaaccgccucccacccgagggauuucucgaaggggucuccccagguacuuuucuaugggucccacccucuugcaacaaugaaacgugaugugacuccugcagggacacagcgugauaagaccuugacccucccaucaacagucacuucucugaccuucaaauuucucagggacaacgcagacaucaucugggaauggucgcagagguuucucauagccauagccuuguggaggaaauuggggguugcucagaucuggggguucaccgaugagaccccagagaguccagagggacuccuggccagggagacccucccccauggcagcgcucccucccccaacauggagggcuuggcaggggaaggggggcugccuuacccauggccccgucaccuggagagggcccagagaagcccucuguguggagguacauugaugcgcacccggugacaucugugggggaagaaggggugaugugagaaguggcuugggguggagcucgagggcaggggaggaggaaguccuauccacauucaagaauuucuuccuuccagccugcuuccuggugacuguucuuugcccagguugccugccaaccacaaaaucccagggaaaguucacccagagggagugugaugcuggaaccccuccucaacuugagggcugcggcugaggccauggaaggcagcagcgggggcugggcaagcuguucugaagggcccaagcugccagggagcagcuguuuccugcgaguucagggggaggagggagggugagaugaacguccggggaaagaguucgguguccacgccuaagacucccucagaauggacaaaaauguccggucagcaggucagguucccagcccugugcacgcgcgcgugugugugugugugugugugugugugacagaaacagagcgugcgccugcaugcaccuggggaagaggcagugggcacugggccuuguuuuuucaggucuaacagagcacauuccacuucguuucauuccauuccauaggauaggaaccuucccacuccacaucgggaaggcggcugugugaagccacccguucaaguuccaaccccuucccgcccuccccccacugcacucccaccuaugaaugagaagauggugaaacaugacaccuccgggaggaggcgggagggugggcucauucaugccuccauuuugugaauggaauuccugacuccauucaggaguagcuggggggaggggcaggaguucaagggcauguaacacaauccccuccggucuacagccuuugaaggucagcggcaagagugccucccuccuccucuccccagcucacugccaagccuggcucaggcuuaugcccuggauuugaggacaggagcaccauccgguucuuaguuggacagccugggggguugugguucaucccccugcccuugaacgguugugggcaccacaaaaagggaaauucuaaaguucuagcuagcucugggccuacucuaauaaacucagaucuagggcuacuaauguaacaaaagccaggaggaaagaagaaaaggcaggguuuucuggacccuuccugggacuggcccuccuucggcccuugaggcuuugaacuauagcuauuuaugaacacaggugagugcaucucacuccagucaacagccagguggaacuagaauuuaaagaagucccuacuuccucugcccuugccucuggccagggcauacaucaauugggaggcucaaauauguaagccacauauuaaccugugcuucuaccagcuugaucaacauggugaaaccccgucucuacuaaaaauacaaaaacuagcugggcauggugaugggcaccuguaaccccagcuauucgggaggcugaagcaugagaaucgcuugaacccaguggcacuccagccugggcgagagagcaagacuccaucucaaaacaaacaaacagagcaagacucugucucaaaacaaacaaaacaaaacaaaacaagaaaacccugcccuccuauugagaacuagcaagaaccaugagccuggcuaguuucaaauucauguuucucuucauucaaaucccuuuguauuuuuaagccucuguggggauagggaccagacacauccuauucaucuuuguauuucccaacucugcacacucguguuccugucacaguaguuuggucuuaauagguaauuaaaaccucaaacaccuguuaaauagaaauaaaugccuuaacuucccuauuaagucacaagcuaccugagggcaggaucuacaucccccuuuauuuuaauuuuacuuuuuuauaaauagacacgaggucucacuuuguugccuaagcuggccuugaacuaauuccugggcucaaacgauccuccugccauggccuccuaaagugcugggauuacagaugacucaccaugccccgggggccccccuuaucuuuuaaucugaauauagguuugcucauugaaaaguaauaauuuguccgggugagguggcucaugucuauaaucacagcacuuugggaggccgaggcgauggaucauaugaagucaggaguucgagaccauccuggccagcauggcgaaaccccaucucuacuaaaaauacaaaaauuagccgggcacgguggcuggugccuguaaucccagguacucgggaggcugaggcacaagaaucgcuugaacccgguaggcagagguugcagugagcagagaucgugccacugcacucuagccugggccagagcaggaccccauuucaaaaaaaaaaagaaaaagaaagaaaaauaacauucuuuugaaauuaugaagaaaaaaaguggguggguggguuggauguaugaaaugguaaacagcaauguaaaaaaacucgggagacauucugggcuuaacugaacacuugaucacaugccacccugccccaccccagucucuuaccugagucguaggcgaaguccgucuguuccuguuugaucaccacccccgccccuggguaccugugcccauugaccccacccugguccacggcuggcuggcccgccuguucauacaggggaucaugguauucuugcuuaaagcucugcuggggauagggugggcagggcuccgacagcugguguugguagggggcugggagggguucccggcccccucccugagaugugaaggaguggcaaauguccaggggcugcuggaagacggagcuggaugugguuggauggagaaggaagagaagagaacuuuaaauuaauccuuccucgagccuguuacuccuaggcuuuuagagugggcuccggaaugggggguaggggguuggggugucaguauuucucccuuucuauuccacugcccccugccucuaccaccccacagcucaagucuuuauggagaacacucaggaauugaaaaaacaccugggcccaugagcaguggguuucccugucuccuuaccuauguuccccgagguacccauggccaggguggggcugggaggugccagaggaucucaggaaauuccguugcucugcccggggaaagggcuguaggggcgacuguccaagggcaccaggggcaggggacuugauggcgauuugucugggggggucauaggcacuggaguugagaaggagacaggggugagggggcagagaagcuggaaagcaucuuugaacccuucauuccuaggaaagcgaggucacagggauuacaggagaaggaaggauagagggggcugagaagggaacggcaggagccacagacucagcccuagccaauucuuuucuuuuucagagacagucucccucuguugcccaggcuagucuugaaccccugggauucauacaggggggauuuguugcucagagcaaugguuuaggugggacagugggccucuugguggaaacagaaucugcucuggccucaguauauauuccugaggcccucugcugcguuuuccgucuauucagaggaaauccuuagcuguauugcuuccuuacaagugcuagaaaauccuuucuguugucuaacuugcaucucagcugcugccucugcucaugggugcccccugccucccuccucuggaacccuucuccuacccuucaccagguccaggcuggggcucaccuggaguaaaggcacugcucgccauggugguaggggaguggcggcuuccugcugcaggacagggccgggucugugcggggacucuggggcuccuucuugauccuggugguggggcuguggaaagcuacuguggggguggaggggacagagcaaggccagagccugucacacaagaggcaggcagggcuucugauaccuucugagcuuugaggaccagcugggugacugguacagccuccuucccucucuggguaucaauuuucugagacccgcagugagacaagaacauuuuggcuauuuacauuaugucuaguuuauacaucagacuagugucugauuauugacuaaauaaaccaucuaaaguucaacauuuaggcugggcacgguagcucacaccuguaaucccagcacuuugggaggcaggaguccaagaccagccuggccaacauggugaaacccugucucuacuaaaaauacaaaaaaaaauuagccggggaugguggcggaugccuguagucccagcuacucaggaggcuggggcaagggaauugcuugaacccaggaggcggggauugcagugagccgagaucaugccacugcacuccagccugggugacagagcgagacuccgucucaaaaagaaacaaaaaacaaaaacauuuaaugcaaccccaggccccagaaaacacuuucaaggagugagcaccuccaaccuagggccuguaguuuuccugagugcccuggaaaauuccaggggagugacauguuuucuuauuugaggauauaaagaaucuuucuuggccgggcgcgguggcucacgccuguaaucccagcacuuugggaggccgaggcgggcggaucaccugaagucagaaguucaagaccagccugaccaacauagagaaaccccaucucuacuaaaauacaaaaaaauuagccgggcgugguggcacaucccuuuaaucccagcuacucgggaggcugaggcaggagaauugcuugaaccugggaggcagcgguugcagugagccgagaucacaccauugcacuccagccugggcaacaagagugaaacucugucucuaaauaaauaaauaaaagaaucuuucuuuuucugguugagguuggauauuggcccacuugaaugucagcugacuaacauuauacacaugcuccuacuuaucugugaagaacacuggccuuuccuguggccccugcgggguucccaaacucuggccacgaggcugagcagcaaagaguugguuccaagccggugugagauucaguuuuaaccgcaguccagucaaaugccguuuguaaccaacuauucucugcuguuuuugauucuuugugccccauuguuucacuggugaagacaguugacagcaaaguaucugacauuaaagcaggguuuguuuuuugguuuuuguuuuuuuugagauggagccucgcucugucacccaggcuggagugcaguggcucaaucuugccucacugcaaccuccgccucccagguucaagcgauucucaugccucagccuccugaguagcugggauuacagguacacgccaccaugcccggcuaauuuuuguauuuuaguaaagacggaauuucaucauguuggccagguuggucucaaacuccugaccucaugugauccacgcgccucagccucccaaagugcugggauuacaggcgugagccaccacacccagccuaaagcaggguuucucaacaguggcacuacugaccugugggccagauaguguuuuauuaauaauauuguaaggagcgguccugagcaucauaggaugcuuuuagcaguaucccuggccucucuauccacuagacaccaguagcaccccacccucaacugugacaaccaaaaaugucuacagauauuaccaaaugucucuugggaggcaaaauuguccccaguuuauggaagugacuuagaauacuagaacugggggcgggcgcacugggcucacgccuguagucccaacacuaugggaggccgaggugggcggaucacaaggucaggaauucgagaccauccuggccaacauggugaaaccccaucucuacuaaaaauacaaaaauuagcugggugugguugugcaugccuguaaucccagcuacucuggaagcugaggcaggagaauggcuuaaacccgggaggcggaaguugcagugagccgagauugugccacugcacuccagccugggugacagagcaagacucugucuuggggggaaaacaaacaaacaaacaaacaaacaacacuagaacuggacucugcugaacuggcccaggccccucacuucagauauaaggcaauggagaaccagagggauagugucugcucuaaggucacacagcaagaacaugucaagccccagauuucaaccaagguuuucauuccaguuauugccuuggucuuuaagaucaaaccccacuguguuuuaggagagaacaagcugcucucuugugauucucuauccuaugacucacuuccugccauccuccacucccuauacccucuccccagggaccucuacucacgguuuucugaauggaaaucaggaacaaacugcucaucacugucugguaccugagcugcagagagaagucagaggugaguuuggggcggagcccugguuguccccugggaggcuccauuauuacagcccugcagauuagcaacagccaagaaaggaccaacagccuuuagaucagggguguccacauuguaagaauugucuugggccacacauaaaauacacaaauacacuaacacuaacgauagcugaugaacuuaaaaucacaaacaaaucucauaauguuuuaagaaauuuuacaaggaauuuauguugggccugggccgcauucaaagcuacccugggcugaaaguggcccacaggcccacggguuggacaagcuugcuugagacuaaaggcugcuccacccuagguccuagugucuuccaccucugggcuccacuaagacccaggagggaagacuguucucagaaccugucugagcagauuccagucuuucuucuucuagaugcuuugucuuuauuuccuccauuuuucugaagugaaacagccucgccccucagaguuuacaaaacucccuuaaagcucacaacagucauaucuaggaugggcaggcauuauaagcagugggauccuguggauuuaaaaaucacauaggaggcggccaggcaugguggcucacgccuauaaucccagcacuuugggaagucaaggcggguggaucaccugagguccggaguucgagaccagccuggccaacaugacgaaaccccaucuuuacuaaaaguacaaaacuuagcuggucguguuggcgggagccuauaaucccagcuacucaggagcugagacagaagaaucgcuugaaccugggaggcagagguugcagugagcugagaucgcaccacugcacuccagccugggcaacaagagugaaacuccaucucaaaagaaaaauaaaauuaaauaauaaauaaaaucacauagggggguggcugggcgcagugguucaugccuguaaucccagcacuuugggaggcugaggugggaggaucacuugagaucaggaguuugagaccagccuggccaacaaagugaaacucccaucucuacuaaaaaauuaaaaaauuagucaggcguggcggugggcaccuguaaucccagcuacucggaaggcugaggcaggagaauugcuugaacccaggaggcagagguugcagucagcugagaucaugccacugcacuccagccugggugacaaagugagacucuguuccaaaaaaugaaaaauaaaggccgggcaugguggcucaugccuguaaucccagcacuuugggaggccguggugggcggaucacgaggucaggaguuugagaccagccugaccagcauggugaaauccugucucuacuaaaaauacaaaaauuaggccgggcgcgguggcucacgccuguaaucccagcacuuugggaggcugaggcgggcagaucaccaggucaggagaucaggaccauccuggcuaacacagugaaacccugucucuacuaaaaauacaaaaaaaauuagccgggugugguggcgggugccuguagucccagcuaauccugaggcaggaguaugccugaggcaagagaauggcgugaaccugggaggcggagcuuguagugagccaagaucaggccacugcacuccagccugggugacagagcaagacuccauuucaaaaaaaaaaaaaaaaaaauuagcuggacgugguggcacgccuguaaucccaacuauuccggaggcugagacaggagaauaacuugaacccgggagguggagguugcagugagcugagaucacaccacugcacuccagccuggcgacagagcaagacuccaucucaaaaauaaauaaauaaaauaaaaaaggaggaugacagugggagagcaggaggcuggugacugggaccacugcagaaggcaaaggacacuggcugaguacauaggugccucauccccuuaaugugcagcuaaggaggggagggauucccaagguuggugauccgaagagcucucccaggaugccaggauggguggagcuggguuggggaauaggcaggaaaacugaaauacagcagcagcucauccauggcuucuaaccugaacaucaaacucugauuucuaguucuuauucuggccuccccagagcggggcuucucaggugguuauacagcuaagaaucucccuugaucccagagucuuggcccacuuuugccccucucucaaaaauaaauggaucacagcaggaaauguagacaccaagaagaacuuccugauauuauuccaggaagagagugguucuagggugaugcaguggaaccuguagcccgaggaggcuggacucuccuucccuggagacugcucucuccuucccuggagacugcucucagauuggacaauggggaaacugauaaaaugcccagagaggucaaaauggcuggugagggguaugagauggcuagaaaaaaccuccacacccccggccuauacaaauacauaucccaucucuuuugcuucucucuaggcuaaggcuccaucauuucuuacuuggauuucacccacggccucuuaccaggauacccuauuuucauucuuaccuccuauggucccuugcucuccaccuaggugucacagugaucuuuuuacaacagaaauaaaaucauuucucucuguuauuuaaagcaugaaauccaaacgcuugcccuuggccuccaaggcucugcaugacuuggccuugccuaccucucugaccugccucuccuugccugugaaucugcagcacucuggucuccuuucuagcccucaaagcugcugagcuuguuccuucuuccccagaugcuuucuugccuuuuucuuuuuuuccugaccaucagagucucagcucacuuugacaucucuggagaggccuucucugaccaccccuaaaccaaagugguuccuccuggcucucuauugcaucuauguuuuguuuucucccuggcacauauugccaccugaauauauuaauuuauguuuaccuguuuguuaucuaccuaucuccuccaccaggaaguuaagcucugugagggcaagagcuuuaucuuuuuugucaucugaugccccagcacccagcacaggguuagaguagacgcucagugcuguuauuucuugacuacaugaauaaacaugcaauaaucguuuguccucaggcuggcagaagucagcacugugggccugagggcaugcacugaagagauccugaccauccuagcccuucccugcaggcucccccucuccacacacaaggcaacacuagaggcagguccucuccaggaaagcacaucucacaggggauauuuuagguugugauauguugcuuggcaagaauauucuucaacaauuugcuuuaaauaucagaggugccaaguguuuauaaacauaggcuuauauuaauagauaguugauuucuugacagaagcauuagggagagggaguuuaacaaucacaagccaccagcagcuaaacgagaacuuaggacaagucaacauaauaauacuuuggucugaagugaccaaagacaucaaugagacaugaaauccgcuggcaagaacaaacagaaacacacagccagcacacaucuuuucaggagcacaaacacggcaaaaagacaaccauucccaaacuggccugauucaagagucaccaggacguuguuaaaaacacgauuacagccaggugugguggcucacgccuguaaucccagcacuuugggaggcugaggcaggcagacgaucugaggucuggaauucuacaccagccuggccaauguggcgaaaccccaucucuacuaaaaauacaaaaauuagccaggcauggugguucucgccuguaaucccagcuacucuggaggcugagacaggagaaucgcuugaacccaggagguggagguugcagugagccaagauagcaccaaugcacuccagccugggcaacagagugagacccugucucaaauaacaauaauaaaaauaaaauaaaaacacgauucccaguccccuccuccggagagucccauuccauaggacugggguggggcccaggcaucugcauuuuaaaaucuauuauaaggaagucuccugugucaggcuugagugcaguggcacaaucagagcucacugcagccucuaacuccugggcucagguaauccuuucacuucagccaccacaaccuuaaaaauaggcacauuuggauagaggguaagaggccaaaucuguccaccugcccagggaugcaaagccaggcuccccacugugcccucugguccauucagaggcaacaucccccaagguggcaggaagcuggggugaugggagcagagugaccaacauuucccucccuccuacuaggcaagaagggucccaagggaaaggguggugcagaacucagggguggcugacgcauuccggccccaccccuggggccucauuaacugcuacuuuccauugagguaaugggcuggggguaucucuugcuggcgucacuggugcuggagagcagagaacccucagcaucaucuugccuuucuuccugccucgggccugacaguuuaaccagggaccccuccaggcccggaauccaggaggaggcuuccuccagcacacagaccacaccccaaaagagguggugccauccucuucccagagccaggagaaaucuguccuagcucagccccucccccaaacacuggccuucucccaaagggguaggccagggcccucagucauccagagacugucaacaggauagaaacaggaacacugagccucgcguuccuggagagcaggagaauuuuuaauuaccauguuucgucuuaaguguacaccacucucuuuauuuauuuguuaacuuggcugagucuuggcugccaagccagugugccagggucuguccccagcuccaucccgguacuaagauggaguuuaucugucuggggacgaggcagaugauuaaggagggggugggaaaagugccaagacagcauaaugcccagagagagagaaagaauuuuagggacucuccuuucaaaaagggggguuaguaaaaaaagaggaggggcuuggggggucucccaagcuggauucuggaagaacugagagguuaaaacagagauacacugaagcucaccauagguuagccacccacacuacauaugcucggucacccucuucccaggauccagucauagggugaaggggguagaggcauucuccagagcuucugcuccauugugucaccgcugucccuuacccugcccccacccuggcagccucuguacuggaaggaaccaguucacuaguuguggaggggacauauuuguccccaagagucuucaggaaggggaagagacagaaagauggagaaggaggcauuguagcugggaaagauuagggaggagauuaaccucaucccuccccacagacaugccgaggcaccaguguacaugcacucggacgcauauucagggaugcacacacccuaauuccuuuuacuucacucuugcagcagcaagacagcacagggugaaaugugcccuccaugcaugcccuccacacauggggucuuuuuuugaccuacaaauaugauugggacagccaaagggcaaagggacuggagcccuuggaggaggguuggggagcagugauuccugugaaaaggggagcgcagaucgaucgaucccuuugagaaucugauaaaagcuaugggucauucucuuccuaaaaaaauccauacaccuuuauguauggugcacuuccagcaauuuuacacacaguaucagagggaucaaggaucccagcaaccuauccauagggcuucugggaauccacagaccugagccucacacaaaggggucauggccuagagucaauggcccuuacuaccaaauagacaacaaagucauuuuccccaaggauucagggcuccugacaagccuggaaaggaaccuuggacaaaaaaccagcauaucuuuuaccauagccagacacauauugggcucagccugccugagccugggucucccuguagcagccugauucuuuccccaacaucucaacagaucccaggcacccccaaaucagacacgcccuccuagccucacaucauucaccccuguguacaaaaacccaaccccaaggauaugugagcugccuccauaaagccgcacucacacucacccuucaacgcccggacgcaggacacugaaccugcaaccacacuggaaucuuccuguaucugcccggcuccaaccugugccuccuccaaaugcugucuucacagacccacccacacuaccaggaccccccugcugcuucucuucaaauuggggcuuuggaaaaaaccaaacugagaaagggagguugggcucugguccccuuuccuccuaaugcgucccaccacuggcaaguuuccaaagaagcuagucccucccugccaccccaaagcuccccauggguugccggggucacugaccuggugggaagagacaggagaggaggcuggggugguguugggauggugcagggggacagggccccggcagcugcaucugucuccgcagagaaagugagaaggagcgaucggccucagcaucccccccucagaccuggccauccaucaccagcugggaaccugagcugcucccucagaaggaaggagagggaaccaaggagaucccagcgcccaccccccucaccuccgccuugcaauccccaccccaccuccccacccacuggauuuaaauguacagggcagcagcauguaacuaacacacacacacucucucucucucucucucucacacacacacuugcugucacaccgacacugacacagacagacauuuguacccucuccagaccccuggccaaggggugggacuuccaagguagagagaugagagcauuuuccucccccucccaucucaaacccaggcacagauggaccagcugcugccaaaaugccaaccucagcccaccccuagcucacagcccuaggagcugcccacuguggggacucucagcugacaggcaaggaaugaagcccggugagccagagagaaaucaggcacugggaaaggaagucuuugagagcccacggaaacugacaccucugcauucuucagcucuagcccagcuccagaaccucagaagaaggauggggagacggggcaaagcucugccuguaaauuggagcugggcaugcaggacuugcagggucggggaugaugcacacaauacccucagaaccuccagaucccuccagcacucacacagccauucagccauuauuuccacaaaaugucuugagugcuugcucuaugcuaaauagucauucugucaacauauauauuuuuagaauaucauagugggcaagacagaccuagucucacuccaaggaucuagucaggggucauuuucuuuuuacuccgagcuucuauggagaguuccaggguaguuggauuugagcuuuaaaaaaauuagauacccaggguggagggaugaggagauccuaaggaaaauaccucaaaaagaccucaaaaaaggaguuccuaguguuuuggcuucuucauuuucauaguguuaaaauaaacccuaagauggggguaguuaacccuucccucucagagacugucuaaaccaccauuuucccucccaccugcagccccaccagcgacacccucaggccccaccaaaacgcacugaagaauccaaccaggaaaccuccugaacacaccacuuccccaucagacccagccacggacccagccacggaccccaccccagccagcucacagcuaacuccccagcacacaggaaggggggaauuugccuggaggcagagguauucaagcgggauggaagagggaggaacacuugcuauuagaauuacaaucaaggcuauuuggggagggagcccugggcucucugugccaaaggacugccgaaaagaauuauuuaaacuuuuguuguucuuuuggcuuggacaguaaauuguuuggugcuggggguugggaagaagagaaacccaggggauaagaaucaaugcuugggcaacucuggaggaugagugacaaauuaauuucuccccccaccccccaccaacaacaccccaacaugcaccuuggccuggcggcuucugcaaaacaaacuuuacaaaugaaaauuucaaccaggaaaaugggccuggggccaaguuccauucaaauaagcaaauaccccacacaauggucugauucauccucaagccuaguuacacaagccuggcucaggguagagaaaauaaauaucaauauaaguguccacgcugggugcuggggugaguagaguggcaagggaccuggggagagggccuuggagaacuccuugaggcagggaagggagaggagaaguguagggcuuaggguggaauaccaggggcuacggagugucccccuguccagccucccaaaauagaaaaggucacaaaacuacucaccuucagcgagccacgucuccuggaagugacuuagauccuggaagagaucugagggguaaauaguggaauuggaggugagguggaggggacgguaagagagaaggggcccuagcaagacccggugacuccccugccuugggaguagggaccgagaagaaugaccaaaaucccuuggagggcgaguuuuuuggggaaacaggcggggguuccagaaucggccguguguguguguguguguguguguguguguguguguguguggcggaggagggucgcgguuugucucucuugcucuuuaccuucagagucgaggggcggcagggagcccggguccaugagcuuccccagcgggccgaucagcgcuucgcgcaagcucccauuuccgggcgauuucugcgagaagcggggagaaugcccgcgagucacccugaggcgcuuagucugggggacgagguugggguccucgggugacucaggggcggggcagcccaggacuccgcugggacugcggggaggggggcuguggugagaguaggggcugggugcggggcggggcgggcguggaggccggcgcggcgcucacgcugcugaagguguagggcacuugcugguccaaguauccggcuuucauccuccgcuccauccggccgcucccuccggccgcacggccggggccccaagcgggggccgagaccuggugggggagggggcugcguucgcacaccguccagggagggcugcgaugggggcggggagggggcagucccaaggcucuggguccgacggcgaaacuucuccgacucacuggggcgauggcgagguuuccgccugccaggccgagcgccaccaccacuccccucccgccaaaggccaaaggaggucccaccugcucccaggagccgggcucgccguuucugcuuucugcagcccugcuuuacccgggcucgguuacauaagaacguguguguguguguguguguguguguguguguguguguguguguguacgcgcgcgcgcgcggaggagcaggcgaagcgcacaccaucgcaugcccacaacucccgcgcccccuccaacccugaaucccagcaccucccacccccgcccuggaaucugcggaggcggguggugagagugaguguggugugcauuggaggcgaggcggggaaucacagacacucucccucccuuucccucccgcagccucaccugaggccggggcgucugggcuggagccgcggggggucccgagcaugcccuggagcccgcaccgagggccgcggggcuaggccggaguaaggcggccccggccccggguccccagcgcaccgacuuguuuuucgggcgcagcagacaguugugagcccgggggagcagcugauuggugcauuuccuucgcucggccucagcucuccaccccccgccccgccacaccgccccccguuucccuuuguuucauugacuuuugugaaug

SEQ ID NO: 16863 - RNA, 2190 nt, Homo sapiens
caggcuagaaagaacaacgugcuauugucuuuacucagcccucagaagucacuaucucuggaacuccguggagcuggggagucugaagcgggugguuugguugguucccucucccugggugacauaaagcaaauuacucucuggacuuuagagugcucaacuauaaaauggaacuaaauauaccuacuuugaggaaugcugggaaaauguaauaagauaucuuaaaaggcuuaguaaaacaauaaaguguaaagcgcauauacaaacacuguacuuuuuuuuuuuuuuuuugagacggaguuuugcucuuguugcccaggcuggagugcaaugaugugaucucggcucacugcaaccucugccuccuggguucaagcaauucucuugccucagccucccaaguagcugggauuauagguaugcaccacuacgccuggcuaauuuuguauuuuuaguagaggcaggguuuugccauacucaaaugauccaucugccucugccucccaaagugcugagauuacaggcgugagccacugcgcccggcccaaacacuguauuuuggaaacucaaguugggguccagaaugccuggucccccucugguuagguauuauguccucucagcauguguuccccuaacauccuuucuuucugccauccucuucuccacccaggcauaugguccccacaaagcaagaggaaagcaacgccccuacccagaaggagcaucauuuccugggcucugugcucuguggcuccagaucauuaauuaacaacugugguuguaaauuaccagauaaaucugggcuggggucgccaguaggauagaugagaaucaacaagaaaaauaaaucuacagcagcagcucccugaguuucaggaaaacccuacagccugggggcagucagggacuagugagagagaagaguuuguguuuuggauaaaaacaaaaacaaggcugggcacgcuggcucagggcuugauugccugagcucgggaguucgagaccagccugggcaacauggcaaaaccuugacucuacaaaaaauacaaaaauuacggccgggcacaguggcucaugucuguaaucccagcacuuugggaggccgaggugggcagauugccugaggucaggaguucaagaccagucuggccaacauggugaaaccccaucucuacuaaaaauacaaaaaacuuagccgggcgugguggcgugccccuguaaucccagcuacucgggaggcugaggcaggggaaucgcuugaaccagggagguggagguugcaguuagcagagaucgugccacuguacuccagcuuaggcaacagagcgagacuccgucucagaaaaacaaaaacaaaaacaaaaaauacaaaaauuagcugggagugguggcaccugccuacugagauugcaccacugcacugcagccugagugacagagcgagacccugucucuuagaaaaaaaaaaaaaaaaaaucaaggccagugugcuagcucacaccuguaauuccaacacuuuggaaagccaaggcaggaggaucccuugaggccaggaguucaagaccaaccugggcaacagagcaagacccugacucuauaaaaauaaaaauaauaauuaaauauaauuuuuuuaaaaucucagaaauaaaaccaggaauucuccccccaacccauuaccaccauucucccaaaaagauucagguaagagucaaguccccaggcuucugccagugcugacagaacugucucugucccugccuuaucaagcuggggcguccacucgguugcccauuauuccugacaacaagagcaaauacagacacucucagagggcugaggagaggcuaaguggaauaaaccguguuuaaucuuuaacgagagaaauugccuucccuuagcagagccccacccagcaggcucuguggccccucauaauucaaguccguacuuaauuaaaaaggggagcauccuggacuuuccccaacuggcaccaauuccauucucauccuucagccugcugacauuuguccguuugucucucuucaacagaaagagaaaaaaaucaaaaggaaaagaaaauguuauauccugcagcuuucugagagggcccguccuugagcuggggcgcuucaucuagaagcagagaggguugaaaucuaacaggaggagacagaacaggacaaggaa

SEQ ID NO: 16864 - RNA, 7402 nt, Homo sapiens
ugaucuugacuacagagggguugggcaugcccuugcauuugggccuccccaaguccaggcugaguggucccuggaagguuaaccagcauugaucagaaacgcguuuuccauaguucuucccagccagacagacaggcugcagugucagcacggcaacuuuuggcugcaugacuuuggaaaaguucauaacuucuuccagccuuuguuucccuggcuguaaaaugggcauauagcaguagccccuuccauagagagucucucugugaagguuagaugcagugauccaugagauuaacucugugccuggcacauaguaagaguucaauaaauagcagcuguaaaugguauuaggcccauauuuccugaaccagccuucagaauauaaggucugacaaauauuucuauauuuauggggaugguggaauugaauauuucaauuaugcugucucagaaauuccugagucuagagaacuucuggcaaucauuuuguuccaguugucaucaggagcauggagcucagagaccugccggagagguuauggggugaguugggccuggcaaaugcaccccauauugaguggcugagaagccuccagaaauggaaaguuuauuguaagaggaauguucucugcgcuuccuuccuccuuugccaucuccuucaacugcuccccgcucacucccaguagaaucuggagcugaucuacucaaagaaauuaucaagaaagcaaggguuggccgggcgcgguggcucaugccuauaaucccagcacuuugggaggcugagccaggcggaucaccugaggccaggaguucaagacugaccuggccaacauggugaaacccuaucucuacuaaaaauacaaaaaaaaaaaaaaaaaauuagccaggugugguggcaggcaccuguaaaucccagcuacuugggaagcugaggcaggagaauagcuugaacuugggagguggagauugcagugagcagagaucacgccacugcacuucauucagccugggugacagagcgggacuacaucaaaaaaaaaaaaaaaaaagaaagaaagaaagaaagagagagagaaaggaagaaaggaaggaaggaaggagacagagagaaaaagagagaaagaaaaagaaagaaagaaaagaaagaaagaaggaaggaaggaaagaaagaaagaaagaaagaaagaaagaaagaaagaaagaaagagaaagaaagaaagaaaaagaaagaaagaaaaugaacaaacggggagaaagaaagaaagcaggguuccuggccuuuggcacuuccccacccuggagaccagcaugguguuaucuuacccaaaccacucccagccccaggccaauggggauuaaagaccccugcuggcagggacagcugugaggccacuguuguuuucccccaaacuguccuugcuacugugguugucuuuaauuuaugggaaugaaggauuuugcggugguuuccucaugggguucaagggaagguugcgugugauuagaguggcuacaggugaauccgaucgcccgccugggaaagccauggugcuagaacucagcacugcucccuccugcucucacguccucacucugcugagacaugccuuuaaucagacgugauuugucucauccuucuucagcuccaacacguguguucccagagcuguccugccccaauuucucuuugcaagaccugcucuaugccugccuccgcccaaccacaaauuugccuaagguauaaaacuccacaaauaggccucucuccucuuuucccuccugaugccccuuuacaggccaccuccccgccccagguccccuccacuaccccugccacgaagccacacccagggacugaccuugcaaacacauccugcauuuucuucccccucucugacugugcucuggugguuucuccuugccuagagcacucuccccuuccccguacuucugccuguugaaguccuacuuaaaaaccacccagcucaaaaacaaccccuuccaagaauauuuuuguucuucuuuuucaaaaauuuauagcuacauuugcauauaacauaguaucaaagaaagcuacaguuaagaaaugucgaagucuaguaucugcuagaaucuguguugauuuucucacuuuagcuugcaguuguuucauaaaggaacucuucugagguuucuuaccugggacaucuuauauuugaaaucuccuuuuuuaaaaauuggggucaaauacacauaacauaaaaguuaccgucuuaacaguuuuuaagugauacaguacaguaguugugcaaucgauuucuagaacuuuuaaucuugcaaaaccgaaacucuaucuccauuaaacaacgaccuuuuuucccuucccccacccccuagcaaucaccauucuuucucuugcuaaacauuugacuauuuuagauaccuuacauaagugaaaucaugcaauguuugucauuuuugugacuggcuuaugucacuuggcauaauguccucaaguuucaaccagguuguagcaagugacaggauuuucuucuuuuuuuuuuuuuuuuuuuuuuuuuuagaaagacagggucuugcuaugcugccgaggcagguguugaacucagggcuucuagcaguccucccaccuuggccucccaaagugcuggaauuauaggugugagccaccaugccuggccuccuucuuucugaagacaauaacauuccauuguauggauauaccaaauuucuuucuucuuuuuuuuuuuuuugagacggagucucacucuguugccaggcuggagugcaguggcgcgaucucggcucacugcaaccuccgccucccguauucaagugauucuccugccucagccucccaaguagcugggacuacaggcacacgccaccacgcccagcuaauuuuuguauuuuuaauagagacgggguuucaccauguuggccaggauagucucaauuucuugaccuugugaucugccugccucagccucccaaagugcugggacuacaggcgugagccacugugcccggccaccaaauuucuuuauccauucaucuguugaugaacauguagguugcuuccaccucuuggcaguugugaauaaugcugcaaugaacaugagugugcaaauaccuccuggagaguguauuuucuuuuucuuuuucuuuuuugagacggagucucacucugucacccaggcuagagugcaguggcgcgaucucagcucacugcaagcuccgccucccggguucaugccauucuccuaccucagccucccgaguagcugggacuacaggcgcccaccaccacgucuggcuaauuuuuuguauuuuuaguagagacgggguuucacuguguuagccaggauggucucaaucuccugaccucgugauccacuggccucagccucccaaagcacugggauuacaggugugagucacugcacccggcuggagaguguauuuucaauucuuuugaguguauaccuagaagggaaauugcuauauuauguaguaauuauauuuuuaauuuuccaaaaaaauuauuuauuauuagaauaaaauauagagacaggggucucgcuauguuggccagauuggucuugaacucuuggccucaaacaauccuccugccucggccuuccaaagugcuaggauuacaggugugaaccacuacaccugaccauauuuuuaauuuuuccuuuuucuuuuuuuuugagacaagagucuugcuguugcucuggcuagagcacaauggcgugaucacggcucacugcaaucucugccucccagguucaagugauucucuugccucagucucccaaguagcugggauuacaggcgugugccaccacaccuggcuaauuuuugcauuuuuaguagacagggguuuuaccauguuggccaggcuggucucgaacuccugaccucaggugauccgcccgccuuggccucccaaagugcugggauuacaggcaugagccccuaaucuccccuucuuauaagcauaucaggcagauuggauugggacccacccuaacagccucauuuuaacuuaaucccuucuuuaaaggcccuauguccaaauacagacacacucuaagguacugggguuagggcuucaacauaggaauuggggagggaagcacaauucugcccuuauagggacuguacaggacuguacggggacaggaacaagggacaagguucaaacuguggcacagacccuucaguugaaaaccccuuuagugaaagcagcacccagaugugugccugaccccagagcuuuccuagcucaggguccugucggcugguagagcuuuuccacugagacaggaaguuguuucuagccacaagcagaucccugauuuccuaucuuacaccaacaaguacagacauaaaaaguggaggcaguuggccgggugcgguggcucacgccuguaaucccagcacuuugggaggccgaggugggcggaucaugagcucaagaaaucaaaaccauccuggccaaaauggugaaaucccauuucuacuaaaaauacaaaaauuagcugggcgugguggcaugcgccuacagucccagcuacucaggaggcugaggcaggagaaucgcuugaaccugggaaguggagguugcagugagcuggaucacaccauugcacuccagccugggugacagagccagacucugucucaaaaaaaaaaaaaaaaaguggaggcaguuuuaggagugaaucucuaaagaagggagcuguuugacagaggaaaggagaaaagaggcaugggcuggaugcgguggcucacgccuguaaucccagcuauuugggaggccaagguggguggaucacuugaggucaggaguuugagaccagccugaccaacaugaugaaacccugucucuacuaaaaauacaaaaauuagcugggcguguuggcucacaccuguagucccagcuaaucaggaggcugaggcaggaaaaucgcuugaaccagggagguagagguugcugugagccaagaucgugccacugcacuccagcuggggagacagagugagauuccgucucaaaaaaaaaaaaaaaaggcaaugguaggcugggcacgguggcucacaccuguaaucccagcacuuugggaggcugaggcuggugaaucacgaugucagaagaucgagaccauccuggcuaacacggugaaaugccaucucuacuaaaaauauaaaaaaauuagccaagcgugguggcaggcgccaguagucccagcuacuugggaggcugaggcaggaaaauggcgugaaccugggaggcacagcuugcagugagccgagaucacaccacugcacuccagccugggcgacagagugagacuccgucucaaaaaaaaaaaaaaaaaaaaaaaagcaauaguagagaugagaaugaaauaaauggacaaccccaauaagugucaccugggucgccagagugaugccaagucccauacaagugaccucaugcccaugcucaccuucuugcugggccacgguacaguaauaggaggaaggguggucagagacuaaggucaagcgaauuaacaagguagcccugguucaggucccugauccacaacuuccuggcuguguggacgugggugaguccuaacccucccugagucucuucugagaaaugaggguaacaguaccuacuucauaagguggguagcugugagacuaaaugauaucagagauguagaguccacagccaacacuugguaaccccuggcuccaguuuucccaaacccacauaugagcaccccucucucuuuaaaguccuccccugaugcuggcuggcugcaucagguuucccacguucaaaaacaggccaaaguguccugagcucugcugaagucuuugcccccugcugucagccgggccugccugacucugacgaugcuacuggcuuaggguuguggcagugcuggguggggugugguuugaggggugcaccgcugcagcagcuccucuugucccgaguccauguccagaaccccuagugaggaagaaguuuuaugguccagaguggccagcgugggaggggagacagcaacuccacacucagccaguaucccucugggcauccccggccuccugauuagagcuccugaccuccucuucugacaagcaaagaaagcucagagcccaaagcaggacccaggccucggccaccaucugaacucagaggcuccagcacaaaucccacgccugggccugcucaggccccugaucagguauagucggaaacucuggagaaaguccguuucugcugaggcagcaggauccugaccaacaucgaagagggaaagauccaaugagcccgugagcuguaagaaggucagcccaggggucaccucagcucugcuccgccacucucccaugcuagggacucaggauuccugcccgcucaccuauuucucuggcuugaauaaaucacgggcacuugggcccagggaggggggauaacucagaggcagagaauccuuucugccugagagacaggacucacagccccugcagaccuccagagcuggcccuuuuccccaacucccucucugcccauaacuugggcuucucacccaauuuggcucccuggccucuggccaggacccacccccuuccuuuucuuuucuuuuuuuuucccccuuguuuuucuugcaugcagagguacaggaacagcgugagcagugggccugggucucaagcccacacuuccuuuggugacagcugagggugacauauggaacuuauaaacaaaacccagaacuacccaugccucuccccauccccucuugaaagcugcugcgcuucccccucaccaacccaccccgccugggacucucagcaaagacuauagcaccagacuuuuuuuucugagacggagucucacucugucgcccaggcuggagugcaguggcacgaucuaggcuuccugcaagcucggccucccaguuucaugccauucuccugccucagccucccgaguagcugggacuacaggcacccgccaccacacccggcuaauuuuuuuguauuuuuaguggagaugggguuucaccauauuagccaggauggucucgaucuccugaucucgugauccacccgccucggccucccaaagugcugggauuacaggugugagccaccgcgcccagccagcauuacgcauuuucauuccagaagaaccugccucucucccaugaaauaucccuugaauucccuggccccagagaggcugggagcccugccgaugucucuuuaggcaccuacaggagaggaaaagggccuggacacugggguggggcagggcucagugagacagucaggccaaccccaggaagccagggagauccuggaugugaacauccaaccaguc

SEQ ID NO: 16865 - RNA, 1602 nt, Homo sapiens
agugaaauggccauccucuaaacuggguaccucacugcacagcuucuagguagccuuccaacuuaaucuaacuugagccucacaguaacccuguaaaguuaguagagcuuguucuuguauugugaccuuuuuuaaaaaaaaggaacugagguucagaaugauuaagggccuggcccccaggguuguccagcuccauaagguggagcugggcaagauuuuggguuugcugcucccugaagcuggauucuuucauacgauacucuuucucaagaagggggcucccugggaucuccagguguacugcacuuacccucaauccagccccggagaagcaagugaaaagggugggucccucauaggcuagaaugugcagcucuuucuccaggugggauguagcaccccgaaguagagcuuucugcucugcuccuggaaaaggcuagggagcuggggcuggggcuccccucccaugaccaggcaguggucaccccaugggacaggcacagcuacuuacgcgaacacagcagguugguguggcuggcuaacuaggaccucucgaaagucucugugggggcaugagggagaaaaggccauugggagaauuacugccuuuacuuugggacuacuuuuaugcugauaacuugggauuucuugauaguccuucaccccugaaaccccguauuuacuuaacaagauuuagcucuuaguucuucaaguaaaauuaaagucucuuguguaagagccaacacaugcccagcugcggaugggagcuguuccuggacagccuucuacugccugggaagugauggaacaggaacucagggugcccuuacccccuccccagaccuguucccuuucuuugacugacagagcaccauccaggcaaaauuagagcgccaaaugguuuucuucucaaucuuaaagcaguauaccuuuccacaggcucgucugugucccugccacucugaguuauccagaaaccaccaccuacaaaugaggggacucaucuagaagaccucuaagguccccuuuuggcucugaggggucucuaauaauccccacuuggaauucagcaccgcaaggaaauuauggguaugugagccauaauaugaugggcagcagguggcgcugccuuccacccauggugauggaugguuuggaaagggaauguuggugccuuuugugccacaaguuaagaugcuacuguuuuaaaggaaaaaaaaaaaaaaaaguacugaucuucaauaugaagacaugagcuuuucucgcaggaaauuuucuuuuucacagaacuggugucaggaaucacugaagggcuaaccgugauaguccuugcaaguaagucaagguuuuauccugauuggaaauagaagacauuuccgguugagagaacagauucguuggaagcuuaacuuuuguugccucuuaacgccaccaaauuuuaggguaauuugauuaugaaagagugaauuuuucuggacagaaaagggagagcuaccaaauuguuuuuuucuuuuuaaaaggaaguuuaauguccguuguaucacaaaucaguguuaaaacaccagaacuuuagccaaaauaaaugucuuacauuacaaaggu

SEQ ID NO: 16866 - RNA, 1668 nt, Homo sapiens
agcccugaacaaccaguaugugucuucuucuccagauagugaaaaagguguccagauaaacccaccuaagugaaauggccauccucuaaacuggguaccucacugcacagcuucuagguagccuuccaacuuaaucuaacuugagccucacaguaacccuguaaaguuaguagagcuuguucuuguauugugaccuuuuuuaaaaaaaaggaacugagguucagaaugauuaagggccuggcccccaggguuguccagcuccauaagguggagcugggcaagauuuuggguuugcugcucccugaagcuggauucuuucauacgauacucuuucucaagaagggggcucccugggaucuccagguguacugcacuuacccucaauccagccccggagaagcaagugaaaagggugggucccucauaggcuagaaugugcagcucuuucuccaggugggauguagcaccccgaaguagagcuuucugcucugcuccuggaaaaggcuagggagcuggggcuggggcuccccucccaugaccaggcaguggucaccccaugggacaggcacagcuacuuacgcgaacacagcagguugguguggcuggcuaacuaggaccucucgaaagucucugugggggcaugagggagaaaaggccauugggagaauuacugccuuuacuuugggacuacuuuuaugcugauaacuugggauuucuugauaguccuucaccccugaaaccccguauuuacuuaacaagauuuagcucuuaguucuucaaguaaaauuaaagucucuuguguaagagccaacacaugcccagcugcggaugggagcuguuccuggacagccuucuacugccugggaagugauggaacaggaacucagggugcccuuacccccuccccagaccuguucccuuucuuugacugacagagcaccauccaggcaaaauuagagcgccaaaugguuuucuucucaaucuuaaagcaguauaccuuuccacaggcucgucugugucccugccacucugaguuauccagaaaccaccaccuacaaaugaggggacucaucuagaagaccucuaagguccccuuuuggcucugaggggucucuaauaauccccacuuggaauucagcaccgcaaggaaauuauggguaugugagccauaauaugaugggcagcagguggcgcugccuuccacccauggugauggaugguuuggaaagggaauguuggugccuuuugugccacaaguuaagaugcuacuguuuuaaaggaaaaaaaaaaaaaaaaguacugaucuucaauaugaagacaugagcuuuucucgcaggaaauuuucuuuuucacagaacuggugucaggaaucacugaagggcuaaccgugauaguccuugcaaguaagucaagguuuuauccugauuggaaauagaagacauuuccgguugagagaacagauucguuggaagcuuaacuuuuguugccucuuaacgccaccaaauuuuaggguaauuugauuaugaaagagugaauuuuucuggacagaaaagggagagcuaccaaauuguuuuuuucuuuuuaaaaggaaguuuaauguccguuguaucacaaaucaguguuaaaacaccagaacuuuagccaaaauaaaugucuuacauuacaaag

SEQ ID NO: 16867 - RNA, 1214 nt, Homo sapiens
auacauuccguuucuguggaauuugcucuuuauuuugggaccagggaaggaccacacacagcccuccagcccagggggcgggggcaccgagacgcgggcggagggccgcacccgaacccugcccagacgccgccgucgggaggcagaauccggguuucuggggucgggagugcguaugcaaaugacgugggcgugguuggcagaucucccaggaggccucagggguccucaccacaggucugggcccuccgaccugcggaagcgaaggggaaggaauuggaucuggggaggcgagccugggagacgucguuaagugauguugccaggguagggccaggccgcgcucucggaugcaggaugugugguaacgggcgcuuuuaccgcgaccugacggggcgguccucgccgucggggaagaacguuuuggaaagaagcguguccgggccgucucuuuucccauaccugggggcggggaagggaagagcguggucagaucuggccacgcccccagguggagcggggccgcagggugagagccccaggggucccgcuccgcgccugcgcucaccgcugccgggugaccagguugagguaguggcgcagggaggcguaguagcgguucagcuccuccggcgaggcgucuucgcggggagccucggguuugaugggguaggcgucgaccagcgccccuaggcagacgagcagggccagaagcacuguggucaaggcgggccacggccugcgcacgaacaccaucugggaaggcgacauugggacgugggucauuccaagccucgacccuacacggcgggaggcugcggcugccgucggggccgcgcuccgacgcucucccuggggcugguaccggaccaaggcucagccaccgggcuugcuguguguucuugggcacugcaccgucuccugacucaguuuccucaugucagaggagcauaagcccugccugccuccccacccccacccccgcugcuggccuccuucccaccuccgauggcccccuccaauccaguuuccuaccacucacccccagcuuccaccaucccagccucaguuuccccacaaaacagccuggguuuccccaggcuugagcccccagccacucacagcgauagcuugugaagcagacgagcaggagguggaaggcgagggaagucccaagggcugcacugccgcaggucaagcugaggccuccucug

SEQ ID NO: 16868 - RNA, 486 nt, Homo sapiens
uuccguuuccgggucagagccauggugguggcaacuucaagcccugcuaaccccaugguguucuuugaugucagcaauggcagucaggaaguuggccgcacaaagaucgagcucucugcagacguugugccuaagacgaccgagaacuuuggguaguucugcacuagagaauucagaaaagaugggguuccaauaggauacaaaggaagcacuuuccacagggucauaaaggauuucaugauuuaggguggagauuuuguuaauggagaugguacuggagucgccaguauuuaccaggagacauucgcagacgaaaauuuuaaacuuagacacucagcuccaggccugcuuuccacggcaaacagcggucccaguacaaauggcugucaguucuuuaucaccugcucuaagugugauuggcuggaugggaagcauguaauguuuggaaaaaucacugauggacuucuagugaugagaaagauucag

SEQ ID NO: 16869 - RNA, 5031 nt, Homo sapiens
gcagguaaacgguccgccacugaugccugggucuggcugugagcccagccuagaaagggagcuguggguggaggcacucacaggcaaggggagcuggggcugcuguggccuggucuguggaagggaggaugcuuccuaaucucugggagggagaugguggcagcauucaucauagaagucuucuacucccuccaggaguccccugauuccccagcccucaagaucuugcucccagccuguaauccuagcauuuugggaggccaagcagggaggauugcuugagcccaggaguuugagagcagccuuggcaacauagugagaccucgucucuaccaaaaaaaaaagauccagguguggcggugcaugccugugguaccagcuuauuuaggaggcugacaugggaggauugcuugagccugggaggucaaggcugcagugagcugugauugcaccacuguacucuagccuugguaacagagcaagauccugucuuuaaaaaaaaaaaaaaaaucuugcucccacggggucacuucuaauuuucuuucaaguguaagcugacucucagacaaguauuugcauuuuaaucaaggccuccugaaaaacugcaagacccaaaggaauuaaaaugaaugguagaauaucacgcaggcagggguauuauuuuggguaagggagccucaaaacauagcacagaggcacagaaacuagcucacccuuaggguuaguccugaguagagcccuggaaggcacccuccccuccccuaauccccagguugaaaaucgaaggccauuugguuguagcuuuagagugagucgaguugggguccuagacugguccccuucuuuccugugcuugucccacuucagcgccuccucugggcagagcuggggcugcuuucuccucugcagaucacucagccaacaagcccccuucagccuguggcuggcugccuggggucaugcccagcuggcauggcuuuugguccacccuggccauuccagggccuguaguguccauggugagggucagcugccugggucagaagcuggcuugugaaaggagucuggcagucccuuggcgugguugaccaacucauaggagucccggauaucagccaggccaaaccagaagaagauccacugcuuguuggagaagcugccaucacuguguuugaaguaccuggguguggggaggugauguaggaaacaguuuuuagggcaaggccaguguucauuacucacugguucugucuuuaaaaaacauugauugaggaccuacugcaugcugggcacccagcuugguccugcuguguguuaucucauuuuauccucacagcagaggccugagccuggcauugugaugcucagcucacagagaagcagcuaaggcucagagaaguuagguaccuugccaggcgcacacaggaagggagcgggugcuuugcucuccacacugccuuggcugugcagcaaagaggaggguucuugcucacuuccuagugcucacagagcaggguguaggggugaggggguaguuacugaaggagagaggagggauguuccacuggaggcgccgcaggccuccaauagacccugaaggguuaggauuccucaggccccugugagaggugggcugcguggggcuuaggaggugucacuugcugccagaaaaggaguguuaagcaugcuuuaacucgggaaaucucaggcuuucuguguguucugccccugggagguagugaaagggagaccaguggaagaagaggaagcccagccuucuuggcaugguuggcaagggugggagaggggagggaagucagggcccagcccagagcugggaguggcaggaccuaccagggauugaugggguuggugacccgggagcgccagaaaagugucugaaggucccgccgcaggcacucccacagcaucuggccggagccuuggcccuggcggcuggagcucaccacaaauuuguccagguacggggugccccccaggacgggcuccauggucagaauggcggcggcguuguaccuggcgcagcgggagagcggcaggcugggaccucuccuugguccgaagcugcccgacugccccccagaccccgcccucugggguccgcaggcuuaccccucggagacguagauggagugcagccgcgggcgcagcgaggccagguagucgucccugagcuucuugccgaagcuggcguugaccagguccacuagacggcccugguccagcuuguccaggcugcgcacccguagcauucgcucggcguucuugaacagggucccggacccuggaggaggauggggaggggcuagucuggcuggagggccguuugcgcagccugguggggacugcagguaggacaggcgcuggugggacaauuuccgucuuugggagaccuccacagugaaaugauuucaguggucugcauagauuugucugugauuuucauucaaggagaugcuuuccccaggcagagauugugccccaaguuccuccugucgccuggagccccacccacuuccguuagucuugccucgcuccuugaagucugucucccgccgcugacccggcccacccaccuaagccccgcccaucucucccggucgaacaccucccuuauggucccgccccuggccccgcccaccggggggccccuccuucuccccccuagucccgcccauuccuuuaauuccuucggaguucccuuccaguacacugggucuccuccucucucaccucccccggguuucggcagcagcaggagccauugcugugacaccccccgccucccccuacggcuccuggacaggaggagaagccgcuccuccugaccgcagacacccagccccggccaguacucacucccgggacccaguccccggcccgcccaccgcccucacccuuguugcuaaagagcucagugagcagcgugcuagcggcggugaugacggccgaggagugguggggcaggcggcugagcacguccacgaugagccgcaucugcugccguucuuuugugcucacccacucggcguugcacaccagguccaggucggcgggcagguucacguuacucaggaccuguguccggagucagcgggugagccuggcccacagccggcacggacugccccccuacccccacggaccucucuuuucucugaccccuuuauccuuacuuccgcccggaguccuuagccagggagggcgcagaucugggcacccagggcugaacuccuccccuauacucccuuaggcuuuucuacccacccggcuugcuagugagucugcggcccgucggggagaagugcgaggggcgcaagagaaggcccggaucgccggcgugggggaaggugaaagaaagggccgcaccuuaugacugcugucgcgcaggccgccuguguuauugaggaagaugauuuuggugggccgcagcgccuuggccagcgacgcggucaccuccagggagucgagaagcacggagcggcgcgcggccgucuccccgauggggcacaggauggggaugcugcccgacuccaggcaccacugcagcaggucugucuccaccgagacgaugccgccguagcugugggccagacguggugcucgagagggcccccuccaggccugccggacggggcagggcgggcagaguagcacgcucugaggacgccugggcgggcagggcgggcacucaccuggcauggggagccggcucggcagcgcguagcacagacccgccgccaaaaaauggcacagcagcggcggcguugugucgaagcgcgucuaccagcaccuugcagcucuuggccagcugcgccuuggccucccagaaggaaagacagcccgagggagccguaggggccggcagccccaggaccaccagcggcuucauguccaugcgcugcaagaaggccagggcaaaggccagacuggauacgcccugcuggcacuugagcaccuccucguccaccugcggaggagugggcuuucaaggagcgugacacggaccugagccgcuggcucccacagccuggccugcagggccgucucggugacccuacccuuccagaagcugucaggacccaguucuggccaccagugcccaccugcuccgcccuuugccccguugggucuugccacucccuugucucacgcugggguaccucccgcccuccucccuccgaccuuggacuccgggacaucuuugggggaggggcagugcaagcggcuccuguccagguccuucugaaccccuaacugcgcccauguugggggccuucuucagagcaucacaccuggcggguggggucccccaggauccucacucgggcugggcgggaggcuuccggaggagcuuacggccucucccauucccggcggcgcuggucugggcccugccgggcuccuucccgcuuccgcugcgcagagcccgcagcguauccugccaugccugaggacagguggccgcacaaccccauccccucgcugcgucacggcccacgccgggcuccgcucaccucgaugacggcgaagggcuuguccgcggagugauggcaggucuggaacugcgugagccaguggcgcgccuccccagggcuggccccgcacugguucaggaaggccuggaugucccgcugcaccagcgagcggcccgaaggaggcucuggggacucguggggcaccgggggccugggacucggcacccacgacggcuccucggcgacgggcgacugggagacgucguccgcgcccgcguacuccucgggcgggggcuggggcugcgaccaggcggugcugagccggcgccccgggcuggugccccucgccgcccgccgccgcgcgccacagcucagccuucgggcgcccccagugccuccccggccucucagccucggggcuacagcagcugcccgcagaaccacagccaucagcgccgucgccaugacgacaaccaacucuugccccccaagaguggcagucugucuggagcgucuggcacuggggggcucu

SEQ ID NO: 16870 - RNA, 3828 nt, Homo sapiens
ucccauccccgcgccugcuucucugacuggggugaggccgcagcggacugcccuuucccaagauggcgucgaagauagguucgagacgguggauguugcagcugaucaugcaguuggguucggugcugcucacacgcugccccuuuuggggcugcuucagccagcucaugcuguacgcugagagggcugaggcacgccggugagcaggccuacgcagccgcuaaacgcggcagggggcggugaugugggcaagaaauugggggcuagaagucgggacccuugaacugggaggaauugggaccucccugggagggguucuggucugggugucggaccaaaucugguagggcgguccugcccaugggaggggagucugguuugggggagcaguggagccugugggaacucaaggggucucaagcuucuucccccaccgcuucauucuguccucguugcuuccccacucccggcucgcaggaagcccgacaucccagugccuuaccuguauuucgacaugggggcagccgugcugugcgcuaguuucauguccuuuggcgugaagcggcgcugguucgcgcugggggccgcacuccaauuggccauuagcaccuacgccgccuacaucgggggcuacguccacuacggggacuggcugaaggugagcgccucggccccaaaagggucuucccucugggugacggggaaucagaggccaaugcccagggcuguuggugggcgaugaauggugcuggccagcugcacagugugaagccugggagguucgaaccccuuggcuuauggagauuacagagcgcagaaauggaucuuagagaccacacaaacuuccucuucaaaguguggaaacugaggucuagagaugggaaacagacuuucccaaagccacaauacaggauacuggugggaccagaaccccggucaccugguucccagaaucuuuuaaacuguuaguuuaguaaucucagacucaugggguacaaaggaccuuggagaguaccuaguuuucauaaaauaaauuuuaugaaaauguaauuacuguuaguauagcauuuaagccagaaccugugccaggcccugcaggcuggagauaagguuggacaaaggcacuguccuugaggaagagacugucagacccuuaggggaggaagaugugugaacagcuacagggcagcaagaucaauguuuuuguggcauagaucccaugccauguagaauaaagaacaccaagauuagagucuacagaucugagaguggggaagggagaaacacauugugucuggguucugccacuuacuggcagguaggaccugccaguuuucuuuuuuguuguuguuuuuugaaacagagucucucuccgucgcccaggcuggagugcagugacgcugucucaacucacugcaaccuccgccuuccagguucaaacgauucuccugccucagucucccaaguaguugggauuacaggcgcccuuccccacgcccgacuaauuuuuguauuuucaguagacaggguuuccucauguuggccaggcuagucucaaacuccugaccucagggugauccaccugccucggccucccaaagugcugggauuacaggcgugagccacugcgccuggccagaccugacaguuuucuuaacccucugggccucaguuucuacuucuauauauauauaaaaagaaugaucugucucuguugcaccugcccaccaagcuuggaaauguaagaggguucaucagauggaaugggauguguagagaggggugguucuacacucugggaagccaggagagauguggcggcugcaguucuugacugggguccccuuaccccggccuagguccguauguacucgcgcacaguugccaucaucggcggcuuucuuguguuggccagcggugcuggggagcuguaccgccggaaaccucgcagccgcucccugcaguccaccggccagguguuccuggguaucuaccucaucugugugguauguugggggacuguugguuggaggugccuggcugggagugaacugugagucuaggcauggcagaaccccaggaagguagacacagaacgaggcccugagugcaguuccugauggcccaguucccugggaauugcccuggccagcuucuaggccucaggggcccuccaaaugccuguugagaggcccuuccuccaacaguguugccacgagguagacuggccauuaaauuucaacccugagagccaggagaacaagauggggugauucucucauggcuccagcccccaaaggacuagaaggggauaaaggagagguuuggugggggucaggccccagcugggacucugcccccuagagcugaugagagcucuaggguagccacuuaugguucucccuggugcuaggggaggccagggugacuggagacauggacaggcgccaggccauuaggucuuaucuuaauuaccgaguauaucucuguacagcucucugugugggcucccauauucagaggugggagcucuagucugacuguggaaauacacuuccuucauagccccuagggugaggggagacaugggcccuaaucuccuggggcuccauaguccgagggggagacaaaggcccuacuuucagagguuccccaguccaagaggggagucagaagcccaucugcagggacucauuugcaggugccaucucaggggugguuuaccccagacaggcuucugagccuguuggagagucuuagaggauguuaugucuccaggccuacucacugcagcacagcaaggaggaccggcuggcguaucugaaccaucucccaggaggggagcugaugauccagcuguucuucgugcuguauggcauccuggcccuggccuuucugucaggcuacuacgugacccucgcugcccagauccuggcuguacugcugcccccugucaugcugcucauugauggcaauguugcuuacuggcacaacacgcggcguguugaguucuggaaccagaugaagcuccuuggagagagugugggcaucuucggaacugcugucauccuggccacugauggcugaguuuuauggcaagaggcugagaugggcacagggagccacugagggucacccugccuuccuccuugcuggcccagcugcuguuuauuuaugcuuuuuggucuguuuguuugaucuuuugcuuuuuuaaaauuguuuuuugcaguuaagaggcagcucauuuguccaaauuucugggcucagcgcuugggagggcaggagcccuggcacuaaugcuguacagguuuuuuuccuguuaggagagcugaggccagcugcccacugagucuccugucccugagaagggaguauggcagggcugggaugcggcuacugagagugggagagugggagacagaggaaggaagauggagauuggaagugagcaaaugugaaaaauuccucuuugaaccuggcagaugcagcuaggcucugcagugcuguuuggagacugugagagggagugcguguguugacacauguggaucaggcccaggaagggcacaggggcugagcacuacagaagucacauggguucucaggguaugccaggggcagaaacaguaccggcucucugucacucaccuugagaguagagcagacccuguucugcucugggcugugaagggguggagcaggcaguggccagcuuugcccuuccugcugucucuguuucuagcuccaugguuggccugguggggguggaguucccucccaaacaccagaccacacaguccuccaaaaauaaacauuuuauauagacau

SEQ ID NO: 16871 - RNA, 6681 nt, Homo sapiens
ggccacguggggcccugaggaaacgccuuuacaaagguuuguccccugcgcugcccaguagggaggaaaaccggaggagagcgcaggaggaaacaguaccggcuggaggccggucuugcaggagcgggggacugcugggggcggggcuugguggugaccgcuggcggggcggggccuggggcucagaggggugggcuuuggagaucagagggucgacgcugcuucguugccuggacucugguuuccgcccuggagcaagccggggccuggucggcagcugggccgccauggaguccacgcugggcgcgggcaucgugauagccgaggcgcuacagaaccagcuagccuggcuggagaacguguggcucuggaucaccuuucugggcgaucccaagauccucuuucuguucuacuuccccgcggccuacuacgccucccgccgugugggcaucgcggugcucuggaucagccucaucaccgaguggcucaaccucaucuucaaguggugagacagagaagcccuccggcauccugguccccacccccgagggcccugagucauguguaagcccuggucucuuucagcaacugucucaagggccuucccaccccuacucuguagucccugauuuuuuuuccccuugagcaucuuugugcagcuuggacucaaaccucagaguccaaccauccuacucauuagaccaguguucuucaaacuggucugauggaaaaaucaccuaaggggcgugucuaaaauguaaauaucccauccucaucucacacuuacuaauuuagaaacuccaagggguugggaauuuauuuuuuauuuuuuauuuuugguuuaugggaauucauauuuuaacaaauauggugauuuaaguaguggagaguccuaccucucaacucacuuuuucauucauguauucauucauuugcuauaauuuuucagaagcaugcuuugugcugggcaucacgguagcugcuaaggacagagacaccuugcagauuaagguguggucccuggaccaugcccaacggcauaggcagcacuugaaaacuggcuaaaaacgcagacucucaggccccgggccagagcuacugaaucaaaaucugcauuuuaacaagguucccaggugauucccugugcguaugcaguaaaguuugggcuaaagcacugcuuuccagggaacacuuucucuucuuucucuuucauucaccaguagacucuucacacugagacuuagaagccaggaaucccagggacauggguggaggcccuguggccccuggggcugggcaugcagccacaccucccuucaccucagccucuguugccagauccucagccugggggaaggaagggaggcucauaggagguauuucaaugagcuggaaugacuugcugaaaaacaacauagaguuccccucccuuccacucuuuuccacgagggccucauccuuauguaaagggaaccacagugaucuguucacuucuuucuugccuaauugcccuuugcuuugugcucuccucucucaaagucuguauaagccucccccucuauuccuugucccccaaagaucacaaucuccuucagacacuauuaaugucccccaaguggcaaagucccuauucauuuucauuuucucuuuuuuuuuuuuuuuuuuuuuugagacggagucucgcucaguugcccaggcuggagugcaguggugcaaucuuggcucacugcaaacuccgucucccggcuucaugccauucuccugccucagccucccaaguagcugggaucacaggcgugugccaccacacucggcuaauuuuuguauuuuuaguagagaagggguuucgccuuguuggccaggcuggucucaaacuccugaccucaggugauccgcccgcuucagccucccaaagugcugggauuauaggcgugagcaaccuggcauucuuuuuuuuuuuuuuuuuauucuuuuugagauggagucuugcucuguugcccaggcuggcgugcaauggcaugaucuuggcucacugaaaccucuuugucucucagguucaagagauucuucugccucagccuccccaguagcugugauuaucggcacccaccaccacgcccggcuaauuuuuuauuucuaguagagacaggguuucaccuuguuggucaggcuggucucaaacuccuggccucaagugauccacccuccucugccucccaaagugcugggauuacaggcgugagccaccgcgccuggcaccgccguucauuuucugugugagcacuuguuguauauauacuaggcucaguuuucagaggggagaggcaagugccuucuguauaucccuccccagcacguggcuuccugccagcaucucuuuugcuaucccaucuuuucucuuucuggccacagcagccucuucauugugugguucccagggcccagccaagcacuugcuagaccagaggauuuugacauuuuuuuguccuccuuauucuuucucagccuucucuguccauuucccacccccauuuucagaccugagaggcucaccuaaauaauuuagguguggauaauucaggcuguaacuggggacauggaggcagggguagcaggaggguuagugagggccuggaggagagagcuggguccuggacucucuguggaugauaagagcuggccuugcagugagaggggguagagugggacggcugaguaucucagagcacacacacggcuuaccacaaucucuugccucuguaucaguuuuauuuuuuauuuuauucacuuuuucuuuuuuugagacaggaucucacuccaucaccaggcuggaguacaauggcacaaucacagcucacugcagccucaaccuccugggcucaagugauccuucccacuucagccucuggaguagcagggacuacaggcacaccccaagaugccuggcuaauuuuuguauuuuuuguagagaugggguuuugucauguugcccaggcuauucucgaacuccugggcucaagugaucugcccgcccagccucccaaguagcugagacuauaggugugcaccaccacuuccagcuaauuuuuuguuuuuguugaaucugggucuugcuauguugcccaggcuggucaugaacuccuggcuucaagugauccuccagcuaaggccucccaaaguacugggauuacagucaugagccacuguaccuggccccagacuaguuuuuaaaaauaguguuuccacaggcugaggguuaggaaaaaaaaaagaaaagaaauagugugcuuucuuucuccuguucuaagguagaaaaccauggcaagguauccauggauaccuugagagcaguggacagaaucguagucccuuuuugacuucaccccucaggcccuccagaguacucuguguccugcccgccuuguacccccccuggcugugugugcauguggaaagucaucuugcaucuguucucuuccagguuucuuuuuggagacaggcccuuuugguggguccaugagucugguuacuacagccaggcuccagcccagguucaccaguuccccucuucuugugagacugguccaggugggaagccucaaacauucucccuuucccaaugugguuaggguucgggugaacauuucagaguacuuuucagccuggguggcccaaccaaaggaccagccucucaauuacuggcgcagagaacaaaagaaccccagggagaccaagcugaguuaugggaggagggcacucaugcuauguaccagcugcccaccuuguauagaggacagccaagagacacagaucaggacagaaaccugagcacagugaccucaaguggcaguaaaaaggccucagagcagagcgaguuaugaaucagugcuggggaaaagcucuucucagccaggaaaggcagcuguauuauugaggcaucaccaggggccccgggguucugccuccaucuucucaccacgagcuucuggauuugcuggcaggcagcccuucuggacacugcaugaucacaggagcagcccucuggcccauaaugacggcccugucuucgcagguggccacucgggcccgcagguauacccuuggcauugcccaccauugggagcaggggugauggcacccuguaccuaauagacacagcagcauggcagccugggagcuggaguuuuggggacccuagguugugugguucaaccauggaguaccugggugcugcaggaggccaagcuguguauggacacgcucugagcuccuugccucucuucuuucuagccgcuggguaagggugaugccuagccuggcuuauugcaccuuccuuuuggcgguuggcuugucgcgaaucuucaucuuagcacauuucccucaccaggugcuggcuggccuaauaacuggugagcaacuggggcaacgggguggacugagaggaugccuuuggcagugggaggaucagucuaggaucuucccaucgcucccagcuucuguagagcccaccccagaggccccccguuaugucucaguuuauucucuugccaagcugcacugcagcugggggucgggguggggagggucauauccccagacuccuugaagcuguugucacuccacucuccuaggcgcuguccugggcuggcugaugacuccccgagugccuauggagcgggagcuaagcuucuauggguugacugcacuggcccucaugcuaggcaccagccucaucuauuggacccucuuuacacugggccuggaucuuucuugguaagucucgcuuugaagccugggcaggcugggcccuguccuaucucgccugcaccuagccuggugugucucugguucauuauagcuaaaaaaggacacauuaccuauucacauagacccucacaggcacaaaacagaacaugggagugggccccaagggcagauggccaagagccaguggccuucuauguuccagccucuccuggcaagaacucuucuuccccacagguccaucagccuagccuucaaguggugugagcggccugaguggauacacguggauagccggcccuuugccucccugagccgugacucaggggcugcccugggccugggcauugccuugcacucucccugcuaugcccaggugcgucgggcacagcugggaaauggccagaagauagccugccuugugcuggccauggggcugcugggcccccuggacuggcugggccaccccccucagaucagccucuucuacauuuucaauuuccucaaguacacccucuggccaugccuaguccuggcccucgugcccugggcagugcacauguucagugcccaggaagcaccgcccauccacucuuccugacuucuugugugccucccuuuccuuucccucccacaaagccaacacucugugaccaccacacuccaggaggcagccccauccccuuccagccccuaaguaggcccuccccucccuaaaucugcuuccgcaccaccuggucuuagccccaaagaugggccuucucucucccagauaaguugguccucccucugccuuuccucucaagcccccaaagagcaaaggcaacagcaagaccagcggguucuugcaacacugugaggggcagccagggcggccccaauaaagcccuugaauacuuugagauuccuuucuugccuaugcgcacaucuccaugggccuugccugugugugcacaaguggaaccuuugccaggcugcuccaguagucucugugccaucuccagcccuguuuccaggggcagagaggcaggaaaggagagggcuguaaacucaggugagaccucucagcccuggguccccugccucaucacugccuaggccacaugagaggucccaugagaugcugugacuauauucgguauaacccugucuuuucacuuacaggacagaucuugcgccccaaccuccaguuuccuaaaucggcuucuaguccaggggcuggagaaaagaguaguguguuuggcuaggaaggaggaugagaaccucuacuccauuugggagcccagagaauagagacauuggccccagaaggcacugccagaaacaaguuuauuuacacaaggacacacaguguaacggguuacaaaauacuuaacugaaauccauauccagggagacaaagcaaggaguggguuuacaugagaaccagaccagccacagggagagaguggguaaggggccgggagccuggggcucagcacagagaggccuaguacacugagccuggccccauccccaucccccaggaggaucuaaaacaaacacacaagcacacuaugaaccgauggugcugggacuccugccccuccccuggcucccucaauccugcucaggcccccauaggauaauaaauauguaaacagauugguggggcccuggagauagaaggagagaaaguauaugugguacuggggaggaggaggaaggaagagucagcccccuaggagccacuucccaucuuugguuuccuacaggcuggauggcauccccuggaagccuuguaggcccacagccccuggcagggcuccugggaaagagaagggacagcgcccagcccccuccuggucuuagcucccuugggcugguggucagcaaagggagcccagaagguauggaagcuccagcugagagccgacu

SEQ ID NO: 16872 - RNA, 6681 nt, Homo sapiens
agucggcucucagcuggagcuuccauaccuucugggcucccuuugcugaccaccagcccaagggagcuaagaccaggagggggcugggcgcugucccuucucuuucccaggagcccugccaggggcugugggccuacaaggcuuccaggggaugccauccagccuguaggaaaccaaagaugggaaguggcuccuagggggcugacucuuccuuccuccuccuccccaguaccacauauacuuucucuccuucuaucuccagggccccaccaaucuguuuacauauuuauuauccuaugggggccugagcaggauugagggagccaggggaggggcaggagucccagcaccaucgguucauagugugcuuguguguuuguuuuagauccuccugggggauggggauggggccaggcucaguguacuaggccucucugugcugagccccaggcucccggccccuuacccacucucucccuguggcuggucugguucucauguaaacccacuccuugcuuugucucccuggauauggauuucaguuaaguauuuuguaacccguuacacuguguguccuuguguaaauaaacuuguuucuggcagugccuucuggggccaaugucucuauucucugggcucccaaauggaguagagguucucauccuccuuccuagccaaacacacuacucuuuucuccagccccuggacuagaagccgauuuaggaaacuggagguuggggcgcaagaucuguccuguaagugaaaagacaggguuauaccgaauauagucacagcaucucaugggaccucucauguggccuaggcagugaugaggcaggggacccagggcugagaggucucaccugaguuuacagcccucuccuuuccugccucucugccccuggaaacagggcuggagauggcacagagacuacuggagcagccuggcaaagguuccacuugugcacacacaggcaaggcccauggagaugugcgcauaggcaagaaaggaaucucaaaguauucaagggcuuuauuggggccgcccuggcugccccucacaguguugcaagaacccgcuggucuugcuguugccuuugcucuuugggggcuugagaggaaaggcagagggaggaccaacuuaucugggagagagaaggcccaucuuuggggcuaagaccagguggugcggaagcagauuuagggaggggagggccuacuuaggggcuggaaggggauggggcugccuccuggagugugguggucacagaguguuggcuuugugggagggaaaggaaagggaggcacacaagaagucaggaagaguggaugggcggugcuuccugggcacugaacaugugcacugcccagggcacgagggccaggacuaggcauggccagaggguguacuugaggaaauugaaaauguagaagaggcugaucugagggggguggcccagccaguccagggggcccagcagccccauggccagcacaaggcaggcuaucuucuggccauuucccagcugugcccgacgcaccugggcauagcagggagagugcaaggcaaugcccaggcccagggcagccccugagucacggcucagggaggcaaagggccggcuauccacguguauccacucaggccgcucacaccacuugaaggcuaggcugauggaccuguggggaagaagaguucuugccaggagaggcuggaacauagaaggccacuggcucuuggccaucugcccuuggggcccacucccauguucuguuuugugccugugagggucuaugugaauagguaauguguccuuuuuuagcuauaaugaaccagagacacaccaggcuaggugcaggcgagauaggacagggcccagccugcccaggcuucaaagcgagacuuaccaagaaagauccaggcccaguguaaagaggguccaauagaugaggcuggugccuagcaugagggccagugcagucaacccauagaagcuuagcucccgcuccauaggcacucggggagucaucagccagcccaggacagcgccuaggagaguggagugacaacagcuucaaggagucuggggauaugacccuccccaccccgacccccagcugcagugcagcuuggcaagagaauaaacugagacauaacggggggccucuggggugggcucuacagaagcugggagcgaugggaagauccuagacugauccucccacugccaaaggcauccucucaguccaccccguugccccaguugcucaccaguuauuaggccagccagcaccuggugagggaaaugugcuaagaugaagauucgcgacaagccaaccgccaaaaggaaggugcaauaagccaggcuaggcaucacccuuacccagcggcuagaaagaagagaggcaaggagcucagagcguguccauacacagcuuggccuccugcagcacccagguacuccaugguugaaccacacaaccuaggguccccaaaacuccagcucccaggcugccaugcugcugugucuauuagguacagggugccaucaccccugcucccaauggugggcaaugccaaggguauaccugcgggcccgaguggccaccugcgaagacagggccgucauuaugggccagagggcugcuccugugaucaugcaguguccagaagggcugccugccagcaaauccagaagcucguggugagaagauggaggcagaaccccggggccccuggugaugccucaauaauacagcugccuuuccuggcugagaagagcuuuuccccagcacugauucauaacucgcucugcucugaggccuuuuuacugccacuugaggucacugugcucagguuucuguccugaucugugucucuuggcuguccucuauacaaggugggcagcugguacauagcaugagugcccuccucccauaacucagcuuggucucccugggguucuuuuguucucugcgccaguaauugagaggcugguccuuugguugggccacccaggcugaaaaguacucugaaauguucacccgaacccuaaccacauugggaaagggagaauguuugaggcuucccaccuggaccagucucacaagaagaggggaacuggugaaccugggcuggagccuggcuguaguaaccagacucauggacccaccaaaagggccugucuccaaaaagaaaccuggaagagaacagaugcaagaugacuuuccacaugcacacacagccaggggggguacaaggcgggcaggacacagaguacucuggagggccugaggggugaagucaaaaagggacuacgauucuguccacugcucucaagguauccauggauaccuugccaugguuuucuaccuuagaacaggagaaagaaagcacacuauuucuuuucuuuuuuuuuuccuaacccucagccuguggaaacacuauuuuuaaaaacuagucuggggccagguacaguggcucaugacuguaaucccaguacuuugggaggccuuagcuggaggaucacuugaagccaggaguucaugaccagccugggcaacauagcaagacccagauucaacaaaaacaaaaaauuagcuggaagugguggugcacaccuauagucucagcuacuugggaggcugggcgggcagaucacuugagcccaggaguucgagaauagccugggcaacaugacaaaaccccaucucuacaaaaaauacaaaaauuagccaggcaucuuggggugugccuguagucccugcuacuccagaggcugaagugggaaggaucacuugagcccaggagguugaggcugcagugagcugugauugugccauuguacuccagccuggugauggagugagauccugucucaaaaaaagaaaaagugaauaaaauaaaaaauaaaacugauacagaggcaagagauugugguaagccgugugugugcucugagauacucagccgucccacucuacccccucucacugcaaggccagcucuuaucauccacagagaguccaggacccagcucucuccuccaggcccucacuaacccuccugcuaccccugccuccauguccccaguuacagccugaauuauccacaccuaaauuauuuaggugagccucucaggucugaaaaugggggugggaaauggacagagaaggcugagaaagaauaaggaggacaaaaaaaugucaaaauccucuggucuagcaagugcuuggcugggcccugggaaccacacaaugaagaggcugcuguggccagaaagagaaaagaugggauagcaaaagagaugcuggcaggaagccacgugcuggggagggauauacagaaggcacuugccucuccccucugaaaacugagccuaguauauauacaacaagugcucacacagaaaaugaacggcggugccaggcgcgguggcucacgccuguaaucccagcacuuugggaggcagaggaggguggaucacuugaggccaggaguuugagaccagccugaccaacaaggugaaacccugucucuacuagaaauaaaaaauuagccgggcgugguggugggugccgauaaucacagcuacuggggaggcugaggcagaagaaucucuugaaccugagagacaaagagguuucagugagccaagaucaugccauugcacgccagccugggcaacagagcaagacuccaucucaaaaagaauaaaaaaaaaaaaaaaaagaaugccagguugcucacgccuauaaucccagcacuuugggaggcugaagcgggcggaucaccugaggucaggaguuugagaccagccuggccaacaaggcgaaaccccuucucuacuaaaaauacaaaaauuagccgagugugguggcacacgccugugaucccagcuacuugggaggcugaggcaggagaauggcaugaagccgggagacggaguuugcagugagccaagauugcaccacugcacuccagccugggcaacugagcgagacuccgucucaaaaaaaaaaaaaaaaaaaaaagagaaaaugaaaaugaauagggacuuugccacuugggggacauuaauagugucugaaggagauugugaucuuugggggacaaggaauagagggggaggcuuauacagacuuugagagaggagagcacaaagcaaagggcaauuaggcaagaaagaagugaacagaucacugugguucccuuuacauaaggaugaggcccucguggaaaagaguggaagggaggggaacucuauguuguuuuucagcaagucauuccagcucauugaaauaccuccuaugagccucccuuccuucccccaggcugaggaucuggcaacagaggcugaggugaagggagguguggcugcaugcccagccccaggggccacagggccuccacccaugucccugggauuccuggcuucuaagucucagugugaagagucuacuggugaaugaaagagaaagaagagaaaguguucccuggaaagcagugcuuuagcccaaacuuuacugcauacgcacagggaaucaccugggaaccuuguuaaaaugcagauuuugauucaguagcucuggcccggggccugagagucugcguuuuuagccaguuuucaagugcugccuaugccguugggcaugguccagggaccacaccuuaaucugcaaggugucucuguccuuagcagcuaccgugaugcccagcacaaagcaugcuucugaaaaauuauagcaaaugaaugaauacaugaaugaaaaagugaguugagagguaggacucuccacuacuuaaaucaccauauuuguuaaaauaugaauucccauaaaccaaaaauaaaaaauaaaaaauaaauucccaaccccuuggaguuucuaaauuaguaagugugagaugaggaugggauauuuacauuuuagacacgccccuuaggugauuuuuccaucagaccaguuugaagaacacuggucuaaugaguaggaugguuggacucugagguuugaguccaagcugcacaaagaugcucaaggggaaaaaaaaucagggacuacagaguaggggugggaaggcccuugagacaguugcugaaagagaccagggcuuacacaugacucagggcccucggggguggggaccaggaugccggagggcuucucugucucaccacuugaagaugagguugagccacucggugaugaggcugauccagagcaccgcgaugcccacacggcgggaggcguaguaggccgcggggaaguagaacagaaagaggaucuugggaucgcccagaaaggugauccagagccacacguucuccagccaggcuagcugguucuguagcgccucggcuaucacgaugcccgcgcccagcguggacuccauggcggcccagcugccgaccaggccccggcuugcuccagggcggaaaccagaguccaggcaacgaagcagcgucgacccucugaucuccaaagcccaccccucugagccccaggccccgccccgccagcggucaccaccaagccccgcccccagcagucccccgcuccugcaagaccggccuccagccgguacuguuuccuccugcgcucuccuccgguuuuccucccuacugggcagcgcaggggacaaaccuuuguaaaggcguuuccucagggccccacguggcc

SEQ ID NO: 16873 - RNA, 20555 nt, Homo sapiens
uggcggcgucuucgaaugcggccuaaggcgccugccgccagucuccuggcgacuuucccuauaucgcagagacucaucccucugaccccagcccggaagcacugucccucggaguccgagacuuccaccugggucguguccaaggccccggcgacuccccggacucggggugccgggccaaccuccccgccgaggcccacccgccgucgcuaugguaaugccgcgcccagcuugggggcuggcgggccgcagggcccccuggccuccggaacugcucaugggguuccagccccucgcccgcgcaaguugcaggaccggggucuggguggggguucggcggagucgggagaccugggcugucgucagggcuugucauggacgcgccggagacccugagaaagcauucuccucccccgggccucaguuucccuccuguugccuuccuacccuccugggaaaccccccuuuccagugcgcucagacgucacuaccgcuuggguccaucccuuuccccuccccgccccacacuuucuacuuuuuuuuuuuuuuuuuuuggacgaagucucguucugucgcccaggcuggagugcaguggcgugaucucugcucacugcaaccgucgucucccgcccaccccuuucacucugacccuuagagucuugggaacuguaucgccagcuguagcuccugcggcucuggcaucugggguuaggcaccaccucugaucuggguuugacacucaucaggaacuggcuacagcagcccugcuggcuagaaagaaggaaccguggacuggggcauccuacucuccugggacccuaguuuuugggccuuggauuagguagggaaacuacuggcuucauuugcagaaacaaugccacugugcagacauguuuggauuuaugguaguuucucuuauguuugacauaagauuggucaggcgaaaccuuugggauauugcaaaauccuuaggcccaagccaggggccguggcugacaccuguuuuuguuuguuuguuuuuuugagacagagucucacucuguggcccaggcugaagugcaguggugcgaucuccgcucacugcaaccuccacuucccagguucaagcaauucuccugccuuagacucccaacaagcugggauuacaggcgggcaccaccaccccagcuaacuuauuucuauuuuuaguagagacgagguuucacuuuguuggccaggcuguucuugaacuccuggccucaggugguccacccgccuuggcgucacaaagugcugggauuacaggagugagccaccaugcccagccuguggcugacaccuauaaucccagcacuuuggaggccacagugggaggaucacuugagcccaggaguucaagacuggccugggcaauguagugaggccccguaucuauaaaaauuuaaaaauuagccugggcgcaguggcucacgccuguaaucccagcacuuugggaggcugaggugggcagaucacaaggucaggaguucaagaccagccuggcuaacauggugaaacccugucucaacuaaaaauacaaaaaaaaauagccaggcauuguggcuuggccuguaaucccagcuacuugggaggcuaaggcaggagaauugcuugaaccuggaagguggagguugcagugagccaaaaucgugccgcuggacuucagccugggcaacagagcaagacuccgucucaggaagaaaaaaaaaaaaagaaaauuagcugagcacgguggugcacaccuguagucccaguuacucaggagguugaggugggagggucacuugagccuaggagauugaggcugcagugagcuaugaucuugccacugcacuccagucugggcaauagggcaagacccugucucaaaacaaaagacaaaaacaaaauguuuacgcccaugugcacaguccuggagaacugcccuugcuccccuaggcagccuucccuuugcccccuuucuucccuuccaggauuagugcagaugguucugaguggauuauguuacaagaaaguuuuuuaaucuuucuuuccuuuuuuuuuuuuaagacagagucuugcucugucgcccaggcuggaguucaguggugcaaucuuggcucacugcaaccucuaccucccggguucaagcaauucuccugccuuagccuuccaaguagcugagaucacaggcaugcuccacuaggcccggcuaauuuuuuuuuuuuuaaagacagagucuugcccugucgcccaggcuggugugcaguggugcgaucucggcucacugcaaccucugccucccaguucaagcgauucuccugccucagccuccugaguagcugggauuacagaugcccaccaccacgcccagcuaauuuuuuguauuuuuaguagagacaggguuucaauauguuggccaggcuggucucgaacgccugaccuugugauccgcccccaccucaaccucccaaaguucugagauuauaggugugagccaccacgcccgaccaaauuuuguauuuuaaguagagaugggguuucacuguguuggucaggcuggucuugaacuccugaccucaggugauucaccagcuuuggccucccaaaguguugggauuauaggcaugagccaccgugccuggcagaaaguguuuuaaucuuuuucuaagaggcgggucucacuauguugcccagccuagccucaaacuccugggcucuagggauccacccaccucagccucccaaguagcugggacugcaggaaugagccacugcacacagcuaaguaaguuuuuuagaauacuugggucuuuuuuuuuuuuuuuuuugauacagacucacucugucgcccaggcuggagugcaaccucugccuccuggguucaagcgauucuccugccucagccucccgaguagcugggauuacaggcaugagccaccaugcccagcuaacuuuuguauuuuuaguagagacaagguuucuccauguuggccagguuggucucgaacuccugaccucaggagauccaccugccucggccucccaaagugcugggauuacaggcaugagucaccacgcccggcccuagauuguuuaagucuuuaacgaaaucccauuucuucucauuccuuaguccuuucccagccguagcaaaaacaaacaaaaaacaauauaccugaugguauuguuagugcugggaagaagcagagugaggacagaaugugcuugcaaaugguauuucucaaccccaguugguuuuuuuucuuuucaggcgugcaguuugcagaagcuguuugcuguggaagaggaguuugaagaugagguagggaaguguugaugaucagagguggcagacgaggucuuaaaauguaaacacucagguucagaacauuuuggauuagccuguaccagccuccuuuuaguugacauguguauguuuuugccugugaggugcugagaagugaugagaaguguaaacaaccuacuuaacugucuuagaaacaaaaaaccagagcaaugaauugccuaauugucauaccuuuaaauuauaagggcucuuuccuggaagcugugucaucuagcugauuuaauucaccucuaugauaacauacuugcagugggaagggcuguguauguagagccagaaccauguaagagauagcauaguuacuggauggcaggaggccaggggucagcaauuggcuaugugaaucagggcaaguuacuuuauucucuggucuucuguuuucucuucuacaauaugagggaugcucuucugccucagauguucuucccuucccucugucuaaucacaagaugaggggugagacuagauccaaagcucgcacguuagaauuacccuugucuaggcucuaccacacaccaauuaaaucagaauuucugggaauggcccagccagggauauuucuuuuuuuuccuuuucuucaacauuuauuuuaaguucagggguacacgugcagguuuguuacauagguaaacaugugccauggugguuugcugcacagaucaucccaucaccuagguaauaagcccagcaugcauuagcuauucuuccugaugcucuccaccucccugcccccggcagcccccacugugugaacuucuuucuuuuuuuggagacaggaucucuuucugucacccaggcuggagugcaauggcacaaucacggcucacugcaaccucaaccucccaggcauaagugauccucccaccucagccuccucaguagcugggccuacaggugugugccaccaugcccagcuaauuuuucguuuuuuuguagagacagggucuuacuaaguugcccaggcuggucucaaauuccugggcucaaaugauccuucugccucggccucccaaagugcugggauuacaggugugagccagugggcccguccugauuuuugcuuuuacaaauaauucacaacugccaguuuugucaaggagauguguccuugucuuugucuuucagcuuuggagauaugugauuacaggcugaaaaagugacuguuaaaaugacccucuugggucuuacaaggugaugaugggacugcuaagugaguaauggaauuagaguaaaggaaucugacagcugaaguuucuguuccuugaaaauggcagaucagucccuucccccuuccuaaagcagaugaugucaugucugagagugagcucuuugggagaaaaaagaccaucaaccuccagagucaucaggauuuuauuacugcuauaguucugguuauuauuauuauuguugaguccugugguuguccugccugaguaugggacucacuuaauaauacacaaagcaggaaaaagccuuucuguagcccagacaauccagugcaguagcagagggugggggugguggggacccuccugucaguuaaaucagcaguucugacucaaaaccacccucagaacaggucuguugcucuugaaggugucaaucucaccuugcuucccaacuggaauccauacuuuauuuagcuugccugaaaagcuauauuuaacuucugccuuuuuugcuggcuccaaguccucucuggcuuacugaaggguagcuaucucuguguagugugugugugugugugugugagagagagagagagaaagagagcacacgaguguguauuggggaugaggagugagcuaaggacaggcagcaugaccagcuggauagaucccuguuuagauaacaggccagacaccagaaaguggucuccuugagaugguuguugugugaccuagggugauuugucugacuucuugguucccuggaacguuugcuucuccugcuguucuccucuaacugccccucuccccacccaugaagacugaagaaagagguuaccugaagacuuagccuuagauuggaguguuuuugauagagccuuguguagggccaugggugaggucagaggugguaagagacaccacuauuggcuuucaugcuuugguuucuuuuucuuuuucuuuucuuucuuuuuuuuuuuuuuuuuugagacagagucucacuuugucacccaggcuggaguacaguggcaccaucucagcucacugccaaccucugccucucagguugaagugauucuccugccucagccucccgaguagcuggaacuacaggugugcacccccaugcccagcuaauuuuuuuauuuuuaguagagacgguuucgccacguuggccaggcuggucucgaacuccugaccucaagugauccuccuaccuuggccucccaaagugcugggauuacaggcaugagccaccaugcccgacccucaugcuuugguuucuuucaaguaucuacacacaaacauacacgccaugugccugaacaguaaaagcagagggguucuugauuuccagaugccaagaccuaccaucucugcuuccuuguaggauuucuugucugcuguggaggaugcagagaaccgguuuacuggcucacugccugugaaugcugggcgccugagaccugucucuucuaggccacaggagacugugcaggcacaguccuccaggcugcugcuguuacaccccacugcucccucagaggcuuugggccugccagacuuggaccucugccucccugccuccagcacgcccagugcugacagccguccaucaugcauaggagcagcuccccuaaggccugucucuacuuccagcagcuggauuggcaaucagagaagagugacagugacagaagugcucagagagacagcaagaccucaguccucagccuuacacccccuacucaccuuugagagccaacagcagcaaguugguggcuuugaggggccugaacaagacgaauuugauaaaguccuggcaagcauggaguuggaggagccuggcauggagcuggaauguggagucagcagugaggccauaccaauccugccugcccagcagcgggaggguucaguauuggcuaaaaaagcccggguaguugaucugaguggaucuugccagaaggggccugugccugccauccacaaagcggguaucauguccgcccaggaugagucucuagauccugucauccaauguaggacuccacgaccccccuugagaccuggugcugugggucaccuuccuguuccaacugccuuaacaguucccacucagcaacuccacugggaagucuguccgcaacgcuccccuguucaagcacuucagccucuccaagcugcuagagggaccauucagagcagcccucaaaaucguuucccuugucagccauuccagucuccaaguuccugguuaaguggcaaagcucauuuacccagaccucgaacucccaacucaagcuguucuacucccucaaggacuagcucuggauuauuuccucggauacccuuacaaccgcaagcuccagugucuuccauugggucuccuguugguaccccaaaagguccccagggagcucugcagacacccauagucaccaaccaccuggugcagcuagucacugcugccagccggacaccccagcagcccacccaucccuccacccgagccaaaacucgccguuucccuggcccagcugggauccugccucaccaggugagugagcuggcuuucuaggauuuggugggcaagggagagaagcaggguuccagcacuguccagcccuagcauaucuucccucuugcagagaaggaaggaaggaagugcagagaggcuuuucaaagcugcaggagaaauaaaagggaagaacugaaugcuagaaaauccacugugaagaagugcuuaaggcucugaggacaucauaauuuucuuuuuucuucuccuuuuuuuuuuuugagauggagucuugcugcaacauccaggcuggagugcaguggcgcaaucucagcucacugaaaccucugccuccuggguuuaagcgauucuccugccucagccucuugaguagcugggacuacaggcccccgccaccaugccuggcuaauuuuuguguuuuugguagagacagaguuucaccauauuggccaggcuggucucgaacuccugaccucaagugaucugcccgccucggccucccaaagugcugggauuauaggcgugagccaccacgccugacccucuuuuccuuuuuuuaagaagacccucuuuuccuuuuuuuaagaauuagagauuggcuauguugcucaggcuggucaugaacuaggcucaagccauucucccgccuuagccucccauauagcugggacuacaggugugcacuagggcaggaagucauucuugugcauuuguuaaggucuuauguguuggacaauuugcuuggaacugagaauacagagauuaaaagaaacaguuccuguccuaaagaacuuacagugaaauggaagaaacagauguaaacaaacaaacaugcacaaagcacacagugugaacaggggucauucccugggugcugggaagacacuggcucugccuuaggcuugcugagugggcuuuggauggaugaguaggagguuaacagguguguggcggagcgggcgcugugcucuguggauguucuggcagugggaaagcagggaagagcauguguaagggcacagaggcagaagagcaaggugcucucagauccacagaacaguucauuguggcagguguggggaagcuggggcugaaaaggagacagcccuggugagacuuggauuaaacuagucuuggaucagaucccagauaauuggacucugaggaucuggacugguugugauaggugugcccucuuccucccauuuuaaggguguuugaaacaauuucugccuguuacuugcucuucccuagcauguuagcagauauccaaagaggccgucuauguuccuccugggcuggaucucccuggaggaaaggguuaggacuuggggaaagcugccccuuugcucaucacaggccucucaauuuuucuuucuuucuuucuuuuuuuuuuuuuuuaagacagagucuugcucucucguccaggcaggagugcaguggcacaaucucggcucacugcaaccuccaccucccagcuucaagugauucuccugccucagccuuccaaguagcuggcauuacaggcaugggccaccacgccuggcuaauuuuuguauuuuugguagagauggggguuucuccauguuggccaggcuggucucgaacuccugaccucaggugauccacccgccucagccucccaaagugcugggauuacaggugugagccgccacgcccagccaggccucucuauuugggucacugcccccuucaggcagcccugguuuuugcaccugggcgagcuccggcuuccucacguuuucaaaccaauccccaaaguaucuuuuuugagcugccaaagaggcuccugagacuuuguuaggagagauguaauauguguuaauagucccugaucauuuccugaacucauuauguaaaccagacaauaagcuguacuuguaaauaacagcugcuaagcuugcucucaucuucuccuucccuccccucuuagcagagugggagaagucuggaggacaucaugguuuccgcgccccaaacuccaacccauggugcucuggcuaaauuccagacagagguaacuuaugcaaauguuaacuuucugggugugauuugagagugaggggcgucccuguguguuucaggaguuaagaaucaagagcugaugcugcuaggccuguuugcuggugucacacacuaaaaggcauuugaggcagguaguugggggaggcagcaauuuuacuggcauuaagugaggccuguccuggugccagguagguauuaucugaugccauggguccagccuucuuucccaucuaagaaauaaaggcccagcuagcuccagcuuccccugggggaggagacugugauaaguauuaugagauugugucucaggagcccuuccucucagguuucugagaacugagcugggaaggaucugccuucucuugccuuugcuggguucccuuuggugggugagacccugcuucccuucuccuugggguucugguugaccugcucugcccucaaacccaguuuugcuuuuaauucuccccaguauuuuuucucugcuguagcuccgcagaucugccaguccauuucagauccaaagcagcagauacucucuggauucaaagcauguauuaauguaagaagguuaauuguuaaagcuagaagcaugccaaauagaauaugacugguuucaaaauggcuaagccacucuggaagccuauaaauauaugugguggaucccuaccccuaagacuuuuugagucuguuacaaaaaauaagcguagauagccuucugcuucaaugcaguuaaagucaggagcugauuuuauuuuauuuuauuuuauuauguuauuuuauguuauuuuauuuuauuuuauuuuauuuuugagacggauucucgcucuguugcccaggcuggagugcagugucgugaucucggcucacugcaaccuccgccuccuggguucaggcuauucuccugccucagccuccugaguagcugggacugcaggcgugugccaccaugccuggcuaauuuuuguauuuuuaguagagacgggguuucaccauguuagccaggauggucuccaucuucugaccucaugaucugcccgccuuggccucccaaagugcugggguaacaggugugagccacugcgcccagucaauuuuuguauuuuuaguagagacgagguuucaccauguuggccaggcuggucucgaacucuugucuucaggugauccacccgccucggccuuccaaagugcugggauaacaggugugagccaccgcgucuggcccaggagcugauuuuauuaaaaauuuguuuuucauaccuaguccugcagacaggaccugauuuuaaaaagaaaaaaaaagaguaucugcugaaugaaaccugugauacgcgacaagauuuucacgugcuucaaaugccaaagcaaucagaaaaaaaaaaaagaaaaagagaaaaaaaagaugucacauaccauuuucuggccuuggagauaaaugagaggagagacuguggccauuguacuacaguuuuuccgaggggauuugccuuuccucucucacccuuccacccuguuucaaucaagagucuguagcaagguagaccuauucauacaggcucccccucugcucugugguaccagauuguugcuaguucccaggcaucuguggaggaggauuuugggcgagggcccuggcugaccaugaaauccacgcuaggccuggaugagagagacccuagcugcuuccucuguaccuacagcauugucauggugcugcgcaagguaaggauucugggugcugagacccaaaggaaagaccauuuuucucccucucucugaccuacugcccuacuccaccuuaggaaggggcuguuugcucccucguacccuauacaaguagcagcacgaagccccuuugguuguaucuuccacuuaccuaccuuuucacugucauccauaggauugggcccagguggaaggagagaguggguuaugguaugccucugcacuuccaggcccugggugggguggggugagcacacugccacccucaaaucucccuagugguuaaggguugugugcagagacaugccaguacaugugccaacauaucccugccugugacuguuaugauggaacauuguguaaacacauauaaacaaaagaaagugcuggacacaguggcucacaccuguaaucccagcauuuuaggaggcugagguggaaggaucacaaaggucaggaguucgagaccagccugggcaacaaagcgagacccugucucuacaaaaaaauacaaaaaaaaaaaaucagcuggaugugguggcacaugucuuauagucccagcuacuagggaggcugaggccagaggaucacuugaucuuaggagguugaggcuacagugaacuaugaucgugccacugcccuccagccggggcaauagagcgagagcuugucuccuuuaaaaaaaacccaaggccgggcgugguggcucacaccuauaaucuugagaggucaaggcgggcggaucaccugaggucgcgaguucaagaccagccugaccaaccuggagaaacccugucucuacuaaaaauacaaaauuagccggacguguuggcacaugccuguaauucuagcuacucaggaggcugaggcaggagaauugcuugaaccuggaaggcagaaguugcggugagccaagaugugccauugcacucuagccugggcaauaagagugaaacuccgacucaagaaaaaaacaaaaaccaaacaggucaggcggggugggucacgccuguaaucccagcacuuugggaggcugaggcgggcagaucacuugaggucaggaguucgagaccagccuggccaacauggugaaacccccucuauugaaaauacaaaaauuagccaggcuugguggcacacgccuguaaguccagcuacucaggaagcugaggcuggagcaucgcuugaacccagaggcggagguugcaaugagccaaggucgugccaugguacuccagccugggcgacagagcgagacuccaucucaaaaauaaaaaaauaggccgggugcgguggcucaugccuguaaucccagcacuuugggaggccgagguggguggaucacgaggucaggaguucaagacaagccuggccaacauggugaaacccugucucuacuaaaaauacaaaaauuagccgggcgugguggugggcgccuguaaucccagcuacuugggagccugaggcaggagaaucgcuugaaaccagaagguggagguugcagugagccaagauugugccauugcacccagccugggagcgaaacucccucucaaaaaauaaaaaagaacggaggcaggggagagaaaugaaggaccucccagcucuaggucugucagagagagaugggguaccuccuuguccuccacaaagaagaucaucacuauaacuauacucugaccccuccuaaccccgguugcccuggcacacuuggagaccugggaagucacaagugggccguggaaggcucagcauaugccucuccuuguaagcaggcagcccugaagcagcuuccuaggaacaagguccccaacauggcggugaugaucaagucccugacucggagcacaauggacgccagugugguuuucaaggaccccacggguaaggaauuagguccuagguugucuggugagugggcuccauugaggccaggaaaugagguggaaucacccucucccuuugcagacaggaaaacugaggcagugagcagcccacuucccagccagggcccauaccagucgcugugcugcccuugaccccgagacugaugggccaugugguauuugcaggagagaugcaggggacggugcacagguugcugcuggagacgugccagaaugagcugaagccuggcucagugcugcugcugaagcagguauggggagcagcucuccacaccacugccccccggauagagcccucagugucugucuccuuaccuguuuggcugccuuccucuacaacaccaggcacggaguggcugaaccauugcuaggcccuggcuugagcucagggaaggccuguggcccuugagcuggcccccauucuucaggguggauagggauggaggguuguguuaaggggagauuguggcaaaugguucucuucuggcaccaaggcuaggcagaggacaccaagugaaaggcaggugggagccagguguccaucuggcagcucccagugcuccaucaggacacugaccuucccuuuccuugacuccagauuggaguguuuucuccuucacuucgaaaucacuaccucaacgugacacccaacaaccugguccauauuuacagcccggauucuggggaugggagcuuccucaagccaucucagcccuuccccaagguaagaggagcaggaagaaacgggagacugguaaggcccuccuucugccuggaucuucugauuucuuccucucuuccacccuggggagcagaggucugaagggggcaggugcucugaggugaaaagguaucuuuggggacaggaccaucuccuaucccucauccagccgccuggcagauggcucaguaacaguaccuagaggagcagcuggcuucuuggugaucccugagcaucugauggcaggcuugaacaucugagaggauaggagucacuugagaacuaaccaaguggagggcccaccagggggugguggcaguaaaugaccgagggucagaucugcuacagguggcaguguggagaacagugagcuacaaauggccugucaggugagccagcaccugcucugugucuucccucuuggcaucugccucugcuaaauuagggggaagcugcacagagcacugguggggacauccucuuuaggaaccgagacgagcauuuggcauuuaugggagguaagcaugggcuuccaggcagauccacuccagguugagaguguagagccugggcuugacuugcccugcccccaccaccuuccuaggaucuuguguacugaaaacguguacugugaccuugggcaaguccuguugccucccuugcaacagcuucaucuauaguacguuugacuugaugaccucuagucaucuuagacagagguuuucaucuaagcuccaacuuuccacuuccauuuuccucaucuuuccccuuagccccuccacauucucucaaaaucaccccacuucuaaacccuuucuuuuucuuucuuuucuuuucuuuuuuuuuugagacaguuuugcucugucacccaggccagagugcaguggcgugaccuuggcucaaugcaaccucugccuuccagauucaagcgauucucccaccucagccucccgaacagcugggaccaugcccaacuaaaucuuuuuguauuuuuuaguagagacagaguuuugccauauuggccaggcuggucccgaacuccugaccucaggugauuggccugccuuggccucccaaagugcugggauuauaggcaugagccaccgugcucggccuauuuuucuuuuaaauuucaaauuaucuauacuuauugaaauaaaucaaaauagcacagaauaagcaaaaaauggguccuacccuuccccacuccuauuuccuaggacuaaccaugguuaaccauuuaauuaccgguauuuauuuauuuuuuuuuuuugaaauggagucucacucugucacccaggcuguagugcaguggcauguucucagcucacugcaacuucaccucccggguucaagugauucuccugccucagccuccugaguagcugggauuacaggugugugccaccacacucggcuacuuuuuguauuuuuaguagagacgggauuucaccauguuggucaggcuggucucgaacuccugaccuugugauccaccugccucagccucccaaaguauugggauuacaggcaugaacuaggcgugccaggcccaguuuuuguguuuuuaguagagaugggguuucaccauauuggccaggcuagucucaaacucccgaccucaagugauccuccugccuuggccucccaaagugcugggauuacagguaucagccaccgugccuggccuuaauuaccaguuuuaauuaccugcccauauauuagcuauauauuccuuuggggauuguuaacaacuaauuuuaaaucucaggcuaacucuucaauguauuucugaauggccucuucacucucugcucuaguuauagagaaucucuaaaauauuagauaccaacagaacuaggaaagcaaaucagccaaaagagguuuguuuuuuguuuuguuuauuaucugcugcuuuggguguuugguguuucagcugccucccuucagcaugggccuggguggcuggccucugccauacucuuccaucauguuucuuuuuuuuuuuuuuuuuuuuuuuuuggagcaagggucucacucugucccccaggcuggagugcaguggcacgauauuggcucacugcaaccucugccuccuggguucaagcgauucucaugccucagccucccgaguagcuaggauuacaggcgugugccaccaugcccggcucuguuuuuguauuuuuaguagagaugugguuucaccguguuggccaggcuggucucgaacuccugaccucaaaugauucacccgccucggccucccaaagggcugggauuacaggugugagccaccacaccuggccccaucauguuucuuuccugagccccacacuguucguuugagguugucuggguagagguggugccaucugaagggauuucagggacacaggcauugguaaccagauccucuguccccaggauucagggagcuuccagcaugauguggcugcaaagcccgaggaaggcuucagaacagcacagaaccuagaggcagaggcguccccugaggaagaacucccagaagcagguaaagcagucagcccaucugggagcaagagagguucuauuuccuguugaauagcugaaccagaaucuuccuggcuauaucuuguuccucuuuccaugaaucuuuggaucuuauauaaucuuacagaaaucagauacagugucuuguuuggcaaggcugcaggccacaaacucguuaacagugugauggggccauguaaaacaaagugucauccacagguuucccccauuuucagguuaugugccaucagccacaaggaggaaacaucaccauccccuguccagauggacaggcgcuaucuuugugccacacucugaguccucugugggcugaugaccagaccacagaggcagauuucccauccugaguaagcuuagaggagugcugaggagucaagacguccacugguuuuugggaaaaccaggcuacaaaccagagaggcccaaaugcagaccccuugugguugggccagcugcuuccucagaaggcagcaucacccaggugaaacuaacaccauucaggaucuaguuuuagcuuuuuuuacuuuaauuuuuauuuuugcgacagggucucauucuguugcccaggcuggagugcaguguuaugaacacgccucacugcauccucggccucuaggcucaagcaguccucccaccucagccucccgaguagcugggacuauagguaugugccacuaugcccagcaauuuuuuuuuuuuuuugagacggagucucgcucugucacccagggugaagugcaguggugcgaucucagcucacugcaagcuccgccucccggguucaugccauucuccugccucagccuccugauuagcugggacuacaggcgcccgccaccaugcccagcuaauuuuuuguguauuuuuaguagagacgggguuucacuguguuagccaggauggucucgaucuccugaccucgcgaucugcccgccucagccucccaaagugcugggauuacaggcgugagccaccgcgcccggccaugcccagcaauuuuuaaauuuuuuguagagacaguuuugccauguugcccaggcuggccucgaacucuuggggcucaagcgauccuucugucucugccucccaaaguacugggauuagaggcaugaccuaccgugcccagccuggucuuuagcuuuucaauuccaaaaauucaauccugucuggccccaaaguucacaggauuauaugugggcagaaaccuacccaggugccgaggcaagagacugaaggcacaaacuguuccaguauaauacagaaaauaguuagaauaagaaaaguuauacuagaaauaggauauagagaugauuauauauggauauuaccaaucauuaguuuuuaguacuaauuucuguauuauuauuauaacugagaaaaaaaccagccaauauagagucaagagcugaagggacauugugagaagugaccagaagacaagaguugggugccagauguaggguccagcccuacugggccuuguggguuuucucuucguaugcagagacgagagauuauagaaaaauaagacacaagacuaagagaaaguaggaaagacagcugggcccaaggggccacuaccaccaaugcguggaguccgguaguggccccaaaugccuggaugcgcugcuauuuauuguauacaaggcaagggggcaggguaaggagugugagucaucucaaaagauugauaaagucaagcaagucacguguccacgugaugggggccuuucccuuugugguagcugaagcagagagggaggacagcauaugucagcguuuuuucugugcacuuaucagagaaaucaaagacuuuaauacuuucacuaauucacuacugcuaucuuccaagaacuuaaaagaagaaccagguauacaggcggaacaugaaaguggacaaggagcgugaccacugaagcacagcaucacagggagacguugaagccuccagaugauugugggcaggccuggcuaaugucaggccucccacaagagcugguggagcaguguucucgaacucccccaaggagaguucccuuucccagucugcuaaguaacaguugccuucccaggcacuggcgcuaccgcaagacugaggucugcuaaguaacgggugccuuaccaggcacuggcgcuacugcuagaccaaggugucaucaggcagcccuuaucagggcgugacagaggacuuucacucuugucuucugcucacuucucacaaugugccuucagcuccugacucuguacuggcuguuuuuuuucucgguuauaaugauaauacagagauuaguauuaaaaacuaaugauugguaauauucauauauagcugggcacgguggcucacuccuguaaucccagcacuuugggaggccaaggugggcggaucacgaggucaggagaucgagaccauccugacuaacauggugaaaccccgucucuacuaaaaauacacaaaaaauuagccaggcgugguggcgggcgccuguaguccagcuacucgggaggcugaggcagaagaauggcaugaaccugggaggcggagcuuccagugagccgagaucgugccacugcacuccagccugggcgacagaguaagacuccaucucaaaaauaaaaaaaauccauauauaaucaucucuauauccuauuucuaguauaacuuuucuuauucuguuuucuuuauuauacuggaacaguuugugccuucagucucuugcccuggcaccuggguagguuuccacccacaauuauggauagguguucucacacuaccuaauucacaguauaccaauggauaaaccacaaaggccauuauaucuugugaaaaagcauaugucucuuauccuggaaucuugcauugccuggaagccugcacucuuucuuugugagacaagccaaggcaucaccagaagguugcugguagugacagagaguugauuauagaauauuagggcuggugggccgggcaugguggcucaugccucuaaucccagcacuuugggaggccaaggcagguggaucacgaggucaagagaucaagaccaucuuggcuaacacggugaaaccccaucucuacuaaaaauauaaaaaauuagccaggcgugguggugggcgccuguaagucccagcuacucaggaggcugaggcaggagaauggugugaacccaggaggcggagcuugcagugagccgagaucacgccacugcacuccagccugggcgacagagugagacucugucucaaaaaaaaaaaaaaaguuuguuucagguaaagugggguugauaacaggagcuaacuggagaugcccuaccuaugaauguuuauugaggcacagagcaagcacucagucaguauuagcugcugcuaguaaauaauauugcuagggauuaucgaggucagcuguguccaaguucucggacauaaguaccacaucugagaacuguagucuuacacaggcacuuugaggaagggggugauauuuuccacugucagaugagaagccaauuaaggaacuguguaacucugaacacaucugauggcuuuucccagcccucuuucuccuucagccaaugagaguugcacuaggugaccucugaagccuucuuguuuggcacuaugacuggauggaaggagaggaaucagugaggcucaggggaauccucuuccucgucagaauggcccagggauuacgcccccgccuuuugucauguacggguacaaggggagcagagggaagauggaagucaggccagccucaggcccauuggcauggguaccacugccuggaggagccgccugcccagcuauacagccagguccaggcccuccugaagggcagaaacuuuggaccugagucacauggaaugcugauguugucacuaaggcuacccaucauuccccucucuguagaugaccuggauggacuccugagugagcuuccugaagacuucuucugugggaccaguaguugagacugccccaacgcaggacaacccaccaugagcaggcagcucugggcaugugucuggucacauccaagggggagaagaaggccagcaugauuggagaguggacacagccggggggcuucugugguugcucccacccuggguguuuucccugagagcccccucaucucugcgcugcccucacuuugggccuuccuuugccguuggcaccagaauccggccggagacuggcucuccagccaacaagaaaggccugucacccucgccuugggugucccucuccugccucagcuuaauuuuagaggauauugggccugguuuucuugucccuucauacccuagucccuggacagcugaggagaugaaaggagccacaccacaacaauggcggccugccccuccacacaggggagaagcacgcucaggcuuccucugcuuugucucuucagaccugugguugcucugcucauccaugcccaagguucccaggugcaggacagagguguggccuauuguaccuuguucugaaauaaagcaucuccugcuucuucugccuc

SEQ ID NO: 16874 - RNA, 4978 nt, Homo sapiens
ggacuuccugucccugguauaacagcuuccgggagaagccggaagagaccggacccugaacagaaucgcagauugccagcccuuuucccgaccccuacggaaagacgaguccaggggccguccuggcgaggucaaaacauuuagucuggucuuuucaggugaggacuuccccauccaggcacagugccgguccaaucccccuuuaauuucccaugacuccucgcguccugaagccccgcccccaguuccccagccccgccccgaaguuugagggguguggacgguuugugacccccuuagccgacccuacuccucacuggccgggacaacuggucuuaucacggaggcuggggccaggcagcccuucgguucgggugggcccauggaccccaguccaacgccgagggaauaggaccauccaaaagcggaaccuucgccucagaaaaagggugcgggaccccuccucaccgugcggucacgguacggacaggguagaucacaggcugagggacagagcaaagaccccugaggccggacaccugggguccugccgggccccuccccacgagaguucccugugucugugccaaucguuuucgucuuucuuugccgcaguuucuuuuccuguaaaucaugguuaauaacauuaaccuucuuaccaucagggguuaguugugguugugauaaauaauuacuaccguuauuaagcaauugcaauuugcagugugccaggcacugugccaaguauuuugcuucgaugauuucacgucaucuucaaaacaaccucaugagguagguacuguuuuuaaccccauuuuacugaugagaaagcugaggcucugagaaaguugucugagguguuauagcuaguaagacgcaagacugggguuauaauuaguuguuuuucuaacuccagggccgguauauuaaauaaggauguugauguguuccacagauaauucuuugagcaacuacuggggcauuauauuggacacuucaguaccaagagaaauacauacgauccuugucuaccaggagucuaauagaaagauggacagguacauaaguauaaugaaguuuuauaggugcugugagaauagucugauaaugguaaucaccagacuggauuugcccagggacagcugugaaagcagcagauucuccaagggaaauaguagguacuccaaggagcaagcagggacccuuccugccuuucuaagaaacugcagcagcagaaccuucacagugaaagaagagagacugagauauggauugugagagcuguuauggaaucuuuuucaaaucacuccacuuggggaguggucauugcaggagugggcccauggugacccaggaagguggugcuucuggugucugucccaaguugcuccccagggcuugccagaaguuucagaggcggcacauaaugucugcugcauaguaucugcccgcggucccuacagaguuaucguuuuagauuugucugacucugcuuuugaugguaggucaguuuucuuuggcucuugacaucuggcagccuggaucugugaccaggaaugaaauaggcucaaaugagacaaucuggcagggauggcuaaacagugcuuccaggggggccccacaguaaaauauuccaggcuuuugggucucucugaagccacuuuggaggcugcuuaggaggcauauuugcuugaccaagcgauagaaauccuagagaaacucaggccucagcaaagauuuuuccucauucaccaaaaaagcaacaacaguagcagcagcagcaaggcugugggcuuuuccugcugauccacacucauugggaaguuggaguuugagagaggaaggucacagaacgugaaagcaagaguuucacaauagaggcaaaggguaggguaggucuuuagguuuagguuggggugccggaauuaggaagguuugugcccccuucuacacaacacugaacuccuuuuuuuuuuuuuucagggcugggucaguuagaaccuaaacaaacuagagaccugguugcaaccccucaggcucugcugaugcugucccccuuuguuccugcagcguggacccugccagcagccaggccauggagcucucugaugucacccucauugaggguguggguaaugaggugauggugguggcaggugugguggugcugauucuagccuugguccuagcuuggcucucuaccuacguagcagacagcgguagcaaccagcuccugggcgcuauugugucagcaggcgacacauccguccuccaccuggggcauguggaccaccugguggcaggccaaggcaaccccgagccaacugaacucccccauccaucagaggguaaugaugagaaggcugaagaggcgggugaaggucggggagacuccacuggggaggcuggagcugggggugguguugagcccagccuugagcaucuccuugacauccaaggccugcccaaaagacaagcaggugcaggcagcagcaguccagaggccccccugagaucugaggauagcaccugccucccucccagcccuggccucaucacugugcggcucaaauuccucaaugauaccgaggagcuggcuguggcuaggccagaggauaccgugggugcccugaagaggugaguggccugggaagugggaagcugcuugugcucaucccccagcccuugguugccucuaaggaggcuggugcagacaugggagcugcagcaaaguguaagauccagccccuaccaagggcagguagauacuuucuuagaaauacacccuucaggccgggugcaguggcucccgggacuuugggaggccgaggcgggugcaucacgagguuaggaguucgagaccagccugaccaacauggugaaaccccaucucuacuaaacauacaaaaaucagccgggcgugguggcgcacgccugcaaucccagcuacucaggaggcugaggcaggagaaucgcuugaacccaggagguggagguugcagugagccgagauugcgccacugcacuccagccugggcgacagagugagacuccaucuaaaaaaacaaaacaaacaaauacaccccucauuaguuaaggauaaagaugaggggggccugucgcgguggcucacgccuguaaucccagcacuuugggaggccaaggcgggcagaucacaaggucaagauaucaagaccauccuggccagcauggugaaacccugucucuacuaaaaaaaaaaauacaaaaauuagcugggcaugguggcgcacuccuguagucccagcuacucgggagggugaggcaggagaauugcuugaacccgggaggcagagguugcagugagccgagaucgcgccacugcacuccagccuggcaacagagugagacuccgucucaaaaaaaaaaaaaaaaaaaaaaggauaaagaugagggaaaaaaaaauccacccuccaguuuuuccccacuccccugcuuuguugguccaggccuguuugccuucucauuccucacccucuaucuuuucuuccaugucuuucauccuuacagcaaauacuucccuggacaagaaagccagaugaaacugaucuaccagggccgccugcuacaagacccagcccgcacacugcguucucugaacauuaccgacaacugugugauucacugccaccgcucacccccagggucagcuguuccaggccccucagccuccuuggcccccucggccacugagccacccagccuuggugucaaugugggcagccucauggugccugucuuuguggugcuguuggguguggucugguacuuccgaaucaauuaccgccaauucuucacagcaccugccacugucucccuggugggagucaccgucuucuucagcuuccuaguauuugggauguauggacgauaaggacauaggaagaaaaugaaaggcauggucuuucuccuuuacggccuccccacuuuuccuggccagagcugggcccaagggccggggagggagggguggaaaggaugugauggaaaucuccuccauaggacacaggaggcaaguaugcggccuccccuucucauccacaggaguacagaugucccucccgugcgagcacaacucagguagaaaugaggaugucaucuuccuucacuuuuaggguccucugaaggaguucaaagcugcuggccaagcucaguggggagccugggcucugagauucccucccaccugugguucugacucuucccaguguccugcaugucugcccccagcacccagggcugccugcaagggcagcucagcauggccccagcacaacuccguagggagccuggaguauccuuccauuucucagccaaauacucaucuuuugagacugaaaucacacuggcgggaaugaagauugugccagccuucucuuaugggcaccuagccgccuucaccuucuuccucuaccccuuagcaggaauaggguguccucccuucuuucaaagcacuuugcuugcauuuuauuuuauuuuuuuaagaguccuucauagagcucagucaggaaggggauggggcaccaagccaagcccccagcauugggagcggccaggccacagcugcugcucccguaguccucaggcuguaagcaagagacagcacuggcccuuggccagcguccuacccugcccaacuccaaggacuggguauggauugcugggcccuaggcucuugcuucuggggcuauuggagggucagugucugugacugaauaaaguuccauuuugugguccugcagccucuuucugugacagagaauggcuuugcgcugcccccaggaaaaugguaaugagaguagguaggccggggcuaccaacgggagaugcaguuuauuuacaccagcagccaugggggcagagggaauacacagcguuuacaaaguuagcuaccuguacagaauggauuacauaugcaaaaauaaaaaucucaagacca

SEQ ID NO: 16875 - RNA, 4978 nt, Homo sapiens
uggucuugagauuuuuauuuuugcauauguaauccauucuguacagguagcuaacuuuguaaacgcuguguauucccucugcccccauggcugcugguguaaauaaacugcaucucccguugguagccccggccuaccuacucucauuaccauuuuccugggggcagcgcaaagccauucucugucacagaaagaggcugcaggaccacaaaauggaacuuuauucagucacagacacugacccuccaauagccccagaagcaagagccuagggcccagcaauccauacccaguccuuggaguugggcaggguaggacgcuggccaagggccagugcugucucuugcuuacagccugaggacuacgggagcagcagcuguggccuggccgcucccaaugcugggggcuuggcuuggugccccauccccuuccugacugagcucuaugaaggacucuuaaaaaaauaaaauaaaaugcaagcaaagugcuuugaaagaagggaggacacccuauuccugcuaagggguagaggaagaaggugaaggcggcuaggugcccauaagagaaggcuggcacaaucuucauucccgccagugugauuucagucucaaaagaugaguauuuggcugagaaauggaaggauacuccaggcucccuacggaguugugcuggggccaugcugagcugcccuugcaggcagcccugggugcugggggcagacaugcaggacacugggaagagucagaaccacaggugggagggaaucucagagcccaggcuccccacugagcuuggccagcagcuuugaacuccuucagaggacccuaaaagugaaggaagaugacauccucauuucuaccugaguugugcucgcacgggagggacaucuguacuccuguggaugagaaggggaggccgcauacuugccuccuguguccuauggaggagauuuccaucacauccuuuccaccccucccuccccggcccuugggcccagcucuggccaggaaaaguggggaggccguaaaggagaaagaccaugccuuucauuuucuuccuauguccuuaucguccauacaucccaaauacuaggaagcugaagaagacggugacucccaccagggagacaguggcaggugcugugaagaauuggcgguaauugauucggaaguaccagaccacacccaacagcaccacaaagacaggcaccaugaggcugcccacauugacaccaaggcuggguggcucaguggccgagggggccaaggaggcugaggggccuggaacagcugacccugggggugagcgguggcagugaaucacacaguugucgguaauguucagagaacgcagugugcgggcugggucuuguagcaggcggcccugguagaucaguuucaucuggcuuucuuguccagggaaguauuugcuguaaggaugaaagacauggaagaaaagauagagggugaggaaugagaaggcaaacaggccuggaccaacaaagcaggggaguggggaaaaacuggaggguggauuuuuuuuucccucaucuuuauccuuuuuuuuuuuuuuuuuuuuuugagacggagucucacucuguugccaggcuggagugcaguggcgcgaucucggcucacugcaaccucugccucccggguucaagcaauucuccugccucacccucccgaguagcugggacuacaggagugcgccaccaugcccagcuaauuuuuguauuuuuuuuuuuaguagagacaggguuucaccaugcuggccaggauggucuugauaucuugaccuugugaucugcccgccuuggccucccaaagugcugggauuacaggcgugagccaccgcgacaggccccccucaucuuuauccuuaacuaaugagggguguauuuguuuguuuuguuuuuuuagauggagucucacucugucgcccaggcuggagugcaguggcgcaaucucggcucacugcaaccuccaccuccuggguucaagcgauucuccugccucagccuccugaguagcugggauugcaggcgugcgccaccacgcccggcugauuuuuguauguuuaguagagaugggguuucaccauguuggucaggcuggucucgaacuccuaaccucgugaugcacccgccucggccucccaaagucccgggagccacugcacccggccugaaggguguauuucuaagaaaguaucuaccugcccuugguaggggcuggaucuuacacuuugcugcagcucccaugucugcaccagccuccuuagaggcaaccaagggcugggggaugagcacaagcagcuucccacuucccaggccacucaccucuucagggcacccacgguauccucuggccuagccacagccagcuccucgguaucauugaggaauuugagccgcacagugaugaggccagggcugggagggaggcaggugcuauccucagaucucaggggggccucuggacugcugcugccugcaccugcuugucuuuugggcaggccuuggaugucaaggagaugcucaaggcugggcucaacaccacccccagcuccagccuccccaguggagucuccccgaccuucacccgccucuucagccuucucaucauuacccucugauggaugggggaguucaguuggcucgggguugccuuggccugccaccaggugguccacaugccccagguggaggacggaugugucgccugcugacacaauagcgcccaggagcugguugcuaccgcugucugcuacguagguagagagccaagcuaggaccaaggcuagaaucagcaccaccacaccugccaccaccaucaccucauuacccacacccucaaugagggugacaucagagagcuccauggccuggcugcuggcaggguccacgcugcaggaacaaagggggacagcaucagcagagccugagggguugcaaccaggucucuaguuuguuuagguucuaacugacccagcccugaaaaaaaaaaaaaaggaguucaguguuguguagaagggggcacaaaccuuccuaauuccggcaccccaaccuaaaccuaaagaccuacccuacccuuugccucuauugugaaacucuugcuuucacguucugugaccuuccucucucaaacuccaacuucccaaugaguguggaucagcaggaaaagcccacagccuugcugcugcugcuacuguuguugcuuuuuuggugaaugaggaaaaaucuuugcugaggccugaguuucucuaggauuucuaucgcuuggucaagcaaauaugccuccuaagcagccuccaaaguggcuucagagagacccaaaagccuggaauauuuuacuguggggccccccuggaagcacuguuuagccaucccugccagauugucucauuugagccuauuucauuccuggucacagauccaggcugccagaugucaagagccaaagaaaacugaccuaccaucaaaagcagagucagacaaaucuaaaacgauaacucuguagggaccgcgggcagauacuaugcagcagacauuaugugccgccucugaaacuucuggcaagcccuggggagcaacuugggacagacaccagaagcaccaccuuccugggucaccaugggcccacuccugcaaugaccacuccccaaguggagugauuugaaaaagauuccauaacagcucucacaauccauaucucagucucucuucuuucacugugaagguucugcugcugcaguuucuuagaaaggcaggaagggucccugcuugcuccuuggaguaccuacuauuucccuuggagaaucugcugcuuucacagcugucccugggcaaauccagucuggugauuaccauuaucagacuauucucacagcaccuauaaaacuucauuauacuuauguaccuguccaucuuucuauuagacuccugguagacaaggaucguauguauuucucuugguacugaaguguccaauauaaugccccaguaguugcucaaagaauuaucuguggaacacaucaacauccuuauuuaauauaccggcccuggaguuagaaaaacaacuaauuauaaccccagucuugcgucuuacuagcuauaacaccucagacaacuuucucagagccucagcuuucucaucaguaaaaugggguuaaaaacaguaccuaccucaugagguuguuuugaagaugacgugaaaucaucgaagcaaaauacuuggcacagugccuggcacacugcaaauugcaauugcuuaauaacgguaguaauuauuuaucacaaccacaacuaaccccugaugguaagaagguuaauguuauuaaccaugauuuacaggaaaagaaacugcggcaaagaaagacgaaaacgauuggcacagacacagggaacucucguggggaggggcccggcaggaccccagguguccggccucaggggucuuugcucugucccucagccugugaucuacccuguccguaccgugaccgcacggugaggaggggucccgcacccuuuuucugaggcgaagguuccgcuuuuggaugguccuauucccucggcguuggacugggguccaugggcccacccgaaccgaagggcugccuggccccagccuccgugauaagaccaguugucccggccagugaggaguagggucggcuaagggggucacaaaccguccacaccccucaaacuucggggcggggcuggggaacugggggcggggcuucaggacgcgaggagucaugggaaauuaaagggggauuggaccggcacugugccuggauggggaaguccucaccugaaaagaccagacuaaauguuuugaccucgccaggacggccccuggacucgucuuuccguaggggucgggaaaagggcuggcaaucugcgauucuguucaggguccggucucuuccggcuucucccggaagcuguuauaccagggacaggaagucc

SEQ ID NO: 16876 - RNA, 9653 nt, Homo sapiens
cagaugcacgcgcucgggcccuucuagcaggcgcgagcagucgcugggcgcgcgaaagcgaaagaaggaagaggaagggagggggagggcgggguguuggggaggggcgggaggaggaagaggaggagguuggagcgcgcucgcgcuuggccucgcgcccgcgcagagggagggggagaggggcgcgcgcgcgcacgcucgcguucacgcucgcuccauccauccauccuccggucgcggcacacgcgcgcgcgcuccgggcucgcgccgcaccccccgcccgggagaggcgggcuggaguggggggcggggggaggggcgcgcggacggcgcgcggacugcgcgcgggcggggugaggugaggaggaggaggcggcgacgggacaagaagggaggggaaggggccauggccgcccggugaggcggccaggcgggggggcggcccgaccccccggccccgggcccugggccccggggagaggcgaggacggaccgacggacauggggcuccggagcagccgccgccgucgccgccgccggaggacgcggcccugagaggcugccgggccccggcgcggccccccgggcggggugaguacgggacggagacggggacggggacgggggaggggccuguggggggcggggggcggggcccaaggcggggcuugggcccccuccccccaggucugggucagcgccccuuccccuccccccgggccgacgcggaaacgcccggcuucccccagcuucccggccgggccggggccccuggcucucccccgucugggucccccuugggcggggcagggccggccggggagggggcgcggggccuuuguuagggagccaggccccagcccccgggacaauagagacacccucccggacuccucuccccggccggccggggcugcuggcgggcggggaaggagaggggcugggacgcgucccacucucugggggucggucugucccggcccggcgccggccccggcggcucggcuguccuccccccagucgguaugaugcagcagcagugccgcagggacgggggaagagccgaggcccggccuccuacccuucccagugcccccggcucauucgucaguccccaccccacucuaggccggcagcuccugaaacucguacccaccguuccgaggggcccuggguuguggguucugugucugaauccuuggguggggguuccuggacuuuggggcucuuggagagacuuccgggcugguccugagggagggcgggugguuauuuaaaggaagaacagguaaggggagugcccgcuccuggcgugccacccuaccaggcucuucccccccaccccccgccguuccugcucaugguggcuagaaaugucccuuagcucuaggcuccugugggcucugcuccccucguggaguggcaggcugauuucaagggaagacagaguggggugaagguuguaggguccuagggccauuucuacuucugguagcaguacccccccaaguggacauccuggcugaaagcagaggugacucugaggagagucuuuagggaaggcgggggguguauuuaggagucugugcaguucuuugccacacccuguggguuugcuuugaggccuuggaguuccuucuccucccccugcugcauugcaccauggguaucaaagagggguuugaguuuuggggaccuagggugagcugcugccuccuauagacccagacucugauuggcaguggaguccagggccugagcucaggccugggaaagacuaggcccccuuuagguuucaggccuugaaggaccauccagacuuagggagccugggccuuggggagggagagacccugaugccaggacugagcuuugggcagcgagguggggagggaagguggccgcauucagaggugccuuggacucacaacaacacccccacccccgugugugcagccguguugccgcccgcugugcuaugagcagucagagcgccgucuccacaagaguuuacaaaugaaaauggaggaaaugucuuugucuggccuggauaacagcaaacuagaggugagggcucccccacgugugccuccaguucuuucucuugaugucucuacgucgcuguaucuggcauccacaccaaagaggaauuuggguagucagccuuguuccuuaaagggaauagccagcugaaaaagccaaggauccaggaagaagaaagaacacgaagucaagauggggaaaauggcaaagaaagcaugauuuuuggcuggggccaguuggcagcagauuugguuggugagaguccagggggcugugacucuugugaccguagauguucuccccuggggcccaggccaucgcucaggagauauacgcggaccuggucgaggauucuuguuugggauucugcuuugagguacaccgggcugucaaguguggcuacuucuucuuggacgacacggacccugauagcaugaaggauuuuggugagcuucagggugaaggagcagcaguccagcccuucccugggacugccuggaguuuccuucucuggaaacugugcuagauguagcaccuggagcuccugugagccgggggagggauugaagaggccgugggaccccaggugggaacaagaggagaggguccugcccacccugaucgccagccucuccuguccccagagaucguggaccagccgggcuuggacaucuuuggacagguuuucaaccaguggaagagcaaggaguguguuugccccaauugcagucgcagcauugccgccucccgcuuugcuccccaucuggagaagugccugggaaugggucggaacagcagccgaaucgccaaccgccggugagggaaccagagcugcccguucucugcagccugugccaugguguagucccccgggggcauugggaagguacagaggguggguuuuacuuggccccagaugcuccaccugcuucugaaguugggggcagagcggggugaccaccuugaccccuuucucuuccuuccccuuggccccuuucucuucccuccccuuggcaggauugccaauagcaacaauaugaauaagucugagagugaccaagaagauaaugaugacaucaaugacaacgacugguccuauggcucggagaagaaaggugcuuggggaucuggggaaacccggggggcauugggaugaggugggaagcaggaauuggguauacaguggucacaaauuguugccuugaaugaugaagagagaguguaguuacgcgauuuccuuuuccuuuuuuuuuuuuuuuuuuuuuugagauggauucucgcucuguggcccaggcuggggugcaguggugagaucucggcucacugcaaccuccgucucccggguucaagcgauucuccugugucagccuccugaguagcugggauuacagucgcgugcuaccaugcccagcuaauuuuuguauuuuuaguagagaugggguuucaccauauuggccaggauggucucgaucuucugaccucgugaucugcccgccugggccucccaaagugcugggauuacaggcaugagccaccgugcccagccuguuguaugguuuucuugagaugcuuuuagauugagaacuuaacggaaacccugcucuuuaugcuuuuguuucccacagccaagaagagaaagucagacaaggugagagccgggccaggcauuggggaaauaauggguaaaggacagauacccuccccuuugggcagggaguccucgagugucaugacucaaggcugaggucauugggggcuugagggugucuuugguggguccggggcgggggaguguggguggggaaggggggugggggagggcacauggguagacaggccuccuacuggggaggaagaguaggaauuugaggaugcugcuuugucaaaucuuuuuuccuucccuggguucucggcucccccuuuucguuacccuuuccccaaagcuaugguaucucccauuccagaaccccaauuccccucgaagauccaagucauuaaaacacaaaaaugguaaguggagccggagcaaugggaaugcuucuagcugugucuucugggacucauugccgggggguggagguggggcccggggauaggggaauugagggagggccugugauccuucugucacccccacuuccucucugguuauuuucaggguucucugucuguaccucugcaucaaacacccuuccccuucuuuuuucuucuucaggggaacuuagcaauucggauccuuuuaaggugaguaugggccgccccucaugcuugcucucauuguccugguugugaggugguggggauuuggacaaguagggaucagaaugcugacagccagaggcacugaugagcuauuuggaucuuacauauuuauguucuuucugagucccaccccuuauccauuggcagaugggaugagagaaaucacuuggaaaacggcagggucguucuaaagccucacuuagaaagggaccagagggacugauucucacuuccaccccuguccuucucuuuucucugccccaucucuaaccuguaccucugguuguccugcaguauaacaauucaacugggaucagcuaugagacccuggggccggaggagcuucgcagccugcuaaccacggugagggaggaccagcaagagagaaggucccugggagugggcuggagccauaggcaguggucaaggccugggaggaagcuggugaccuagcagucagggccguaucguucucucugucuggaauuagguuucccggcccauaguguccugggaccaucugcucuggacaccuuugggccaucucugcuugugcuaucuagcauuuauacagaaagaaacaucuaacaucuagaguagguuccuuccaucccuccuuucagcuuauauuccucuuccagcaauguggggugauuucugaacacaccaagaagaugugcacaaggugagcacagaaccuagaaagggggccaggcgcuuccugcacacucaccaugggcauggguugggaguaccccuggacuugagcaauggggcuccugcccuuccccuucccuccucuaaugaugaggccuuuggccacaaucuggggaugaaucugcauucaccccuucccugucugugccuguggcuccugccuugccgaggggaggggcuuuaccugaguuccucagaacccucccugccuugccucaccaccaggucccugcgcugcccacagcacacagaugagcagaggcgaaccguacggauuuauuuucucgggcccucggcguaaguggcccuacaggaagggugggggguugugaccaguuagggcgaugaucacuaucucuaaagcccuucuuuggcucauccccuuuccaguguccuuccagaggucgagagcucccuggauaaugacagcuuugacaugacugacagccaggcccugaucagccggcuucagugggacggcuccucugaccucucacccucugauucaggcuccuccaagacgagugaaaaucagggauggggucuagguacgugaugcaguugggcccuaggggcucugugcccaaagccaugggggugccaccucuccugccauaaccauacucucaucccuugugucucuuucucuacagguaccaacagcucugagucacggaaaaccaagaaaaagaaaucccaucugagccugguagggacugccuccggccuagguuccaacaagaagaagaagccaaagccaccggcacccccgacgcccagcaucuaugaugacaucaacugacuugggugcaagggauagccuuuggcugagcagagcccucucuccugacccccacccagguggcauagccuggcaaauggacggcugcuggggguuggggcuugggaagcuuggugggccaggcaggcagaggauccgauuaugcgccccuggggggugucaaaguccucugcaauggagcacgacuccucggcgugcaggacucagaccuggacauauuaugccuuggacauaaguuugguggggaggcgguuuuccuauuuauucugugaguuacuggauguccagcuaggccaggggccugaccugggcacugugccagggcacugccugccccccaccccaggaacuggacuaagcccugcugaggggcaauguggcgacccgggaggcuguggguuggaagcugagccuggagggggccugccucggccgcccucagcaaugugaauggguccggugcuuggagcugaggggcaaggcugggcauguccugucugugugcagaaucuuaucaaaugcccccagucccagggguaggcaggcacagagugcugucugcugaggugggcguccagaacugccgccaccuucccugccccucacaggggcagcccuuuccccucaguccccaugggccuccuuggcagcaggagcuguccuuuuguugggugccaggaaagggccuccagccucuacagcuucaaggaaugggaaagggaggguaggaagagggagaagugucagaauuccucccccugccucuccucccugacccagggcuggugaggaguggggccccaaggugagagggaacggugcugcuuuauuugaaauguuuucuuaccucauucccugccccaggaagggacccagccucacccuccugggguggccccguguuccuccugcccacccugccccacugcccuaccggggcagcccagguucccaacugcugcuuccacccccuucaccuugacuggcuucaguuccucucagcgcuccugccuccaaagcgugcccuguuucccuuccuuagcgcuuuuaaguuauuuauucuguacuugugguuuggggcucugaggaaaauccuaaucuugugccucucccccuuugcuaggaguugggugggaagagaggguggccucugugccccagguugucaguggaggggaaggggugucacugccccucugugggacugucaugccagugugcccaccugccuggucuacauccuaaagagauguaccguccccccuccaugcgggcaccaccacucccaggagccaagcuggaggaccgcgaccugggcugggagcagagcugacugacauggguggaggugacccugagccaaguucucuggcacuugcuggacauguccccuacccucuucccaagaggagccaucccacauuuggguaguuaguacccaggacugguuggacugaucggguuagggacccuagaggguuaagggaacaacagagauggggcugcaaugcccugucuggaacuccgcucucccgcuggggugguucugauuguggcucaugccugguugcaaauugguuuuuaacccacaaauugugauuauuuuuuaaaaagccaaacagauuuuggcaggaguuagaauaaaucccggggccugggcuucucuauucuuggcccuccguagucucccuccgagaggaggccagagggagaggaggaucucagcaggccucuagccgcuuccagaugcagucuggggagugggcugaaggugaagggaggaaggcugugggccacucucccuucugagaggcagcugcagcucaggcccuaauacacucuuugcccuguggccucucccuuuuccccccuucugguuggaggagggagaagugggaaguagcuugggaacugguuuguccacauaaacuuccccauuguuccuuggcccgcccucagggcagagcccccugcccaggcuggguaagagaugggcuugguccagcagggacccugagggaacaaacccuuuuccuucuggggagagagugcccccccuaccauguaguugaacaggggcuaggagcuccccacuccccucccucuaacagcaggcuguguggguuucaauucccauccuucccaccccggcuaggugucguccacccuguauccugugucugaguguguguggggggguucuguacuaauuuccauggccgguggcuuuuccuuccaugcaucacucccccccgcaugcccaggggccacccgccuggcauuaccgcaugcuggggucauugggggagggggguggggcucacgcuguccuguggucuugagauuuuuauuuuugcauauguaauccauucuguacagguagcuaacuuuguaaacgcuguguauucccucugcccccauggcugcugguguaaauaaacugcaucucccguugguagccccggccuaccuacucucauuaccauuuuccugggggcagcgcaaagccauucucugucacagaaagaggcugcaggaccacaaaauggaacuuuauucagucacagacacugacccuccaauagccccagaagcaagagccuagggcccagcaauccauacccaguccuuggaguugggcaggguaggacgcuggccaagggccagugcugucucuugcuuacagccugaggacuacgggagcagcagcuguggccuggccgcucccaaugcugggggcuuggcuuggugccccauccccuuccugacugagcucuaugaaggacucuuaaaaaaauaaaauaaaaugcaagcaaagugcuuugaaagaagggaggacacccuauuccugcuaagggguagaggaagaaggugaaggcggcuaggugcccauaagagaaggcuggcacaaucuucauucccgccagugugauuucagucucaaaagaugaguauuuggcugagaaauggaaggauacuccaggcucccuacggaguugugcuggggccaugcugagcugcccuugcaggcagcccugggugcugggggcagacaugcaggacacugggaagagucagaaccacaggugggagggaaucucagagcccaggcuccccacugagcuuggccagcagcuuugaacuccuucagaggacccuaaaagugaaggaagaugacauccucauuucuaccugaguugugcucgcacgggagggacaucuguacuccuguggaugagaaggggaggccgcauacuugccuccuguguccuauggaggagauuuccaucacauccuuuccaccccucccuccccggcccuugggcccagcucuggccaggaaaaguggggaggccguaaaggagaaagaccaugccuuucauuuucuuccuauguccuuaucguccauacaucccaaauacuaggaagcugaagaagacggugacucccaccagggagacaguggcaggugcugugaagaauuggcgguaauugauucggaaguaccagaccacacccaacagcaccacaaagacaggcaccaugaggcugcccacauugacaccaaggcuggguggcucaguggccgagggggccaaggaggcugaggggccuggaacagcugacccugggggugagcgguggcagugaaucacacaguugucgguaauguucagagaacgcagugugcgggcugggucuuguagcaggcggcccugguagaucaguuucaucuggcuuucuuguccagggaaguauuugcuguaaggaugaaagacauggaagaaaagauagagggugaggaaugagaaggcaaacaggccuggac

SEQ ID NO: 16877 - RNA, 16319 nt, Homo sapiens
gucaaaccuuuguuuuucacuuuauuauacaaaaaagggaaaacaaaacuuccacaguuggcuuuaagcauaggcagacaccucuaagccacucccucccaccucccaugauacaaauucaaguuguggugguuguugaauccuacaaaacacuccuuaaauauuagaaaagaaguuggggguggggaugggggucuucccaccccagccaucccaucccagugccaaaaugcacucaagagugaccucuuacagcaccaacacccccacccugacaguccuguuuguacuguaagaauuuuucaauuuuuaaaacaggaaagaaaaagugccccauucaaaguuguuuuuaaaugaaaauacauuccacugaaacacaacaguguaggggcauccaaauaggaaacugggguucuuugcagggcucuugggaagaaauagaaccuauaaaccccuguacuuaauuccaggauuaggacaaaggaaggggaaugggaguggggagugucccccccaggccuccccacccccagcaccaagguccaaggcaaagcagagacugucugccuuccuuugggagagggacccaccagccucucugggaccagggcccuucaccguucuugcuccaccuccgcggcagaguucccgcucuucccccauuccuuggcuuucauucagagggggaagguggaaaagcaccaagccccaauuuaauaggucagugacaugaccauaaaaaagaaccccccaaauuuagucaacaaaaaaauaagaacuacagagauaagguggcuuggcuuauuaagagucaaggaaucaagguaccaaaaaauacgggagauggcugggaagaguuagagacagcugcagaugcagcuuuugcagacuucuugcccagcugugggguugggggaggagggagcagaccugagaaauuaaaggaaauaggggguggugggaggauucaaggaaggcuggagggauguguaaguuaggagcucccagcacauuucuugaagcccagguucugagccugggguggccaggcuuggccucucagaugaacaggggagaccuuuuccaucaaauacaagcuuuaagcuucacaccaucuugccugccuuuccgccuuccugcuggacaauggagaccagcagcucggaugcaugugacucuggcagagggagccuggucugggaagcauccgagaauggcuucagcacacucccccuaauggaaucagagacugggcaaaacagaggauguggagaacggggcagccucagccugcucccaccagggucaacaucucccggcccucaccgacccuuuuuccagauucacaacaaacugaugugggcucuaggacagaccccuuuacacacacacacacacacucacacucuuuugcacacauccacagcugcacccaugcuauguacaggaacacacauacacauacucucuuccacauacaucaagaccauuuuuaaaagguuccaaaucuaccccuaaacccucccucucccagaaaugacaacagagacggcagccgagaucgguaggaaacgucucguugacagcucagagcuuaaaaaaaaauauauacacauauauaaaaaacacuucugcccccucccccaugaacggguccaggcagcuccuuccugcagggggcaggggagagggccaccagggcagugccuguuuucuugaaggcaccgacccuccuccuccccauguucccugccuccaguuccaaugcagggguccagguggcaggccccucugggaaggaaugggucuuccccaagcuuccaccccaccuuggauugggccgcagguguggagggccucaucaaacucuuugggaccccccacccccacucuccgguccauuguccaugccggaaccgcaagugcagaaguggguggggugggccaggcugguccggugcuggcuuagucugauaguugcugucccuggaggaggacccccaagggcugaugucucugaggcugcagaguccuggccugggcuccuccagcccccuacccccaccguauuuuuuuuuuuuuuuaaagaaagaaagaaagugggggaggccaggggggcaagggacagaacaugggggagaaacaaagguggucaguuggggaggggagcuccugggcucucccuggcugcccugggguggggcugagccucaguuggagucagagucugaggaguccccugaggaggaggagcuggagcugcugcccucggacucauuaucuucauccucaucgucauccucgucgucgucuucguccucgucauccucuucauucuggggggugagaaaggauguggagucaccagguggcccuccuggcaggacuccccuccccucccacugugcccugucugccccaccucauccccauccucgcucucguccucgcugcuggacucagaggagucgccgccaucuucagaggaguccccauucucaucaucuuccucuucuucauccucguccucgucauccucauccucuucaucauccuccucggacuccuuggagggauggaggcacaucaguggucucuggucucugcccaaccauuccaggcagugccccccgccccacgccccugcaucugggaggggcuccuuaccgacuuggacugcagaguaguccggcuggauuugggguuugggccucgcagcuuggucaugcucuuacguuucugcaggauggggacacaaagguggcagccaugaguucgacaccccugaauucccccaccccuaccccacugcugcucugcucccagacucacauuggagauguacucuuuauaugcugcacgguccuggggagacaggcucugggggagacagaagcggcaaggguuggaacauagccaacuacugcugacugagcaugcuggcccagugcuaggcagugggcugagcauuuauauaucaucaccccaucuuaccccucccaggcucccuagauuuugggucucugcagagagccccugggaucugagaacacagcucuaauuuuuuuuuuuuuuuuuuuuuuuuuuuugaaacagggucuugcucugucacccaggcuggagugcaguggcacaaucucagcucacugcagccuugaccuucccaggcucaagugauccuuccaacucagccuccagaguagcugggacuacaggcaugugccaccacaccaugcuaccuuauaauuuuuuguagagacagcaaucucacuauguugcccaggauggucuugaacuccuggccucaagugauccuucauaccuugggcucccaaagugcuaggauuacaggcgugagccacugcgcuggcccaaacccuaguauuucugcuucugauacccagaguccuucucuaaaccacuaagacuauugguuuucacauuuucccuguugcuuuucgcaaauggaagcuccuaucagagucuuccucacuccaaagaagugcccccgugaugagucagccuggcaucaucaaccacaccccaacaccaaacccuugagccaucgaugaggcaguggggcucaccaaacuccugaaacagcaaauccccacagucuuccuggguccuuggccaaccugccuuggugagugggaaggacacaggugauucucuccacuuuacagaucugacuacucaaccaaagcacagaggggaagcacaaaggccaggagucuaggagaggucccguggucccagaugggggaggaaaaggcagucugauuuggauucuucuacuuacugugugaccuugggcaaguuacuuaaccucucugagccuugguuuccuuauuuuuaaaagggugauaguggcugcggacgguggcucaagccuguagucccagugcuuugggaggccgaggugggcggaucacaugaggucaggaguucgagaccagccugcccaucucuacuaaaaauacaaaaauuagccagguguggugguacaugucuguagccccagcuacucuggaggcuguggaaggagaaucgcuugaaccugggagguggagguugcagugagccgagacuacaccacuguacuccagccugggcaggagagcaagacugucucaaaaaauaaaaaaaaaaauaaaaauaaaagggugauagugaccguuauccugaaggauugcgagggcauggaaugaaaucaugaaugagaccagccagcacaaguggguggaugggccaggcuaggauggugcuggcuuagucugaugccucucuguuccuuccaagggucccuugcccucucaccuuaacccagagguccaggugcaccuuguacugcuuuugcugcuccucggccagcuuuuuguagugcuccuucuggcucugggagaugcgcugccagcgacugccgaucuccaccaugcgcuccuucagcggcaggugguucagcuccccauuggacagcagcuccugggagaacuucugguaaccguuccugggagguggguugguagaaggagggucaggaccccaacaaagcagccauccagcccugacccuccccgaccuccagggcagacuccaacccccaggcucacaugggaggcuucuuggguucucccuggaauuucaucuucuuggaagaauuuguagcagcuggaggugcccgcaucucacucagcucucucuggagggagaaaggucacgcucaccccccagucccacccccaaaauacugcugccuucugccucaugccaucagcaccuuagcuggcugucuuuuucugugccagggaggaggagaaacagguagcuagugagcaacuuccuaacagcucacgucugaggcaggcaccacaguuuacaagugcuuucacaacugcucgcauccuccgagucagccuggagguuagcaaugucacccccaccuuacugaugagagacagagguucagagaaggaagcugagacuugcugagagucacagaccaaggcugggacuucuugcucagagcugcccaaccaaaggggaguucccgagcuuucaaugaaugggguggccccagccccauuccuaccucauaucgcuuuuggucuucggcugccuucuuaauccacaucaguuucuccuucuuuuccauguuauuccaggucauuuccauggcuuucaaggccuucacccggucauucuggggaccaauaaggguaucagccgugggaggggucacccggggcuagaggcugcaguacuacccuuucccaccccugucaccuugaagcgggccagguagucgccgauaacgcucuguugccagaucuccucagcucuuuugggggacucgggcagcuugccccguuccucgcgcuccccgccgggcuuccucuccgacugagccuugagcgccgccucucgggccuuguacuuggccugcggggauggcccgggcgucagccuuccacccacccccagggggcgcgcgcuccccgcgcagcagcccaggcgcucccgccggcgggcagaagcaugggcuggugcagaugucucccgccuggggcucgcccccgccuggucugcggcgcucagcugacagcuucccgccuuccggcugcugggcgccggccccacgucccagcccaggcaccgcguggcucaggcggccaggggcgagguggcacggcccgccaaggggaagagggggcccuggcagccccccugggggcacagcgcuccgccaggcagccugaccuucuucuucucagacaggucguuccacauucgggccagcaggcgggucagcucgcucucggagagcucaggccgcuccuccugcagcugccgccguuucuccuccgagaagaugaacauggccgacacgggccgcuugggcuucucggagccgcccuguccaggugcagagggucgggguccgugggugcugccagggagcccagucuugcccacccccgccugcgcggccgcacccucugcccaccuugcccccuuccugggcuggcuucuuggaggcggggcugguggccugcuucuuguugauguucagcaucuucucuucccccaagacccgcugcugcuccuccucaggcaggcucuggacaggaaagaggagcacggggcugcaugccuggcacccagacugcauggugcccuaucuccaggggcucaccagggcucugccugccaagucccagucuucucugcccacugccccaccggaggaacacucaccucgaggaaacggagcagcuccaccucguaaucuuucuuuuucugggaaagugaguggagucaggaucagucuggagacagugucaccacagacccugcaguacucggaggacagugaccuucagcgggccuccagagccugggugugggcuggacucccugccuggacgggcucaguugcuaagcccagcccagccccacacuguauuggaggcagguacccaaggcacacgccaccagggacugacuggcccaagaugggaucagaccucaugcuucaaaaccccaaggcaggguggccccugccacagcucaccugaucacacuucuugugauaggcguccuucuccuucugggacagcagcuuccacugcuggcugcacagcaccaugcgcucugugcugggcacguccuucauguuggccaugagcucugcgcaguacagcgaguagcuguuccuaucagagccgcggggagagaggugcagcccguaagcgagcagggcagcaggccuucucaccugcagagcccagcccaacuucccagcugcccacucgcccacccaucccagggcagcgcucacggagguggcuuggugggucgcccgucaaacuuguccuugagcuggcguucggccuuggugaggguggacuuggugauacccuccucacugauguucagcucugggugcuucuggauauagucucucaugaucuccugcagagccagguggggggacggagggcaaugggguguggaguuagcuagggcaggggcagggggagagccgcuggggagggcaggcagggagcaaagcuggggguggcugcgcgucaguggugucacacgagacguggugcccugcccugcccuagccugagaucucaugggggugggggguggggaagguaggggcagaggugaggggcccagaaggccccucccucaacagagggauggggagugacaccucccgcagagugcgguggccacggagucggagggcagaggcucgugaagagccggacggggaggagcgcagcggaagccuaaccucguacuccuuccgcugcuccagggccuuaugaauccauuucagccucuuuuuguccgagagcugagaccacugcuuccccagggaguccuucaccuccuucguaguggccugcaaaccaaaagccgucagacacgcacaggcagccaggggcagggggaggggggaagggggaagggggcacagaggcccccgcccccucaggccaugggaggucacaucagugucccccacaggccaggaggggaaggcggagaggcggggaucccgccugggugcaaggggacuggcucauacacgcacgcacacacgcacacgcuugcacgccagcuggcccgggcccuguccaugcagcccaccccuggggaggggccuccucuccugcuccccugcaccgugcccggccgaccuggcgcggcuccccccuggccaccgccgugcauccuccacccccaacccuuggccggacacucacaucuggccgcacuuugagauacaccuucuucucguggguguaccacagcugcugggggguuuugggcuucucugggauguccgauuucuuggcauucuggauuaggucggggugauccucccuagccaggacacggggagcaaggaucagcaggggacgcugccagggcagacucaagcuagcugccccacccaccaagccuccugggccuuucagcuggggcucagugggacgguggcugccugccugucucugucccugagcaugacacacuagggcucacaugugacccauccucuuccaugccucagagauggcaaacucaaggcucuggccaggguuagccuauucugcugcccccagugccccguggcccuccucugggcuccacugccuuaccugaaucgggccagguuucgcucgaacuccuguuucucucucuggaaguccugaauauauuucaucuggggggaggaggggauggggucacucaggacccaaggguaucucacccugagcuaugaaggccacccagaccccuccucgcuggcucuucugccucccacgcugugaugcagggaguggaggcuggcgcccugcccgccuccuggcgggacucaccacagagcagaccugcuggcuucuaccacagauggugggagcugcaggggucgcccagacacugaauccuacauccuauucucuccuucugagcaagagucccagaagggggccauggcauuacccacggucacacagugcgcaguggcagcgcugagccucccccacucguuucuccaacaccauagaacucucacaguggcgucgggugcaggccuugcuccugucacucccucuucucacugucuguggcagcugacauuagucuguccccuuguacguagccucuacaucuauggccagggcugggcugaguccuguuuccaaggcaugaggggagauuguguggaggggaacccagagcgaguucuuccaauacaagucucagccagcuacccugcaucuuccugcccaguucucacaccaucaccuucuucucuuucuccaggauccuggcugucuggccccuccagcccucccucccucagcccacucauucuuucccaccacuuggcuucccuucccuucaucacccccuuuuuagccuccccacucucaccucacucccucccugcaucuuuccccacuucuccauagucuccuucuuguuccuccuuuccaaugugucucuuucucuuccucaucgaccuucucucuuggcucccacacaauguccaucucuucuuucauccucgcgggcucacaagaguggcacuggcaggugccaggagcucauggcaacugagcccaaccccugccucuuauagaagcaccaggcauagaaaggcagugcuccuuucccacaguucccacagaaaaccagaagcagagcucagccuccucuucccccaucucaguccuccucagacaaaacaguuuuagaccugaaggggaccacacagaccuggcucaccucacauaaagaccaggcccacagaagugaaaugacuuaccaaaggccccauacacagcgguucaguggcagagccaggagaacaggcccaagucuugugucccccaggacagcaccuuguccacucuaccaguuucuucuggccuucccuggcucugacucuagagcuuggccucucccucccaucccaugagaguguuugggugugugcagucaacuguccaacauccucaucaaaggggucaacaguuccagcaauccauaccccucucugcuugggcagugguugcagacagcuggcuuuuuuggguacagcaccaagggcaugugagucugcagccaggguaugccaaccaggaaaaagggcuacucauagcauggcagcggccagugcccccuuuugagaacuggcuguguaugacuuuguuuccucuccaagcagaugugcuucuugucuuuccugcugcccuuccccaucuaucccuggcucugucuccuugucccgugucucuucuuuguguccucuguccccaucccaucuuccucgugucccaucugcaggcuccuccaauguuuugcugccuaucucugggagggaccuccugagcucugugacugagcccugccugggaggcuuaggcaacccuccacccagaguuaaugcuuugauggucugggacagugcccgaccucugcaaggaacaguaugaggccaggagggacaauguguguccuugagugaacacgugugcguggagaagugcacuucacagguggacguggcaguaacagcacuggacugggacucuggggcacuaaauccugcucuagcaucaauaguugugucacccgggacacuuaacccuccugcaccucaguuccuugcccacaaaacugggauaaccuuuuccuaggguuaccuuuauaaagacauugcaaguaucaaaugagaccaugacgggaaacgucauagagggugaagaagugcugcggagccuaacagugaggauggguguaugggggagagagagcuugaaacagaaugcuguggguuuucuguagggggaaagguuggucugagcaccugcugucugguuuacaucugugauggugccugugccugaccaugugugggccgaggaaggggcaaucagguguggcugcccaggaccuauucugcugugcugacucacccucaucccugaugccagguuucuccaaggccuaccuccaacugacccacaccacaccagcugcucccagccucuccccuccucccaccuuaacucuccuccccccaccuucuucuucuccggaagcuccuuguauuucuuggacagaaucuugguuagguccagguugcucaucucaggguggaguuucgcauacuuggcccgcuucuccaugaagaagcggaaauaaggggucaggggcuucuuugggaagucuggguguuucuggaagaagggacaaggacacaauggaggucaaauacaucccuucuuuggaccuuuccucccauaccccucaugcuccuccuccuaguaacucaccuugaguuuuuugccuuuguaaggauuuuuaacauguuccugagcaucgaggaucaauucugucaauguacggaacuuccucaccuggaggaagaggggugggaggaaggggaaguugggaaaaggaaaaugccacacaguaguauacccccaucuuauaacgggucucuucuacucuuuacuagacuaaauuuaccaaagaagagcagaggccaacagccaaaugaagcaggcagcaugacacccaggcacuggcccaugccuaccgcagaggcccaggcagucaguacacaccaaaggccagcaacaaggggacuaacugaccucaaccugguuguccaugcuaacaccuccgucaaucucagcaugcuagcaccuccgucaaucucagcacagcucaggcuguuuggcucaagaccacucagauagaaaguggcauaacuuuaagccagugcugucaaccgugccaccucccaaaaugcaaaggggcagguagagagcuaacgggagaccacaugaaugccucuccuggucucuuuccuuccuguuuacagccuguuucacuucccccaccacgcugagugggggguauguguguaugucagaaaagggggaucaguuaccucauuagaaaucuccacccauuugagcuugcacaugucuccagaaaagucuuuaaaugcuacuuuuucccaguccaugugugauucggugguuuugaacuuggagcugucauuggauggaagguuguucuucaugcauuccagcaaagucagcaugucuuccugggaccaacggucugguaaagaguaacagaggccaucaugccuggcucaugcuauccccccgaucuguuccccaguucuugagugcucaacucuuccucccuagggcaucccagccccugguugcuucccaucugaaggcacagacaagauauggcucagcccuaaggaaacuguggccauauuggaucagggcagggacuccaguccagaccaugcuauaccuagaaagccaggcucgaacucaagucuggcuugcuucaaggcuauuaucauuuauacugugccaagcugcaacgggcagcuauuugcuguaaggggaagagggguggaaaugaagguacagugauucagggcuuugugggaaacgagguagcuugucagagaaggagggaagcagggaagcaauauaucuaaaugugcugccaaguucaaguucugaguggauauucuaaaugugcaacgacugagaaugggguguggacaguaaggaaaauccaugcagaugucucuccugcacagcuggaaaccaauguuagagacacccaccacccccuagccccuuaaagcagaucaagggagaauuucuggcaaauaagaaaaaggaaacagaagcagaagcaggauacagggcagcucugaggcaagguaggcaggugcacagaaacucucagggcccugcuccagggagaacccccagaauuacaagcugucuugucagcccaacuacccagggaagcaagaacaggucuggaacaguuauuuuucagccacugaaaugcagccccagagagcucuaggccacuguggaugggcugggagaauagccacccaaggccagaagucaaaagggcucuccauuuucauuugcaucugguaaccugggccagagauucugcagaaugggccacguggacccauaauccccucuccccucaaugucccacaagcauggccagcuguccagcuucauccuacucucuauccccaucuagacuggaucacugcugaaugaggcagagaucuaguugaguacauauaucccauggcuuggggccuaaaaccaccaaaacagcccuuuucuccaccugccucuacaaaagccucauggucuuccuaaaaagccugagaagccuuccccaaccccuuccugacccuuccucuacacucauccuuccucccauuccaggacacugggcugggacacacuucaggcugaaugggaaccccagaaggcaggccuccucuaacacagagggugagggacagggagagaggggaggugagccacuccaggccaaauaauuuggauucagccaaaccccaagugugggagaugcuugauucauaaauacucaaggcacuuucucccccaguucaguguaugcagacugaaaaagcccuugaagaagggagugagccccgcagccacgagggaaagaggguuuaaguuucagagggccggggguggaugccccuaccuuggccuuugggggcggccauuuccaggucuguggggcagucggcuucuccguucauccuccagcuguccagccaccuccucggucgugcuggccgggcaacccggggucaaagccaccucacccuuuggaagacauaccaguucccacucaggaaggcugagaggugaacgacuaacgacuuucuaaccgcccagaguagaagggggcagguccacacucugagagacucagccaugaccuuauuagacuuaaggggucuaugggaaugggagugcgccccuccucuuccucgugacccccucccccagccccugcagcccggcuccgcggcgcgcgcccuccccuggccacgcgagggccugcuccuagcucccgcgugcagcgagcgcccgcccuccgccccgcuucccaaccccagccaaaaaaaaaaaaaaagaaaaaaucuccuccuccucggagcgcccgccccggggaggccccaggcuggagggcgggggaagaggaagggcggguaaagggcgcgcgcggccacggaagcgggcacgcgccccagucuccuccucccgccuccccccggccgguuccccccgccuccgcaacccggcggggacccggacgcagcgcagccgccgccagccccggagcggagcggccgcaccgcccccggggaccggauccggauucccgccgcuccccccucccgggcucccuucgccguccccgcccgcacaggcgggcaagcagccggagagaagcggccuagccugccccccgcccccgagccacccaccccggccagaggcgccgccaccgcccagccaccccgacgcgcacggaggagcccggcacagaggcgcgaccgcggcgggaaccgccgccuccucccccgagccugcggcccagccccgccggcgcccccgccccggccuccggggagccgagccaaggagagggcgggaggacggcggccgggaggcgggggcgcagcgcucaccggccccgccgcccccuccggcggccggggagaacugcgccugccggcuccgagaagcgcgggcuccuccgccagcggccggggcucggcucaggccucgcuuccugccuuccccucccccggcucucggcguccucccaagugcccuggucugcucgcgcccggucgccugcucgguggucgcuucggguccccgcugggcgcccaccgcaccccgcgguucgcucccgccguccggccccgaccccagcgcgcguccucagccgccucgguuacccggcgcagcgcggccuccgggcuucccgcuccagcggcucccucccuggcucugaguggcggcgcccucccccgcucggccgggcacagccgcagcucccucccgcggcggcagcggcuccuccuccgggcgaggcggcggcgcuggggcggcggcugcugcugcuguggcggcggcggcggcggcggcggcuguggcugcugccugcugcuccucgcggcgaaaagcacaaagcacagcgcccuccgccugcaggcagcccgcccgccgccggccccggccucagcucgcacaccccccgccgccgccgcagccucagccgccggagcggggaggaggagggagaagggaggaggaggagcgggagggggggcgggagaagcggggcagcgagcgcguccuuccccguagagcgcacaccgacccccggggagcgagcgccagcccgcccgccucgccggcuccgcucccucccacagccugcccgggcgggcuccgcggggggcagcugggaggaggggcgggagcuggggggacccgggcggccgaggcggagggaaggaaggaggggaggggggugguggugguggugcuggcggcggcggcggcugcugcugcugcugcugccgccgccggggaagggggggggggccggggcagggagacacgcagccgcccggauggcggcggggcucggagccuaggcgggcgggcgggcgccgagagcgaccucgccagacccgcgggggaacuagcaggcuucgccggcgagggagggccgaggugcggccgcggagagggugcccggaggugcccccggcguccggggaggcucggggggcgcccacagcccugcuccggagcucucccccaaguucucccagcucagacuagggcuuccaggccagcucucucccgccucccggagcgagcgguccgcgcccacccucaucccccggagcguggccgcugguuuggggcgcacgcacgccgaucgcggcguccagcuucggugccuaccucgcgguccucuccuugccgaacggcacauacgaaacuuaaaaaaaaacccgaaaacuaaaaccucugcauuaaaaaaaaaaaauccccguugcucuuuacaccccggaaacggcaagggaacgacgggcuccggcggaggggccgcugugggagccgguucaauccagcccggcaugguucuccaggccugcccgggcgcaugaagaucggcgccgccgccacucguagcaaccccucucccccgaaauccgcggcucccgggcucacuuaccgagcguguggaugggagcgcaggccgggggcaccugggagcacggcgggccgaacagucgagccgcagcuccgcugcagccgacgccggggcagcgagucgccagacaaagcccgagauggcgaagcggagcgacggcuaauggcgagccccacgcgccgcgcuccgcccgccccgcuccgcccgcccgcccgcccgccucggcgcagcgcagcgccgcuccgagcgcuugcccgucagagccgccucggcgccgccgccucccgggccaccccggccucgccuggccccuccgccuccuccgggcggcucagccucaccccuucccucccacugcucuagggguugcacaaaaaaaauuuuuuuuuuuuaaagaaaaaugguuuucgucuuuuuuuuuucuuuuugcagggcgggcauguugagacuuuuggauauuucugcccccagcucgcacucaccugcggagccgccgggagggcuaggggugggggcgcgcggggcuggagccggcgagcgcggguugaaagccagccaagcucugcagcgcccgacccgggcguguacgccgccgccaguccccgcagagaaaucguccuccuaccccgccu

SEQ ID NO: 16878 - RNA, 1671 nt, Homo sapiens
uccagcuucggugccuaccucgcgguccucuccuugccgaacggcacauacgaaacuuaaaaaaaaacccgaaaacuaaaaccucugcauuaaaaaaaaaaaauccccguugcucuuuacaccccggaaacggcaagggaacgacgggcuccggcggaggggccgcugugggagccgguucaauccagcccggcaugguucuccaggccugcccgggcgcaugaagaucggcgccgccgccacucguagcaaccccucucccccgaaauccgcggcucccgggcucacuuaccgagcguguggaugggagcgcaggccgggggcaccugggagcacggcgggccgaacagucgagccgcagcuccgcugcagccgacgccggggcagcgagucgccagacaaagcccgagauggcgaagcggagcgacggcuaauggcgagccccacgcgccgcgcuccgcccgccccgcuccgcccgcccgcccgcccgccucggcgcagcgcagcgccgcuccgagcgcuugcccgucagagccgccucggcgccgccgccucccgggccaccccggccucgccuggccccuccgccuccuccgggcggcucagccucaccccuucccucccacugcucuagggguugcacaaaaaaaauuuuuuuuuuuuaaagaaaaaugguuuucgucuuuuuuuuuucuuuuugcagggcgggcauguugagacuuuuggauauuucugcccccagcucgcacucaccugcggagccgccgggagggcuaggggugggggcgcgcggggcuggagccggcgagcgcggguugaaagccagccaagcucugcagcgcccgacccgggcguguacgccgccgccaguccccgcagagaaaucguccuccuaccccgccuccaucgcucugcguuucucuuccaaucagccggucgcuugguggcuccuccauucuccggccaagcccagcugccuagagcgagcuccacuccuccaucuguucgccgggguccucgcuccccugccggggccggcgagacggcgugaggccggagggggauuugcaaggaaaccugccugcuucccgcucccauugcuccauccccgcugccuccugccuccugcuucucuccugcgucuuuccaacucuccccugucgccacuggugugugucugagugugugcgcgguuuuuuuuuuuuaauugcucuuugcuuuugcaacccugaagcaaaaggggggggggguaguuacagggaaaaaaaaagcgagaaagaagcucuuagauuugcaacacaucggaaaaccgggggagcaccccgccuuauccgaucuccaugcuccgcaagggccuuccggguuuuaggacaagcuucucaaugucccguuucgcuggguuuaggauccgaggaguccgagcaaaaaguucucccccugggucguagugacgggugucggggugggaguugcggggauuuuucaagaagcagcagcuaccccggcgucggucacugggccgggguaggggaaagagcaaaaucccaguggguuugcgcgagggaucuucuagggucgaggcggguguggggggaguuggaaccgggagacaccgcuuggcgcaucucucccucggucucuaccuccuguccuaugccagcucccccuuua

SEQ ID NO: 16879 - RNA, 11796 nt, Homo sapiens
uggccgaggggggcgggcggcuggaggagggggugacggggccccggcucagcaccucggagagcucccuccccggccuuguuuugcucuggcaucgccgccgggggagggagcgagggggccgggcaccgggcgcaaaggcagggggauggccauggaaggguugaggggccccgucggacagagggcccagccgugauccagcgacggguuuggggcuccgggaggggugggggggcagcgggcggcggcagcaguggccgcacaucuggauggaagcgagcuuuguccagaccaccauggcucuggggcuguccuccaagaaagcguccucucgcaacguggcuguggagcguaagaaccugaucaccgugugcaggugggcaccgcuagugggcgggggcugggguggugagggagagggguugggguggacugcggaaacccggacugagcgcugccgcggagaaaagggaggggagaaaagggucgagaauaaugcguccacugucccucccaggcccagaacccagagggaggcugcagucuggucccuacccuucuaggccaagccaagccuaugcccgggccugggccuggggggugagggguguuuaauugguacuguagcuuccugugagaaccaggaagugacacugugugagggggaaggggguggggauggcuggcucccuugcugggaauggggcaggauggacagaggggaccccguggggggaugaaugcccuccaagcauacccucauugacacccaugucaaacugaccucucuggggugggguucuccaaugcucagauucuggagcagggaugggcagggucaauugggcauggggucagagcccaugaauccuuccagggaagggugaggggcaccacccaagacgugggaaggaccaagagccuggguuccagguucaaggggagaagaucgggaggacagggccacuggucucugaggguggaacgguugcaggguugggaagauucuccgugauugcggggcccaggaagugauccuguucacuucaaccugcagugacucacccucccugcccugcccugucccaaaaccagggcauggccagcugcucagccacucccccugcagcccacaccugcacucuccucuggugcugggauccccugucagcugcaaccuccccuggcccccaugccuaucagguguugcccccucagugcagggugcuccugggggcagggcucacucuucccucgccagccccaccugccugccacauaggccucagcucugcugaagcccaccugaugcccugaggcccacuagugcccaccugaugcccuggcuccuggcucccauagcuccuucccgguuccugggcacgcacuccaccacacugcaucugucucccagcacuagugcccagcacagugcugugcacaucagaccucugcagaaaugccuggaacuuuaaggaaggagagaguguagcaauggcccagcccacagugcagggcacugccuuuacccucauuucccccaaccccugccaguguguuauaaaacaaagauuucuguccuuggggccagaagguccuagguucaagcucuuacuccaucagcuuuagcugcgccaccuuggggaggucucuuaaccacucugggccuugggugccccaucauccccauuuuagaugucacagccacaccaaagaaugaaaauggcaccauccauguaggagccuagcucagugucuggcacacagaaagagcccuguccuaaugacgcucuuccugucccucucugcugucuaccugcuagguuccucuuuuucucuugccugccaagguagcugagccucuugaguacauggggggaaugagggaacucuccuugacauaggccagagaaggagaaguugaagggcugaaggugguuuagagcugggagggaaggauagaguuuuggggggucagggacauaacaaaggcucaguaacccccaggccccuacugccucaucacugucacaugguuugccuccagcucccagaacagcucccuuuagcaggccaugggcuccccugggcccuggccucccugucuccaugguaaccugcagcagccacugcaucuccuaucagggagcacaccacagggcucccgggggcaaugaccaccucugcggcaccccugaggacagauaccauauggcugccaugcugaacccaguccaggccccaucauggucugacccagaugaccaggggaaaucaagcuggcaggagggugcgcauagugaagcuggaauaaugccccaaacacaggcuggcucucagcagggccagccuucccagccacgaccccgcuccucaccaucccugcccagcggcccuaggcaccuaccuucucccaacccugccugggcucucaaccaaaauguaaugaggcagguacgauuguucccauuugcauuugacaagaagggacucacagaggggcccaaggccacgugagugccacagggaaacaggauuugaauccagcaggcugccucccucuagugcaaccccaagacugaccuggcucugaucucaaggcaguucaacuccaaguucaaaaggaagggggacgagggcucagcugugcaauuggccugagagccucagaggucagugguccaaggcuggagacuugcagaguagaggacaaagggcgguggagcaggggcugcuccaggccuuggucaucacaacagcugccaggaggccacagauguagcagaaagagcagaagcuucagaaucagaaucagacauaccugcuugacuacucauaagccaugugacuccgaacagaucagucaaccucuuggaccaucaauuucuuuaccuguaaaauggggaugagaguaauacuaagaggaccuaccuuucagggcugagcauggguaagggaaugcaugcaaaguacugugcuugccacauuauagggcuugauaaauauaagaagaaaaggacauuuccaagcagcucccauuucccuggacaccccgccccugcucugccacccacagcagggaaaucaugggauguuaggaacuguguccucaucccugcccuacuccauugcagggauggcagggggagauugcagggguagugacugcagagggagccugaggcuuagacaggacuggagagggggcacugcauggcuucaguccuucagccccacaggcuucccuuagucccuuccucccaaagaagccaggcccccaagccccuuccagggaucugcugccaaugcccccuccugcccagugucugugucaggcccauaccccgcaccuccccaccccacccccgcccagcucugcacugccugguucugggcagcuggugugugggaggccaagccgggaaggaaaggggggaaggggguaucuguguacugggagcccaccuggccaccugcgcaugcccacacuccaugugcacagugccaacucacaugcccugguacaggugacccccauccccaaaagggacugaagguugcuccagcaaucacagaagacagcucagguggggcacacacuggcuucuaacaccuaguugacccaggccucgcacacacagacccugaaggguggucuauggggaaggggcuccuggaccgcccccggcuugugccucaucuuccuauuuuuucagucccucucaccccuugcucccgaagcuuccuuucucuggcugucaccucuccugucacccacuuugucaaucagucucccaccugucacccuuccuccccaucugccacccucucacuccacaugacacgguaccucuauggucacuguagucuugccugucuccccacucgcucugccccccaccacauccaugcccuuccugaccuuucuucucugccgguugcucccugucucucccuccaucaccuguuuccucaccugacaccccacugccccaucuccccaccucgccgcccagguucucugugaaaacgcugcuggagaaguacacagcggagcccaucgaugacucaucggaggaguuugucaauuuugcagccauuuuagagcagauccucagccaccgcuucaaaggugggcccagcgccccucccccagcggucccucccccagcgccccucccccaguggucccucccccagcgccccucccccagcggucccuccccaacucccaaccuuuagcucccagccaccucuuucugauauacuccauggacucugaacccccucauugacccuggcccccauucugggccaugcacagaagcuuguguacagaucugggaagagggagaggccuuuggccuacaauccccaucaugggcaagcgauaugcuggggugcccacugcacacgugcaugugugugcacagaucuuugugggaggaggcugcuuaugcuuaugcaugugagugccucacuacauggacccucuccaaacucccuggucuugcugagcccccucccugcccuggcucagccugugccccagcagguccagugagcugguucagcucagacgggcagcggggcuuuugggacuauauccggcuggccugcagcaaagugcccaacaacugugugagcagcaucgagaacauggagaacaucagcacagcccgggccaaggugaggggccugaagcaagcaacugcucucugcucuggacacagggggccugccuguuucuugguuuuugcccccugugcacagcccaggggagaagggcccacaccugaugcuggacacaugagucccucuggggcagcaaguaaaggugaacaugauuuccagggccgggcauggauccggguggcacugauggagaagcgcaugucagaauacaucaccacggcucugcgugacacccggaccaccaggucagacuucccaggcaacucagaccacaggucucagagugcaccugcauugcccaaacacagcugauccuuaaguuccugcagcauccuucaguuccuggacuacaagucccagcaccagcacacauggcugauuucccucuuccagccuggccugcagucccaggacgaacucuuuuuuuuuuuuuuuuuuuugagaaggaguuucgcucuuguugcccaggcuggagugcgauggcgcgaucucggcucacugcaaccuccgccuccuggguucaagcgauucuccugccucagccuccugaguagcugggauuacaggcauacgccaccaugcccagcuaauuuuguauuuuuaguuucuccauguuggucaggcuggucucaaacucccaaccucaggugauccucccgccuuggccucccaaagugcugggauuacaggcaugagccaccgcuccuggccccaggacaaacuuuuaccaccaccaccaccaccacuugcaagucaaaucuaaugcccauuauuugccaucaaugcccagcacgcuccacccuugcacaccucuggaugagccucagccaugcaccaucucaaguguuggcuugcuccaugaucuacaacacagcccuucugucucuccaaacaacgaaagcaguucuguacuugcuauucacggacacagaguccuuauauggggaguucaaucccugcacuguggguucacagggagguugggugccugaggcaagggguuacaaggaggagugugccugugugggcaggugcaucugaagcugucuggguguggcggggggcauauaccuccccaucccaauuggccauacccagccugauguuuuuacugaauuccauuccucagucuacacguuucaaguuaacacguuuuuugcgcaccuacuguauaccaagcacuaaugauuaagacuugcuuccugauaugaaggaucuggguaacccaguacuugaugaggaagggguagcucagagggaggagucggcucagggaacacccauucuaggugauggggccacaggugcgagccccaggcugaagggggagagaggcuccaggccugcgugcagaucaggaaggagaauuggccuuccuucaggaugggguggcaguaagccaacaauagcagcucuggggggggggggggcgcuccaggggccugcugcauccucuggcccucugccuccccacagacgguucuaugacucuggagccaucaugcugcgggaugaagccaccauccucaccggaaugcugaucggacugagcgccaucgacuucagguggggucugccugacggcagugguggagggggcuguuucccccauaaauguccuaccccaaccccucacacccaccuccaacccuguggcuccucugccucagcuucugucuaaagggggaaguccuggacgggaagacccccguggucaucgauuacacgcccuaccuaaaguucacgcagaggugagcggcuccaugacugcggcggggcgggggacggggccucgggacauccuggggacguccuggucccaccgcccucagcggccagcgcagacgcgcggggggaggggcgggaccggccgugcccacugcucccucucccaagcuacgacuaccugacggacgaggaggagcggcacagcgccgagagcagcacgagcgaggacaacucgcccgagcacccguaccucccgcucgucaccgaugaggacagcugguacagcaaguggcacaagauggagcagaaguuccgcaucgucuacgcgcagaaggugcgcgacgccggcgggcccggggggcgggcgggccgggcgggggauccgggcaucccggggcggggcggggaugggggccgcggccgggacguccucccagccgcccgggcugagccggcgccccgcagggcuaccuggaggagcuggugcgucugcgcgagucgcagcugaaggaccuggaggcggagaaccggcggcuucagcugcagcuggaggaggcggcggcgcagaaccagcgcgagaaacgggagcuggaaggcgugauccuggagcugcaggagcagcugugagcgcacggccugcccuaaccccugacccccgccgccccgaccacaucaccgggugaaccccaucuucacuuccaucgacucuaacaucacccgacacgagcacccaccucuccagcaucaacccucugauccagccagccccaccccgagaugcccacaaugaucuucuaacauugcccccagcauaagauccagugacuuccaacagccagagcccacccuucaccuucaguuaucuuccgcuagaguggccauccaaccuuacugcagggaccccacgucacucacaaggaccugcgguguugcucugcaaccuucaacacgauugcauucaucgccucacucaccugcaccacaggcucacugaccgucaucauccgccgugacccccgaccucaccccugccgaucccuguaacacuucuucucuacgccuuuccaccacccugaucuugcggcaagauccccaagacgaucuuacacuucagggauucccacacuauccuccacugacguccccaucaccccagcugaccccaacaacacugcaccauucccuccaacucccaauauuugugcacgaaucccugucaccccuccaccccaguaccaccuccacuuccucccgggaucuggcccacugaccccaacaccguauccccauuuuugccgcucagauuucauuccugaccccucccucauccccuugcugaaucucccuuccucacuucuccuacuuccagccaggccugacuccuccucccccucccaggacaggucugauccccagugaccacgccccucuggcccaggguuccaaggagcucacuacaccccuggucaaucaauggcccucacugggaacgcuuaauggggccgagggcgccagcaacuccaagcucuaccggagguaagccccagccagguggggcuugggccugagagcgggucguccuggggaagaagggcuuccucuaccggcgcaccagcucucgcucugccgcagacacagcuucaugagcacggagccgcugucagcugaagccagucugagcucggacucccagcgccugggagagggcacgcgggacgaggagcccuggggucccaucggugagcucccccaacccaacacccaguaccccuccagaaagggcugaggcaaggcccugaggccucaaggcauguccucauucauucucuuagucuuuuuuuuuuuuuuuuuuuugagacggagucucacucugucauccaaguuggagugcaguggcgcaaucucagcucauugcaaccucugccucccggguucaagggauucccuugccucagccucccgaguagcugggauuaaaagcgccugccaccacgcgcagcuaauuuguguauuuuuaguagagacgcgcggcuaauuuguguauuuuuaguagagacggaguuucgccaggcuggucucgaacuccugaccucaagugauucacccaccuuggccucccaaagugcugggauuacaggugugagccacugugcccggccucucucagccuuucuugaggguuuagcacagcaaucgagagcuuacuuugagguggcagaacacagcauaugcagaacccagcauaaaucuggcugugccuccucugaccaugugagcuuggucaaucacuuuaccuccaugagucuauucuuuguaaauggggauguugauaaucaccaauguugucacauggugagggcucagugguuuuuuagugucaugacauccucgggggcucacaaacucucggggaacuccuuagacuaauuugcucuuaucucaugcacacugugaacuacuugccugaccauuguuucccccuucucuuuggcugccaggaagcucagagccaaauuaguggcucccuucgagcgaaugcccaggacuucaacgcaugcacuuuguguugaccucaucccuggcuucaccuugguuuuucccauccuaguucucccuaugccugaauauccugucuuuucuuuuuuauaagcaaccacacuguauuggaugacccuagaucuucuuugagacaaggcaggcuguggccauguagccccaucacacuguguuugugauugucugugugucugucucccccaccagacugugagcuccaugagggcagggaccgugucuuguccguucucuguauccccagugcuuggaacagagcgagugcucacuguguauuuaauaaauggacaaagagagaggaugacccucacggggagacagagacaucaacugacgauuacaauacaguguccccagcacggugccuggcacaggcaggugcuuaaccaaaguuuaacugaaaauggcaaaugcuguggaauaugccaaggucuccuggggggugacuugagggcugccccuucacugcccaccccucuaccaacucccacacauguagacuggucgcuuggccucaccugcccucucuccccagggaaggaccccacgcccuccaugcugggccucugcggcucccuggccuccauucccagcugcaagucccuggcgagcuucaaauccaacgagugccuggugagcgacagucccgagggcagcccagcacugagccccagcugaggaacagcaugggcagugccagccccaccugccaggggccauggacaccugccaccuuucuucaacaagagucccccaauccaggcuacccuuccagagaacgcuacccacccagccaggguucucucggggaagaucucgucugcucaccuuagcuuucugccuuggcagcacgggcugcggaagaaagcacgcugggccaggaggcaggggugcccaagccacagggagccccuggggaagccugcuccauucuucuggugaccuuggcgcuccuucacucaucuccccugcccccucaggaacugguggcccagcuuccacacccccaccucccagucucuagccucuccaucugucuguguauggccuggagucacuccuuccucagcccccagggcaagagagcucaaauaaaaaccagaggacugagggcagccuuguauguggggggcuggggaagggccccguccugaggucugaaggaaguggagucagugccugaccgaagaccaaggucaggcagcacuagcaugugcccuguggggacaggcaggccagcacucagggaggggguagcuucuguguccaaaauauuaggucugccuagggcaggcccaagacaugcaacugccccccaacccaacagccuuuaagaacuugcucaaaaccaggcugaggcggccgagcacgccaggggcaggauggaggcacacccuguagggccagugcccugugcuggccucagcaauggugcuuuggcccaaaguugcagaccccucuguuaggccagagccuggcaguuaagcaacccucacuccucugcugucgcuuaagugugcccuuaaggagagguguuaccaucccccauucuuuuuuuuugagauggagccucgcucuguugccaggcuggagggcaguggcacuauuucagcucacugcaaacuccgcuucccagguucaagggauucuccugccucagccucccgaguagcugggacuacaggcgcccaccagcaugcccagcuaauuuuuguauucuuaguagagacgagguuucaccguguuggcuaggauggucucaaucuccugcccuugugauccaccugccucggccucccaaagugcugggauuacaggcgugagccaccgugcccagccccuaccacccccaauucuaacccuaacaugggggggagguccccaaagggaccucaccaccagaaugucuacuuguggucccuuacacucuagguccucaccccgacucucgccaaacuggagagguccucuucauaggugccacucugggcagccaaaccagcaccagggucccucccaagccucccucccagccaccccaggccccagagggacaggcaccaggcagaaguucaucaucuuuagacuuaaggaauuaacaagggucagggagacuacaccaggcugagggcuucuugguuccuggagacaugcccagcuacagcaaacacagggaaacacgaagggggcagcuggaagauuuggucuugaacuugggggguggguaagugaugauccccacgacuggagcagcaggaagaaguugugucugaggaagugcugggccgcccagagggacagcccugcccuggagcuugucgccgggagggaagggaaacaagcccccucccucagugcugaggaaaaggcacuuggcugggucuccuccugcccucuccccauccgugggagagacgggguccuugccuccuugccccuuucagccgcccagaagccgguccugguucagccucuggaagaagcuuuugccgaacucauaggugcugaucaugauggcacaggagggggcagccuugaugauccgaggaaggaagccugcaguggaaaggaggcccgugucaggggucaggucgcagguccgccaugcccccacccccgacacccacacacugaccugcaaagagucccuuggugcccgacucggcccggauccuccgcagcagcagccagguggaguccacaugcaggggguucacugcaaacgcgaggccggcucagugagaccccauucaggaccccaccuguccccugccacggcaaucugggcccucaccu

SEQ ID NO: 16880 - RNA, 870 nt, Homo sapiens
uuuuuugcgcaccuacuguauaccaagcacuaaugauuaagacuugcuuccugauaugaaggaucuggguaacccaguacuugaugaggaagggguagcucagagggaggagucggcucagggaacacccauucuaggugauggggccacaggugcgagccccaggcugaagggggagagaggcuccaggccugcgugcagaucaggaaggagaauuggccuuccuucaggaugggguggcaguaagccaacaauagcagcucuggggggggggggggcgcuccaggggccugcugcauccucuggcccucugccuccccacagacgguucuaugacucuggagccaucaugcugcgggaugaagccaccauccucaccggaaugcugaucggacugagcgccaucgacuucagguggggucugccugacggcagugguggagggggcuguuucccccauaaauguccuaccccaaccccucacacccaccuccaacccuguggcuccucugccucagcuucugucuaaagggggaaguccuggacgggaagacccccguggucaucgauuacacgcccuaccuaaaguucacgcagaggugagcggcuccaugacugcggcggggcgggggacggggccucgggacauccuggggacguccuggucccaccgcccucagcggccagcgcagacgcgcggggggaggggcgggaccggccgugcccacugcucccucucccaagcuacgacuaccugacggacgaggaggagcggcacagcgccgagagcagcacgagcgaggacaacucgcccgagcacccguaccucccgcucgucaccgaugaggacagcugguacagcaaguggca

SEQ ID NO: 16881 - RNA, 8745 nt, Homo sapiens
ugccuggcacaggcaggugcuuaaccaaaguuuaacugaaaauggcaaaugcuguggaauaugccaaggucuccuggggggugacuugagggcugccccuucacugcccaccccucuaccaacucccacacauguagacuggucgcuuggccucaccugcccucucuccccagggaaggaccccacgcccuccaugcugggccucugcggcucccuggccuccauucccagcugcaagucccuggcgagcuucaaauccaacgagugccuggugagcgacagucccgagggcagcccagcacugagccccagcugaggaacagcaugggcagugccagccccaccugccaggggccauggacaccugccaccuuucuucaacaagagucccccaauccaggcuacccuuccagagaacgcuacccacccagccaggguucucucggggaagaucucgucugcucaccuuagcuuucugccuuggcagcacgggcugcggaagaaagcacgcugggccaggaggcaggggugcccaagccacagggagccccuggggaagccugcuccauucuucuggugaccuuggcgcuccuucacucaucuccccugcccccucaggaacugguggcccagcuuccacacccccaccucccagucucuagccucuccaucugucuguguauggccuggagucacuccuuccucagcccccagggcaagagagcucaaauaaaaaccagaggacugagggcagccuuguauguggggggcuggggaagggccccguccugaggucugaaggaaguggagucagugccugaccgaagaccaaggucaggcagcacuagcaugugcccuguggggacaggcaggccagcacucagggaggggguagcuucuguguccaaaauauuaggucugccuagggcaggcccaagacaugcaacugccccccaacccaacagccuuuaagaacuugcucaaaaccaggcugaggcggccgagcacgccaggggcaggauggaggcacacccuguagggccagugcccugugcuggccucagcaauggugcuuuggcccaaaguugcagaccccucuguuaggccagagccuggcaguuaagcaacccucacuccucugcugucgcuuaagugugcccuuaaggagagguguuaccaucccccauucuuuuuuuuugagauggagccucgcucuguugccaggcuggagggcaguggcacuauuucagcucacugcaaacuccgcuucccagguucaagggauucuccugccucagccucccgaguagcugggacuacaggcgcccaccagcaugcccagcuaauuuuuguauucuuaguagagacgagguuucaccguguuggcuaggauggucucaaucuccugcccuugugauccaccugccucggccucccaaagugcugggauuacaggcgugagccaccgugcccagccccuaccacccccaauucuaacccuaacaugggggggagguccccaaagggaccucaccaccagaaugucuacuuguggucccuuacacucuagguccucaccccgacucucgccaaacuggagagguccucuucauaggugccacucugggcagccaaaccagcaccagggucccucccaagccucccucccagccaccccaggccccagagggacaggcaccaggcagaaguucaucaucuuuagacuuaaggaauuaacaagggucagggagacuacaccaggcugagggcuucuugguuccuggagacaugcccagcuacagcaaacacagggaaacacgaagggggcagcuggaagauuuggucuugaacuugggggguggguaagugaugauccccacgacuggagcagcaggaagaaguugugucugaggaagugcugggccgcccagagggacagcccugcccuggagcuugucgccgggagggaagggaaacaagcccccucccucagugcugaggaaaaggcacuuggcugggucuccuccugcccucuccccauccgugggagagacgggguccuugccuccuugccccuuucagccgcccagaagccgguccugguucagccucuggaagaagcuuuugccgaacucauaggugcugaucaugauggcacaggagggggcagccuugaugauccgaggaaggaagccugcaguggaaaggaggcccgugucaggggucaggucgcagguccgccaugcccccacccccgacacccacacacugaccugcaaagagucccuuggugcccgacucggcccggauccuccgcagcagcagccagguggaguccacaugcaggggguucacugcaaacgcgaggccggcucagugagaccccauucaggaccccaccuguccccugccacggcaaucugggcccucaccucucacagccuccaucgcucccagagcgaccuggcguugggucuuuaccacgucaaaggguagagucagcacugcagccaccugguggggugggcggggagagggcucagcuccacuuccuggacccccaccccuaccucccagauggcucuugcggcugggagggacaaaggccucauggggucugcuucugggcaucuccaaaaauccucaggccccccgcagggagaccuccgcuggccucaccuccagcccaguccacucaccgucccugagaugccaccagccacaaagcucaugcccacagaagucugguccuucggccugaacccauugagccagcucuucaccagcucauaguugaaccaguacagggcuuggggugggggaugcacugauuagagacgggaagggcaaggaaguggccccagaccguccaccuuucacugccaccacucccucccagcugugagucuugucugcuacaugcaggcucagaagcaggcacucuguaggaauuaaucuccugaccgccugggcaaauacucuaccugcuaggcccacuucacagaugagaaacccauggcucagaaaagcuaaguaacuucauggucacuagucacaaagcugggacuuggcuguagacccuuugugcaucaccccaggguucccucacccacccccugcagcuugggugccuaccugagaagggcacaucucgaagggcaguggggccccagcccagccacagugagcgccagccacccugagccacugcaguucgaacacaggcacccagcucccgguacgacacaugcugagccugcagcuuuguccgcauaagcuccagggggcugaucacagucacggugcccacuguguggggauugggggugacaauggggagaagugagaucacaggucuuacauggcaucaccuaccugcugucccaggucuggggaccuagaacaccccccuaucccuaggcuggcagagguuggggcugggagcugggacugacuggguuugggccgagguggggacagagggaggucaaaggcccaagacuaugcucacggcgggccagcgcgccagccaccaugggugcguagaggucagaggucagggcucgaccacacaggaaggccuucaguuggucauaggcagugaaguagauggcgguagcuggcacagucaucacccuggggauacagagagagguuagcugggacucccaaaaggacccaaacuuuuaaagcaucaccugccccaccuagccauucaacagggagcaaagggucaggaaguaccagaggagaguggugcaggacccggcuacucacaggguggcggggaggccgcuccagaggguccuggugcccucgugccucacgaucuucacgaaggcauccuggccaagcaggcaccagcccaggggaagaggagggacacaagugaugucugugauggggcuggcccaggcuaggccuuugccugacgcccucagccucugcccacagcccucaggccucccugccucuacacaugcaguaccccagcagcuggguccaggcggacaccuggucacccuucaaaaaccuuauggaggccaggcacgguggcucacauauguaaucccagccagcacuuugggaggccaaggcggauaaaucacuugaggcaggaguucgagaccagccuggccaacacggcaaaacccugucucuacuaaaaauacaaaaauuagcggcaggugguggugcacgcuuguaaucccagcuacuucggaggcugagacaggagaaccacuugaacccaggagacagagguugcagugagcugagaucacaccaccgcacuccagccugggugacagagcgagacucugucuaaaagaaaacaaacaccccauggagguacugccuucuccggaagcacuuccugacggaaccggcuaccucugcgugccuugcccaaucccuuuacuccugggucugcugcccagccagaccgaacuccucacggacaccgacgaaucccuacggacccagcugcuccucaccauggugccagugaagcggguagggucuugaaaccagguggcacagcgggcaccauuugggcacagguacagaggcuccaggacaccauugcaauacaggaggcacuucccuguggauuggagagaggagggcacuggggaaaggcagggggcauuauaaugacaggauccuagaaccuugcagggaggcagugggccccuaucccuggaaggccaguaaaggccaggucccuguguggauguucuggugcaggucacaggacuggcuggcaggaccugggaguauaugcuaguccauggcuguggagcccacuggugcccuggggacagggacaaggacugucucccccuugcacccucccaugcucccuguggcuuggggcacucacauuugguauaggagaggcuccacagucuggaggaaggcaucagcucuaaaauacaaggcagccccucaagucaggagagcccccacccgcccuagggaccccaucucugggagaucuuuuuauuuuauuuuuugagauggagucuugcucugucgcccacccuggagcauaguggcacaaucucagcucacugcaaccuccaccuucccgguucaagcgauucuccugccucagccucccagguagcugggacuacaggcgcaugccaccaagcccggcuaauuuuuguaguuuuaguagugagagaguuucaccacguuggccaggcuggccuugaacuccugaucucaggugauccacccaccucagccucccaaagcgcugggauuacagguaugagaaaccacggccagccucugggagaucuuucuuuugcccaggcaccaccccucacuaguuccaggucagguacucaccgcuggccauggagggccgcugagacugcaggcgaaccuucaccacguccaggggugucacugggggaggaagcgggucugaaggcuccuuucaggaccccaccccuaggacuccucccccaggaccacacagccuccaaucuccggucugccccauccccacccgcccccaccccaccuccccuaggucuuacugaagagagagguaaccacagccccggugccugaggccaccauuugcuggagggggcugaugcccgcaggguccuggucagccaucuugaagcuucaguccugaaaaccaaaccucaaacagaccacaacuccagggauggcaggaaaggaggcugggccacugugagacuuuuguuuugagacggcgucucgcucugcgcacuguugccaggcuggagugcaguggcaccaucuuggcucacugcaacauccacccccguucaagcgguucucuugcuucagccucccaaguagcugggacuacaggcgcgcaccaccacgccuaguuaauuuuugcauuuuuaguagagacaggguuucaccauguuggccaagaugaucucgaucuccugaccucgugauccgcccgccucagccucccaaagcacugggauuacaggcgugagccaccgcacccggcccacugugagacuuuaacccaacccucauccaccgcccucgaaacaucuguugccucaacaacccuggcaaugaccucuaaagcagggacuguccgccccccuccgccggggaaaacuaaggcucggggagacgagguggccugcccaaggucacucaggagugguuccgaaggaagcuagggugccagaccuaucgcucgaaugcaguaggagccaggguccuucccucguccaccucgcacguguccacugcgcaccuccuacgugcaggcgcggauuuggcccucguggccccaaaaucagaguaccugugcugcccccacagcccccacuccagcaccaaggccccgggcaggcaccugagagcccaaguuacugggcguggagggacggccgggcaucgagggugacguguaaacagauccggugaccaagaagggcccgucgccuccucaggacugcgggcugggaugcccggcccuccccgcccggccggacgggccagacccggggcccggagagaaagagcagucucuggguucccgccccaaaaugcaggcccggggcgcagccgggagagcgggaaguaggaacguaggaccaggacgucuccccgacccucggcgacacucccggccccgaacggcggagagccgccaggugagggggaccacgccagcucgacggccccagcaccugcccuggcucgcacggccgcccggagacccccgcuuccgucuccgcccccagccccggcccagugccgccuaccuggcucuaggcuggugcucgugcggcgcggcgcccagggucaggcgggcccauaccggcuccgccgccugugcgcgguccgcgcgcgcucgcagcgcaccuaggccgacgccgaaagcagccaagggggccccgccccuacaccgcgccacgaggccccgcccgccgcgggccgaccagccgcaagcccggaguguccccggcuccgcccacucgcgucuccgcccggaccugcgacggucccgcccccuugacggggccgcgcgggcgaguuccaugccuguccagcgcugagagcugccggccaacuucgcggucuccacgucgcgcuuaacguggcagcagcacgcacuuccagcaucuuuuuuuagacagcaucuuuuucagccucgcucugucgccgaggcuggagggcaguggcgcgaucuaggcucacugcagccuugaccucccggguucaagcgauccuccugccucagccuccggaguagcugggaccacaggcgcgcgccgccacgcccggcugguuuguuacuuuuauuuuugucucccuauuuugcccaggcuagucuggaacuccugggcucaagcgauccgcccaccucggucuucgaaagugcugggauuccaggcgugagccgccgcgccggccuuaacagcgcauuuucaccagccccgccccggccgcgcgcggcacuggaaaccccagcgccuucuggacggcgagggugacgcacuggcccucuuccucgguguccucaggugcguggcggcggcagugagaaugaguucuucgagaucgccgggagaccacacaauaacgacgaaguuacuugccgggcuacccgccgagacuugaaaacuucgcggcgacuucucucgccggccuuagcaucgcccccauuuuucagguuacaggacaggccugcaacugcaaaacgcuuuguaaaccacagggccccgcgcgggugugcgccacuggguuagcugagcugcagcccgggccgggcgggcugggacgugagcaagccgggggagacgggagagccauggggagccagaucccaccuucgcgugaccuugggcaaaucacaaccucgccuaaggcccggaaugacucugcgcggagaggaagagcacugagugcgggagggcaucgacguuuugguguugguugcucucguaucgugauuucuucugagucucaaaacucuuugcaguagguuauuguugaaauagauuaccacaggccgggcgcgguggcucacgccuguaauccagcacuuuaggaggccgaggcgggcggaucacuugaagucaggaguucgagaccagccuggccaacauggugaaaccccgucucuacuaaaaauacaaaaguagccgggcaugauggcuggcgccuguaaucccagcuacucgggaggcugaggcaggagaaucgcuugaacccggccggcggagguugcagugagccgagaucgcaccacugcauuccagccugggcaacagaguaacacuccgucucaaaaaaaaaggccgggcgcaguggcuuacgccuguaaucccagccuuuuuggaggccgaggcgggcggaucaccagaggucaggaguucgagagcagccugaccaacauggugaaaccucgucucuacuaaaaauacaaaaaauuagccgggcgugguggcgcaugccaguaaucccagccacucgagaggcugaggcaggagaaucgcuuaaacccggaaggcggagguugcggugagccgagacugcgccauugcacuccagccugggcaacaagagcgaaacuccgucugaaaaagaaauagauuaccccguuuuacagaaagugaaacugaggcucgacgugaagagccggagauucgaaccggccgggugcuuuucccagggcuccacacugccuccccgggagacaggaaggcuuaaguccag

SEQ ID NO: 16882 - RNA, 5901 nt, Homo sapiens
gggaacuccugagggagagaguuucagggaagcugucucagcggauuccagguuccagcuguauuucuaaagauuugugggacucugcccuggggagaagagcagagggaaacacgaaggccaaaacagcaaaggccagggaggcaaggccagccagcaguggggcugggugcccagugcuccugggugaguggagggagacaaggccugcugaccacaaacugugagggccuugacuguggggccagacagaggggcugucagccagauggagcuccagacaccuuaggcuagggagggucuggaccuggacagacuacagaaauuggugagcaggaaugggagguggcagugaguggcagggccccuggcucauucucccucuguccucauuuccuugcucuggaggggaggguggugaacaaucuucucagaggagguuagcugugggaggacagcuccuaaggagcauuuccugccuuuggcucacaacugcuuccuguccagaccucccaacacuugacccccauucaauuccuuccucccagggcagcuggguggccacgaggucuucacagguccagagacccggagcuucucagcaagcugaaugaggcagcgucccagggguccagaagcccagccucgcccggcgcuggugaggaacuggaauccaggcuuguacugaaagccucagggauagauuuggaggaggaagcccgagauggcgccucucucccaccggcuaggaccucaguucccacuuuccuaguuaccucuuccacccccucaccuccagcugggaacuuacaucccuucuuucauuuauagggcacuuuuaggcugggugcagugguucacgccuguaauccuagcacuuugggaggccaaggcaggcggauugcuugagcucaggaguucgaggccagucugggcaacauagugagaccucgucucuauuuuuuuaaaugaaauauaaauauuuuaaaaauuaaaaauucaaaaaaaugaaaaacaaauggcacuuuuucuucccaaacaauggcuggggacuucugaagggaaagggaggcaaauucccuaggaaauaaucaugagugauuacuucuccagaaacaccugaggccuccaaugaaccccuucuuugagagucaaucugcaguuuucucccugguucugagaugucaggccagguuccaaagaugugagguuuuuuuuuuuuuuuuugagacggagucucgcucugucgcccagccucgagugcaguggcgcgaucucagcucacugcaagcucugccucccggguucauaccauucuccugccucagccuccugaguagcugggacuacaggugcccaacaccaugcccggcuaauuucuuuguauuuuuaguagagucgggguuucaccauguuagccaggauggucucgaucuccugaccucgugauccacccgccucggccucccaaagugcugggauuacaggcgugagccaccacgccagccuaagaugugaguuuugagagcccaucacagguuguuaaaagugugucuggaguugguuccuucccauggguucuuggucuuacaggcuucuuggguucuuggucucacagacuucaagaaugaagccguggaccuucgcagugagugucacagcucuucaagauggcauggacccaaagagugagcagcagcaagauuuauugggaaaagcgaaagaacaaagcuuccaaagcagggaaggggacccaagcggguugggucuccuggcugggaguggggguggggauggggggaguggccagcuuuuauuccuuuauuugucccugcccacauccugcugauugguccauuuuacagagugcugauuggucuauuuuacagagugcugauugcugcauucacaauccuguagcuagacacagagcacugauuggugcguuuuuacagagugcugauuggugcauuuacaauccuuuagcuagccaagaaauucuccaagcccccacuccacccagaaaguccagcuagcuucaccucucaaaaggagccagaucuuucuccuuuaucucuuaaaccuaagccaugccugcccacccccuagugcaggguacacuacaauacuuaaaauggggagaggacuaccccaaauaacccagcccaucucagcucaaccaugagccucugcuaugccucuaaaucaguccugcccucuuccuuccauaaauccuagagaccccuaggagaugccccucaccagcagcauaccagccaggaaucccugaguccuccauaaaagccacacuuggagcugagaugacccuaggggagggggcuuagucccucugccuugcucugccccuuaaccaccagguagaccacaaguguuuguugcacaucauaccccacuccccacagacccccacuuaaggccagggcagaauuaaaggauggaauugcugaaagaaggggucuucucccccagggaugcuuggucucaguccacagggaaaggaagguccuacggguguggggagugcaggccuggcugguccccugcucucugccagcucuagagcacccgcuguaccgggggcuccccuugguggggucaggaaaaguccacgggagacuugggggaguggaggggagggcccuggggaaaauuaauguggaucaagggcuugaagacguuccugacucucccuccccuccccuacccccacccccacgcccgccucagguggaccaaauacugaggaguggauuugugugagccuaaacacaagagcucugggguucuauuuccucuuagucauuuuccaaagcugcaccacccuaccacugccuggcugguguggcaucagagggcucuagguccccagcccugcagagaagcccuucugaaugaaggagaggcccaccagccuggggagaagaggugaguccccgacucccuccgagacagagccuccuccccuucucaagcaccccgaaucucugcaccaccaauucacccucagaucuguuucuuucuuuuuuuguuuuguuuuuuguuuuguuuuguuuuguuuuguuucccccgucgcccaggcuggagugcaguggcacgaucucggcucauuacaaccucugccuuccagguucaagcgauucuccugccucagccucccaaguagcugggauuacaggugugcgccaccaugccuggcuaauuuuuguauuuuuaguagagacgggguuucaccguguuggccaggcuggucucgaacuccugaccucaugauccgcccgcuucggccuccccaagugcugggauuacaggcgugagccccaggucucuuucuuaaaaugucuuuucccucuaucuuuccccucccagugauccaaaagcuacgccugauuuggagaggggguggcaagugggaaaggaggagggaaggggcaguguggaucgaggagggggucacccccacccugacccugagcacccuagguuuggccccucugggugccucccucuuuggagaacucaggaagccgaugagcuaguuugcgagcuggggguggggcagugaggagacuggggaggagggaggagaggggagagugaugggagccgcggcugggaggcuucggaagguugaaggcuggguuugggaggugagggcgagcgucccucucagccccguggggggauaugcaaagaauugcuaauugcaacuaaacgaggccucggcgugggggaaggggcagucuugcggcugucaggggcuaccgccucuuugagugcccggguaaggccaggccagcccgcucuucucauguaaagcagcuuuuugucugggggagccagggcuggggccaggggcuggggaaggggcccaagccaucagcaaguuucuuguuccccagaaagggagaagggugccgaggccuccucagagugagaaugccccccuccuucuccacucucaagcuuuuuauguggggguugauggggugcugcccagcaggagggggugggccugggaucccaguaccccccuugcuggacugugggaaaaaaaagagcacaaagaagggggcuggccccgcugagaugggagacggggcagcucugauccacggaugcccugaggcugaaguacccaucccuggauccccuucuagagaauguccccauuggccauguaucuuaucuggucaucugggcccauuucagacuuucucacccacuuugcaaacccucccuaaccuuuguacucugaggagauggauuuugugaauccaaguuaguuccuaacugagccuaacuagagggagaagaaggacucauaccuuuggggaaaucuuugcucuaaacauagggaccuacgaauaaugcuuccagacccuggggccacauaaccuguuagagacccaagaaucuugcuuucuaauucagaugcccccuuuuaugagcuucuauaaacuugggcaaauuauaucagcuauugagccucaguuuucucaucuguaaaauggggacaauaucauccucucaaaauccuugugaagauauggaaagaugcaacgcaucccguauggcagucccugguucucaguguguccccuccccuccccuggaacaucuaucaaaaggauggauacacacacacaagcacuucagggauagugauaccucauguccauaucacacuuugcaauuuccacaaugcacgugacaucucuuucucuuuuuucuucuuuuugagacagaaucucacuuugucgcccaggcuggagugcaguggcaugaucucggcucacugcgaacuccgucuccuggguucaagugauucucuugccucagccuccugaguagcuaggacuaccacccaccaccacuccuggcuaauuuuuguauuuuuaguagagacggguuuucaccauguuggccaggcuggucucaaacuccugaccaucagugauccacccgccucagccucccaaaaugcugggauuacaggcgugagccacaacgcugggccacaugucaucucuuaaugauacacuaucuaaucaauggaacagacucuucuuuucuauauuuggugaaaaaaaucaagauuccaagagcuuaagucagauccccugacaccucugccaaugcucaucccacuccaugguguggccucagggaucccaucucacagacuagacaaauggagcccaaggccagagcaaaaccagccggagacugucaccguccaagguaucacccaggguuucucaauagcacagcuugucuuaguggccaccugcacucuucuccuaaaucagugcuuguguggaaacuuuaggaccauguggguccccuucucucagcuccacacugggguccuugagaagcagagggcuggcuggaggauaggaaggguuguccccuccccucccagcagaaaaccucugggaugacaccuucacucugagaggcagcgggaugacacggauagaaucgcugggcaagucaguucuuucccuccucccuuuuccugcuagaaguccacuucuucaucgagaaaugucuccuccguuccuuccccccucuauuuugggggccccggggucuagcuccccaucccugugugucgcuccggcuggauccccauccucccagccccucggccaaguggaggaugcugaucugacugccuccugccagacaccuagggccuccugcucccagagggucuuggccaaggggcucuggcgcugggccggugccuuucucacugcccggcucccuccucacaggccccuaauccaucucacccagcaggaagcccuuaagcugccuuuucagccgccuuccccagcccgcugugggcucugugccuuucuauaccacccu

SEQ ID NO: 16883 - RNA, 6744 nt, Homo sapiens
cucuuucugugagcccaagcuccucucuuuuccuugggaauggagcccggcagaggccacagaaggaagcaggaggccaaaugcuccucucucacuggggcucuggguuggagguuggugaguuguucaagauggcaacagcagcuuccagacacucucugacaacacgaaggccacgucauaugaggucucagcuucaaguacaggaguugcagcccacuguagggagcaggagcucccaggaguccacgcacucacaugggguaauugagcacaacauccuguuuggcaaguuccagcaacauaggaucaucgaagaauuugcugaugcucacaucuucacugaggcccugcagggaauggggcaaauauaagaaagcccgagguggucgcagacuaagcaaggagacuauccaagaccuguguucaguggggaggcuagugguggcuggaauguagguggugguguuucaggagcccugccuuuaggguacuaucacaugggaggauaaggcucuccuuucccaacgagacuggggcccagguuugguugccuaaggaguauacagaucauaucucuacauuggaaaagugucccuuaggaaaaggggccaaaagaaagagagagagauccugcuucugagaguccugggggguugagggauggcaacaggcccaagggagacauaccuuccuacggcggguuuugaucaugaauucccgggccaggugaggagcuggcuguggcuccaaggggcggaugacaaugcucuuguccaggggaucaccaggcacaaucuaaaaggcaaaggaauuucagauggcccaggcagaauucccagaagauucaggcccagaagcaggacucuucuuauuuauuuuauuccuaaauuuauuacuuauuauuauuuuuuugagauggaguuucgcucuugucucccaggcuggaguacaauggcaugaucucggcucaaugcaaccuccgccucccggguucaagcgauucuccuaccucagccucccaaguagcugggauuacaggcaugcaccaccacgccuagcuaauuuuauauuuuuaguacagaugggguuucugcauguuggucaagcuggucucgaacuccugaccucaggugaccugcccgccucagccucccaaagugcugggauuacaggugugaaccaccauagccggcccuauuauuucuuuuuuuuuuuuuaaacugagagacacagauucaaguugcccugaauauaugcuccccagaggaggacucuucuccaggaugcuguacaccucacuuagggcuuggagagggaucaggacagaaggggaugaggcuugcagaggugggaagccaaguccgccagccugcauugcuuucucaccugccagugguggaagacagacagagaaaaggcuugucccugggugugaguccggagaucagucucaaagccaaaagagucgauggccgggauaaaagcuuugaugguguacagaggggagccugggaugggugcauccugagucacgugcccccugagacagaaaaacaaaggcugagccucuagucaaacauaggccaaaagccaagaagcaauccagcauuugcugucccccaaaugcauuccagcccagaguuaccaucaaagaaagaguaaccaagaauguucuacaaaaagcagaaaaggcucagggcucucaguauaauucccuguggaagucaaaguggcagcaaccucugggcagaggacaggagugggauggugaagggacaagggcccaaagacauucccaucacugacuugccucagcacugccuccaacagcucugugaggaggggaucccaaaagaaaugucaauuuuuuuuuuuugagacagagccuugcucugucgcccaggcuggaaugcaguggcgccaucucggcucacugcaagcuccgccuccuggguucacgccauucuccugacucagccucccaaguagcugggacuacaggcacccgccaccacgcccagcuaauuuuuuguauuuuuaguagagacgggguuucacuguguuagccaggauggagaaaugucaaauuuuaaucugcagaaaagcgggggcuugccucccuccgcuccuacuucuuucuggaaaaucagcucucgggguuuccagagagaggaggguagagaaggccaaccucucuucccuguaggagccgaggugacucuuguucugcucuugcucucagcacucucccuaauacgccuggggccgcucaccugcgccuggccaggacgguauaaacugcagagacgcaaucugcaggggccuggaccucuacaaaguaguaaggcuccaucagacgaggaguagccugcagcagagcaagaagaaaggccccucagcuuggggaaggcugggggccuauagucccacuugcuccuucacuuaguccccuguccagugaagcagaugguccccuaccgccccauucucuuaccaugaggaaggcagaguagacgacucuccuggcuguggggaugaucuggcccccgccccggugcaggggcuccugggcaaccaccgcauccaggaucuuaaacuugacauuccgaaucacuguaaaggagguggagggagugacuggggagagguucugggccugucauggggccauggcagaguagcagucuccugcaacacugcagcugucuugcagucaugaaagacaugguacagaaaucaaaugggaggugggcguucuaacugaauaagcaaggcccauggcagaggucagaaguuaagcauauguucuuaguguuugcuucaggccaugcucagacuuagagcuuuccuagaaguuuauuuccuucuucugcacauauuuacauuuuuguggauguagaauaaauuccagaauuguacauuugguccaugaagcccaaucagggucuauaaaccauuccaaucucaucauccucuugauaucucuucucaaauacguccaacgccaaacccuucucagaaaugaggagcaaaugacaguuuagaaaugacuuaaauuuccauuuccaggcuacaccaccaggauaaggaaggaaaagggaagaagcuggcccaggacuugggaugguccuguguaccccaagcugcuucuccugccgaauccuaaagauggugagcccaucccacucauaugccuggcugcaaggacccucgaggacuggggugggggagugcugguggacuuacauucaucacagagggggcccucccugguuccccacuggaaaccuugaacgaugcuguccuucacugaaccaagaagagccuuguccaccuauagagaaacaugaggccuccuuagcagucgcccuggcaacggcugaagcauuuagagggagaagacagaugugccuguaaggggauacuguccuucaccagaggacacaagauacuuuugggaaaagaacacuuuguaguuucuuccacuccagagguaagagaccgccacccaguucccaucaguucugcuguaccucagagggcagaguaucauccaccagaauguuggggccagucgcaucagggccaaaagcccagauggaacgggcagccagcagaucccaaucguacuuggucuggaagaacucucccagcuucuuccuggggaagggaggagacaauggagcugucagccagcucugugauugcugguccuggagccacagacccucccuuccuggaagacagucacuucauccuacccacugugcccagaacaagagcaaaggcaaagacauaaaugcuccccagaaagaugugugcucuuagagacccggcaguuaaacuguggcaucccugccuccuuucgacccuggcgucagagcccuguucucaccuguuccacguaaucuggaccaccucauucucuauguccucugccaggcccuucucaagaggcucagcaaucauggugaucuuguuccuggucagaauggaaaugggugguaaggacggcuaacagaacagcagaagaggcauuacuaagaaaaggguaacaagacggacagcugaggaagugacaucagugaaagccacaggggccaagcguggugguucagaccuguaaucccagcacuuugagaggccaaggcaggaggaucacugaaacccaggaauuugaggcugcagugagcuauggcucacaccacugcacuccagucugggugauacagcaacauacugccucuuaaaaacaaacagccaggcgcgguggcucaccccuguaaucccggcauuuugggaggccgaggugggcggaucacaaggucagaagaucgagccuacccuggccaacauggugaaaccccaucucuacuaaaauacaaaaaauuagcugggcgugguggcgugcgcuggcacaugccuguaaucacaacuacucagguugaggcaggggaaucacuugaacccagaaggcggagguugcagugagccgagauugugccacugcacuccagccuggcgaccgugcaagacucugucucaaaaacaaaacagaacaaaaaaaaaccccagacaaacaaacaaacaaacaaacagaaccugggcaacaaagcaagagaccccaucucuauaaaaaauuagccagccgggugcgauggcucaugccuguaaucccaacacuuugggaggcugaggcaggcagaucaugagaucaggaguucgagaccagccuggccaacacagugaaaccccaucucuacuaaaaauacaaaaauuagcuggguguggugacacucacucccuguaguccuagcuacucgggaggcugaggcaggggaauugcuuggacccgggaggcagagguuccagugagcugagaucgagccacugcacuccagccugggcuacagagugagacucuaugucucaaaagaaaaaaaaaaaaagaaaaacaaacccaggugugguuagcacaccuguagucccagcuacuugggaggcuaacuaagguaggaggaucgcuugagcucggaagguugaggcugcagugacccaugguggcaccacuguacuccagccugggugacgaagugagacccugucucaaaaaaaaaaaaaaaaaaaaaaaagccacaguaucaggggcaagguggagcaaaaagggcaaagggcucaucuuucuuucauuucaaucuacuggucuuuaugaaaguaagguuuaagcugggcgugguggcucaugccuguaaucccagcauuuugggaggccgaggcgggcggacugccugaggucagggguucgagaccagccugggcaacauggcgaaaccccaccucuacuaaaaauacaaaaaauuagccaggugugguggugcgugcauguaaucccugcuacuggggaagcugaggcacaagaauugcuugaaccugggaggcaggggcuacagugaggcgagaucgugccacuguacuccagccugggcgacagagcgagacugucuuaaaaaaaagaaaaaaaaaguaagguuuaagcugggcaugguggcucacaccuguaaucccaacaauuugggaggccaagaugggaggaacacuugagcccaaaaguccaagaccagucuggacaacaaaaaauaaaaaaauuaacagauggccuggugugugcccauaguccuagcugcuugggaggauugcuuaagcccagaaaguugaggcugcacuccagccugugucaaaaaaaaaaaaaacaaaaaaacaaaaagugaguaagauuuggaguaaacuuuuaagauagucauuuuauagagacaaaguggcaguuaugaaacuccucuugggaauacccaaggcgaauaaucccaugucauuguguucaaaggcagaagggcugagagggcuggagugaaacucaaguauuguaagcacccccuauucugagcuguagaggucucuaugugcauagugcucaugguggggguagagguggaagauaaaggagagagaguguccaggaggcugcagucccagggacacugugcucccagcuuacuucuuauuaggcguuucagcaaagcacuugagggaggauguuuccaccaccgucucacaaaacgugacaacugggucagccaccugggaaacagaaaauaaauuacugaagcgaggucuaauuuuguuggaagggcaaccauuuaccuaagggaauucagaagcucccuugacacuaccucugugaaaaccccaacugccuuaaucagcacaagugauaaguacaacagcagguuaaaagagcuguccaaaucaucaccaaaaagcccaagaaaacuuacuguaguaaagaaauuagauuccugagccaagaguaagugggguaucaaacuagggccuuaauucuagucuucaaagguagcucucagcauccauucagccaucuaccaccauucacugaacaacccccaugggucugacagagcuggugcugagacccacuggcgugcacccaugucauucucaacccacagcaucugagugaagcucugcccugaagccccaacauggucugcugcccaggaaacccaguguuuucuaugacaccaauccuuccuccuuccuagauacaucaguagaggagucuaagagggguauugaggguccuccacagggccuuggagaaaauacgacucaacuaggacaaggaggccaagcaacacaugguuugaggggcuacaucaaggcuug

SEQ ID NO: 16884 - RNA, 8682 nt, Homo sapiens
gcggggugaaaauguuuuuauuauaacuuuggucagacggggcacagccgggcgggggcucugagggugcugggaagcuauccagcccccaacuccccccucccccgggcgcgccaccccggagggagcggagggcagcucaucucagagcgcaggaagcaaacccgccgccgcgaccucuccccaggcuggggugggcuggcaggcggaggugggcaguaaacaguccuauuguacaaauauauagcgcgggcugggcgggggcggucaaccccgguucccuggcacggggacagggcgcgcugggcccggcucugcagcgagccggugggagggccuagcuguggcccaggcgguguugagcacgggccgggggcgucauagccggggagggccgggcagcgagcgggugggcgaggggcgagucaucgucugccccgcccggaggggaccccggcgggugagggacguggguggagggagacguggggagcucagucggaguagaugaugaagccagagaacgugcuguauuuguugcuguugccgccgugugcuuugccuccauccagcuugaugaagaccucgucgccggcguccaggugcaggaucacgcuguugcuggcguagucguaguucugguccgcguccugggcaauagcacuggcccgcaccugcgggugggggacacgggagggagggcgagaggagagagaggaugagaagggagggaggugaggcagucccgugggggaggaucagcagacccagaaaccuggccuccagccucgccucaucccugccacgcucccccucccccgcccccuuccaaucauacaggacuuguuucaggaaaggggcagagaggaucccuggauuucuagggcaggucugaucugggccugaauugggagucaaggcagagucuuccuccuuaacucuuauagggcuuucccuccagcuggcugagaaccucaauaccuccaggaagccuggaagccuguccuugcaaagaggaauucucuggaccuccagggaauggagggccuucccuacucucaucauuccuuccucucugcuuucauaaugaugccaucguuucagccacacccgcuggaucuuaugucaguggauggacacaagggcacaccuuggccccacaggucaggcagcuggaccaaugccaggcugccagucagcaaccacccuggaaccagggccaggucuuuggucugaagugcauuccagagucucuccugcugcagcagugagacagaaggccugguaaugcuuuccccucccagaguuuagaaggggccugggugccagccuccauggagcuguagcuauguaccugucacuacccacccaaagaggauuguagcuccuccugucucaccucagggugguagaaaggaacugggugggaagaagggaauccaggccuuacuucccucugggauucucagucugaugugacauccuugcuggucccugccuugaugggggauggggagggacaggcaggauaaugggucaagggagcaccagcauuugggcuuggagccugccgucacuuuugggggcucugacuauaaucauaagagauugugugguggcugcauacgguggcucaugccugugaucccagcacuuugggaggcccaggcagguggaucauuugaggucaggaguucgagaacagccuggccaauauggugagacccccaucucuacuaaaaauacaaaaauuagcuaggcauaguggcacgccuguaaucccagcuccuggggaggcugaggcaggagaaucacuugaaccugggaaauggaggcugcagugagccgagaucaugccacugcgcuccagccugggcgacauagugagacucagucucaaaaaaaaaaaaaggccaggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacuggggaggcugaggcaggagaauggcgugaacccgggaagcggagcuugcagugagccgagauugcgccacugcaguccgcaguccggccugggcgacagagcgagacuccgucucaaaaaaaaaaaaaaaaaaagagagagagagagagagagagagauugugugguggugaacgaaugaucuacagacauucagcuaacagguauggaaacauaaguccugaguuugaggaucggggccucuccaggguauccuggguagagacauggaagagaagcgcccucuccaggacuguggcuugugguguggggaggcugcacugaguggaguucucucagccagguuucuccacggccccucucuauccugucccuucacugaaggcagcuuaccaucccaacucccagggcugaagucuggguagaaccaagccaaauuaggggaggggcccauccucucuccugggcuggaggcagcacugcaggucagcugugccagagcugcugacucagccgcgaugcugcaaugaagaggacccgacauauuugcaugagggccucccuuuaaagcccuucuccagccccuucuuuucccucaaccucuucuucccaaccugagaagaaacucuuugugugcuuagcugggaaaacuggucuaguuaaaggugggagggaauaaaugaagggggagaugcugucugccaaggagcucaguuucucugucuagaaaauggaugagaagacuuugccucaccacugccaccucuguaaaagucuuuugaugauaaagaaaaaaaaacauuagaucuugauggggcuuugaguuauuagggaagagcugaaagcaaacagccaacuucuguauuguucccugagcccuaauccugguaauauuuauuauuacacaugcauuucauuaucuuugcuaauaaauuacuacuaauaacaauuauuuuuauugcccagauuaauuuagccuuaacucauuaaaacagugugcuccuuaauagccaaauccauuggaacagagucaucugucaucaggaaucuccuggugaugugacugcaucagaacuguuaugcuuauguuuauuauuuauucaucaccaugauuguugccguaauuauccuaauuauccauggaggcagagagaauuuaugcccuuccauccuuagauggugggggauccaagaauggaacccaggggucccaauucucugccugacuggagacaguugaggccugcagcuccuccugggguccaaggggaaguguggggaaaugagguugccaaggaagcaggaaagcagguuugggccuuguuaugagggagcgcuguauaaucagcuccucaagggcugccaggaggggaaacugaggcaauggucugaccaagggaacugggugagagggcauccaggaaacacguuccugcccucagaucaaugcuggggucuuggguguacagauguggcucccauaggggagccagccuggcccaugggggacacuugcauuuucauacauacauuaacugcauucccacugugccaggcacugugcucuguguugugaaagguauuaggggccagaaaggauagccagggggccaucugccaccaccaggggagaggcugaucuccuuaggucuuuuuucuuuuuugagacagagucuugcucugucacccaggauggagugcaguggugcgaucuuggcucacugcaacuuccacuucccagguucaagugauucuccuaccucagccucccgaguaacuggaauuacaggcacccaccaccacacccggcuauguuuuuuuguauuuuuaguagagacaggguuucaccauguuagacaggcuggucucgaacuccugaccucuggugauccgcccgccucagccucccaaagugcugggauuacaggcgugagccacugugcacagccuucuuaggucuuuauaccaccaccuucaauuuauauaugccagcaccucucgccacacucagauucuguugucaaaccccuggcccauuggugauacucaccuccccacagccuccuacccuggauaagcagcacccugaccacaggcccuggcacauccucacaaagcccccugcccaguuuauuaauuuuguguccucuccaacccaccugaacuguggaucuuggaggcagcugcaggcaacucaccacacccagggccccacugccaacccagaguccuuuccccaggcuccuugcauccuaauggccaggacuuggugccaucaggggugcugaugcaaggcuaccccuaaggacuggggccagugggccucagauaaggacagagggagccucagugccaggcaugaagguggugcuccccaucccgaacuugcccggagaggaggcagagcccagauucagcucugccucccuaaagaaauucuggaagccucucuacaggcaggaagccaggaaggaaaagcgcagugcucaggguggccccugguucugaagucacaagagauacaagcuucucucuuuuguucccauacauugucugguccugccauuuuuuucucugcuuauuuaaauguccuuguccaccucugagcuggcuuuccccuacacuugaccuuuuauauucucccuugugguaucuccucacuuugcagaccaagguucaccaucuucucccccugcaucagguuggucugcaccaggguaggcccuacugaagcacucccucccagccaacacauuuggggaccaaagucaucagcugggcucccagcccaccuuuaacacaguauucgcuggggcgugugguuguauguuaugaauguucccccugcauaggccaugaggucuuggagggcaaguggacugaacuccuacaaagccucaaaucuggcuccuaguaggggcucaaaacuaacaagugggauggcuagugagaucaaaugagucucuugggcaauuuggaagaagucauaaaggacaugggagagggggcuacgggccccacuauuucuccugguuuucuuuucuuuucguuuuuaucuuuucuuuucuuuucuuuuuuuuuugagacagagucucacucuguugcccaggcuagaguacaguggcgagaucucaccucauugcaaccucugccuccuggguucaaguuauucucuugccucagccuccugacuaacugggauuacagguaugcaccaucacgcccagcuaauguuuguauuuuuuuuuuuuuuugagacggagucucgcucugucacccaggcuguagugcaguggcgcgaucucagcucacugcaagcuccgccucccggguucacgccauucucccgccuuagccucccaaguagcugggacuacaggugccugccaccacgcccagcuaauuuuuuguauuuuuaguagagaugggguuucaccguguuagccaggauggucuugaucuccugaccucaugauccacuugccucggccucccaaagugcugggauuacaggcgugagccaccgugccuggccuaauguuuguauuuuuaauagagaugguguuucgcuguguuggccaggaugaucucaaaccccugaccucaguugauccaucugccucagccucccaaagugcugggauuacagacgugagccaccaggcccagccucuccuguuuuucuuuugagggggcuggucugaauaacuauuaaagugcugggccuuugaaaccccuaguuaaagccaccuccuuuuuuccuacuagccuguggucccaucuccagugagcaccccuucaucagacucugucaacacccugccccugcuggagggaaaaggagcuuuugagaugguuuuaccucccagugacugaagcaaguuccccauucuaagcacauagcaucuccggggccucuuguugccucaucucuggggaccugcugggacuuccugagguggugcagggucuagggccaaccuguggcccaaugacugccucccuauccaggcaagcugccaauccccugaaaccucagcucugugucagcccaaacuucuuugggaaaggaagacauuccauugaugaaggugacauugcugcaucccuuauuggugauuaauagggggaaucauggggcugucugcagaaugagccuuugcuggauacuggggccucccauuuggucaggaaccaaggacaaagaggagagacacggggaugucugauagacacacgugggaaagagagacauacaaggaauagagaagagugggguuagauccggggaggagaggccagaaacccagggagagauggaaaaggcagacacaggagagagauggacaagaaacagcaaaauagaagaaagaggcaggggagaggcagaaaccagagaaaagguguuggcggggcagcagccaggcagaggaaagagaagaagggcugacuuauaagcaccuggcaggcuaucugcucacuuucccugccugccccugucucugccccuaagacuugcagacccgcaggcuggcagagccucagggcagugcugcugugggaaggguuccaacaaggucuuguaucuuaaucgugagagauuccuucucaacuuccacuagcucagcuuuaguucugaccagugguccccuucuucgaagagaaugcucagccugaccacacccccaggucacaggccaccacgagugagagcacugggaagggaggugguaucaagagagcuggcuaaaauugucaccccagggcggggcuggguggaggcugguccuggggucggccauuccaaggagagcuacacgcacaugcgagucccgguaccagaguccccgacacacucagugcuuuccagcugcagcgucugagauggggacggagaauggagaggaccccacacacuccagagucaggaggggcuggagcugggagaccaagaggagggggaguuuccaucucuuccaccaccccccaccccccacccccuccccgccucaggaggaaaaacucccccgccccccagacugccuucuuuuuggggaagcucugcuacagugggaaacagcuccccaacucccggauuuugcaaagggugucagauucgcccaauggucccuucuccagggcaggggaggcacugcagccagggcuguaagcaccgggcucccuuugccuuugugccccaaacauuuccugcagccagccuucuccgcucgcgcccauggccacgcgccuaggcgcccgcgggcgcggaugcugcuucucccuguuccauacgccagagcccauccuugcccuccccuuaucgcccacugcugucggcccgaauccacuucccaaggggcaagcccccaagggcaaguccgugcaccugggagcccugcgcucugacuaguuggguucauuucccgcauuuccaguagcguuccagacggugcccagcagcgucugucuuggagcgggaacccaggaacugaggaucggcgauguccgcuggcuccgaccauccccacacgugaugaccaagcggggccgcuguggggugggaucuccaccugcguccgccuggcgcccccgccaacuccgaucagguacccauuugccccgggcucccugggugcccugggcccagcccagccccaugcccccgccuggcccaccuggccauucuugcagaggucugcccacauacuggugccgucgccgccgcgcaugaggacaugguaggugaaaaaguaggugccgggaauguugcacguaaacuugccgcuggccgcgucguaguuguugccuagguuggugaccacgucgucaaacuugaguaccucguaacccucguggggguucuugaggccggcguagaaggccacgcgcggcaccgugguguagguggcagugcugauggcgccgcugccccccgcgcccggcagccccggagggcccggcuugccuggcucacccuucucccccggcggccccacagggccgggaggaccuggguccccgggaggccccggagggccgggcuugccggugcggcccggcuuccccugggggcccugcaccagcguggaaggcgggggcgcgccgcucugcucgcucagggcgucgccgccgucgguccgcgcgccggcgccggggccccgcgcgggguaggggucgcacaccaugcggcaggugcccagcaucucauaguggccuuccgggccgcccgagcucaccagcacggggaugagcaccaccagcaccagcagcaucaccacacccgcggcggccgcuagcagcgucuuucggcccgcgcggagccuggggagcgccgggccgcccggccgcgccgucggggcaauggugccggcgggcagggggcgcgggcuaggcgcccgcgcucaaggacgguccggcggggcugcgggcauggggccgggcccggggcgccgcgcugcgcuggcugcgcugcggagcccagccgccggcuccugccucgcgccucccuccugcugcgcugccggacugagcgccgcggccgccgccucccgccucccgccucccgccugcagccucccgccugacuccucccgccuccu

SEQ ID NO: 16885 - RNA, 3076 nt, Homo sapiens
uccuggaggguuucuccucuccagauggccccagagcaccccaagcucaggacaugucccuccccagccaagcugucucccuuuacuuccuuugccuccucucucccaauuauuuuggcccaaacugaucagucccgcuggccucucccaagcagguccuucuggcacuccucugguggaccgcccccaucggccacacuugcccugcucuccagugauucuguagcuccuggcuccguagucucgcggacagcucucuuuccuggaagauguuucuggugggccugacagggggcauugccucaggcaagagcucagugauccagguguuccagcagcugggcugugcggugauugacguggacgugauggcccggcacggugaguuggaggggcagguuggggggccgugcacagcagcuccccacgcuuccggccuucugccaugccuccuuuuuuuauaagucucagaggaggggaaggcuccuguugacccuggucugacuucugucucugccccgugcuugccuucucugcucuucuauuuucuguuuuuagaaaccccccagcuguaccccauuaccagcacaagggauccuguacacucugcucuuuuccuucacugcuuucucuacccucauuuugcuuuugcuccaccugaaagaagcacccgaguucccccaucauuuugccccuggucacugagguccucugacuggcccugaggcuucagggagugacccagcuucuuccuccugccacagucgugcagccaggauacccugcccaccggcgcaucguagaggucuucggcacugaggucuugcuggagaacggcgacauaaaucgcaagguccugggggaccugaucuuuaaccagccugaccggcggcagcugcucaacgccaucacccaccccgagauucgcaaggagaugaugaaggagacguucaaguacuuccuccgggguaagugccagggccuggggcggggggcggggccuccuuccagggccagggcccuucuccucugcagaaaguuuggccaggguaggggagcugguuaucccagcugaugaguucauacugcuuacuggcauccccuccacacagagccccguaccagccccagaggaaagaagcacguucccucagcucuuaaggaggcugacaguuuaaugagaagagacacaugaggcuuucgagccaugagcccaggaaguaaguugguuuuucuaguagggaugggaguaauaagagcuggugaauaauggagccauagaucugaguucaaaucccaacccugacuuucuagcugugugacuucauugagugaucucgcccucagcucauuuuuucauuugugcaguggggauaauaauccaacaugaggcugggcacaguggcucaugccuguaaucccagcacuuugggaggccgaggcaggcagaucacuugaggucaggaguuugagaccagccuggccaacauggugaaaccccgucccuacuaaaaauacaaaaauuagcugggcaugguggugugcaccuguaaucccagcuacucgggaggcugagacgggagaaucgcuuuaaccugggagguggagguugcagugaaccgagauugcacccuauacucagacugucugggcaacagagcaagacuccgucucaaaaaaaagaaaaaauccaacgugagcauguuaggaagacugaggguccaggucagugacugucaguuaaucacacauguaaacugcagucaggggcagguuugguucuggcugagccauuugggaaagcaaguuuguagacuggaaauugggaagggaccaagauggccaggguggguaggggaaggggaguauuugaaaucagaggccuggggccaguuggcaagaaccuucuuccaagcuauaugccaugguucaagcccuguucuuuuuuauuuuauuuuauuuuauuuuauuuuuagagauggggucucacuaugcuggccaaaguggucucaaacuccuggccucaagcaauccucccaccuuguccucccaaagugcugggauuacaggcaugagccaccacaccuggccuaagccauguucuucaggacagcauugcacagggguggccugaugcuuacuuuacagguuggggucagucaccagaagugggagggagaacagagggcgguggcuugggaucuggcaagaggcuggccuagggcugcuggagauuugcaugccagccuuuggcacauguggccuccagccugggccuccgaguugaaggccugguugccugucaccccacucucagucacuacacugagacucuccuuccacgaggguauaggggagccuuuuuuuuuuuuugagauggagucucgcucugucaccaggcuggagugcaguggagcgaucucggcucacugcaaccucccuucccggguucaagcgauucuucugcccucagccucccgaguagcugggacuacaggaacaugccaccaaaccuggcuaacuuuuguauuuuuaguagagaucggguuucacuauauuggccaggcuggucucaaacuccugaccucaugauaugccugccucgcccucccaaagugcugggaauacaagcgugagccacugugccuggcugggggagccuuuuacacugugaccauggccaagccccuuauucugucaugccuugagugagcaaccuccccccacccucaucccccuguggccaauaccucccuccaaaagagggaugacucgacagacauccaugaugcugaccccaacccccucccguccgggcuggagcuggcucccgcaucuucucugcugaaccagcgugugcgcuccaucucagcaccaugccgcaggccuccucccugccucccucaagaagaguccucccucuggacucuuugugcugccuccuauguugugccaguguccuucccgucccccacccagagugaagucaucugccuuucauuccugcccuuucugcauucucucccaugccaguuacugguauaucugcagggcuucgaggcggcaguggcucucc

SEQ ID NO: 16886 - RNA, 8882 nt, Homo sapiens
uuuguuuucuucuuuguauuuauggcuucguuuuuaaaaacuuaaaucuuuaauccuuugaggguuauugugcauggacagagugagauguggacccucccuuacuuauauacuuguuuauuuauguuuaucucuggaugggcagccaguuguccugugaccuuucacugacaaguuugucuuuccccaugaccugugauggcaucuuuagugcguccugggucccggcugugcuggggucugguggcggcaacugguuuggugguucucucuguucccccugcugagcugucacagagugaguuuauaugacuuugcuccccagagcuggggucgagcugcaggaguacccacuuggugggggggcccuagaguggagaagagaugguggucucugccagugggccugugggcauggggcaucugugaugucaaaacaccagcaggaauucucccugucuccuuggugcccuggccuuacggguagagacuaccuggcccaccuguuuggcccuccucagcuccugggcucaaggguacaaaagccacccugccuucuccccagggucccaugaugggccagccugccccaagguuccccugggagccuccaccucagacacagccucucaccugugccagccaggucccacccacccacugucccagccucugcuugacucaggcaguagcaggucgcaguuggcagcagaggggaaacagggcguguuuaaguggccuuauucccagaauccuggcuccagagcugugucugaaagggagaggaacuacuuuguaacacuucggggguggggggagcuggaagggcaagucuguuuccaggugagaaauaaugaacaacuuuuuuuucuuuucuuuuuugagacagggucucgcucugucacccaggcuggagugcaguggugcgaucacggcucacugcagccucaaccuccugggcucaagcaguccucccgcuugguccucccaaauagcugagaccacacgcuuauaugguagugacagugaggauggagaauaguaaaaaaguuuaagggauuuuuuuuuuuuuuuuuuuuuacuuuuuauuaugaaaauguccaaauaggcugggccugguggcucacaccuauaaucuuagcacuuugggaggccgaagcgggaggacugcuugaacucaggaguucaagaccagccugaaaaacgcagugagaccucgccucuauauuaaaaauaaguaaacaaauuuaaaacugaaaaaaaaagaaaauguccaacaugaagaaaaguaaaaaaauuuuuuuuuuuuuuuuuugagacagagucucgcuuugucgcccaggcuggagugcaguggcacgaucuccgcucccgaguucacgccauucuccugccucagcuucccaaguagcugggacuauaggcgccugccacugugcccggcuaauuuuuuuauauuuuuaguagagacgggguuucaccguguuagccaugauggucucgaucuccugaccuugugauccacccgccuccgccucccaaagugcugggauuacaggcgugagccaccauacccggccaaaauuuuuuuuuuuuuugagacagaaucuugcucugucacccaggcuggagggcuguggcacaaucucagcucacugcaaucucuaccuuccagguucaagcgauucucaugucucagccucccgaguagcaagugccaccacaccuggcuaauuuuuguauuuuuaguagagacggaguuucaccauguuggccaggcuggucucgaacuccugaucucaaaugauccaccuaccucugccucccaaggugcugggauuacaggugugagccaccaugcccagacaaaaagaauuuuuuuuuuuuugauacugagucuugcucugucgcccagccuggagugcaauggcacaaucuugucuuauugcaaccucugccucccggguucaagugauacuccugccuuacccucccaaguagcugggauuacaggcauaugccaccaugccccacuaauuuuuguauuuuuaauagaggagggguuucgccauguuggucaggcuggucuugaaagucugaccucaggugaucugccugccucggccucccaaagugcugggauuacaggcauaagccaccacgcccagccaaaaauaauuuuuguuuuuuuuuuugagacagaguuuagcuuuuguugccuaggcuggagugcaauggcucgaucucggcucaccacaaccuccgccuccuggguucaagugauucucugccucagccucccaaguagcugggauuacaagcaugggccaccaugcccagcuaauuuucuuguauuuuuaguagagacgggguuucuccauguuggucaggcuggucucaaacucucgaccucaggugauccgccugccccagccucccaaaauacugggauuacaggcaugagccaccgcgcccggccaauaauauuuuuaagaaaugaauacaggccgggcgcgguggcucacgccuguaaucccaggacuuugagaggcugaggcgggugaaucacaaggucaggaguuugagaccagccuggccaagauugugaaacccugucucuacuaaaaauacaaaaaauuagcugagugugguggugggcgccugugaucccagcuacucuggaggcagaggcagagaauugcuugaaccugggaggcagagguugcagugagucaagauugcgccacuguacuccagccugggcgacagagcuagacuccaucucaaaaaaaaauuaaaaaaagaauacaguuacuuauugccuagauuuaacaauagcaaggagccaacuccuugcuggcugcucuacuagaaaaaaaaaaaagagagagagagaaaagagaaaaaacaauauuugccguguuuauuuuuauuuauuuauugcugaugaauuauaaauucuagacaucauauuucaccccuaaaaacuucagcaugaggcugggcgcgguggcucacgccuguaaucccagcacuuugggaggcugaggugggcggaucacgaggucaggagauugagaccauccuggcuaacacggugaaaccccgucucuacuaaaaaaaaaaaaauacaaaaaaauuagcugggccugguggcgugcgccuguagucccagcuacucgggaagcugaggcaggagaauggcgugaacccgggaggcggagccugcagugagccgagaucaugccacugcacuccagccugggcgacagagccagacuccgucucaaaaaaacaaaaaacaaacaaaaaaaaaaaacaaaaacuucagcaugcaucucugaaaaguaaacacccuaccauuauuauaucugagaaaauuaacaauaauuccuuagugucaucuaugaccuaagccaucgucagauuucugccuuauccuaaaacaucucucucacagcugguuuguuugguucaggaucccguccaaguccaugccuuguaucuggcugucucuucaaucucccuugaagagcccuacccuuucuuucugccuggacauugacucauugcccugccugcaaggugucuauuugcuuccuugcagcaguguuuccgucuuccucuaaccuugguguuaccugagaacugguaggcaggucugcaaggcuuaggcuggucggaucaauggggcucagugucagaugaggcaaagccagcaggaggcaaggaugauucuaccuugagugacagagguagaugucacucagaugcuaagaucggggaaggaggagggagaggacaaauuugauuuggggcacacgguuuucgacauguacaaaggacauccagauggcaaugggcuaugugagccuggagacugugcugcgaguuguugaucuacagccgguggggcugggcucucccaaggcgguggagugagaagccaggugagacaccaagcaugaggccguggcagaggagguggagccuggggcccaauugcugagcaguagcaaagaaaaagaaggaaaacuaggaggccuggccugaggaagcccaagaaggagaggauuuuaaagagcaaacacuggagagaagucaggccagaggaggaccagaucuaucaucaaggaagugguagaaggccucuaagcagugggcugauugucuaagugagggaacagagaaguuggcucaaaaaggaggaagggaaaaaggaauuaguuguuaaaaggagaugcagagcuggguccagggaacaaaacuuuuuuuuuuuuuuuuuuuuugagauggacucucucucugucacccaggcuagagagcaauggugugaucucuacucacugcaaccucugggguucaagugguucuccugcuucagccucccaagcagcugggacuacaggcaacugccaccacgccuauuuuuuuuuuuuuuuuuuuuuugguauuuuuaguagagaugggguuucaccauguuggccagcuggucuugaacuccugaccucaagcgauccaccugcucagccuccaaagugcugggauuucaggcgugagccacugugcccagucaacauuuucuuuuuaagauggagagaccaauugggugcaguggcucaggccuguaaucccagcacuuugggaggcugaggugggaggauuucuugagcucaggagaucaagaccagccuggacaacauagucagacccugucucuaaaaaaaaaaaaaaaaaaauuagccgggcgugguggugugggccuguacugccagcuagccagcuaccugggaggcugaggcagaaggauugcuugaguccaagaagucaaagcugcagugaaccaugaucgugccacugcccuccagccugggugacagagcaagacgcugucuaaaaaaaaaaaaaaccaacauggagaggccuugaguuuguugaaaugagaaagggacaaagguagucagaaaggaaggguuggaaauuugaggugaggccacuuccgagcaagcgggaggcuaugggguccuucaggaccgggcugaggagguuggcuuggacggcaggccccugugccuuccacugggggagggggaaggaauggugggugcaaacacagauacguuugagggggagggcagaaggugaucauuccuuggucucauuuucccaccucccuagucuggcucaucccuacagccuucgcuggcugggagguucccucauggaccauuucuuuuuuuuuuuuugagauggagucucgcucugucacccaggcuggagugcaauggugcgaucuugguucacuguaaccucugccucccagguucaggcaauucucuugccucagccucccgaguagcuggaauuacaggcgcacgccaccacgcccagcuaauuuuuguauuuuuaguagagacaagguuucgcuauguuggccaggcuggucugaaacuccugaccucaagugauccuccugccucggccuuccaaagugcugggauuacaggccugagccaccgcacccagccccucauggaccauuucugaucccuccuggccccagcagcccugcugggugucugccagccuuacuuagagcacaagcguugugagcccugaggaugccccaccccagcucccaccccgcccuggaggagcaggccaggcaagcagccccaugaggucacccagaggcuggggacagaguccagagccgagggcacccaaucgaaacccgaagucagaaaagcagaagugcaggccugcuuucccccaauccccaugggugugggaacccaaggcccgcucaguucuuucauagaaccagcccugugacggaguaggguugacagcucuguucuacacaugaagaaacugaggcccagaaauucaagcagcugcucagcgagaagcugaaguagagucuagacaagaguccaagucucuggucuccggcuccacucuuuuucccucugaaucaauggaagcuucugccccaagcccaagaaaagggucucaccugaaaccguuacauuuggaaucucaccccacauccaugcaauaagauuacacugagucagccgggcugcucaugccuguaaucccagcauuuugggagaccaaggcggcggaucacuugaggugaggaguuugagaccagccuggccaacacgaugaaaccccaucucuacuaaaaguacaaaaauuagcugggcaugguggcaggcaccuguaauccuagcuacucaggaagcugaggcaggagaaucacuugagccugggaggcagagguugcagugagcugagaucgagccacugcaccccagccugggugacagagugagacuccauuaaaaaaaaaaaaaaaaaaaaaaaaaaaaaaaaaaaaagauuauacugagccguggugccacaccugggaggcacagucaaaucacccaaggaggcuuaaaauuaaacacuuuccccaggucccggcccaaaccacuuccaucagaaucucagagggcugagcuaggcacaguuccccaaagccuacugaggccugaggcccaggauccuguggggucacccccagcuccuccgauccugccccuggacauguagcucugggccaggccgggaugguuaaagggagacccaguuucuguccuggagaacauguguuugggggagggaccugucguguggacaugacugagcuccuugaggcaaagaucaccauuccuucuggcucucccuccaccuggcuuggguggcacagagcagacucacugagucaacaaaggacaccauguccccucgccagccccugagccaguuccugggccaaguccugguuuggaggcguucauuuugccucuagccccagaggacugggucuuccuagugcaccugcuccugccccagcacuuccuaugaggguuugggagggaagagugaggucagaguggggaaaggagggguguugugcagcugguuuguucuagaaccucuccugacccucccccuugugccucucagaggcaugagggugugguggagggagguggaccccucuggggagccacuguggucaucaccuccucucacuggggggagggaauccgagacagggccugagagccaacuucuguggccaagagcaggcaggaacugugugaguuuguucacucccuauaguuuggggcuggagcccccugggagacccccaucaugggggcccagcuuccuacuggggaagagaagcaggugagaugccaggugaguugcuggcugcccauucugcagucccagcccugacacugacacuccuggcucugccauagggagucccugccccccaugcuaccugcagggcaaugcugagggccugaguuccacaccuguccucuucucuccccucuccacccagcuccucccugguggcucagaguuucuggccucucuggaauuuacagaggcuauuccugucucugaggccugguugcauaacccuuggugaccugucauaugcacgcacacguguguagugugugugugugugugugugugugaguccucaucccuggccucaggguggggacagagagaugggucaggugugugauaagcaugaggccuccagccuucugugauuccugcuguccuccacccugauagcgaggaggggauuagucuaccccuggggucugggcuucugagucggguacaggggaugggacacugguaugagagcuuuugugggcagagcagggcauggggcccagucuugcuccuagugugaucucuacaagugucucgugccccacauucacacugugccuggcucugcuugggguccuuguccccagcccacaguggguacaggagaagaggggcugagagacauggcaggggagaaaaagagauccagggugggggccagaggaggaagaaugggccuagaguggaagggugggggucagagccugaccaggaaaggagguggacuucagcaggggugggcuggugggcuuagugcugccuggcccuuaagccuggggaggaagcacuucuaagggaggagggaagacaagauggacccaugggcucagaggaggggcuguaacuucuuacucagggcauguguccacugugcguggcuggggucugucauccccacacgagggggugaagggaagagaggccaggaagaagauuuaaccuuccuccuggaagaagcuggugccuggcccucuucucuggguccuuagagaggaggggacaggcacgggcauacuuguacacguauguggacacgcaagugagagugggcacaugugggcaugcaggcgugggagggcauaugcaucuuggugaccgagucuggaggagacagacccagguggucaggcgggcagauagugauguggucagaauccuuccuguccuccucggggcuggcacaguccagaugccagcucccugugauaucacaucugcccagaccccuuccucuuugggaacucuuccccucccccccacaagcuuccucuuucccauuacacccucccugggccuagagggaguggacaaccacucauuguccuguuuccgccccaggagccacuccaggccagcccaggcccccagcacucagcgcccccucugcccacccugucugugcaagcgcgccccucccccacaggcucagccgugauucucucugugcaguucaugcuguggcugggucuggccgugaucuuccucugugcagcccacaccauggcuaugucugggccucggaugcggcucacuggucauuagagcacugaguggggcagccagcaguguuucuagaagcauaaaaauacccucaaccugaggccccuccaccccac

SEQ ID NO: 16887 - RNA, 5565 nt, Homo sapiens
agccuuacaugugauuuuaugcaaguucccauuuuagagaugggaaaacugaggcccgaaggcgaacggcgagugcaggaucgggacucgaacccaagucuguccccgagugcggggcuauuccaggcucgguggucuugaccuccgcggcccuccuucuuguugcccgcaggaaaacgccgcggcugcgauggcggcggacguggugggggacguguacgugcugguggagcaccccuucgaguacaccggcaaggacgggcgccgcguggccauccggccgaaugagcgcuaccggcugcugcggcgcagcaccgagcacugguggcacgugcggcgugagcccggcggccgccccuucuaccugccugcgcaguacgugcgcgagcugcccgcgcugggcaacccugccgccgccgcgccgccagguccccacccgagccccgcggccccugagccgcucgccuacgacuaccgguuugugagcgcggcggcgaccgcgggccccgacggcgcccccgaggaguccggaggccgagccagcucccugugcggcccugcgcaacgcggcgccgcgacccagcgcagcagccuggcgcccggccugccagccugccuguaccugcggcccgcggcgcccgugcggcccgcgcagucccugaacgaccuggccugcgccgccgucucgccucccgccggccuccuaggaagcagcggcagcuucaaggccugcagcguggcgggcuccugggugugcccgcggccucuggcgcgcagcgacucagagaacgucuacgaggucauccaggacuugcacgucccgccgccggaggagagcgcagagcagguaccuccccgggcgcuggggcgcggaggcggguggcgcgcuagggaccgcgcccgcacggagccggggcgcaaggagacccgcuccgcucagcgucgggcacgacgcccaccucuguccgaagacuucggaugagcucccucuccccaaccgcgaaacgugaggggugcacgcccgcagucccucaucagcaauucccaagcuccaaagcucccuggaagcccagaggcuuuucguaauccaauugguggcaaaauugcgcuugaacugaugugaggcugcugauggucuuuauuuaucgcacuugugugaauauucauguuucgcugcagaaaugcaaaugagcucgauggucggcugcugccccaagcccugcugggagguuauauaaccuacugcaggugugugccccauauuaucuuuccaagucccagcuguucuguauuccgaagcgcaucugggcacggaacgggggauugcgggccugccccggcccaaccgacuugcccgucucccaggagucuggggucagaugagaggguggaugugaaagucaggcgucugcuucccuuugagggugcuuccagcauuucaguuccuuuuuuuaaagaacucuugauggguuuguuucagaaagacguccgguuaagugagguuguuuuuuucccccucuucagaguccaguuguguucaucugggaaaucgaaaauagagcacguuuuaaaaacaggucuuacauccucagaacacucuaggcgacccugacauuuugaacuuuaggaacuuuucagagaggggcagcccgaggggaaaaaaagaugcucagaaccguucugccaucugccaccggccgugugaugaucuaggggcaguucuuuuccucucuuagggucucgguuuguucuuuagcccaaagggagggguuggacagaugaccucugauccucgggagccucugauuucuuucgcuguaccugaugucauuaccaugaacacugaugcccacuaugugccaggacugaguccgggaugcccagacgaaggagacacgccuccguaggcccgcugcuggguguucccuccgcccgacucguuacaaugcagagcucagguuuugagacuagggaaaggggaacuggauucugcugggucaccugccagcugcugacagccacuuaacuuacacgcgaggacguucccccaggcccagcguccucugguguaagcacaauacuuaaggauuaggguugugagccuuaaacgagguaaggcuucgaagcgcuugacagcagcaggggguccacccaggcugucuggguaguccugguuuggcuucccugggucuccgccgccuucacucaggcuucugcagcgguagcccgccgccuuguggccaggguggggaacggcacccggcgggcggggcugggcacugccacucuguccuagugacggugggagggugccugcccaucugagcagagccccuggaggugggggaauggccuugcucuuugaaccucgcaucuggcccagggucuggcucaaacagagugcacagagaguguguguugagaagcgcagaggugcggcagcccuuuaccuaugagccagggcucuguaggucugcaagggccaacaccccaggccccaggaccaaagaggaaggagacugcccagguccugacaucuccugagaagacagaucaccccggcugccagggcgccugccagguggccccucugcccauccuuccuccagcucccagcagguucccaguugcaguggcauauggagggaggggcaccgaugauagggguaggggacuuacccagggggggaaucuaggacauuggccagagacaggcagcucucuggccccacuugugaccuccacaagucgcuuugcaucucugguccuguuuccuccccugugcgaugugugcaauaauaccacguucccugccacagagcuuuauucaagaggcagcugugggucucccuggugcuccacccccaacaaaguccaggguagggaguuggcccugcccccgcaagggaaccccaucccugcucuuaguugucccaggcagaguuuccccaccaugauccuccaggcccauucacuccuucauuaggcaucaacuagcugaauaccugccaagcccuggugagccuucggaucuggagaggacugaggcacagccacgauccugggggacucacccucuuggauaggaggccagcaagagaagacauggggccggggcucagaguggagcauaggguugagagugggugcccacccgggcagggccucgugggcccuugccaggaaugugcacauuauccugcagccgcugugaggcuuuuagcagagacaggaaugggauugagaaaaaaaucccuguggccagggcuucaagaauggcugaagcucuugguggucucgugggcauguguggaaacagagguuugggagauggaugggcagggucugggggccgagggaggugggagggaaaucagguugaguucuagauucccagcuggcacucgugggcagacaguggugcugcuuccugacggggggaugacuuggggaggagcagaguggaaaaaagauggggcccaccuggauuuaggugccaaagggaagagaagcaugagagugcuggcucagaggccaagaaguguccagaagaaggacgcacaggaaggucaugugagagaaaggccguauaacacuuacccuaagugaccacuagacgcucagcuggucagggggcugcugaaggcagagggcaguggucaguagugaagugagggugcgaauugaguguguggacaacgggcagaaggagagagacacaguguggccagaggggguguagggucauggauggaaccguccccaggcucaggugggugggcaggagauggggaggcuaaagauggggagaagguuguugcugagaagggaucucagaagaaagugggugcagaacagagggggcaggauguggggauggcauggcacgggggcacuggggaguguguggggaugcccuucugucaggcagcagcucagggcuuagggcaggcuaccagacagggccagggacccccagaacagaggagcuccugccauggaugguguuuuacagccuugucacuccccaugcacucuaaucgcgcauauugagcacuuggggugggcuggucacugugcuggacacuggggacaaagugugguaagaugcagucccaaaggggcuaacaguccugugggcucuugcugaaaggcuuguaacccaggguuaagcucccagcagcuuggaaggcaggcguaggcaccuccauuugcccugaguacaaacagagguucagagagguuuagugacacgacgaagcucacacggccaggaaguggcuguguucaggacaguuccaggcccccugaccccaagccccacccuggccagcagguucaguuucagccugguggccuuuaggguuggccacccuguuccccucaacaagaacaguacaagcugaaggcaggcacaugcuccuucuucugagcguccugcgugcccagcccuguuguggaagaguugaugucccaggagggacaucuccuguucuuuugcugcccaggagagggcagaagcaaacccuucugagaggggauagagggagacgggggagguaagcagggaugacuccuccucucccacaaagaggccacucagggagcucugggaagccaggccaaagccagugcaauaaaggggccucugagacucuucccuugguccugacucugggauuucagggugcggucaccauccccgcccagaggugggaaggcccaggcagguggagcuggccuggagcccgccccugcugcuggggcauuggccgcugggagggaaguuccagccgggcugcugcaccuucuuauacaagcagccccggaggcgccgcacaugagcaggcagccccgacuggaaggagcccggggcccucauuccuucuccuccacugggaacugagugaguccucgccccugggggacuaggggguggccacagcaguuuccccaaucucuccccucccuuucccgaauccuaaaacccaucugggggccccuccccucuggauccaggcccagcacccacuuccuaggacaaacuccaagggcagcccgaggccacugugacugagagaaaggaacuggccuugggacagacccuccugucccccuucggggccagcuagggggacuuuggcaagggguguugguaacagcaggaagcugaggccaaguugaagggacucuagcuagccccuugcucguacucccuccuccggcaccccccacccccaacccccagguggggcagccacccugggguggcccugcugguuucuuuacaccugacccaguucccucccggugacucaccugcagccccaggcugucccaggagccccucugccugccuaggaccugacuuaggagacagcagcuucuuggaucucccucccacccucaccccacauugcuguccacccagagaucucccugcccaccccccgcacccccuggcucuccugcaggccccaugaucucuucaggucucgcuggagccugugccuggcucucaccucuuaguccuuggcucccuucagcgcccaggggccugcgaug

SEQ ID NO: 16888 - RNA, 688 nt, Homo sapiens
ccugacuccaagcugagcgcagguaagacagcuaggacugagggccugcuagguccaggagaggugggggaaggcgacagagagaccagcaaacccacauuuccccgaagccuggagggucugaccaucacuuugaaaacaauuccagacucccaccccagccccaaggccccuucaaaggcaguccugcuccggggaacuucuucagucuccagugucccggcugggcaaguucagugaugcuuugggaauucauggcuuugugaggugguggcugcauccacagggcaguucccccgcacgcccugcacagcuuaggaccaggucacuucuccacagugcagggcguggcugccugcccucucugggguccugccuaucugugcccuggcaggggucagucaggcagagagugugaccccgggcacccaccaaggugggccuggagcaucugcagcagcgccccugucuguagaggggugaggagcgcacggggaucgggggugggcaagacggcgacccuccauaaaccgaggagggcucaaagugcugacagugcugguuuccagucauuucuccuucuccuaauggggccaaggccccaggcuagagaagagcuaggggcucugacgcugagaaagcggugggcucagcaggcgagacgcacugggguggggaguaaagagga

SEQ ID NO: 16889 - RNA, 951 nt, Homo sapiens
guuuacgcuucuauugccaaaacuaauuauuccuuguugacauaaaagauuuggccucuuaauuggggccaaguggcggcgguuugcauuucaaacucguucuugucgguguguuggucucagcgcuuuccggugccccuccucgggccagguagcgcugaaucaaacaacccugcgucuagacgcgcuccccaaaagcgagucaccucugaucgcucuucccgucuccggccaagagccaggggaaagcggcucugggagcgcuacccauucacuccgcguugaacguuuuaagucaccaccguagguucuggcacacgccccggucccuagauggcccgaggacagguuuggguugcggggggaggggcgaugugugcccgagaguuugggaauuugcuggcggcggcgaggagagcaucccggaagacgccgcgagcgcauacgcgccccggucggugcccagagcccggaccuugaacccagguucgcgcccagcuccggccccacguuugcaccccgcccccggcgaguccccacaccaccgccgcgugggcggccaaggguuaaucucugccccgcgcuuugagacccggggcgcagcgggucgggcagcccggggcgcgcgucuuccgcgagucugggggcggcggggucggcggccggaaggggcgaggcgcggcggcggcgcggcgggcccgaggcgcuuccccaggcgggggcgggggcaggggcgggggcgggcgccggaggggccugggcggccugaaaagcgcccgagcaccgcccccccaccgcgcggccgccgcgccauucacacgcccucuggccauucggcgcggcgcggcgcggcgcggcgcgggggcggggggcgccgcuucaauggggauuucgcggcccggcgccggggccgggggcgcggcccggccgcgggagccgcccguugcuacg

SEQ ID NO: 16890 - RNA, 7992 nt, Homo sapiens
ccacaucaaccagcaccauccacggcacaacaaaagaaucugcuaaaucggcauuucccaaacuuccuccaggaaauguuagcagguagaaucaaguaaguuugggaaacccacucugugaccuucucagagggucacaauggccauuaguacauuaaaggcucugacaaguccugcagcagaaaagccuguuuaacuuacuuuagucuuuuauuuuuuucccccagucacugggccauggaacucuuuuuuaauccaaacacaccuaugaaccucuaguaggccaguauucaagaaaacaucauuucaggaaauauuguaguaaccugucaagucaguuauuuguccccuacuguuuuggaauuuaacaaaggauauaggauauauuuuuuucucucuuaacuuuauuuuauuuuauuuuuugagacagagucucacucugucgcccaggcuuaggguacaguggugugaucuuggcucacuguaaccucugccuccuggguucaagcacuuauccugcuucagccuccccaguagcugggacuacaggugcccgccaccacgcccagcuaauuuuuuguaauuuuaguagagacagggucucaccauguuggccaggcuggucucgaacuccuaaccucaaaugauccaccugccuuggccucccaaagugcugagauuacaggcgugagccaucgcccccagccucugucuuaacuuuuaaacacaggcuucuuuauagcauuucaaaguuuucccuaaaaguaaaaucuaauaaaaauuuaacagaugcuugcaacugugagcuucaguaacauccauuucugggcucugcaaauaacugugaaaugcuaagggucccaaauuuaugaacaagcucgccuuguggcucugaggucuccugugggacaccaacucuccucucccugauacuugggacucuccucccaccaaucccucccugcagggcugcuguggucgugcuccugagggcucaaggugggcccugcucaacccccuccaaugccagcaugaggauccccuuguccucugcagagggaggugguggcauguggaccagggagaucuugugucugcuccuugucuuccugccacaaggcagagugggugggggcagggcacugggccaaaggcacagcaugagcucugggccaccucuggaugcugugugugucaccugcugugugugcccugcacaucucuguguuaggcguccacacuccagcaccuccugggaggcguugugggaugcaggacaggcgugucuuucagagacaaccuaccuggaucccaaaccuggcucugucacuuacuacucauuggccuucggcaaguuacuguacuucucugagccuccguuuccucaucugcaaaguggggcugcuuaugccuacaugggaggguuggagaguucuagacaccaugagggcacccgucauccugucgguggaaggcacccaccaaaccuccugugggcugaugggccguuguggacaaaucaaguggccagagagucaaacaagguggguagcacggagcgggggugcuggugacaugcagaguggcgggcaagcgugaggggcgcgugcggccacagccugagcacgggaggaggccgagggaguggagcagcugcacccaggugucgauuuaguggcguccuaggaacgucagaagcagcaggagucgggaggccuggaagcucaguggcagugcccgcagccugggaggccugggagguccccagggaaggagcgaagaagcucaagacacagaccuuugaguugagggacccggcugacgggcuucccccgcggagcagcagcaggcugcuuuucagagggcucuggaaggucagccucuuuuguguccucucccaaagaggggccccgggccucuggccccucuccaggggccccuggaaaugcagcccuucccaaaugcuccuccgagugcgccugcuccuucugcacguugggugugauuuccacgugaaacgugaacuccaggggggcauccugcccuuuggcccgcccuacacugggcccgucgggcucugaggcugggaucucuguggaaacuuuggagaggaaauccacagggagggggauggcacccuccgcugggaagccugggaugcugguggcuucucuggcggcugucuggggaggccgcccaucuugggcuggggaggccuuggagggaggggagucuuggggggaggacucaucgacgucgcggucuucauccaccuccuccuugcuccccggccucucuuugcccccugcccccuucagcggcggccccuccuggugcaggucuccuagaagcuggugcuugagcagcucaggggcguggcggccgcccucuguguccucagguccuguccccgaagguuggcguguggccucucuggggcccucaggcaggaggggagccccaggcaugccggacaugagcugguggcucagaccuggggggccuggcucucggaggaagccuuccuggaccaccuuaccacuuucaggcucuguguggagauacgcagugguggcgggcuucggaaaggccggacccuucucggcccaguccccgccuuuuuguccccacuccagggagggcuccugagggccuccuguuggaggaggcgcugggcaaacgggacggugcugaggaaggcucgcggucagcgggacgggagcuucuggcucuuucuccccgaggcacggcccagagaccccagaggccucuccgcaggguccaggcuggacgugggcgcuaaucucauuggccaggggccuuucaggcgccuuccucugccggcccggaacucucaacuccucugguuugaagaggcagcgauagcaaaagguuagcaagggcgcauuaaucgcuuaagagagggagcaucauccuggacaaaaugacacugagagggcaucccaggcccccuaacaaagagaugggagcacagcucugggcucgucucguugccuuugcuugcuuggaaugacagcucuccuggucuagccgccaccagcucgcuagguggcucuccccucucugggccucaguuuccucaucuguaaagaggguucuuggacguggugaccuccgagggcccuucugguguggguguuauuccucugccuaugaugggcucugguugggcacagagcaugucacacaucuggagccgcccugggcuuaaucuacugggaaagcgggagggcuacagaagcuucuccugcuuucuagggaauuugagccucccaaagauucuagccucuagaugguaucugguuuggguguagcgagaauccccuuuccucucccuaccucucacuguucuccugcccccgccccccaccccuuuuuuuugguuugagacagagucucacucugucgcccaggcuggaguacaguggcacgaucucagcucacugcaaccucugacucccugguucaagcgauucuccugccucagccucccgaguaacugggauuacaggcacgugccaccacaccuggcuaauuuuuguauuuuuaguagaaacgggguuucaccauguuggccaggauagucuugaucuccugaccucgugaucugcccaccccgguccccaaagugcugggauuacaggcaugaguuuuuuuuuuccuuucuuucuuucuuuuuuuuuuuuuuugagacagggucucguucugucacccaggcuagagugcaguggugcaaucacagcucauugcaacuuuaacuccagggcucaaacaacccucccaucucacccucccaagcagcugggaccacagaugcaugccaccacgucugacuaaaauguuauuuuucauuuuuguggagacggggucuccuuauguugcucaggcuggucucgaacuccugggcucaagcaauucucuugccucugggauuacagggaugagccaccauacuugacuucugcuccccuuuuugguaaaugaaaccagugaaacuagugcccacaaaccccgccucaagcccauucucugacagauuuggaaaauccaaaaugugugaucaucaagaauggagucuuuacugagagaccugccauaagacuccucgaaaaagaagccccauucagaucuauccaggucacugaccacagacaagcccuuggcacaggugagguaggcccccgugggaggaagggcucugcacggcagacagugacggcccucaggaccacugcuguccccuggucacacagcuugcugcacaccaacccagcugaucaagggcacacuucauuuuuuucugguucauucacgugacauucauuaaccuggccgcauauuaagaacaggagaauuacacuccuugguucuccuaauaaauacccuuuauguuuuuuaacucccaacucuuugaacaccccaucuagucccaaugcaacaaccuaugcaacucaccagcucugcuuuaaacaaaaccugcagcccugaaggauucaggggcuuggaaaagaaagagauuuggaugaggucggggaggaagguguggucauggacacacaaagguaaccugugggcccgaccccaucggaggcaaggugguugacaugggcucauccccaagaggcccggucagagcgcagcagcaccuccagccugugauacuggccaugcucaugggccccuccaauuccuguuccuggcaucgaccacagugcaugccacacagcaggugguuaaaucaauggauccugcacagaucaacuggugucaggaaaacauugacuucagcuucucacaggcucugcaggugccuuaugggagcccuuugucagucucugggaagaacagcccagaggcaacccugagccugagcgccagaacugaccagaggcaggggcugccccuaugcugccccaacaggacaggucuccacugccuuccggaagucgcuuuccuccuagagcuuacuagagugcucuugacugggauguuacuguacucugauauaauacaagacuuuaagaaacacuauuaaaaaagagacaaggaccccaaacguaaauaguaaauguaccuugaaaaguaauggauacaggauuguaguguguguguguguguaucaaugaggaaacugacaugauuaauuacaccccuggaggaagaagccagguuaggagaauguucuuuuuuuuuuuuuuuuuaaacagagucucacucacucugucgcccaggcuggagugcaguggcaugaucucggcucacagcaaccuccaccucccagguucaagcaauucuccugccuccuacuccucccauguagcugggauuacagguguguaccaccaugccuggcuaacuuuuguauuuuuaguaaagacgggguuucaccaugucagccaggcuagucuugcacuccuggccucaagggaucugccuaccuuggccucccaaagugcugggauuacagacaugagccaccgcacccagccugguugggagaauguucuauugauucccuaggaugcuaggaaguacucagcaaauacuaaauguagcaauucucagggguuaggaggaguucaagauaaaugaguauuguaaacacaguaguccagguaaguuaagcccccaugcccucuucaggaggccuggucucuggacacuuacagaagaaaaguccaccccucguauacaggccuucccauagcuuacucucaacagacugcagcuccaaccugaaacaccuuuuuccaucuuacuaauagguacuuuaucccuccaugauuccaggcugcugucagaaagcuuaaaauucagugagcacaaaagucaaguucccagcaaagacggugaccugggcuuuuuuuguugcauggaauauguucugggggcauguagacaucaccugcacuaacaaucaguagaaaaaacucaaacccacuuccauuuaugaaaagcaaugauuucuagaggucaugcuuuaucaaagccucuaguuuuaccuaagcugaaaaacaugaccuaaaagaaacaggagccagguuccuaguuaauuucacacauugacugagguucuucucuuauagccacugucccuucuaauaguuuuugaagcucuuuguuagccugagaacgaaaaugugccuuucugugccaugugacaugagaaacaucagccugcuauaggcugugaccucucugggggcaggaauguguaguuaggccucaaaauauccucaacgaggcagagucuccuagaaucagauggccucagaggcagcucuaaauacuggacagaucccaucacucgggagaaaagaacagugucuuuccagcccuucugcaaucuagaagcuuccacauuuuacaguaggcucucaaguucauuuaucuagcaaaugacagaaaacaagcccagcccacauuauaucaguaccauaggucucccauuuccuaaaauuaggaaucucuaggauuuuucuuaagauauuuaugauaaaugauuacacaaagcugccuuucuugaauacagcaguuugguuccugagaagaaaaucauaauaaggguugaaggcugcacagaagaaaguuuacaagcaaucgcuuggggaugacaugguuaaggccuugcuccuggaucagccacagggcagccugcagugagaaucgccugucacacauauuugaguuucuuuuuuuuuuuugagacggaguuuugcuuuuguugcccaggcuggagugcaaugaugcgaucucggcucacugcaacguccaccuccuggguucgagcgauuguccugccucagccuccugaguagcugggauuauaggcaccuaccaccacacccggcuaauuuuuuuauuuguagugagacaggauuucacauguuggccaggcuggucucaaacuccugaccucaggugaucugcccaccugggucucccauagugcugggauuagaggcgugagccaccaggcccggccuagaguuucuguuagacauucauucucaacucccaggcuggacaaggcuagcaucuuucagaacacuaaaugccuuaggaauuacccagaaaugguauuagaaaaaaaccacuagggcucuuucuauaucugaguagccaaccuuugauaagaaccaacucccuaaaaucuccuggacuugugaauuagagcucagguccaaaugaucuuuucagggcagagcccaccccaugucccuccccccaacccccaagucauggcaggcaauuccaguucacugaccuugggucacgugaccagcagcuucgucuuccaggcugggggugucuccaaugccugcuucuucagcugguguaugugucagcaaaugaagggggguaaaagcaagacaguuauuguuuacuagaaaccaagcucucuguaccuucgggcauuuucccuuaaacauucaggaaagucacaucccaagaauaccaaggugccucagcucuggcuucucugcaaaugucauugcugaggaugcuggugauaaaaguucacuaaacaaaaggcacagcacccacaugcagguguagcuaugaccuaguaggaaagacuuucuccacuuugggaccaggguccugaaugccucacucaacaaggacacacaggcugagugaggucagagaagcaauuugcugcugagccaugguuguggaggcugugucuaagcaguggcugcugggaaguucaaggaaagacuuugccuggguugcggagucaggcagaugggguucauauccaggcaccggcauucauucaaccucucugagccuccauuuccucaucuugaaccccaagaugaagauacuaguuugucuuguagaaggauggugaggguuaguaagagaauuugugugaacacguuuagccuggugccuggcauaugguaggugccccaaaauguuacauuuccuuccucccaacuucugggcaaaugccuuucg

SEQ ID NO: 16891 - RNA, 60869 nt, Homo sapiens
ccuccccuccccucccgcugcgggaaaagcggccgcgggcggcggcgcccacuguggggcgggcggagcgccgcgggaggcggacgagaugcgagcgcggccgcggccccggccgcucugggcgacugugcuggcgcugggggcgcuggcgggcguuggcguaggaggugagugaggcuccggcucggcagcgucgcagcugccccaggaucugcgccccggucaaguugcggacuuggagccggcaaacgcggagggcuggucccgcgcgucugcgcugggaaugcgcguguccuggcuggcgcggucggagccgggagcuggggaccuuccuggcccggcgguggcggggcugagaggugccuggugccugggagcggguccuccgagacgccgaagccaucagccaggcugagcgccuucccggccgccgcggcgcgcacggugcggugggcgcaucucugagccccgcgcucacccggggcugcgcgcgucgcgggugguccuggucgggccaaggacgacuggcccaggagccaaggcgagguggggcuuccggggguuguucccgcgccuuggcagagggaugccgcuguagcuuccugggugagagcgugcgcgcgcgcggguuugccaguuuccccacauuuccaauuucuccuguuacgcuuucuccagaagguuuuuucuuuuccuuuuuucuuucuuucuuucuuuuuuuuaccuucaacuuggcuuccugcgggguuguuuuggagcaggaugagggcuuugccuccuccaguguccccagguggcagcggugccucugcucccagggcagacccugcacccgaaaaaucucuaguguauucggggagccaugaaaaggcucccuugggccggugggauccuuggcuuugucucuggcugcugcgcacaccgucagccgucagggcaauuggcauucggccucuuugguacuggggacacagguggagggauggagcgggcacagcccgggguugcugcccgugguccucucugaguccuuggugauuuugccugggcuggagagaaacccuggcuccuggucugcuggggccgccucugccucagaggaugacacaagagugcauguaaguauuuuuaauaaaaacuguaguacucguaaaacaaucuacacccugcagaagggauuuguuauuuuauuuuauuauuuauuuauuuauuuauuuauuuuugagacggagucuugcucugucgcccaggcuggagugcagugguggguucucggcucacugcaacuucugccuccuggguuuaagcgauucuucuggcucagccucccgaguagcugggauuacaggcgccugccaccacggccggcuaauuuuuguauuuuuaguagagacgcgguuucaccauguuggccaggcuggucuggagcuccuggccucaagugauccgcccaccucagccucccaaagugcugggaauacaggcgugagccaccgcaccuggccaggauuuauuuuaaaaagggaagauuuguugauaaauucacuucaaagauaaacuauucgaaaauacuuuagugauucccgucaagacucuucuguguauguauagacguauaacucauucuggacagggcaaggauaucuuuuuuuguuuguuuguuuguuuugagauggacucucgcugucgccaggcuagagugcaguggcgcgauuucagcucacugcaaccuccgcuucccggguucaagggauucuccugccucagccucccgaguagcugggauuacaggcacgcaccaccacgcccuacuaauuuuuguauuuuuaguagagacgggauuuccccauguuggccaggaugaucucgaucucuugaccccgugaucagccugccuuggccucccaaagugcugggauuacaggcgugagccaccgcacccggccaaggguaucuugaaggagggauuacaguugauauguagaggaauauugcagugguuauugcugcauuuccuaugugacugggacuaaaacagaucagcugauaguguuagcgugcagugagcagucugaugacuaugacacagaaauaagaaucuccagcauucugcccugggacauguggagccuugggucagaugcugcuggcuauugaugccgggaauggagaaauccaccagggcaacucaguaaaaauaaauaaauaaauaaauaaauaaauacauaauuaaaaaaaggguauccuuguccuguccaggaugagaugcuugcuuccaugcacuuacgacaauuuuugcugucauuaaaaaauuuucacauucacagucuucuaaauucacuuuggaguguauuggauuccacugcauugacauacguaaguuugcauuaaaagauccuuuaagauaucuggucaggcacgguggcucacgccuguaaucccagcacuuugggaaguggagguagaaggauugcuugagcccaggaguucgagaccagcuugggcaacauagugagaccuaaucucuacuaaaaauuaaaaaaaaauccuuaggcgaucuguucacagauuaaucuugugauuggggcgauuccagaagugguaauggguugugcugagcuagccccacacucucucugagaagcaguguacaguaguguuuaagggcaggggcucuaaagucagacuuccagaguaauacccccccccccaaccucacaaaucaguuucuacuauauuuauaucugccaucccaguguuggugguagggucuucagaucccuggggaagcagauggugggaugagaguaggagaguuguguugggacuccaaguguugaaggggcacagaaagagcugaguggcacagagagguugucccagaguagcggagucugcuuuggggagaagagagauugacugaggauagcaucaaguuuuucauuuuauguacaaagaugaucuuuuuagcuucacccaggaaguauggguuuugugucuuccucguguuuagguuuuuauucugaccuaauuaggucuaagcugaggugcuuauuucucuucuggaguuuauauccuagaagcucuccaaucgaagcccucugcagguauccucagguccuggagaaacacagcaggaaggcuuguuggcuucggaaagggagggcuaugguuuaaagccaguaagauguggguuugauucuugacuuugucuccuguaggcuguguggccuuaaauaaguuaccuaaucucuugaguccucaguuuccucauuuguaaggcagaggaaacaaugccuaugauuaugcugauuaaaugaaacagaggcacaaaauaaguguuuaaugaaugacaacuacuauugucauuauucuuccuauccaugcuaucugccauguauuggaggcaaaagcuguuacuacuucaugcauaugcgcuaugcaggcuuccagaaugaaacugauggggucccuuucccccacauaugugagagggggucccucuuauuucaacucguuccucauugcugguuuggcauaucucagcuacucuaacccggcaagaauccacagaagaagccaagaaggaaaaaggcuuauacauuugcuuuacccauaagaaaaccucaagcccuguaucugaaaaaagaggaagauaaaaggaucuauaagacuucaaguuccaugagaagagggacaugucuauuuuguucaauacucuaugcccacugccuggcacauaggcagcaaaacaaauaucuguggaaugcuauguaaaggcaucuauagaugaugugccucccuuuaagaaacccaauauuugaauauuugcacucauucauacaagauccucaagugcuccguuuggauaaucuggaggguaugaaaacauagccaagaucaugaauucuuugggcauuugggccgcugcacuguugcaccauuuagaccugugaucugagagugugaaaaacucaagggauccucuguaaagugucugccuuuuuuucccuccugggaggagccguuagaagggcaacauucuccuuucucccccuuggacguguggguguuggggcaagggugaggagugacagaggucuccugggaagaccauaagauggggcaagcacaccacagugaggagggggagucuggcuaugacuuuagaauuuccugaucgaaauuucuccucuaaagcuccccacccuacuugggaucugagguuaucauccccucccagucccaagaacccuucuucccuuguuggcagaaaucuccaggaagcaugcccacaggaaccacaacucaugaaucagaagacagauaauuaaccgagggagugacugagcagcuucagggaugaaccgcuucguuuuacccagcccucucugcugcccacagagugggcugcuccaccccaucgccucugcucccucuuccugaaccuuggcccuuccugagugggaccuucauugugccugauggagcucaggccacuaguggaaaugaaggugggagcagggaaaugacucuguuuaggggaacugccuauuccccgugugggaacugcuggcauuuauugaaacgugagacucuccagcaaaaaagugauagcaucugccuuucuguccacacacacagucucaccaaaaacacucuuuuuuuuuuuuuguuagauaauucagguauaauuuauguacaguaaaauucacccuuuuuagugcauacaguucuaugaauuuugacaaaugcauauagucaaguaaccauugccaucaucaagauacagaauuuuuccaucauccccuaaaauucccccaagcucuuuuuuucccuucuuuuucuuucuagaggcagggucucaccauauugcccaggcuggucucgaacuucugagcucaggcaaucugcccaccucggccucccaaaguguugggauuacaggcgugagcuacugugccaggugcccccccagcucuuuuguaaucgauacccuacccucaacccucgucgguugcaacugcugaucuauuuccugucccugcaguucuauguuuuacaaaaugucauauaaaugaaagcaugcaguguauagacuuucagucuggcuucuuucacuuagcacaauacauuugggguuaaucuaugaugcugcaucuaucaguaacucuaagacauugucugaggccacuccgucauccuccguguuggaacaguuacccugaaagcagugggacuggauccguuaaacuuuggaggugcuccccagcuuucagcuucuaaauuuuauaauuggauagauguauuuagcuauauauaagucauuagauuuuccaugugcuaaguaguuaaagacuucaggauacuagagaggauucuguagcaaccaacacuuauuauucuugcucauaggaguaacagauauuuuguggccaaauauuguaugucaugaugcuuggagucagaaguuguuaaguaaaccugggggcuauucuaccuuuuuacauuuuugguagcaucucugaaaaaacaacccacuugacuuuuuuuuuuuccuuuuuuuugggaggguggguggguggguggcuuuuuggccaaaaccagaaagcuugcuagacaaauucuaacacuagaucuaacacuagaugucuuauuucuguuuuucugucauguucccaugaaaagacuauuuacuuaccccccucucucgguuuuauaguugaguuaguucaauuucuuaguucaguuagugaagauguuuaaauauucaaggagagaaagaaaaagaacaaggugauacacauuuuaaaaaagucaaaauaacaaauauuguuauuucuuggcugggcgcgguggcucaugccuguaaucccagcacuuugggaggccgaggcgggcggaucaccugaggucaggaguucaagaccagccugaccaacauggagaaacccugucucuacuaaaaauacaaaaucagcugggcaugguggcaugcgucuguaaucccagcuacucgggaggcugaggcaggagaaucgcuugaacccaggaggcagagguugcagugagccgagauugugccauugcacuccagccugagcaacaagagcaaaacucugucucaaaaaacagaacaaaacaaaacaaauauuguuauuucucaaauagguucauccacauaggaucauugucagucguuaaaauugcugguucccuucuaauucuauuccccuauaauguucauauuaaucaggugguguguucuguuuagacauuuccccucgcauuuauguuuauuuguguguguguguguauuccuuuacuuaaacccaugauauauaguacuuccuuuuauauagaaaaaagcucaguguggaaagaacaacguaucuggaauuaagaaaccuacauucgauucacaguucugcaggcuuuuucaucagcuugcugggugacuuugaacaagugacuuuaccuuuaggcaucagucucuuggugucccaggggcugcaaagugggacagagaagaugaagggaaauacuucaauuugcuccugccccuuccccaccaccuucaacuggaacuccuuuaacuaauuaacaauuuggaguucauguaaggauuucuuugggaaaaaaagaagauccugcuguuaaaaucaagcuugaaaaacuuugcacuagaagagagcuccagaaguuuggcaaaagacauauucaguagccacuuaaaaagucccuguagucaacccuacaucucuuugcuaauggaaauuuuggauagagaaaccugggucugugagauccacugauggcuccagaccccaacuuuagccaucgcacguguugaacuccagguugagccuuugcuggagccgccugcaaggagcauguuugaccaauccccaguggaggggagggugguguuuccuuucugggacuuccacaaguugagaacagaccaugcugcccugggcaguucuugaaggcugugagagugggccugacaaaguuuauuccuuuuuuuuuuuccauucucuuuuauuauuauuauuguuugaaauugacaaauaaaaauuauguauauuuaugauguacaacaugaugucuugaaauaugugcgcauuguggaaugguuaaaugaaguuaaauaacauaugcauuaccucacauacauacuucugauuuauuuguggugagaacacuuaaaaaucuccucccagcaauuuucagguagaugacauacgguuauuaacuauagucaccauguuguacaguggaucucuugaacuuauuccucuugucuaacugaaaauuuauaucccuugaccagcaucuccucaugcaaaccauaccccaaagcucauuucuguguuccugcugaguuugccauuccaagagguuuugaugcugaaggugcaguuuguggaaagcccagcagacucuggggagccuacauuuaaauaaaugcaaaugucgacagggaggcagaacagaggacauuucaaauuagcuuuaauuuucuuuuagcuuauaaaaguaauuaagcuuauuauuuaaaaaaaggcagcucagaaauauaaugcagaaaguaccaguaccaguuccuuguagucuuguccuuaaagauaaccacuguugauaguuacugcagaguuuuuuucuauguauuugucaacauauauaauuauuuaucauuauuguuauuucucaaauaggauaaucaauaauaggaucauugucuuuuuuuuuuuuuuuuuugagauggagucucacucugucgcccaggcuggagugcaguugugugaucccagcucacugcaaccuccgccuccuggguucaagcaauucuccugccucagauucccgaguagcugggaucacaggcauuugccaccacgcccagcuaauuuuuguguuuuugauagagacaggguuuggccauguuggccaggcugguuuugaacuccuaaccacaggugauccacccgccucggccucccaaagugcugggauuacacgcauaagccaccgcaccuggcccauugucucuuaauaauauacucuaggcaucuuuuuaugucaguuuauggcuuuccauuauuuaucccaagagcuauaauucuagccauaaggcauacucuuuguuauauggauauaucagaauuuacuuaaccaauucccuguuggcagacauugggaucauucccaauuauuugcuacuacaaauaaagcugcaggggauauccuuauucauuuauuaugcaccuuuguucaaguguuucuacagacuuaauuucuugaaugaaaguuggugggucgaagggcaugcguauuuuaaauuuaaauuuuaguagguguugucaauuuguccucccaaacgguugaaccaguuugcuuuccuaccaagacaggcuggcaguaaggacugguguuagcaccgcggccugcuguccacacccauaacacaugagcugggggaggaaggcugcagaacuggacagcaggaugccaaggaggucaccaauagggcaccccugggcugagccucggacagcuugguacagaccugcuucuucuguauacugaaugagguggggucgaugcuaauaaaaauuuccagaacucuugagaugcagcguuugagucaaauaucaggccaucaggaagaaauggccacuugugccuuguuugaggguucucaugccuuggguugcuaggcuuccuaggguaugagucccccuguugauguuuucuggcuggaagaguggauacuuccaggacuggcagcaccuugaagaucaucaaauuugacaccuguuuguuuuacaaaaaagcaaaaagggaguuccugagaagugaagugacuuguccaagaucauacaacuggcucaguggcauugguugggucucucccuggggacucuugucuccugcccagagugauuucuucacuauauccuguuagagacaaagggcccuuucacgucugacccugagguggaggcgaggggauggggauuccugguguaggaagugacuagagugaaaguaagggggaaggaaaugaacauuuauugagcauccacuauagaggguucuuucauacguguuaugucauuuaauccuaacaacucgggagcacuggggaaaggaagcagcuguuuggagucuccggugcuuggccgauguggcugguuagacccguuaaauacuacagagcaguuaucacuucucgacuaugaaugugacauagacucaaagaggcacugggccuuggagagagcaccagagagaugaagggauguacuugaggucauacggccagaggaagggcaaagauggcuuuagacgugagguuuccugcugcuuugcaugcuuuuucugccauauccaucuguuguuuuacugcuccugccuuaccacauuucucaggagcuggguguuaauuuuagaccacaaccuuagagaagacaggacucugucccuggaaugggcuuuaugcagucuucagcacauggcgaccuaauuaaccucauuggagaugauaaccagacauaauguggcuucauuuacaaggacaggaccugcccuagaucuucccauuaacaucaucuugaagugucagcuccacagagagaccuuuccugaccacaugcuuuaaaggagacuccuucccucauugcuugcuauuccccgccccccccacccccacccuuucuuuucccuuugaggcagagucucacuccaucacacaggcuggagugcaguggcacgaucuuggcucacugcaaacuccgccucccauguucaagcaauucuccugccucagccucccaaguagcugggauuacaggugcgugccaccaugcccagcuaauuuuucuaguuuuaguaaagacuggauuucgccauguuggccaggcuggucuugaacuccugaccucaggugaucuacccgccuuggccucccacagugcucagauuacaguguuagccaccaugcccggccuauccugcuuuauuuucuuacagcaugaagggucaaugaaaggauauggccaguggucaagacauuugaacuuuguguacagggaauccccuugcucagacaaaaauccuuccuguuuuucccuugugaacaaaaguucucugaaaaggaauugggaggaaagacuuuauuccaaugaacaguuuggaaacuggggaaacucagcuguuggugucagaauuggggguuuauaaugaaaguuccugccuaggauccugaugagguccacuuaugcaaaugaacaauuccaacuugcuuaguucuguuugguugaaacaacugaggccugauuggucaaggcagcagagcccugacugguuauuuuagguuagcucuggaggucccaaaguugaagagagguguugauuuucagggaacucaaaguggguugugaccucuagucagcaaauggcagcuuugcucuguuuaaaauuuaggcccacuuagccacuccagaucuaucuugaaggacuggcucuuucagguucacauuuguucacacccucaugccccaugagccauccaucagcaagucuuuagauggaacguaucuagagucugaccacaucaguggcuccgcuacuguccaaauccacugccaucuguugccuggauuauuuuaguacauuucuaauugaauaauaagucucuuuccuuuuugcuucccuucuuucugucuugcacucagcagccaggaugaucuuuuuuugcucaccucugcucagauuccuccaguggcuucccacuauguggagaaaaaagccacacucucuaccauggccuauagcuuccuaguguucuggucccuaacugcuccucuaaccuccucugugcuuuucucuuccuccuuucucuccaccugcuauuucuuuaacaggcugauguccauccagaucuugccuuggguucuuucuggaaugucugugccuuggaucgucccaggauucacucuuuaacaucauuuugaaaugucagcuccacagagagaccuuuucugaucacaugcucuaaagagaguccuuccccuuauugcuuguuauuccuuuauccugcuuuauuuucuuacagcauuugccacuguuugaaauugugcauuuuuguuguguauuuuuuguuaccaucuuccucacuaaaauguaagcuucacaagagcaggggcuuuguuuaguuuaucagugugucuccagugccuaggagagugccuggcacagguagaugcucaaugaauauuugucgaguaaaugaaugaaugaaucaaugaaugcugacaccauugauauauauagguagaaaaauguacagcuaaaguaaccauuuuucaaaccuuauccauacguggauuaaaugcaacaaaaauuucauuucaugcuggcuuuuuuucaaucaugcaaaguauuucacggcaguguucuucaaaaucaugccauauacaugauggagaugcaaauccauuuuguauuaguuucuuagggcuguuguaacaaagcaccacaaacuggguggcauaaaacaacagaaauuuauucuuguuggaagcuagaaaucugaaauuaaggugucagcaggcccauggucccucugagacucuggguagaauccuuccuccuuccuaucuucugguguuggcuggcaauccuugguguuccuuaguuucuggcuguaucacuccaaucucugccucauguggcauucucucuauaugucucucucuucgugugguguuuuccucuucucauaaggacaucagucauguuggauuagggccuacccuaacgacaucaauugaucacaucugcaaagaccugauuucucuguaaggucauggucaugggcacugggguaaggacuucaacauaucuuuuuuggggacauaagucaacuuauaacacauuuuaauauugguggaggcaaguuauacacaaauguuuuccaauguuaaauaccguacuuaacuggcucugauauacuuaaaaacaguuuuaaaucucuaaaaucaggacauauacuauauucauaguguuagauuugaugaaauauggugccuggguucucuacugcuuugggugaugcuuacuggagcuuuuugcucagagcacagagguauguguuacccuaaacuccaccucccugucuccuucuccuuccuuggguuacuuagcugaugcuacauuuaaggaaggaccaaaauuaaaauaaacuuucuuagcaacuugcucuagauaaaccacuugugccuauguaggacaguaagcaugagauuuuuuuuuuucaugagucacauggccaggugacuacaaugaggcaucaugugagucacccacuguccccauggaccuaauugggaagugagcagucaaaggucaguggcagggcuggggacccagauuagaacuccuuucuggcagagugauagauguccauaguguuaguggaacauccucccuucucgauaaacaccucuuacugugacuuagcccucuccuguaguccccuguccucauuaggguggccuguuccuacaguccagcauccugucucacuggacaacauguccucaaaauagcccccauugacgcauuaugacuuccacuggauccaauucccucccuuguuuccuuuguucuuccauuuuucccacccuuugucucucuucugcuucugugauucaagcugaugugccaaaccacagccuucuacuucuacuuuccaggcaaacuucuuggcuggucuugauuggauuaaaauuguuauuuucaaaaaacuuuuuugaggcagggucucacuuuguugcccaggcuggagugcaguggcacaaucacagcucacugcagccucaaccucccagguccagcugauuuuccugccucagccuccugaguagcugggacugcuggugcaugcuaccaugcccagcuaauuuuuaaaaaaauuuucauagagaugggggucucacuauguugcccagacuagucgccaacuacugggcucaagcaauccuccugccuuggccuccgagaaugcugggauuacaggcaugagccuggauuuucgaagacuaauauuccuaaccccauuuagaagccagaucugacaaguaaacauuucacccuggugugauacuuucuggcuccacgcucccacgacuccuucugcucagggcauacuuaacgucaugucuaguguccccuagaaugaugucaucaaggaaaaaaaaguauucaccugcccuaaacaauuugagacucaggauaaaaacaacaauaaaaccaauauaaauuacagcagcagcagcagcagcauuuauugaguacuuucuguguuccagcuguugugcucagaguuuuacaggguuugguuuauuucauccuuacaaccacccugugaagacuggggucaauccaccuugucccugguucuggcuaaccugucagaggaaaggggugguaggagguaggaguuguuuguucuguaagugacauuauggugaagauucccacuuuagcaggaaugagucugggccccagagaaugagcaggaacauaggcuuuaugaaugacuggaaacagaggcccaaacuccuuccacacguucaggagggaggggugggcucagaacaacaacucauugaaucagcaugggcucagugcagagacuucugaugagucagucacuuuuaaccacugcauuccagggaaucugccuggguagcaggacuugguuggggguaucaugggggguucauugguucucauaaaaucaaccugugauucauuaaaaagaguggauaaagggacuugguaaccaugacucugcaggcaugauuuccuaaagaacaaaucccagcaccucauuuuauccucuggggucagggaccauuaguucacugggagggaccugcuguuauuuauuuuguaucuugcaaaacuuucuauuguggcuacaagucaaggacucauagggaaaugcuaauuugagaaugaaugggugguuaaaugaauagacugggaaaaguccuaaaaaguaaucugacagugucuguauuaguucauuuucaugcugcuuauaaaaacauauccaagauuugguaguuuauaaaggaaagagguuuaauugacucacaguucaacauggcuugggaggccucaggaaacuuacaaucaugguggaaggggaagcaaacacguccuucuucacaugguggcaggaaagauaagugccaagcaaaagggagaaaagccccuuauaaaaccaucagaucucaugagagcucacuuacuaucaugagaacagcagcauggagguaacugcccccaugauucaauuaccucccaucaggucccucccacaacacauggggauugugggaacuacaauucaagaggagauuugggggguggggcacacugccaaaccauaucauuucaccccaaccccucccaaaucucauguccucacauuucaaaacacaaucaugacuucccaacaguuccuucaaaucuuaacucauucaaggauuaaccugaaaguccaaguccaaagucuuaucugagacaaggcaagucccuucugccuaugagacuguaaaauugaaagcaaauuaguuacuuccuagauacaacgggaguggaggcauuggguaaauacagccauuccaaaugggagaaauuggccaaaacaaacaggcuacuggccccacgcaagucugaaauccagcaggacagucaaaucuuaaagcuccaaaaugaucuccuuugacuccaugucucacaccuaggucauauugaugcaagagguggucucccauggcuuugggcagcuccacccuuguggcuuugcaggguacagccucucucccagccacuuucaugggcuggcauugaaugucuguggcuuuuccaggcacauggugcaggcugucaauggaucuaccauucuggggucuggaggaugguggcccucugcucacagcuccacuaggcagugcccgaguggggggcucuaugugggggccucaacccauauuucccuugugcacuccccuagcagaggcucuccaugagggcccugccuuguagcaaacuucugccuggacauccagguguuuccauacauccucugaaaucuaggcagagguucccaaacgucaguucuugacuucugugcaccuguaggcucaacaccacauggaagcugccaaggcuuggggcuuguauccucugaaaccauggccugagcucuauguuggucacuuuuagccauggcuagaguggcugggaugcaggucaccaaguuccuaggcugcacauagcagggaggcccugggcccagcccaggaaaccauuuuuuccucuuaggccucugugccugugaugagaggggcuaccaugaaggucucugacaugcccuggagacauuuuccccauuuucuugguaauuaacauucagcuccucguuacuuauuucugcagcuggcuugaauuucuccacagaaaauggguuuuucuuuucuaucacaucgucaggcugcaaauuuuccacacguuuaugcucugcuuccugcugcuguaugcuuugcugccuagaaauuucaucugacagauccccuaaaucaucucucucacauucaauauuccacagagcucuagggcaggggcaaaaugcugccagucucuuugcuaaagcauaggaagcaugaccuuuacuccaguucccaauaaguuccucaucuccuucugagaccaccucagccuggacuucauuguccauaucacugucagcauuuuggucaaagucauucaacaagucucuaggaaguuccaaacuuuaccacaucuuccuguauucugagcccuccaaguuucuaggaagcuccaaacuuucccacauuuuccugucuucuucugagcccuccaaacuguugcaauuucugccuguuacucaguuccaaagucacuuccacauuuuugguauccuuauagcagcacuccacucuaccauugccaauuuacuguaauagucuguucucacacugcuaauaaagacauacccaauaccagguaauuuauaaaagaaagagguuuaguugacucacaguuuagcauggcugagaaggccucaggaaacuuacaaucaugguggaaggggaagcaaacacauccuucuucacaugguggcaggauggagaagugcugagcaaagggggaaaagccuuuuauuaaaccaucagaucuugugagaacuuacuauuaggagaacagcaacaugaggauaaucaucccugugauucuauuaccucccacugagucccucucaugaccuguggggauuauggguacuacaguucaagaugaguuuuggguggagacacagccaaaccauagcagugcucauaucucccaugguccucuucccucuucuaacccuucuugaugucuucuugugcuucugucucuugugaauaucaauggcauuuauguccagaauuaccccuuggcaugccaauucccauggaaacuccagaaagggagggagauacuuaaaauaguucaggcugugcuccucucagaagucuucugauaggggaaaaaagagaggcucuguccacaucugccugggaagagagcaauuauaaggcuaagagauggccaggcagcucaugcagggagaagucuuggguugcauuguucguugugaacauucaggaauucugaaacuagcagccacuuuucuuucauuauagacauugcauggcucagggcugccccaucucagaggugaccuugaugcuuuaaggccaggcuuggaaccaaugucaucauucccacucaugggccucacgcuuacauucugaaguuguagucaagucggagaguggagccccagagguuauucaugggcucauaaaggcaucccacuuguagaauuuuaaaguugggcaaggccuuugaaguuagauggacucaaggcucugaggaaaccuggggcuuccaggaggugcuucaaggauuccgcauauaaucuaggguuuuugggagaacaaugaaaguuuaaauugccugaggaauuguuguagcccauuuacauguuuuauauuggaauucuaugcauaauuuugagaaaugagcucaguugcuuaaaaaagcaaagcaaaacuucaucuauuccccuaccuuucauuuugccccagugcauauuuacugagcaucuccacugaguaagaacuggagcugagcugggcagggcagagcaggucucaagggacuuaaaaucuguuggguggcaguguuguuaaggcagacacauaaauuauuaugaugugguaggaauauuagaauugaagaaauggaggcugagaggaguuaaaugauucacccauggccacacuauuagugggugacucgauuaggaugacagucuacucauuguguguacccauucuguuagaccuccugucccccaaguaagguccugaaauggguacuguuaaaguauauauaauuuuaacagaguuaaaaguaugauuucuacacaaauauaaagggaauauguguaaaagauuuuauucaacuuuaguaauuaaagaaccaguaagacguuaggaguaguucaaaaggaauuucaaagaagggagauuuaugguugaucagucaaaggaaugcugaaaugaauuagugaauagauugaaaauugguuaauauucugcaaggcaaugaaccuuaaccugugggggauaaccuuuucuaccagacagaaaucauugguauuguuguuggauaagaauaauauacauuguucucuuaucuaaauaauuuaccuugcacaccacaauaugaucaugauuagauuaaaauguugucuuagccaguucuagcagcuauaacaaaaugccauaaacuggguggcuuaaacagcaaacacuuauuuauuuauuuauuuugagacagagucuugcucuuguugcccagguggagugcaguggcaugauaucggcucacuguaaccucugccuccuggguuuaagugauucuccugccccuccugaguagccucccaaguagcugggaucacaggcgcccaccccaaugcccagcuaauuuuuuguauuuuuaauagagacgggguuucaccauguuggucaggcuggucuugaacuccugaccucaggugaucuaccugccucggccucccaaagugcugggauuacaggcaugagccgccucaccggggcuauuuuuuuuuuuuuuuuuuugagauggagucuugcucuggcucaggcuggagugcagugacacuaucuuggcucaccacaagcuccgccuccugaguucaugccauucuccugccucagccucccaaguagcugggaccacaggggccugccaccacacccggcuaauuuuuuguauuuuaguagagacaggguuucacuguguuagccaggauagucuugaucuccugaccucgugauccgccggucucggccucccaaagugcugggauuacaggugugagccacugcgcuuggccauuuuuuuuuuaaaagaauaauauacauuguucucaucaagaauuauuucccuuuuuuuugagacagagucucgcacuauugcccaggguuggaguguaauggugaucauuuccguuuuuaugguuuucaauaggucaacaucuacucuuacaguauuguaaaauauccugauuaauagaagccaaauaauagguacauacucuuagaaaaucagauaaucccuaagcauggugggucagcuagucaacauucugcauuacauugaaaggacauuuguauuuucuuugccuguuuccaaauuuuauguaaucuuucuuucuuucuuuuuuuuucuuucuuucuuuccuucuuucuuucuuucuuucuuucuuucguucuuucuuuucuuucuuucucucuccuuccuuccuuucuuucuuuccuuuuuuuucuuuucugagauggagucucacugugucacccaggcuggagugcaguggcaugaucucagcuaacugcaaccucugccuccuugguucaagugauucuccugccucagccuccugaguagcugggauuacaggagugcaccaccacgcccggcuaauuuuuguauuuuuuagcagagauggaguuucaccauguuggccaggcuggucucaaacuccugaacucaagugauccgccugccucguccucccaaaguggggagauuacaggcaugagccaccacgccuggccauaauuuuucuuuacaauauuguguguguguauacacccucauuuucugaguguguuuuuguccagguguugggaaggagggaauucagucacacuguaauaaaaugaauggagacagcuaaaugagaaguuuuggggacacugggaaaacaucgcaauggucaggcugauuucuccaaaauagguucgcuggucuuaccagcuggggucaaagaggucccuuuggaaaacugcaugaaggagcugucaggguaacugggucauggagaggaacagaucccucacauucugcuccuuauauuggaaaaaaccuccuuaaggcacugcaggaagaaggguucaccuggcuggagcaggaaugcugagcuaggcaauuagagaggacaguggcuucugucuaagcagaugccuggguuuggcuuccuggcugagcuucucaaggugauuuugguucuccugguuguuucugcuccuccucguagccuuugcucuguccuuugacaguaugaggacuguucacauuugaauagcaccuuauaguguaccaagugcuuccccuuaccucacugaauucuuguacaaauccugagagacagauauugucaucccauagaggcuaguugaguugcccaaggucaugaaguaguuagcaggaagaacauucagaauucaagcacaaaccuuccaacucuaaaauuccauguucuuuuaguguauaucagucagccuuuucuaacauuucugcacuuccuccuagagcauuuugugguuggauuccaagauauaugcauugagaagcuugagaagauuucagauuugcuuuucuuuugccagucagugggacacugccaccaaagucaccucacccuccacgcccccacuguauuuaggcuauguguuaauguuagugcaucugggccuuggauccccuguguaguggcugugaauaucacuagaaugacugaagaggggauacauugccauuuuucugggccccggagauauuuucauuugcacaauguaggugucaaaccaguuguuaauuaaagccuuuccaucaguuacgaucugagacuugcguccauggcucagccuugcccugucacuuguuaccacuguggccucaucaguugagagcggugaugaguuucuccugauuuuccuccuccuccuucuuccuaaccaauaaccuguauuugguagacgucugugguaugguuaggguguguuugugugcaccugagagcuguaaaccuggacauugggaaaguugggaaggaugaggcaggcaaguaccuucacugagccaaaucuggugcuaaugccuuugucugucuguugcagggcccaacaucuguaccacgcgaggugugagcuccugccagcagugccuggcugugagccccaugugugccuggugcucugaugagguaaggagcagauaccagaccuuguuucuucuccagacuaagcugcuuuugugcagaaacagacccaugaaguuaucaccucccucuugaauacacaugccccuuaucccuucuaagcaaaacuuugaugaauuuuucccauugaugcauggugaggagcugucauggggauguugcugggaauacuaacccaagucuaccauauagccccuggcccuugccaguuuggcucgaccuccuguccucucuguaaccacugcugcccuuucucacacuuugcuugcuuuuuuuccuaagaaaaacaguuuauuuuaaauuuuuugguagagacagggucucacuauguugcccaggcuggucuugaacuagacauaagagauccuccuaccuuggccucccaaugugcugggauuucaugugugacccaccaugcccagcccuuugcuugcauuucuugggguggaauaucccagggaagcagggcgucaggucucaaaaggagaggcagcaagggguauagguacggaugggguugggagggguugcuggcuuacuucuuuuuccuagagguuaaaaaaggcaaauagaagagaaaucuugugcuuguguguggugauguuuagucagaaaaucuuuucucuucccuucucuuugaugauugggccccgcggcuuuacauuuuucuuucucuucuucuuuccuuccuuccuucucacagguguugaagaaaggagcugggcccacuuggugaggauggaagggggacaggaaaggguuaguugugucuaggcagaggguuuguugugucuggggcccuagggaaugagugugucugagggaauggcuauguuuguggcugggauggaaauuuggagcuggcaagagcugaugggguggggguggaagaugaaugugguugaagagauucggugauuauagagucucaggcugagucacuggccuggccagcaggugguuaccugaguuccuggccuggcugcggcucagcuaccugaggcuuccucugucccacaacaagucccagcccucuccaguuuuaugaccgcuccaauccagcccucagucucucugucugcuucuuuuucagaucugcugaguuuccuaaaaaggcaaccucccuggccgccuggggggaggggcgggagcugggaggcuguguuuaucaccggccaggagggcugccagagcagcagaggccagcuccgcacguugcuuuggccucuuugccguucagcacgggaacugcuuccagaggcagcugcccaacaucugggccacauuaacuucauuuagcaaaugaaacauucccuggggcuagggaagggguguaaggggggcauggaugagaccuucucccccacccccgcagguucuccuccccucugggcugagcgggcugcucagugugauguagccuccucccuccuuauucacuauguccuccuuccucccaucgugauauuacuaaagcuucuuuuaccaggaaguugcaauucugcaacugaaugcuggaagaagagagagcugaauggggaggggggccuuggguagccgaaagccuucaggagcagaggaaggucaggacagaagcccuagugucacucaaagggugcuucccccuuuuccuccuucccuccuuuccaacccaaagcaagagaaaaugcagguaucucuggcccagagaaucuggggaaaaagaaaaccuucuuggagggucuguccugcucccuaucccccauuuuucaucccucuugaucuguauagggacuagccaugcagcugaggugggcuggggccugaccagacaaagcccuuaggucacauaaccagauuucaaagaugcaaauguagaauauuuaugggugacuguugugcuccuuguccccuggggcaggccuggggagggcagagggaaaggugcaggguagaucagagcaugacauaggaccagccuaggaauuaggggugcagucagugaggaaaugggcgcagcuaggaccaaagaaaacaaauggaaggagguagaaaguccaguaagauauucccugggagaauggcauauaaacaugaaaggaggcggggccaagguuagugaaggacuacaacuaucccucagcaagagggaggagggagagaaggaaggguggaggaccccaguaugggacagaauguggugaccggggagggaugggaggugggaauccuggacuguaaccugaacauaaaugcuauuuuguucuugagaggagcagggcuuccccuggauaggccaaguuuaacugcugaaaaugccuuggacauugacuucaaaaaaccaaaggugaacuggcugguccauuuuuuagguaauuuuuugaauaaucaaaccuuggagagcccucuguucuucuuccuccccugaguuggcuguuccaggcaagcuggcagugccuggaaaaacaacugguugggcucggcuuuccccuugguccuagaggaccggagcucuuggguguguauagugagagcuuggcuggguaagaggaaaacagccaacguggaugagcacggaguuuugggcccaucugcauaggguguguucuuggaggguuggauaccgacgcggguuggguugcugugcucucucugguccauaaaucuagcaaagaggcgggcuuuauacagagacucaacgcguagucuuagucucaacagugacaugcuggagucuagaaccucccaaacucauuugguguugagaauugccugaggugcuuguuaaaaauaaagcuucccgggauggauccugggucuguuacaucagaauggauauuuaugauagcaaguuuggcaaacauugcuaauugaagggccacugggguugggucaagguggauggagguggaguuaagguugccagauaaauacagaacauccagccuggugccuguagucccagcuacucaggaggcuggagugggagaauccucugagcccaggaguuugaggcaauagugcaccaugaucaugucugcuaauagccacugcacuccagccuggguaacacagggagauccugucucuaaaaaauaaaucuagauuacagaacauccacuuaaauuugaauuaaaaaauaauuuuuaguauaaguuugucccaaauauuugcuaaauuuggcaacccuacaguggagggaaauacuaggaauucuuauauaagccugaguacacccuggaaggugggccagcuucccacuuagccugacaaccaagggugacagaggaagaaggaguuugagucuagcaaaguagaggaagacucuaauaggauuuccuucucauuuucuucucugcaacugcaggagcaagauauaggccaugauuuacauuucuuuauaaucacaaacauaauuuuauucugacuugucuucuuucuauuuauuuuuaaucuggaggacaaauguucaucuugagaguuuugcuccaauuuauuauuguaaaaggaaguauaauauuaagagugcuccucuucuuguaaacaaugaaaugugaauaccaacaacuauaaacaaaaaugcuucauguuccuccccuccuccuuucugcccucuucauucuuuucucuuugcauguucaagugauuucuuguccucaccagaugaguuaaucaagacagcaauggaugggagauguuuugguggugcucugggguaaaaaaaguacuggggcauauugacucucgcucuccaagaagaguaugaaauaauaguaguuauugugguaacuguaaaaaagagucaccugccaggugugguggcucacuccuguaaucccagcagggccaaagugggcagaucacuugaggucaggaguuugaaaccagccugaccaacauggcaaaaccccgucucuacuaaaaauacaaaauuagcugggcgugguggcgcaggccuguaaccccagcuacuagggaggcugaggcaggagaauugcuugaauccgggagguggagguugcagugagccaagaucgugccauugcacuacucuagccugggcaacaagagcgaaacuccaucuaaaaaaaaaaaaagagucacuuauauuugcauuuauuugcuuauacuguguccuaaagcaggggcuccaauuccuaguccauggccuguuaggaacugggccgcacagcaggaggucagcagcaggugagugagcauuaccgccugagcuccaccuucugucagauccgugguggcauuagauucucacaggagcucaaacccuacugugaacugggcaugggagggauccagguuguucacuccuuaugaggaucaaacuaaugccugaugaucugggguggaacaguuucauucugaaaccauccccaccucccuguccauggaaaaauugucuucccugaaaccagucccuggugccuaaaagguugggaaccucuguccuaauggauuucaguauaguuaacuuauguugagauuuuuauauuuugaaagcauuucacauucacagucuucuuuuacuuccugaccaacccugugaaauaggcaggauaaugacaacuauucauguuguacuuucccaauuuccaaaaugggauuaauggagaaugguaccaagagcgugugucacccucccaggagagggagguaauucagccagcucgcagggcgcuggcuggaaccucccaccucugugcucaggcccuuccccugggucuuggcuauuuuugcccuuuuuguguaacauccgguuucccugggaacugaaacuuuaauauccaccccucccccuucuagcuuucuuccugcauaaccuggagacauucuuucuaccuucucagccuggguuaccaagaaagggaauguugcccaaguauguugaggucacugccuuggugcucuucuggaacagagggcucucguggagagcuuggcugacgagcaggccuguuauauuccugaccucugaugucagcaaccacaaagggagggagggaggcaguuuuguuuuucaguguuuaauuuuucuaaggaaacucauaacaaaccauuaggacugucagcacaucuuagcgcuucaaacccucuucucauuaggacugccacauuagaaaauaggagucaggaaacucccgucuaaugcauucucucccucugcugauggagccugaagaugcaugaaggccuugcugcucucauccaguuugcugggcuccggucccugcugucuucuucagcaucugucuugguccuggaaaggauccgcuccucacugcauucugauuuauccacugccuuuuugggaagguuuucucccuggggcuuugugggcagcuagaaucagagauaggauuggggcuuuuuugagcaagagaaagacugcuuccagaggaggaagggguaggagaggugggcagggacaacaggaggagucugggcacaaaaccugaagugcccaaguucuccccaggucauuccguccucagccagagcugggugcacgggagacuuucaucuuccucagaguuguggaaggucugugaugucccuguuggaguauuugccaccaggaagguuaagucuuauucauugauuuccaucgccgaggcugguucccugccugcauaccugugaagaugagagagaaagagagaagcugcuggcuuccagaaacucuacuuacuucuugccugggccaggguaguccucaugcuguugauguugcucguguccccauccacguggggaaggcuucagcccaugaaagggggaucggacuggagagggagagagacuuuaagcauugggaaggguuuuggguuacaggguuuuuuuguuuuuguuuuuguuuugagguggggucucacucugucacccagacuggggugcaguggugugaucuuggcucacugcaaccuccgccucccuggcucaagugauccucccacuucagccuccugaguagcugagauuccaggugugcacuaccaugcccagauaauuuuuguauuuuuaguggagacgggguuuugcccuguggcccagggugguccggaacuccugagcucaaguuauccacccgugucggccucccacagugcugggauuacaggcaugagucaucgcacccggccgguuacagggcuuuugaguaugaauggcuccuuguggcccagucccucuucuggcauuauggcugccagguugcuugagggggcugaggaggcagaugucauccauccuucuccaucccucgcacaugcccaccuugcauccuguucccuaccuggggcauucucuguuguggcuccucccuaggaccauuccuuccacacuuuuccuuuuccgugccuugacucucacucuauacggaauguaguaaagcuuauuuuaugaugauaauuacagucagacaaucuagcuggccucucaguucugccacuuccuagcucugcaacuuugagcaaauuccuuaauuuauccaagccucagauuccuuaccuguaagauuggguuccuuauuugugaagccuccaaaccuuagguuucucccuuguaaaauuauaauaguuccagcauuauggaacugucaggcauauugcaauaauccauguaaagugcucaccacagugccugacauacaguaaguguucaauaaaugucaacacuaguuguucugggauauugguguggguuauccagcagacauuuggaagugcugguuggggauguggguaggggugggguugaggagagcccgaaggccuagacauugugaaauaggucccgggagggguuuuccagcuuccuggcugguccccucaacuugguaaggagcccucauagacaugcacccacacaguguuggcuaaauuggcugaaugucagagccggaagggacugaaaacacugugucaucuaaaggccuuguugaacaggugaggacacaaaaugacguaucugaggucacaugacuagucaguggcaggccuaggauugaucuucuuuccugauuuucaguguucuuuccaggguggcgugguccccuucaauacucagguuuaagcacccagagccccagggggccguggguuuuuggaaggguacucaauuuguucuuuguucagggugaaggaggacacugaagugauaggaugggcucugguuaggugccuggcccauguucccaaguuuguggaguuuauucauaauuagcuuauccaggaaguacuugucaagcaucucauaguaauagcuuacauuugcugaggacuuccucugugccaggugcuguccaaugcauuuuauguggauugucuuauuuagccugugugacaucccugugagggagguaccauaauuacuauuauuuuaaguaacuuuuauugugggaaaauauacauaacauagaauuuaccaucuuaaccauuuuguuuuguuuugugagaucaagucuugcucugucacccaggcuggaguggaguggcacgaucuuggcuugcugcaaccuccaccucccagguuuaagcgauucuccugccuccgucucccaaguagcugggacuacaggugcacgccaccacaccuggcuaauuuuuguauuuucaguagagacgggguuucacuagguuggccaggcugguaucgaacuccugaccucaggugaucugcccaccucagccucccaaagugcuaggauuacaggcauaagcaacugugccuggcccaucuuaaccauuuuuaagcauacaguucaguggcaugaaguacauucauaaugucaugaaaccccucaccaccaucuaucuccuuaacucuuuucaucuuguaaaacuaaaacucuguacccaucaaaacaguaauucucuauuccucccagucccuggaaacuacuauucuacuuuuugacucuaugauuuugauugcuguuaaguacugaaggagggacuguuauuauguucguguuacagcugaggaaacuaggcuuggaggaauuaggugacuugccuuaguaagcaguuguaagugcaaugcugagauuuacuccugugcucuuagcccugacucucuccugccuccuuacacugccuuucccuaucacauuugugguaaguccuaggucggaugcugggaaaugagaggggccaagacacacacagucccugacuacauggaucucacagucuagcccgugucaaauacaguagcuuccaaacuguuuugacucugaccuacagaaagaaacacacuguacuggguauaguuauuuauuauauguguuauucuccacucuccuccaacaauauaagaauuucacaaaacaacccuuugacuauuuguacacuuucauauuuucuauucuauucuauuguauuuuauuuaacaaaaugaugguugacaccugcuaaauugauuuugggacccacaaaugugugguauuccacaguuaaaaaaugcuggucuaccaggcaucuuacuguacaggcucuccuucuagcuacaacuccaugaauaggccuucuugauaucucaauuucucuuuucuuuuuccuuuuuuuuuuuuugguagagacggggucuagcuauguugccuaggcuggucuugaacucuuggccucaagcaguccucaugccuuggccucccaaaguaucaauuuccccuuucuguacaacgguccuaagggauuaucccaggaaagaccacaacaauuuguuuaugcuccaauguacgggguaaacucuuagcuauugggaagugguagggccugcaggagguagagagucgccauagcucugauugcuggacuucucuuugggcuccugucuuacaggcccugccucugggcucaccucgcugugaccugaaggagaaucugcugaaggauaacugugccccagaauccaucgaguucccagugagugaggcccgaguacuagaggacaggccccucagcgacaagggcucuggagacagcucccaggucacucaagucaguccccagaggauugcacuccggcuccggccagguagggcugggacucuuugcggggagagaccugaagcaggugggcauagagcacaagguggaggucugaggaggaagucuuggggaaguagcucagaauggaaauggggugggaagacaaggaugaggggggaggugugggcaagagaauggaagaaaauaagagacguuaggacuugagucagaagaucugaggugaaucuuuacuguaucauauauuagcuauuugaccuuggacaaguuacuuaacccuucagacauaguaggugcucaaaaaauauuuguuucuucuuuacccaagugccuguuuuaccuagcuuagagcuuuguguugaggugcaaaugagauauagaacaagaaagcgacuuguaagccccccuuucauggggaauugggacaggggaaugggggcagacacaauagguacacaagaccuuuagagggaggaaggguuagacuaaagacagaaauuuugaagcauugauuuugacuuuccaacuaagucaagaaggauuuaccuacuaucaaggcauguguuggaugcaaugggauucagagaaggguagggugcaguuucugucuuuuacagagucugaaguguaguaacuaucaaaaucucugugacucacagugauagacccguggaacucacaggauuagaaauccccugggauuuagagaaaguggaaaauuuuagaauggaaaagaagagguuaaaaauaggagggucaagagauuagaagaguaauagaauugcaaaggaagaggaaaagggaccagggcuuucugguuugcuuugaucaugcaauuucuuagucccaacuguauccaaaucugcuuauucaaucuuggugggagaagaagauaaaaacuaacaucuuucugccuuccagaugauucgaagaauuucuccauccaagugcggcagguggaggauuacccuguggacaucuacuacuugauggaccugucuuacuccaugaaggaugaucuguggagcauccagaaccuggguaccaagcuggccacccagaugcgaaagcucaccaguaaccugcggauuggcuucggggcauuuguggacaagccugugucaccauacauguauaucuccccaccagaggcccucgaaaaccccugcuaugaguaagucccuccuccagacgccaggacagcauccuuugccccaggaagguccaaguccugguuccuauuucuagcucuaggaucacuuuguuggcugucuucuugccaaacuauagcuccuuucuaccuuggucucccuguuuggcaaaugggcuagcuuguggaucuggaguguugugucaauggagccuaaggcuguuuggagaaccuagaaagaaaauucaucagcuucucagucuugguaacaaauaaauagaaggcaagagagaaugggagggaaaugacgucaaaaguagaaagaaauuuauggauaaggaaaccgagaaauuacgauuacagaaggaucgauuccauuguuggcauuauugucuucaucaaggccgugcauccugcagggugaaaacagaagaaaugaagugcuaaggaauauaaaagaguggaaaugacauuuguuggacacuuuuauagucuguaaauggauaacuugugccucuguuugacacuuuggcuuaaaacugaauggcuuauuuauuuaaucgguggagacugugcaaauccauguauuagaauaacuuacaaugcugguugcugagccugaaaaggugugaauuuacuuuuuaguuuucaaaguuacggccagguggggugacucacuucuguaaucccagcacuuugggaggccaagaugggaggaucacuugagccuaggaguuugaguucagccuaggcaacauagugagacccccaucucuacaaaaauuacaaaaaaauuagcuaugugugauggcgcaugccugcaguccccaggacuacagggaggcugaggugggaggauugauugagccugggagguugaggcugcagugagccaugauugugccacugcacuccaaccuggacaauggagcacaacugucucuaaaaaaaaaagaaaaaguuuugaaguuauaugauguggcauucaaccuucuaucuggguuguaagguucccaggcaagacaucagcuauuaauuaaacacacuauuuugacugggggcagaaaugcuccugucuugcaugaucuaucaauuuauugaugguucagggaccuuaacuuacugauggacuuuugcuuuauuguuacuuuaggaaaguguuaaguauaaggugauaguaauagcaacucgagccucgcucuggucuaagugcuuuguguguaugaacuuacuuaagucucacaacucuuaugggauaugugcuauccuggccccucuuucauagguuggauugagaggcuugccaaaggucccaugacuaguacagagggcaccugggaucuaagcucagggagucuuguuuccagcucaaucucuuaucuucuagguuagcuggauggggguaauguugauggggagcuucagauaauuugaggauuuuggagucugaacugucuggguaacugugguuguauggaacuggccuuggcauaccacuaucuauauuuguccccucucuuuccucccaauucccaugcugccuuuuccaugaaggugucugcuuaaauuaucucccaucccuccccaguaugaagaccaccugcuugcccauguuuggcuacaaacacgugcugacgcuaacugaccaggugacccgcuucaaugaggaagugaagaagcagagugugucacggaaccgagaugccccagaggguggcuuugaugccaucaugcaggcuacagucugugaugugaguuuggaggacuuggagugccagguguggcuggcauagaucaaaaugggaaaggaagugacugaacucuggggauuucugguguaaaaugagaugagaacuaagcagggcuuccugcaguuaugaguaguaaguugcuccugauauucagccuuggcuuagauccacucccuggccugagcugacauuucuuugaaccucaguggucucagauguucccaggggagagcaucuucccaucuucagaguuacuucagaguuaaggcugaguuaacuuaaccucagcaaaguaggcagauguucagaugagauuucuucuagcccagaucagcucuguggaugcacgucaguuucuagaugagcaaugugacugucauuagaagaguuaaguuuggaguuuaagaagaucucauucagcugcuugaacuaaucagcuaugagacuguuuucugaagagaaugaaacuccugaacuggaaagcuucagcuucgguuccaaggacugggacugagacccuuguuuugaagaaaaauaagcuguccagcccuuuagccagggagcaccuugggucucuguucucuaccagugacauggcugaauuuguuuugucuccucugccuuuguuuuuuguuuucuuuuaacaggaaaagauuggcuggaggaaugaugcaucccacuugcugguguuuaccacugaugccaagacucauauagcauuggacggaaggcuggcaggcauuguccagccuaaugacgggcagugucauguugguagugacaaucauuacucugccuccacuaccauggugagaucucuggcaccaccuaugguuucuauucaugauugugaggguugcccuaaucuaggcagagucugugugaauaugaaaauggcagccccuccuucugggcagggugcagggcucgguuccagcuugccccuaucccuuaccaacuggacaccgucauccagcauacaaccuauauaaccauuagagaugucccugauugugguguuaucacugccuucacugucaccagcauagcagcagcaucaugggauccagaauggacccaaaggauuuuuacaacccagcuggaaagcaggucuuccucuccacucugauuagcccuuucuuggaauaccauacuaacuugugguuauuggaagaagacagaggaaaaaaaagagaaagauuggccaggcauaugauggcucaugccuguaaucucagcacuuugggaggcugaggugggaggaucacgugaguccaggaguuugaaaccagcuugggaaauauagugagacccugccucuacaagaaaaugcaaaaauucguugaguguugugguuugugccuauggucccagcuacuuguggggcugaggcagaaagaucucuugagcccaguagucugaggcugcagugagcugugaucuugccacuacacuccagccugagugacagagcaagaaccaccccugcuuuuuuuuuuuuuuuuuuuuuuuuuuuuuuuugauacagagucuugcuuuguugcccagcuggagugcaguagugcaaucuuggcucacaagcuucaccaccucagucuccugaauagcugggaccacaggcaugcacuaccaugcccagcuaauuuuugaaaacagggucuuucuauguugcccaggcuggucucaaacuccuuggcuuaagcaaucugcccucuuaagccucccaaagugcugggauuacaggugugagccauugcuccuaguggagaccccuucucuuagaaagagagagagagagagagagagagagagagagagaaagaggggaaagaacauaaaaggcauggugaacagguccuacgaggaaagauuaaagggccagagucauuuagcuugaaagaaagaaggcuaaaggaugauuuagcuuauacaugagaaaacuucuuauaaguuguuuuauauggccauagaagguuaaacaagaggaaaauauuuaaauugaaucaggagaaauuacuauaagccauaagagaaaugugcuguaaugcucuagguaucuggggcaggugugaacucuucgucuccuaaggacaauauagcaacuuccucaucuaggugacuuaaagguguaccuguguaaaggcaggagacugagcugaggaucuaaugagcucccugcaaggucuaggaucccauggacauguucacgauucaccaccgcccccgcacaguguccuugaguuccuuggugucagccauauccaagucaagcacuaccagacaaugagucagcaacauuugaccccuaaucuaugcaaggcacugggccaggggcugagggagguaacaagacuauguaugguucuauccuuggggaguuuuuggucuacuugaggagaaaggauauauauauuuacaauaacacaagaugcaugauuagugccaaauggguguggcacagccaauguggcuauacguauccaagggaggaaaggucaucaugagcugggauggccaaggaagucuccugaagaaggugggggcuaagcuaggcccuaagaaaggaggaggauuaccaacaagaaggccacuccaggugggagacagugggccagaucacugcugaguggaagagggagagaggugagcaauauuuggaaagaaagacugagaccacacgguggaggaucacgagggccaggccaaggcauuugucaguaguuccaaaacagaggccuaacccagucccuugugcacggaagcagcuccauaguauuagugcauuaaauucaagcaggaagaaagaggugcuuaguuuugacaccacuggccuguaccucuucgucuaucccuggaguucacaaguagacuucugugcuacuuacccuucuuaucucacugucaccccccuuuuuuuuuuagagacagagucuugcucugcugcccaggcuggagugcaguggugcaaucauagcucacuguaaccuccaacuccugggcugaagugauccugccucagccuccccaguagcuaggacuauaggcacuuaccaccacaucuggcaaauaaaaaaaauuuuuuuguagagauggggucuugcuauguugcccaggcucuugucucacuuucagcaugaagugaaaugguuuaagcaccaccacacucugagccacagcccaagcaagauaaguucuaagcuuuagacccuagagauguacaugagacgucauuaaccucuacauccuucauuuuccuaggauuaucccucuuuggggcugaugacugagaagcuaucccagaaaaacaucaauuugaucuuugcagugacugaaaauguagucaaucucuaucaggugacugugccuucgggcuuccuggagugggcccugugauggugggugccccagguagccagccugugcuagcauuggauacaguccccaaucaggaaagagucuccccuaauccacuccccaggagcuaaagauugcacucugggccuuuuuccugcaaucuugaacuuacuagguauguguugguguuuguggugguggaggggagguggugaggggugugagagguuuccucuacuuuugcucagggcugaaaaacugcuagauauauuccuggcagugacaauugaaauaucccguaccuuccuccaaucuucaucucaggacucucagugggauuuggggagggcuuuuggagaccaccagcuuccuuugguaagcucuggacaucuuuguuuuccuuucuagaacuauagugagcucaucccagggaccacaguugggguucuguccauggauuccagcaauguccuccagcucauuguugaugcuuaugggguaagugucuugugcugggaauagucccgcggagaguccaccucauuuggcuuacacagcagggcucagauuugugagucccaguugccagucuaccacacggucuuacugccuucuccgugugcucccagagcccaggcaauggcccgcucuagaagggaugcagccuucugagaaggaaggaaggaaggaaggaagagagaaagaaggaaagaagauggggauggggauggugauuagauggagaaggagcagagcccuggaauugugggggcagagugagggaaaacugggcuccaauaacagggaaaagagagagcugagacauggggaaggugagguugaugaaacauuagguagaaaaugccacuuuccaaggugaccaguauuggcacuccccuuuugcaacaucugugaggccugcaggaggguguagcugguacauuuuacccagacucaccuagacgcaaguggagauggaaagagggagcagguuccugcgcaggaaacagaguccuaggggugcuccggcagcuuccaggucaaaccuuggccucuggcacugcuggggugaguccagagcuacuugccagauuuggcuugggauggaacuggcucuugccauuucccguuuccuuucaguucaauuucuugucuucuugugccccuuucugcucagaaaauccguucuaaaguagagcuggaagugcgugaccucccugaagaguugucucuauccuucaaugccaccugccucaacaaugaggucaucccuggccucaagucuuguaugggacucaagauuggagacacggugaggugggcugggcagggccuuuguccuggagcaucugugggcacccaacccccuuucuuccuuuuguagugacuaaaaauggcccccuuccaccagaaaaaaaauaugggcaagaaaaauacguuuccugaaagucauucuaaguuagauguaauggauccaccaaucuuuuccucugaggcuucuguugcguaagccauuucuguuacgugaacuucacucucaggaauuugaaaaacuuacaauuugguuaccuuuguuuguguaugcacaguugauugcaaaggaaaauauuucuuuaccuucagucccucaccagucgccagccuuuccaagguaauuaauaccuuucuuuuguaaaacgacacaagaaaguaaaaucuaaaauguaaaacacuccagucucuccacgacuuuccuuauuggucguuucuccuccgcuucugccuaaggggagagggguuggugggaggggaggaaggaggggaagaaaauagaucuuuggauacgcugauccuuucuauugaccuaucugucucucaggcacuugugcaaacaucccauguuagaaauauuguccugaaacaugcuuuauugcauaagcuaugaaaugugugggaacugaaguagauccugagcuuaugauugaccaccaugugggauuguguggugcaaaauagugcuuugugcaucuugcugauaauuauaaucaggccaaagcaggguguuuauaugaucacagguucuguucaguuugagcuggucuauuucauauguggagugaaaaaacagccuuuuauuauuuauugacuguaaaccaugucucugcauccagcuagauaugucacaacgauacuauucccgugcuuguguuuuugcuuugcagaccuucauauagggaaggcugaggaacuccagauugcaaaagcauaagacacccaauuuggguauuccuuggcagggcagggaacaacuuuuuuuuuccuccagagcuggaguguuaacugggcccaacugugucuaaauacaaucuuucuuuccauccaggugagcuucagcauugaggccaaggugcgaggcuguccccaggagaaggagaaguccuuuaccauaaagcccgugggcuucaaggacagccugaucguccaggucaccuuugauugugacugugccugccaggcccaagcugaaccuaauagccaucgcugcaacaauggcaaugggaccuuugagugugggguaugccguugugggccuggcuggcugggaucccagugugagugcucagaggaggacuaucgcccuucccagcaggacgaaugcagcccccgggagggucagcccgucugcagccagcggggcgagugccucuguggucaaugugucugccacagcagugacuuuggcaagaucacgggcaaguacugcgagugugacgacuucuccuguguccgcuacaagggggagaugugcucaggugaggagaacugcagggcccccuguccuggaacccacacccccucauauaccugcaaccacuggaaacauaggugaaggccugagaugggucuuugcaggcagagguguaagucagugguuccuaaucuuuuugaguauaaggaccaauccccuuuucacguuaaaaaaaaaaguuacugauagauggcaauuaaauuuuuagcauuuauagacuuagaaaacacaugucagaauauguaguaagguuaguaauaauuuuacaugaguuuaucuuuguaucacaagagaccgggaaaagaguaguauauaugcaagacauuggagugugcuugaacaaugucuggaaaaugguguaaugcucuuguuaauguuagcacuauuuuguuaaucacuguuacuacuauuggugcuacuguuauuuuuuggauucuagaucuuugcuauccaauaugguaggcuuuagccacauguggcuauuuaaauuaaccaaaauugaaaaauuaaaaauucaguucuucagcucaucaguggccacauguagcuaguggcugcuauauuggacagaucuagaacauuucaacgugauagaaaguucucuuggauagcacugccacagagagucccugcugacagauuggggauuauaauuuuaaguccuucuacucagcaggguacugaguuguccuucucauugcaaaauucaguaaaaucuugaggcccacugauaaucucaaacuaguuucuccuugccccaagaaccacuccugggguacuuucccagcuagaaguugaacuaauguuaauguagucuuuauccgcagacauguuggcaacacucucagagggcaaauagucuugaguuguuccuggggcacugaggauggguuuuuacugggccauaaucacuguggcuuaaucccucuugcgacagacacaaguugguugggacuggguuacggguguauuguguggccaaacagagagauuauaauuguuuucuggggaugacccuugacucagauuggcuucauuggcauugggguucuuuuuuuuuuuugagacggagucuugcucuaucgccaggcuggagugcaguggugcgauauuggcucacugcaaccucugccucccaguucaagcaauucuccugccucagccucccgaguaguugggacuauaggcaugcgccacgaugcccagcuaauuuugguauuuuuaguagagauggaguuucaccacauuggccaggauggucucgaucucuugaccucgugauccucccaccucggccucccaaagugcugggauuacaggcaugagccacugcgcccagccagcauuggggcucuaaucaguugagcuaauccaugcagauacucacuucgauacugauauuaaccuuuaaaaaagcucacuuagaaaggucgaucugugucuuucuaaagcaugucaguaacauaaaaaugacugcuuuuuuuauuaucuacgacauuguuuccuuuacucaugcugucaaaauuuuagagagaguuuggaaggaaguguuaucagaaugauuaggggagagcaagagaucagauacacacagaugaaagcacaaacagcaaccauuugaauuagggggugaggcaggaguuucacuucauuuuacuauuuaaaguauuuauaucuaauucaaaguaccaaaggaaauggguaaauuugaagugggagaccccugggaagaagguuggggacugagggagagaggguggucccaggagaggaguacggcuggaccacgggggcacccccaguccuccuccauggccugaugguuccuggucuggugugaggcacugcggcaggaucccagccagagcauguuucuuuuggcugcugccccacuaaagccacaaaacaaagcugacugggucagaagccccaguuccugccucucaccagugcaagaacagcuccuccucagugcauuccagucuaauccaugagggaaccagggcagccauugccgccucccucuaccaugucuugcuagggugucaggugcccacccagccucaggucuagacccuguggugccaucaucacauccuccagugacagauacucaggggcgcacaucauugagcacuugcucugugccaucauuugguccauaugagugaacaaggggucaugcaugaucccugaccucuccaagcuuaaagccccacucaccauugccccuugccagagcugcuggcucuaugcuucauucuuugcuauaagcaggggcucaggaggcagguguucugugacucggccauuucccuagcccauggccuguaagcauggcggcugguucccuggccauccccguuguccccucccuacuuugggccuggucuucaugguugcucaugaucaacauuccugccucaaacaucaagaagugcaucauccucaagggaguuuuccacuugccacagccacagaucagucaggcagcuucugugagccagauucugugcuguuguggaguaggauagagaggcgugaauaagacaguuaaccaaggauaauucccaacaugagguugaaucugacagauccaggaaguguggagugcucagggaauguuauaggaguccacuggagcgagacuugacuggggacaggguaggccuggguggcuucauggaggaggugggaugucugacagaucucagaggaggggcaggcucaggacagacaggaguggagcgagcaucagcccagaaggucuagcuguggggcucguguucccaaugaccuuaagcacccguuccucccucccuuuucuggcuccccucccuuucuccucuuccacucuucauuucuuacuuuacuccucugacuuuccgaugaacccggacucagccucccuuuugcuggaagggugccaguccugugacauuaccacacuguggcuaccuuuuaagggcuaacccuaccaaggcuuggggucagccugcuggcucugaccugucacuuccacucccaaccucacucccuggcuggcccaucuugucaaagaucacuuuguuuagccucacaaaggaaacacuaugggacaagaguuucugaggaggcggaggccucugagugcugccaggccccuguggugucggucuuucccauccaggagccguggccaaaugcaggguguagugaaaggccggggggcgggugggggggcagcucugcuggcuggcgcacuccucccccagcugcugugagguuggccgauagcagcucacagcugccccuucugugaagaacugcccucggcugacaggagcugucuugccccuagauguuggccaaugacugauggagaagggguuacucaaggcuagacucuucgccucagggugggccuggcuuuguggugccauucacguaggaucaggcuggagggcaucuggcugagaccacauuccugccagcucugccucuugccauguccuguuucccucccuccucucuacauccucagcgagucccuuaaauaagauccucauccaagcuguacuucuagggaaccuagccucgggacacagccuuucugcuuuccccacccuucuggcagcccaacaucucuacuuuccagauauacuuggcagcuggggcagcuuggguuauguccgccauccuuccugggaagcagacauuucuuuccaugcccagcccauagugcaguggcaugaucauggcucacugcagccuugaacuccugggcucaagugauccuucugccuuagucuccgaaguagcuaggacuacaggcucuugccaucaugcccggauaauuuuuuaaaaauuuguagagacgggaucucgcuauguugcccaggcuagucuugaacuccugggcucaagugaucaaucugccucggccucccagaguguugagguuacaggcaugagccaccaugcuuggccuuugaagguuuuuaagcaggugaguuacaugaucaaguugacucauacuuuaaaacggugguucucaacugggaggaaggagcuauuuugucucccagggcacauuuggcaaugucuggugauauuuuugauuguuauaacuggaaaggugcuacugaugucuagaggguggagcucaaggaugcugcuaaacauccuaauguacaggacaguccuccccaacaaaaaauuaucuggccccaaauauugaaaaguaccaagguugagaaaucacauuuuacaaagagaauccuggccacagaggaauugacaaucaccuggagaaggggagaugacuuacuuaucuagagacaggaccaggcugaggacagggcauggaaauaucuacagugaggcccauccacccuucgcuuaaauaguucagaacauuugacuccuaaaauguuccuuccuugaaauuucucauugagaucaagccuaguuacuggacuuuccauaacuucuuucuuacuacuuuggucucuuuucuuccuccacuggucaauuugaagaauauuccauuaaaacuggcuccaucuucuguugguuaaggccauuuucucuguaaguuagagacaucuucuggaaagaccauauuaguauaaauagggaaaagcauugcuuaugacacugcauagaggcuaagcacuugggaucugaagucacagugacuucaguuugaguccugacccugccauuuacaaggcauauggccuugggaaaguuacuuaaccucucugaccucaaaggguuguuauaacaaaugaaaaggauaacauacuaaagaacuugcggcugggcaugguggaccagcuggccgggccuguagucacagcucuuucggagggcaaggcacauggaucaccugaggucaggaguucaaggucaggcuggccaacauggugagaccccaucucuacuaaaaauacaaacauuagccgggcaugguggugcaugccuguaguccuggcuacuugggaggcugaggcaggagaaucgcuugaacacgggagguggggguuuacagugagucaagauggcaccacugcacuccagccugggugacagugagacucucaaaaaaaaaagaaagaacuuggcacaagcccacaagccuaggcaauauaacaagacucccaucuguacaaaaacaaaaauaauuagccagcugcaguggcacaugccuguagucccagcuacucaggaggcuaaggugggaagaucacuugagcccaggaguuugaaguuacagugagcaaugauugcaccacugcacuguagccugggugauagggugagacucugucucaaaaaaaaaaaaaaaagcaaauaaauaaaaagaaaaagaacuuggcacaguacuugacacauauuaaaugccuccuugguugguuuggaaaguagauacacauucucuucucuaaaugcuuuccaagucuguuccacugcacucccagauaugauaugaugaggucagauugagaagggaaccaggucaagaaagacagguuguguuggugaacuugaacugcgccuguaacuuuaaauaauuaauuaauuaaaaaaauguugaauuguggcaaacauuucuccaccuguugagugcagaggcaggaaccaggaugagucaacaggggcaugggggaggccaucgggcuacgugaggucauuacuagugauugucucuacugcuguucaccuuaggaaaaucucucuuuuuuucauuuaauuucucuuauuuucugacuucuuuucucuauggcauucaugggauuuguuuaacugcacuggcccucggcagucugggagguaggggauauuuguucucucugcuuacuuggcuccguuggccaacuccauggguucucagugccgucccucugccccuuggaugccccaccccaucuacccauacauucagggugcucugugugcacuuucccucucugcauuuggaauaaccccaugcccuggaucucuccuuuccuucuuucccuaugcuacaauuuuccugucuugugcaugugcccucagagcccugcuucucauccugcaagguaacaccuagcugauuugagaaauggaagugguggcugcuuuguuagugggacgggaccagcucuuccaaacuggacccuauguuguugucuaacccaacuggguggccacgaugacgacaaugguaguaggccucucaggucagguaggagaggcgagcagcgcugugucaggucaaagggagagaguuuuggggccugugaggccuuuugccaucaucaagucacaccgucaaggcuacugagugcccuguguagguucagggcuguggcuuugugcugugucagccaaacuagaagggcuaaagagcuugcuucuaguucuuagacuagaaggaacuaagucuucuaagccuccuacccuuucucuugccuuucucagaaggcagagguauucagaaaagggcaagagagagggcaagaggcccaggagacuuaguuccugagaaucuuuugcucuacaguggcuccgagcaaguccugccauaccuugggaccccuagaaaacugaguuugucccugcuggguaggacuccccuggguggugagccaauucccugccaaccuggaggaucauuaucugugugguugggagagcaggauggucguguguagccugcugccaugggaguggagcucucgccagcggguccaccuuccugggcuguguguuuucaggccauggccagugcagcuguggggacugccugugugacuccgacuggaccggcuacuacugcaacuguaccacgcguacugacaccugcauguccagcaaugggcugcugugcagcggccgcggcaagugugaauguggcagcugugucuguauccagccgggcuccuauggggacaccugugagaagugccccaccugcccagaugccugcaccuuuaagaagugaguguggagucuggagagagccgggaggcugggagguaggagaggauccccugacuagaauccccagcucuccagguguguuucuugcucaccagagccuuagggagaggaguccacuccagccagauggcugucucuccuuuugccaaaggcuuugggcaaguuggaauagagccaacugugaaggagccaaaguugaacgagcuggacuucgauugagaauguccucuccuagggugacauccugacucccucugagcugggaggaaggcuaaaccagucugaggaacaauccagugcuaauguucugauucagugggagaugugagggcuggaauuauggaggacacucugugaaacuacuacaaaccucccacuuuaggggccagaggaagccccaucagccugaguccauggcacugccauucugcuuaccacuuuaagcagggccagauuuacgagugugcaaccuaugcagcuguauagggcccugugccuacaagggccucaugcuuguuuuaaugcucugccaucacugucuugacauucuuaguaaucuuugaacaagggagcugacauuuucauuuugcacugggcccccaaaugacaugacugguucugacuuuauaguucucagaaauggcauaggguucaccauccuggcacagcccuggaugggacgggaaguuuaaugaaggaccugggaggcuucuggcugccaggugcugccuacaggugagggggacacucccaccccugaacuccacacuugccauucagguccccaggauugucuuacaggcgcgcgcgcgcguguguguguguguguguguguuuuaauggagguggagcagcuuucugaaugcauggagaucagagcuggacugggauacgcuuaggcuugcuccuucuuugccuuaaucacuguguccucucuccuucagagaauguguggaguguaagaaguuugaccggggagcccuacaugacgaaaauaccugcaaccguuacugccgugacgagauugagucagugaaagagcuuaguaaguucagcacaucuuagaguugcacacacccagguucuaaauguuucuaauucaaucccagaaccuauccaacucccaccuguaaaauggaagcgugacuucuaccucagggaauguugugcaggcuugaggaacaauggacacuugaugugagcuggugucucugagaguuguccuccucucuuacuagugugugcagccauccaccacuucugcuucccagagcccacagacucagcaagagccugcaaagcaaagggagcaagugccucccuaaggaagggaagagaauguaucccauuuuacagaugaaaaaacugaggcacagagcugggaagugguugccugugauagucaucaucuuagcucaguaggcuaguaagcguuuaccaaguuuacuuaacuaaaaguguuaugcagugcccaagauuuugcuuaaagcuuugcaguuuggagggaaaccuucaaccuuauggauaggcaaccaaaagcuuuaucugaaguccuucugccucucuggggccccuuuugaaauaagacagacagaaauacaaacaauagggagaaaaaaaaucuugccugcaauuauucuugaaguauucucuguccuucaucuuaacuuaaaaggagaugaucuuugcugcugucaucacaucugauauaguuaugugggccagcgaggcauugagaugguacucuaguacuagagagauggcaaucucuccauagauagcaaucucccaugaaggcagaaacacauuucagagagagccacaguaagacacagccagccagucagcuuccuggugggcguguuauagaaaagagucagcucucugggccuuuuggcuaauaucagaaguagggcuggggugagguuagcgauuuggggauugaguuugaagaaacaguuuuuccucuggaggagauuaggcuugcuaugauuaguucagagaggagaggcugcugagauauuauuuuuaccaucuacacuagguggguauuacaggcuaauugauaagcaguucuguaccuccaccuccccucuaccugugguauuauaguacagggaaaagaguguggaaauaagcauauuaaaauaaaugcuuauuuauagggaauuuuauagcuuguaaaaguuauaaaguaucuuucauauacauuaucuuauuuuucugucaauagccuagugaaguagaacuacaguacuauucucaucuucauuuugagucucaggaaaguuaaguaacuggcccaagcaagggaauggcaaauuaagauaagaacuagguccugaaauccguacucuuuucccuguauuauaauaccacugguuuucugaaggguuguugaguucaagucugcaagaugugcuuugagacuccuguucuuguucugcuucaucacucauuugcugugugaccuggguacauuugcuuaauuucaucaugugucaguuuuacucaucugguuucaucaguauggggcacagugcagcuaguggaggguaaccccuaguaucuuugcagaauaacaaacuuuagaauuagaagagaugaagucuacaaaacacggugggagucagagaagagaggauagcucuggggagguauacuggaucagaaacagaaauggaagaaauagaacagcugcauaagcaaacuauuaagaaucacuaagcaagcagagaaaggaaagagagggaagaguacaccuacuauauguuaggcacuguucacuuuaugcuguuuaguucaccgaccuugugagguggggguaucauuuucuuuuuauagaugaagaaagacuugaugaggucagguaacuuacccaagaucacacaacggguagguagugaagccaggauuugaauuaaauuguguaauacuguuauaucaugucccuuucagaggaaggauuaggaaccaaaaagggccuaugcaguacaaaauacaucagugagugucagugaguggcaacugccagacacaacagccaccuugaaucuaggcaucgugcacaugaggcacaggguuuccugucacauacuucccuggaaguccugugauagggguuuggaguggucccaucuuccaguaguugucucacuuuuuauuccuccauuuucccuacucccagaggacacuggcaaggaugcagugaauuguaccuauaagaaugaggaugacugugucgucagauuccaguacuaugaagauucuaguggaaaguccauccuguaugugguagaagagccaggugagugaacccugacggcucccggcccugccccaggagggagagggagaaccauguuaggcaggaaucucuacucaucgaagcuguuaagcaaaacagguuaagccugcaagugauaaguuaggggccagguguggugguuaacaccuguaaucccagcaguuuggaaggccaugguggguggaucgucuggggucaggaguucaauaccagccuggccaacauggugaaacccugucucuacuaaaaauacaaaaacauuagccgggcaugguggugcaugccuguaauuccagcuccuugggaggcugaggcaggagacucacuugaacccgggaggcacagguugcagugagcugagaucgcgccacugcacuccagcuugggcaacagagugagacucugucucaaaaaaacaaacaaacaacaacaacaacaaaaaaaaacgauaaguuagggaccgucaucugggugaagggcauuuauaaauacaaauauuaucaagaaagugacuuguuaauugaggagacaggaaaaucagaaagcagguaaggagaagaagauagauauggaucucauuaauggacaaaauauaucacgcauuuuuuugaggcaaugaugucaagaaauaaagaauuuaaauuuuaggacuuuacagcacauggcaucugcacuauuaaaauugagaugguugccaagagcaacuugacugugcuucagaggaaggccugaugguuagagguguuaccuuuccaaguuuacugcaggauguagggauagguuugaggcacuaaggcaaggcugcccugaacacugaaaguacagugccuucugggagcaggaggaauccaucccaucauacacagaccagccacagguuugucaccaaccaaugcugucgaucgcuugcuucccuuuaacaccuucauggccuuuguucuccuuaaacaacagguuaagaugaauuauuagaaaacauuuuugaguauucacugccaguagaccccuucccccacauuaggagaacagaccccagauccauagacccacguuuccuaucuuuuuuuuugagauagggucucauuuuguugcccagguuggggugcaguggugcgaccuuggcucacugcagucucaaccucuucggcucacacaauccucccaucccagccucccugggacuacaggcguacacuaccacaccuggcuacuuuuuaauuuuuauuuuuuuguagagaugaagucucacuauguugcccuggcuagucucaaaacucugggacucaagugauccccccgccucagccccccgcaaaguguugggauuacaggugugagccaacacacagggccaacauuuccuauguuguugcucuggaauucuaggcuccgccucccugcucaucucccagcuccaaucauuuccuggcuuugaguagaauguugcagcuggggccucagacagugggggagaugauucucuuucucuuccccaacucaugcucuugcagaugcucucuuugaagggcuaagccacuauagggcaguaaagacaacacugccaaaaguuuuggcauuggccaaauggaauuuaaccacauggaaugggcucuugagcugggcucuuaucacucccagaugggguuaccaaauaaaauacacuaggucccaugcaguauuugguacacaaugauaguaaaaaauaaucauuuaucugaaauucagauuugucuuggcuuccugcuuuuuuuguuuuguuuuuguuuuuguuuuuguuuuuguuuugagacagagucuugcucuguugcccaggguggaguacagcggcgugaucuuggcucacugcaaucucugccucccagguucaagcaauucuccugccucagccuccugaguagcugggauuacaggcgcccaccaccacaccugacuaacuuuuguauuuuuaguagagacaggguuucaccauguuggccaggcuggucuugaacuccugacuucaagugaucuggcugccuuggccuccugaagugcugggauuccaggugugagccacugcaccuggccaagcauccuguguuuuuguuugcugaaucugccaacccuacccagacuucucugaccuugggucauuugccauugguccaccgcuguggcuggaagggcccuccagaggucaccugaucuugccuucugcuuccaggaaacccaccccaaacuccuuucaggacacaugguuaacagauuguuuuccccuaaagaccuccuggcacccuaccugcccugcccauacuaaugugcagaauuaaagagauuuuacuuugauaauugagggucagcccuacccaaaucuuccagagaauccauaauuguuuuucccagaacuggggcccuucacucuugggaacuugaacacuggaaccucacagccucucuccaggcacucauuuaauuauagacagguuguaauuuggcggguugggagauagccagcuugaguuaugguggugguuguuuuugugguguguguggugagcauuggguauauguuuggcgaagaaggugggagacaguguggaaagugggugugacuuccucuccaggcucauuagcacccucauauauaaacaccugguuucauaacacuugagguuacuggaauaagaucaccuauuagauaccugacauuugugggaagcagagcucugcagaguauacucagccugacccccagaggggugacaugccucuguuuuaguuguugacugggguugaacaggaaggcagcuuucaauaggguuaugauuuuagaugacuaaguauuuugggaaagaacccaaaauauugucuuggcuggcagguccuggucucuaagaaugcaaaaaaugucauuagguucacagcccucaggaauguaaauaucugaaccaggauaacagacacaaauacuuacaguggcuaaggaagcaaauaaguuagugaaaacagcuggguguaagaagauccguuacaacgguagcugauauuuacugagcacuuacucugugccaggcauuguucugaguuuuuaagauauauuuaauuuaaucauuccucauaacaaguuucuuuuaaagucagugcuauuacuaucuucauuuuaaagauggagaaacaggaaacagacauucagaaagguuaaguaauuuuccaaagaucauguauaaaaguuaagugauaagucaggauucaaacccagggagucuggcuguaacauccacaggagcgcagacacaccaacaagucacacugccuuccucuaggagagagaagggagagugguggggauucugguaaacuagaaaacaugaguuccaacuaaaaggagcagcuccuccucagcucuagcuaacugcugcucugcaggaauauaagaaucucucucuuucuguauuucucucuuucuuucuuuugagauagucucucccucugucauccaggcuggagagcaguggcacgaucauggcucacuaugaccuugaccucccaggcucaaacgauccucccaccucagcauccugaguagcugggacuacaggcauaugccacaaugccuggcuaauuaaaaaagacaauuuuguagaggcagagccucacuauguugcccaggcuggucuugaacuucuggacucaagcuguccuccugccucggccucccaagugcuggcauuauaggcaugagccacugggccuggccuggauuuucuuuuuaaagagacuaauaugaaauuuuagggggagaaucuccugauuauucaauauugccaauaaagucaauuuuuuauuucuuauucauuuauuuauuuauuuauuuauuuugagauggaguuuugcucuguuacccaggcuggaguguaauggugugaucucgguucacugcaaccucuaccucccagguucaagugauucugugcuucagccucccaaguagcugggauuacaggugcucgccaccaugcuaggcuaauuuuuguaguuuuaguagagaugggguuucaccauguuggccaggcuggucucaaacuccugaccucaggugcucugcccaccuuggccucccaaagugcugggauuacaggugugagccaccacacucggcuuuuuauuuuuaauuuuuuaaaaaacuuuuauuuuugcuuuagggguacauguguggguuuguuccguagauaaacugugagucaugggggucugguguaccuauuauuucaucacccagguaauaagcauagugacucauagguaguuuuucgauccccaccuccuccccgucuccacccucaaguaggucccagugucugguguucucuucuuuguguuuaauuuuuaaaauaaacacuugggugaacccccacacaaagguguggcuggguucugucuagggguuaccaggucuagacuucugauuugagccacucagugcagauuauugcuguccuaaugauugucuccuuaaaaaaauuaauuuuugaaaacuguccuauuuccuucaaggaccuuaguuacuuugucaagaacaccuuuuucauagccaguucaagugacuccugcuucauucacaaccgcccugcucugugcuucuuccucacagagugucccaagggcccugacauccuggugguccugcucucagugaugggggccauucugcucauuggccuugccgcccugcucaucuggaaacuccucaucaccauccacgaccgaaaagaauucgcuaaauuugaggaagaacgcgccagagcaaaaugggacacaguaagagacggggcugggcguuuucuaaagucauuggucugagacucuuaaguggaagcagcagaugcuuuggguggucauguucagccaguaccaucgucuuuccauuauccucuguucuggaaacugggagagauggucucacuauccccuuguccuucagcuuccuucagccucuuagaaauaguggcaggaugucauuccaucucauucucuucuuucuccucaaauaaaugguuacuuccaggcugggccugguggcgcgugccuguaaucccagcacuuugagaggccaaggugggcagaucacuugagcucaagaguucgagaccagccugggcaacauggugaaaccccgucucuauuaauaauauaaaaauuagccgggugugguggugcaugccuguaaucccagcuauucgggaggcugaagcaggaggauugcuugaacccaguagguagagguuguagugagcugagauugcacccugcucugggugacagagcaggacucggucucaaaaauaauaauaauaauaauaauaauaauaaaauaaaauaaaagguuacuuccaaaucagacucuacucuuuuauccugauuuauuccaauuaaauaagcauuuacugagaacuuucuauauacuuaaucuuacucuauucucuuuuggcucuucuuucacauuucaacuuuuuuccucgacccuccaaauggcuauuugacuccccaaauguccagaguuaggcugcaaguuuguucccauuugauguugaccccagagcuuuauacucaagggucccaagaaacugagauguuucuguuagaacaguguggaacauccuguaccuaugaggcccacaggaauguguuucuuucucuuuuuuuuuggagacagagucuugcucugucacccaggcuugaguguagcgaucuuggcucacugcaaccuuggccucucagguucaagugauucuccugccucagccucccaaguaacuggauuacaggcgccagccacugugcccagcuauuuuuuguauuuuuaguagcgacgggguuucaccauguuggccaggcuggucucgaacuccugaccucgugaucacccgccucggccucccaaagugcuaggauuccaggcgugagccacugcgccuggcuaagaauguguuucuugaagcuaccauuauaggauuuguuacuuucuguuggaaaauaguuugggaaaccuagugagggucuuacuuuuuccugauaacaugacaguuuguggauagugcuuucucuuucucuccccuccucucccauucccuccccuccccuccccucuccuccccuccccuuccuuuuacgcuuccuccccuccccuucccuuccuccccuccucuccuuuucuuucccuucccuucccuccuuccuucuuuuuuugagacagggucucgcucugucacccaugcuggagugcaguggugccaucauggcucaaugcagccuccaucuccugggcucaagugauccucccaccucacccucccaaguagccaggacuacaggcacacaucaccgagccagcuaauuuuuguauuuuuuucccuuguagagacagggucucacucuguuacccaggcuggucuagaacuccugggcucaagugaucuuccuaccuuggccccuaaaagugcugggauuauaggcauaaaccaccaugccuggccaugguuagugcuuggccagauuagaugaaaacaaauuaauaauuauuugagcaaaagcuuuccucuguguucugaauugcaccugauacauuucugucccuuguccacaucuccuaucacugucacagggaauggaaaauaggagaagggcaaaagagacggggacacaggggugaaauaggagagguucuauccccgaaugcuguggaaucacugaagagugauaggcugaauauagcuccuuagaaauaguggcagggaacaggugugguggcucaugccuguaauuccagcacuuugggaggcugaggcagguggaucgcuugagcucaggaguuugagaccagccugggcaacaugaagaaaccccaucucuacaaaaaaaugcaaaaauuagccagacaugguggugugugccuguagucccagcuacuugggaggcugaggugggaggaugucuugagucaggggagguggagguuucaguaagccgagauugugccacugcacuccagccugggcaacaaaaugagacccugucugaaaaaaaaaaaaaaaaaaagaaacgguggcaggauggcauucuaccucaucuccuccuguuauuuccuaucaauucccaugccaagaacuaaagugugagcaaaaugaacauuauucuguuucauugaugauguauuccagagaacggugccuugggaaaacuucugagaugaauuuuaaacauucaggguagggaaggacuuaaggaagucacuguaagaugcuauucuguuuccuccacaggccaacaacccacuguauaaagaggccacgucuaccuucaccaauaucacguaccggggcacuuaaugauaagcagucauccucagaucauuaucagccugugccacgauugcaggagucccugccaucauguuuacagaggacaguauuuguggggagggauuuggggcucagagugggguagguugggagaaugucaguauguggaagugugggucuguguguguguaugugggggucuguguguuuauguguguguguugugugugggaguguguaauuuaaaauugugauguguccugauaagcugagcuccuuagccuuugucccagaaugccuccugcagggauucuuccugcuuagcuugagggugacuauggagcugagcagguguucuucauuaccucagugagaagccagcuuuccucaucaggccauugucccugaagagaagggcagggcugaggccucucauuccagaggaagggacaccaagccuuggcucuacccugaguucauaaauuuaugguucucaggccugacucucagcagcuaugguaggaacugcugggcuuggcagcccgggucaucuguaccucugccuccuuuccccucccucaggccgaaggaggagucagggagagcugaacuauuagagcugccugugccuuuugccauccccucaacccagcuaugguucucucgcaagggaaguccuugcaagcuaauucuuugaccuguugggagugaggaugucugggccacucaggggucauucauggccugggggauguaccagcaucucccaguucauaaucacaacccuucagauuugccuuauuggcagcucuacucuggagguuuguuuagaagaagugugucacccuuaggccagcaccaucucuuuaccuccuaauuccacacccucacugcuguagacauuugcuaugagcuggggaugucucucaugaccaaaugcuuuuccucaaagggagagagugcuauuguagagccagaggucuggcccuaugcuuccggccuccugucccucauccauagcaccuccacauaccuggcccugugccuuggugugcuguauccauccauggggcugauuguauuuaccuucuaccucuuggcugccuugugaaggaauuauucccaugaguuggcugggaauaagugccaggauggaaugaugggucaguuguaucagcacguguggccuguucuucuauggguuggacaaccucauuuuaacucagucuuuaaucugagaggccacagugcaauuuuauuuuauuuuucucaugaugagguuuucuuaacuuaaaagaacauguauauaaacaugcuugcauuauauuuguaaauuuaugugauggcaaagaaggagagcauaggaaaccacacagacuugggcaggguacagacacucccacuuggcaucauucacagcaagucacuggccaguggcuggaucugugaggggcucucucaugauagaaggcuauggggauagauguguggacacauuggaccuuuccugaggaagagggacuguucuuuugucccagaaaagcaguggcuccauugguguugacauacauccaacauuaaaagccacccccaaaugcccaagaaaaaaagaaagacuuaucaacauuuguuccaugagcagaaaacuggagcucuggccucaguguuacagcuaaauaaucuuuaauuaaggcaagucacuuucuucuucuuaaagcuguuuucuaguuugagaaaugaugggauuuuagcagccagucuugaaggucucuuucaguaucaacauucuaagaugcugggacuuacugugucaucaaaugugcgguuaagauucucugggauauugauacuguuuguguuuuuaguugggagaucugagagaccuggcuuuggcaagagcagaugucauuccauaucaccuuucucaaugaaagucucauucuauccucucuccaaacccguuuuccaacauuuguuaauaguuacgucucuccugauguagcacuuaagcuucauuuaguuauuauuucuuucuucacuuugcacacauuugcauccacauauuagggaagaggaauccauaaguagcugaaauaucuauucuguauuauuguguuaacauugagaauaagccuuggaauuagauauggggcaaugacugagcccugucucacccauggauuacuccuuacuguagggaauggcaguaugguagagggauaaauagggggcggggagggauagucauggauccaagaaguccuuagaaauaguggcagggaacagguguggaagcucaugccuguaauuauaaccuucagcuacuaagacaggugugguggcucacgccugugauuauaaucuucaguuacuaagacagaguccaugagaguguuaaugggacauuuucuuuagauaagauguuuuauaugaagaaacuguaucaaagggggaagaaaauguauuuaacaggugaaucaaaucaggaaucuugucugagcuacuggaaugaaguucacaggucuugaagaccaauauuauuugucaauauguggggauaaccuguagcugcauucaugagguagcaaauagcaguuuuggccuguggggugaacagcuaaacaguguucuggcaucagauaacacggcacaaagggauugugucuagcucuuuuggagaaaauuuauguccagucucaggaucuguggacaauaacggaaaacuuugaauauuccugacaaguugccauauuaggagucaguucuuuacuucucugagauucccaggucauccaugauuuuuuuuuuaauuugagacaaagccucacucuuguugcccaagcuggaaugcaauggcaagaucucaguucacugcaaucucugccucucagguucaagccauucuccugccucagccuccccaguagccgggauuacaggcacccgccaccacacccggcuaauuuuuguauuuuuaguagagacgggguuucaccauguuggccaggcuggucucgaacuccugaccuuaggcgauccaccuuccucggccucccacagugcugggauuacaagugugaagcacugugcccggccagucauccaugauuuuaaugggguccaaaggccucuuuuucuuuguuaaguauuccugguugaaauuucuuuucuuuuuuuuuuuuuuuuugagacagagucuugcucuaucacccaggcuggagugcaguggcacgaucucugcucacugcaagcuucgccucccggguucacgccauucuccugccucagccucccgaguagcugggauuacaggcaccugccaccacgcccggcuaauuucuuuuuguauuuuuaguagagacgggguuucacgguguuagccaggaaggucucgaucuccugaccucgugauccucccgccucggccucccaaagugcugggauuacaggcgugagccacugcccccggcugugguugaaauuucuuaagugccuuccucacuuccuaaccaccuucucuguuuggguuugugcaacaguaaauuaaauguacuuuccaaaaagaauuggccuaaggcugcucagugcuuccuguguuguuauuucuguuuccuuuggaugaaaagaauaggugucauugacucagaaaugauuauuuuagaacaagcauguuuccaaauguaacagaaugaugacuacuauggguacugaagcuagcuucagaauccagagcuucucuuuagauuuuuuuguuguuguuguugagauggagucucgcucuguugcccaggcuggagugaagugagcgcgaucucggcucauugcaaccucugcuuccugggcucaggagauucuccugccucagccucccgaguggcugggauuacaggcgcccaccaccauaccuggcaaauuuuuguauuuuuauuuauuuuugagauggagucucucucuguugcccaggcuggagugcaguggugugaucccugcucacuacaacaucugccuccggggcucaagcaauucuccugccucagccuccugaguagcugggauuacaggugugcaucaucacauccggcuaauuuuuguauuuuuaguagagacaggguuucaccauguuggccaggcuggucacaaacuccugaccucaacugauccgccggccucggcuucccaaaaugcuggaauuacaggugugagccaccaggcccggcccucuuuagacuuaauauuuuuuaaaugaguagguuauuacuguucuaagaguuugcgguuuuuuuuuuuuaauuggguauuauuuaggaacuugugcaaccucaaaagaacagacugccaguguagccuagauuuuguuuguaggaagcauaaauggauaaaauaauagcuuaauggcaaauuauuuacaggaccauuuaaaugccuaaauuuuauuuaaggcagugggugucaaagugugguccca

SEQ ID NO: 16892 - RNA, 66353 nt, Homo sapiens
ccuccccgggaggcaucacuucgucccgacccggaggaggacgcgagccccuugcgggcggucaucacagcccagccucggggcugccacagcgcguugcgccugugcgcccucgguccccgcguccacugagcgccgcgcucggggauggggcccggccggccggcccccgcgcccuggccucgucaccugcugcgcugcguccugcuccucgggugccugcaccucggccgucccggcgccccuggggacgccgcccucccggguaaggcgcugccaacuuggccaacuucagggcccgggcggggggagcgccgaggcgcgggccgcucucgacuuuucccuccuuuuccccccucuuuucuccagaagcgugugugcgugugugugugacuggguuuuuaaaacucgucuccgcuuuucugaaagcgggggaggagaggggaggaggagcgcgccuagaggugggggaggaccugaguggaaccagauguggcgggcggcgggggaggggagcccgggggacuccagcagccuaggaggaagcgggugggcucuugaggacccccgcgcaccgcgcucccggaccacccggcgccggcccguccucggcaggggaccugcagggcgcgcccggggagccagggcucucuguccgggaguucccgggcccagucuccucgcucugccccaggacugaugcguuaggacggcuuuccaacuauccgcgaggguucguuucccccaccuuccccccgcccccugcaucucgugggcguugauauuuucuuuuccacacuuagucuucaaggaggcuuguggcgcgcggcauccgccccgcgugagcucggcagcccugugaggaggcuccugccacugggacgcagcaacaggcugggcgccgccgugcugugauguugcguagcgugggcagcucugggcacacuaguggcccuccagaggggacagaccuugagcggcaaaagagcugcuaaagauuuuaaaacccaacgaacaggaaacaaaacaaaaaucagaaaaccccaaaacugugccauucucuuccugcuccuuauucagggguaacagugaaguguggggacagacagaucccucgccaagaaucuaagaguugaaaggaaagauccacuuccugggggagugggggugggggugucuggagugaccgggggaaucgcccggcccagcuugguccugcuggcuguuuaauugggggauggggacaguccgugcagugucugcaguuuugugcaaggaccagacagcccccuggagagucuggggccuccagccuggcccgugcuugcuggguuggccuggcgugacguaggcacaagacacauaucugccagaugggaaaggugggggccacggugacccacauucacaccaaccggagacccccggggcaauucugggcccaccuggcauugaaugugggacagacacaaaccaggccggguaacccccuaacccacugcagggcggccucacaggcaguuccccuaccuccucgcacuccugccuuccucugcuccucugcgcagggccucaggaggcaggcggugggaagggguggggaggauggccauucccagagcuccagagcacacuuuaaagccaggcccugggagagaguuguggccagagugcugacucggccuuucccccuggagcuuuucauagagggggcuggaagugccuggugagaggcccggucagggaggacaaggacgccuggagugucccuccuccuccuggucucugugccuggcccucccuggggcuguguccagggaugaauagccucagaggguccccuucccguuggcacugcauugaccacacccugaggaggcuuggaucuggguggcaggcagugugaggucuuccagcagcagcugagcaggaggaggauggagcugcugcagguuccuucccucggaaccgugcccucugcacagagugcgcuugccccugcccugccaaauuccacugggcccuacccugggaagccuguucagagccucugggccgaauuccuugcccgaagagcuggcagccccuaguaccuggugaauuacguuguuguugggaggaauucaccagcaccagagaccaaauagcccaggaaaugcaugugggagguaggguguggcaggccagugcugcugggggcgaggcuuaugccaggcagggcaggggcugcgugugggcaguuuccugaccaccaugggggagcccugugugcccagagcacggggcaggggcagcgaggcggcagugccuucuuggugcgugaugguggaauccaucuuuucuccaccuugguggaguggcccgcggagacugucacuggaaggaguccucuuuguuaguugccauauuaccgcauuucuggagcaugcaguuugcucagccuugagccaaguucuuggggaggagggaagguagagaagaguguaagaugcauccucuggaaaaagaaaaucgugugggagaaugaaacguggaacagugaacugcguagggggcagaaugccauuggugggaugccugccugcccagacccacgcucaacccuucaugugcaaguucccauuucauuuugauaacaacccaaggagaugguuauuguuggaccauuuuugcaguucaggaaaugaaggcuaagaggggucugaucauuuacauuggucacaccccuaguaagugaaaggcuggaguguggaugcuucccgucuggagauuggaggcaggagagaccguaugggccaaaggguggccaaggcugucuggagagaggcaggaaggggccaccaggcugggcucuucuggggaugauguggaagcuugcuggcugggccggggagaagguugagugaaagaggugccugggaggccagaauggggaugggaccugcaagcuggcuguggggaaccccaggggacccuuggagguuuccgagcagaggaaugaggggauaguugcugggaaaggggcuucugggagcuccagggaucaagucucaaggccauggggugaggagaccucaggaaaucuuccuguggggaaggucggugcugccuaaaggacagggaggguggcaucggguacuuggggcucugaccagagucagccagaccagcucccuacacuucuggcccagcuucugcugagucgugggguucggaaacuucuuacuguucccccacgcaaaacucaguuuuccuugcuccaacccucuggcucucugugagucaucagggcccaggaggugcccagccgagcuguggcuagugcugggauccuggcucucuucuggguucaccugggcaaggugaggguacauggaggggaggaagaaccccggguuuuggcccccauuuuucgcaccagagaaauccuggcuuucugaugcacguagggcaccgugacuuggcucaaugagaugauuucggaagugccaugcaguucucaggcagauauucauuugaguuccucaucaguuuaagcaucgaggaggaguccuguugcacuguccauacccccagagggauggagcgauggcacccacggcugcgcugugcauguggugggcgccgugcuggguccugugcuggcaguagcucuucggcaccucccaucucugagcaggugucagagauuugcacacaccuggcgugaaaauguuaaagauguuaagggagucacucaaggcugugccaccacaccacuagaagguguuaccagugagauucgaacccaggagugguuacggagccugaacgcuccaguaccauacagcguuuccaucgcaugaagcacugucaguguguguguguuaggaaagccugggaaauucugccuuauguguucuccccgcccccauaacuccaagcccucuaggacaccucucaaugugucccaccgggaggacuccugaggaggaggguggagcgagcagcccucugucacaugucagcggucugggcgcuugggucagccacuuccuuguggguccaggaggccuggaccgagccgccugcaguguccucaggaucucugagggacccccuccaagaaggcauugauaagugagugacucaaggugccccagcauggcacuccagcuucccugaggucaaggauucacaugguuguucauucauucauucauuccuucagugggugucugcugagcuccugcagaacugaaguagagauggccauggccuauucuuuauuugagaccuccccaccgugucuccagugggggucccuggacuuggaaggccugagcacugcugauaggaagcgugucuuccuguucaggccuacgugagaugggagggggccgcuuucccacgccuggguccugugaaucuggguggggugggccagugggguggugacgcgcuccuggagcucacccugggcccugcagaucugucacucuucagcuagggguuguaccaguaaacggcagcuggaugagggcuguccaguggcaccugugacaccggggucugccgggguccaccagcugcagcccuuuaggaaacagauugggucgacccccucaacugcacacuguggccccucguggaauuccaccgguuguuucccuucuugcacuucccccuggccccucgucucuccuuccgccgcugggcaccagccucuuggcucugcacucucacagcgcagacccuuccaccugcgcucugcuccccucagccucccacuccuccugauuucucuuucucugacugugcauucugcccuccgcagcucugguuuuuguuguagaagaaggaccaacuucuuccuaguuuccccggccccccaugccucuggucucuuguccugccccagcuuucuccaccuccaggcuucugcccacgcacgaucacuuugccuggugugccuccccuccccucuucuuucccaccuuccagugacccuuccuucgagacucaaggauccuggggaggacgcugagggagccuggucccugccucuugggcugaccuggggugacgagagacaagcacacagacauggcccauggugacaaaucccagauuggauggguggccucucuguuuaucuccuucccagggaucaccucaggagggcacauguagggaacacuauagccagccuuccucagccuuccccagccuucccugaaggcagccgggugcgaggcugagcaguggccccuuccuccuguagaugaggcaggagugugggcauggcuggcaguguuuccccccgucaguccucuggaaauguaaauagggacagagucggugggaccaggauugauggcacucaccagcuaugugaccucaggcagaggcucaagugucuucauuuauaagaugggaaaaaucaauaccucuuguagagguauuauaagauuacauacaaaugagaucaugaacguaugagauaugucccugguacacuacugggcacagaauaauuucuuagcaaacaauacuaaauuauugcuauuuuuauuagaagagaaagggugggugagguggcucaugccuguaaucccagcacuuugggaggccgaggcggguggaucaugaagucaggagaucgagaucauccuggcuaacacggugaaaccccaucucuacuaaaaauacaaaaaauuagcugggugugaugugggggcgccuguagucccagcuacucaggaggcugaggcaggggaauugcuugaacccaggaggcggagauugcagugagccaagaucaugccacugcacugcagccugggcaacagagcgggacuccgucucaaaaaaaaaaaaaaaaaaaagagaaaacaugacuaucaagguucccaaauaugauaaaacacagucuucaauauacaaaauccugcuggacacgguggcccaugccuguaauccuggcuugagcccaggaguucaagaccaacuugggcaacaugacgaaacccagucacuacagaaaaaaaaaaaaaaaaagcuggguguccuggcucauuccuguagucccagcuacugggcaggcugagaugggaggauugcuugagcacaggagguugaggcuguagugagccacgauugcaucauugcauuccagccugagugacagagugagacccugucucaaaaaaaaaaaaaaaaaaaaaaaaaaaaaaaaaaaaaaaaaauccuaacuacagcugucaccagaaaggagguccaauccagaccccaagagagggaacucacgcaagaaagaauuugaggcgaauccauagggaauagugaaagcaggcuuaauaggaaaguaaaggaauaaagaauggcuacuccauaggcagaggaguagcacugacggcucagcugcuuauacaauuguuacuucuugaugauaugcuaaacaagggguggauuauucaugaguuuucugggaaaggggugggcaauucccggaacugagggagucuucccuuuuuagacccuauaagguaauuucuugacguugccaugacauuuguaaacugucguggcgcugauaggaguaucuuuuagcaugccaaugcguuauaauuaguguauaaaaaaaugggcagugagaaugaccacaagucauuuuuuuuuuuugagauggagucucacucuguugcccaggcugaagugcgauggcguggucuuggcucacugcaaccucugccucccagguucaagcaauucuccugccucagccucccaaguagcugggacuguaggcaugugccacuacacguggcuaauguuuguacuuuuaguagagaugggauuuuaccauguugaccaggcuggucuugaacuccugaccucaugaucugccugccucagccucccaaagugcugggauuacaggcgugagccaccacgccuagcccagagaucacuuuugucaccuuuuaguuuuggugggauuuggguggcuucuauacugcgugcuguuuuuucagcaaggucuuugugaccugugucuuguguugaccuccggugucauccuguggcuuagaaugccuaaccucuugggaacgcagcccaggaguucccagccucguuuuacccagccccuuuuaaagauggaguugcucugguuugaacaccucugauacaacuuuuuuuuuuuuuuuuuuaggacggagucucccucugucacccaggcuggagugcaguggcacaaucuuggcucaccacaacuuccaccuuccgaguucaggcgauucucuugccucagcuucccaaguagcugggacuacaggcacgugccaccacgcccagcuaauuuuuguaguuuuaguggagacgggguuuuaccauguuggccagacgggucuugaacuccugaccucaggcgauccacccgccuuggccucccaaagugcugggauuacagaagugcaccaccaugcccagccccauuguuuuuuuuuuaaauugaagcaggucugaaccuguuacuucauugcuauuuuucucuuuuuuuuuuuuuuuuuuuuucagaaauagccucaaucagaggcauuacuucuucgugacacuuugcuaacuacuguaagugccaaaaaguaaucauaguuuuucugaaaguaaaagaaauaccaaagaaaaaaaaucccacccucaaugguccuacccccuaaagccccucaauuuaucaccauccucuuuaucaccuuccucuucauccuuacacuucucuauuuaaccuucauuuagggaaggauaaggagcuuccugggacucuggaauaaaaccaagacagacuagggaacacugggaugguugggcauaccucuccccuuuuugccucuaguugccuuuagccuacugucugagggacugccucccaagggucauacugaugaggcucccuaauuacuaaauuaagugaccuuucuuaggccucaccuugcagcaugcaugcuguucauuggccucaauuguaagaaugggccaggcaugguggcucaugccuguuacuccagugcguuuggaggccacgggaggagagacugcuugaggccaggaguuugagaccagcuggggcaacauaacaagacccugugucuagaauuuuuuuuuuuuuuucugagacggagucucgcucuguugcccaggcuggagugcaguggcacgaucuccacucacugcaagcucugccuccccgguucacgcaauucuccugccucagccucccgaguagcugggacuacaggcgcccgccaccacgcccggcuaauuuuuuguguuuuuaguagagacaggguuucacuguguuagccaggauggucucaaucuccugaccucgugauccaccugccucggccucccaaagugcuaggauuacaggcgugagccaccgcgcccggccaauuuuuuuuuuuuuaaauuagcugggcacaguggugcgugccuguagucucagcuacucaggaggcugaggcaggaggauuacuugagcccaggaguuggaggcugcagugagcuaugauugcaccacugcacaaccugggcaacagagugagacccugucgcaaaaaaaaaaaaaaguaaaaaugcaugcucaguggaaaacauucaaaccauacacaaguaagugcaaaaaaaugugaaguccacucccuuacacuacacugauuacacacuagcacaggccacagucuaccacugguagauucuguggguaaucuucccaaccaagauuccccaaugaagauuaguaguaguucauuggguaaucuucugauuuuuuuuuuuuuuuuuuuuuuuuugagacggagucucgcucugucgcccaggcuggagugcagcggcgggaucucggcucacugcaagcuccaccucccagguucacgccauucucccaccucagccucccgaguagcugggauuacaggcacucaccaccacgccuggcuaauuuuguuuuugaauuuuuaguagagacgggguuucaccguguuagccaggauggucucaaccuccugaccucgugauccgcccgccucagccucccaagugcugcgauuacaggcgugagucacagcaccuggccugucguuguuuuuuaacuaaagacagagucucacuauguugcccaggccuggcuuugaacuucugggcucaugcgauucuucugccuuggccucccaaagugcugggauuacaggcacaaaccacugcaccuggaccaauggacacuuuugaaaacucucuucccccggccuuugugguguaauuuacauccacaguuuccucccuuagggucuucccuuccacccucaguccagagcuggcauugcugccagguuagcgcugcuaaggggaagcuugaaucgauguaaacuuucugaauuuagaauuucugcuaggcucggugacucaugccuguaaucccagcacuuugggaggccgaggcaggcggaucaccugaagucaggaguucaagaccagccuggccagguaaaacccccgucucuacuaaaaauacaaaaauacaaaauagugaaacccugucucuacuaaaaauacaaaaaucagccaugugugauggugcaugccuguaaucccagcacuuugggaggcugaggcagguggaucacuugaggucagggguucgagacuagucuggccaacauggugaaacccugucucuccugaaaauacaaaaauuagcugggcaugguggcacaugccuguaaucccagcagcucgggaggcugaggcaggagaaucacuugaacccuggagguggagguugcagugagcugagaucacgccauugcacuccagccuggguaaaagaggaagacugugucucaaaaaaaaaaaaaaagaaaagaaaaagaaagaauucccggccuucucagugcuugugcaggucaagcugagcuccuuaccguucccauagcucccaguacugcccaacccggacucugcucaggcuuuuuuucccugccaggagcaccagcuucccagggggcuguuucugagucccaacucacaccugugaccuucugauuacccucagcuggaagaagccuuucucuccacggcugcucuagcauuuuacugcugucgucccucaaacaccuccagagcaaggccuuuuugucacuacacagguuccagcacaguaccuuguccacgguggcauuuguuuuuguuuguuuguuugaaacagggucuugcucugucacccaggcuggagugcaauggcacucacgggagccucgaccuccugggcucaggcgauucuucugccuuagcuucccaaguagcuggacgacaggcggcgccaccacucuauuuuguugcuccuauuuuuaguagugggagggucuuccuauguugcccaagcuggucucgaacuccugggcucaagggcuccuccugccccagccucccaagguguugggauuacaggcgugagcaacuaugaggcuggcauuugguauuauuuaguaaauauuuguugaaaaugagaaaagaaagacaaguguuccaaagaauuuuuuuuuuaauagaaaggcaaugagaguuacccuucuagaauuuuacaugaugccacggucaugaaaaacaucauaugguuuuaaauuaaaauaaacagaaaaaaguccaauguacuagaaaaaaauuccagaaguggauuuaaacuguuauaagaaaauaaugugagacacaccagaaaaaacacacuaauaggaaaaggaauuuuuacuuuuaaauguuaugaggauggccgggcguggugguucaugccuauaaucccagcccuuugggaggccaaggugggcggaucacgaggucaggaguucgagaccagccuggacaacauggugaaacccugucucuaccaaaaauauaaaaauuagccagguguggcgacgugugccuguaaucccagcugcuuaggagagugagguaggaguaucgcuugaaccugggaggcagagguugcagugagccgagguggugccauugcacuccagccugggugacagagugaaacccugucucaaaaaaaaaaaaaaaaaaaagaaagaaacaauuagccaggcgugguggugggcgccuguaaucccagcuacuugggagauugaggcugcucuugaacuccuaacccuggaggccgagguugcagugagcugagaucgugccacugcacuccagccugggugacaaagcgagacucugucucaaaagcaaaauaaaacaaaaauaaauguuaugaggacaccuggauuauaauuagaaauuuuaauuucaguuuauaguugaucacacuugaggaaauucagauagcaagcugucacauagaaagugcaaggauugggccgggcacaguggcucaugccuguaaucccagcacuuugggaggccaaggcaggcggaucaccugaggucaggaguuuugagaccauccuggccaacauggugaaaccccaucucuaccaaaaauacaaaaaguagcugggcgugguggcacacuccuguaaucccagcuacucaguuggggagggggcugaggcaggagaaucacuugaacccaggaggcagagguuguggugagccgagauugugccacugcacuccagccuaggcaacagagugagacuuugucuuaaauaaauaaauaaacaaacaaagugcaaggaucacuggaaaugaaggaaauuagcuuucuuuaacuacuuaaacuagcaaaaacagaaaagcuaguauuggcagagcugugaagaagccaauauaucugacugggggacuguaaauugguucuguuuuucaggauucaaucuuucggacaauauguaagaaacuggauauguaagaauuccuauccuuugaugucauaauuuuacuuuugguaauuuauaagauauuaaucucaaagauaaaaaaaauguucuuagaaguguuuuuaagagacugggucucacucuguugcccgggcuggagugcaguggcacaaucauaguucacuacagccucaaacuccugggcuuaagcaaugcucccgccuaagccuccugaguuguugggacuacaggcuugagccacagccuuuaguagcaaaacaaauuggaaaccacaugauggauuauuuacguaacuuuaagugacaaauauauggcuaaugauucuuuuuuuuugagacagaguuuugcacuuguugcccaggcuggagugcaauggcucgaucuuggcucacugcaaccucugccuccuggguugaagcaauucuucugccucagccucccgaguagcugggauuacaggcaccugccaccaugcccagcuuuuuuuuuuuuuuuuuuuuuuuuguauuuuuaguagagacggggguuucuucauguuggucaggcuggucucgaacuccugaccucaggugaucugccugccucggccucccaaagugcugggauuacaggugugagccaccacgccuggccagcugauucuuacaaggaaaguucugaggacugugagacagucuuacaacauuuaauaugcacauacuggaaacaagaugcauaccugacauucaucuguccguuuauucauucaguuaacuggugucuuuguucauucauucaguuaauuggugucuuuguuuuuguuuucuuuccugaacauugaaaacguaccaggcaugguauuuggugcugccaacaccguggugagcaggcuaggcaugauuccugcuuuccugaggcuugcguuuugaaagcagucccuucccaauauagagugccacaaauaaucucaaacguacacugauuucauuugcagguccacuuuuuuguuuuguuuuguuuugagacacugucucgcucuguugcacaagcuggaaugcaauggugggauucacugcagccucgaccuccugggcugaagugaucuuccccccucagccuccgcaguagcugagaauacaagcacaccaccaccacuggcuaauauuuaauuuuuuuuuuuuuuuuugagacagagucucgcucugucgcccaggcuggagugcaguggcacgaucucggcucacugcaagcucugccucccagguucacgccauucuccugccucagccuccugaguagcugggacuacaggugcccgccaccaugcccggcuaauuuuuuuguuuuuuguuuuuuguguuuuuuuuaguagagacaggguuucacuguguuagccaggauggucucgaucuccugaccucaugauccacccgccucagccucagccucccaaagugcugagauuacaggcgugagccacugugcccggccuaauuuuuuuuuuuuuaaauagaaacaaggucuugcuauguugcccaggcuggucucaaauuccuggccucaagugaucuaccucagccucucaaagugcuggaguuacaggcauaagucacugugccuggccuguaggugcaauuuuuaaguucauuaagagaaaaaucggcugggugcgauggcucaugcccguaaucccagcacuuugggaggccgagguggguggauccggaagguggagguugcagugagcugagauggcgccauugcacuccagccuggccaacagaccgagacugucucagaaaaaaaaaaaaaaaaagagaagaaaagaaaagaaagauggaggcaaucgacugcucuaaaaccuuagaccuagaaacaggaaccugucugacaguggggagaacgacucccagacaaacuagccuggcugaauaggaaggacucaacgggaagcagcuuugcagucaucuugguccccaaggaaaggggauucugguauuaccccauaaaaauuuaaccucauuccugaaggaucuaaguauguaagggcauugaugguuugcaaagagcuuggaagcacuguuuauaguagcaaaaacaaaaauguacuuggaaagagauauggauaaauuauagaauagacacaaugaaauguaacacagagguggacgaauggacuccagcuauuugcaacaacaugggugaauauuagagacuuaauguugaaugggggaaaagaucccagaggacugcauaugguacaauacucuuucucaaaccacuggaaaaacugaaaaaauaauacagugggcacccauauacucuucaccuagaagcaccaguuguuaacauuuugccacauuugcuuaucucacucucuguguguguguguguguguguguggugggucuguuuggugaaacuuugaaaguuaguuauagacaugacauuucacaccuaaauacuucaacauguaacaacuaaaaacaaagacaugcuacuauguaaccauaauaucuaaucacacccaagaaauagagcggaugcaauuuuuuuucucauaugcaguccguguuaggauuucuccauuugucccaauaauguccuuuauagcuguuuuaaaauucagaauucaauuaggugucaugucucuuuaaucuccuuuaaucuagaauaguugcuuggccuuguugucuuuuaucggcauugcauuuuugaggaucccaggccaguuguuuuguaaaacgucccacagucuaaauuugucugauuguuuacucguuccuggauucauauuaaacguuuuuggaaagggaacucaugggugauguuguguccuuccauucugucacaccaaugucaauuuguucccuuacgcuaacuuugaccauuuguuucagcuggugucuaccagaucucuccacuaaaaaggucccuuuucccuuuuucugagaugaagucucacugucacccaggcuggagugcagcagcacgaucucagcucacugcaaccuccaccucccagguucaagcaauuauucugccucauccucccaaguagcugggauuacaggugccugacaccaugcccggcuaauuuuuguauuuuuaguagagauggaguuucaccauguuggccaggcugguugugaaccccugagcucaagugauccaugugccucagccucccaaagugcugagauuacaugugugaaccaccauggcuggccuccccuuuguauuuaguagauaaccuaaggaauuugaaccauagucuuaaaaaagcaaaguuguucauaguagcauuauucauaauagccaaaaacuaaaaacuagugccaaacugaaaaccacccaaaugcccaucagcgauagaauggaugaauuguggcagcuucacaaaauugaauauuagacagugaugagaaugaacaagcuccaguugcaugccacagcauggauggaguucacaaacugagccagacgcuacuucauaccauaugacccaauguauagaaaacaccaaaauagccaggcgcgguugcucucgccuguaaucccagcacuuugggaguccaaggcagguggaucaccugaggucaggaguucgagaccagccuggccagcaugaugaaacccugucucuacuaaaaauacaaaaauuagcugggcauggcggcaggugccuguaaucucagcuacucaggaagcugaggcaagagaaucacuugaaaccgggagguggagguugcagugagcugagauuacaccacugcacuccagccugggugacaaagagugaaacuccgucaaaaaaaaaaaaaaaaaaaagaaaaagaaaagaaaaaagaaaauaccaaaauaaaagacacaacucaucugugcuguuugcagucaggagagugguuaccuuuagugcgggagaaggguacucagcaaccagggaggguuucaaauaaaauuuagaaagaacaacaaacagggaagggaucuguaacaaacauggcaacuagcucauauaaaacuaugagaaaaacgcaggaaccugcaauaguuuuaaggcaacaaagaucaaaauagauaagacuauaaaagaucugaacggaguucaccaagaggaaaugccaguggcuaauaagccaauggaaaauguuuaaaaucacuagcaaaacaauuucaccucucgcaacagugccaggaaagauugauauaauaauauguucaacguaacauuauaauuaggaaauucuauuuauaaguuaaaguaauagcuaggaaaugaugaaaugaaacgugauauuauaucauggaauaauauacagccauuaagaugauuuuuacgaauauuuuuaaggacacagaaaaaucccuuugcugaaauguuaagugaaaaaagauccaaaaauguuugcguguggauaugugcauguauauuuauguauauauauguguauuacauguguguguauauauaugaauagaaauauuuuggaugucuagauaaaauugguagaaaaaccacaguaaaacuaaaagacuguacuaugcuaucuacuacauaauauauuauuuaacaggggugauuguagaugaaauuuuucuguuuuaaacaugucuggaggcuggguguggugacuccugucuguaaucccagcacuuugggaggcugagguaaguggaucacuugaggucgggaguuugagaccagccugacugacguggugaaacccugucucuacuaaaaauacaaaaauuagcaagguguggugaugggcaccuguaaucucagcuacucgagaggcugaggcaggagaauugcuugaacccagaagauggagguugcagugggccgagaucacaccacugcacuccacccugggcaaaagagaaagacuccgucuggaaaaauaaaaaaacaugucuggaggcgggaugccguggcucacgccuguaaucucagcacuuugggaggccaggaguugaagaccaccuuaggcaacauagcaagaccccaucuuuacaaaaaauaaaaauaagaaauaaacauguucguaucuugggccauggaguggcagcgggcaucuuuugcuugugaucagucagucacgugaccccagcagcauuuguguccuguucccaguaccguccuguaauuggucagaggaugagcaugugacuccucacugccagucagagccucccuggaaggugguguuuuucagcacagcccgcagauccucauuugggacuuacgugagggcauaggauuccuccacgcugguggucgagggucagccuccgagauucugcgggagagacucucaagggucaccagcuggagcugguucugugucugcagggaaccaccuggugcucucuccauuaauagcccccuaccgcgaguuuucucuucuuuaucuuugugacuuagcccaguguucacagaaggggagggguggaggguucaaacgcugucauacacguuugcuuuucgaaaaacaacaggacacaaaauuuuauaaacaugaaaugacaguaccugguacgugacucgaaugcaacucagaagggugccaguaaguuagggaauuggccuuuggaaggcuuccuucuuuuuaaaaacuauaauguuuccauauaauguuuguguaacaaaugagaaaugggagaccccauuaucauuuacuaacgguaaauuuacauaaaguaagccagggucagcaucagauaauuccguauagcccauauuuuaaaccuucacauuccuccauuucacagauaaagaaauugagccugagaggcuaagagacaggaucacaggagcaaggaaugugauccaggucugguuccuuugcaugguccucuagaaacauuauauacauucaucucaaaaauauauauauaugugauauauauacacacguauauaauauacauauuguguguguauauauacacauaauauguguguguguauauauuauauauauauauauauauauauauauauauuuuuuuuuuuuuuuuuuuuuuuugagauggagucuugcucuguugcccaggcuggaguacaguggcaugaucuuggcucacugcagccucaaucuucugggcucaagcaauccucccaucucagacuccugaguaagcaggaccacaggugugcaccaccaacugcagcuaauuuuuuuuucuguauuuuauguagagauggguuuuugccauguugcccaggcuggucucaaacuccugagcucaagcaauccaccugccucagcuucccaaagugcugggauuacaggugugagccaccgcaccuggcuuucccuguaaaaaacuuuauagagauguuuucauguuguuucauaauguucuucuuucauucaggaauaugucaucaauguauuucugcccaacacuucuacuggcuacauaggguucuguugugugaguggaccauaacuuauccccuauuggacauuuaggucauuucucuguccuuuucuauuuuuuuuuuuuuuuuuuugagacggagucuugcucuguugcccaggcuggagugcaguggugcgaucucggcucacugcaagcucugccucccagguucacaccauucuccugccucagccucccaaguagcugggacuacaggcgccugccaccaugcccagcuaauuuuuuguauuuuuaguagagacgggguuucaccguguuggccaggauugucuugaucuccugaccucgugauccaccugccucagccucccaaagugcugggauuacaggcgugagccaccgcgcccggcccccucucucucuuuuuuuaagagacagggucucauuauguugcccaggcuggucuugaacuccugggcucaagcuauccuccugccucagccccaaagugcuguguuuauaggugugaugccaccaugcugggcaggucauuucucauugucacugauagaagugucacuguguacaucguagcacaccagacuccuugcucagaccugaagucggauguggaucccagucagggugaaaaggugcuugaccuacgucaacuucaugccucugaaggcacccacuucuuugcugucagcagugucugcuccuuggcaccaggauuggaugguuggucucauccaucuggagccucucgcagaaggaucuucuuugguuuacuuguuugcucacccucuccaaaugugcuggguuuagugucaaacucugcauauaugaguucaagucccgcaggguuaaguuugaaacaaaggacagaugcacaccauauauucccuaucucuuuuuaauuaccaaauacauuaauuguagcaaauacaaagagaagaaaauaaaaaucaacagcuaucucauaagucagucauaaccacuguuaacaccuggguauguacaguuguucuggaacccugauguaccccagaauugcuugggacucuuguuuacaaucuagauauuccaucacuccgagauucuaauucaguagaacugcucuagggcccacacaccggcauugcaaauaagcuccccaggcgauuuggacacccaacuuuaagaacaagaaugcaaaagcgucuuucuagacauuacuugauuuaaaagaaaauaaaaaugaaguuauacuauauauucauuuuuucuuuuucuuuuuuuuuuuuuuugagacagagucuugcucuaucgcccaugcuggaguacaguggcaugaucuuggcucacugcaaccuccgccuccuggguucaagugauucuccugccucagccuccugaguagcugggauuacaggugcaugccaccaugccuggcuaauuuuuuguaauuuuaguugagaagggguuucacuauguuggucaggcuggucucgaacuccugaccucaggugauccacccgccucggccuccugaagugcugagauuacaagugugagcugccgcgcccugccauuuuugcuuuaaaaaaaaaaucagcaauagaaugugaacuucugugucuaaauacccuuuauacauuucuguugugugcauaguauuccauuagacgaauauauuuccauuuacuuagucaacacuauauuguuggacauuaguugcucccccaucauugcuauuguaaauaaugcuguguggcuaaaucuuuguauacauucuuaguucuuuccuuaaguuaaauuccuaggaaaugaauucuggggugaaaguuuucauucuuuugaagguuuuugauagaugcugccaauuuuuccagcaaaaagguugccccacuggggcugcuacucccaugagcucccuuugugaggagccgugaggugagaucuucccauccaugaucucagccaucccugccaacuacccagcgggcagcacgagguaccugcucagugguaccugcuaagugcucaguaauuggucuacgcaguggacaggaggaguguuuucuucacugaccagaggaggacacugagaguggaggggucaagugacucgcucaggaacugggacucaaagccagcuuugaaucuagagccugaguucucuucaccaccccaucaauuuuuaauugauauuagagagggaagaacaggccgggcauaguggcucacgccugcuaucccagcacuuugagaggcccaggcgggcggaucacuugaggucaggaguucgagaccagccuggccaacauggcgaaaccccaucucuacuaaaaauacaaaaauaagcugggugugauggcacacgccuguaaucccagcuacucaggaggcugagacaggagaaucacuugaacccgggaggcggagguugcgugacugcgcaaggguccuggugagggucccaggucaacuccucccgucccagugucugccaggccaaggggugugggcgcugccccaccucuuuccacacuuucccuuccagcugcguugugagugaccucauuuucccuuuacagcugcccuuggaguuuauuucugcagaaccggaauguggcugaaagagugcacacccuaucugcccugcccuagcccuuccagagagcccccuacuuuucccugacacacccuccucuucuccuugcaucucccuccugggagaccugaggagggguccagaguucaaagacagaaacauauggugguggcaagggacugggcacccaugggaauuggggucgggggaggacuuugcaucuggaccguggguuuauuuuucuuuuaauucuucugaagagcagcuuaaacacuggaguccuuggccguauuuccucuuaucguuucuucuuauccagauugcagugucugcuaagccugguucccaggcucuccgcugugaaacacaaacagauucuugagcucgcugcccaaaacugggcagagguucuugcuuaaauaucaaaagcaguaauggccuuccauuacucugugcuccccagguacagagggacaggaagccuucucucccuuuguccucccagaaacccaggagacaggucuuauucguguccuucccaaaucgaggcuugcggaagugaggcagccaaucccagggcccaagggcccaagcagaggugcgaaccuggguagguccacauucuagagcugcccucccaagcccuccaccauggugccuccuggaggugggggcaggcccggcugaucugucgucacagaaguuggcaggugcucaaucuuuggcuagaauuuuaaagggagaucuugaagguucccaagcaagaaggauucuaaauucacuugacuuuaaagagugccauuugggcgcaguggcucaugccuguaaucccagcacuuugggaggcugaggcagauggaucacuugaggucgggaguucaagaccaaccuggccaacauggcgaaaccccgucucuacuaaaaauacaaaaauuagcgaggcaugguggugggcgccuguaaucccagcuaccuggguggcugaggcaggagaaucccuugaacccaggaggugaaggcugcagugagccaagauuucaucacugcacuccagccugcgugacagagagagacucugucucaaaaagagugccgugccuugcuuuuagaaccaaacaagugaucuuugaauguugccaugucaggagggcagggaauugccaauguguggagcaacagcucauuaggaaacgugccuugauuucucagucauauugugcugugcuucaaaugugucucaugucuccuaugcagcgugucacagugucauuugacaucaaucauguuggcagggcagcagaccccccccgccccaccgauacauacauuuuuuguuuuguuuuauuuugaaauagauacagccuucuugucauucuuuuuuuuuuuuaauuuuuuuuaaaauuuuuuugagacaagagugucgcucuauugcugagguuggaguggcacuaucucggcucacugcaaccuccgccuccaggguucaagugauucuccugccucagccuccugaguagcugggacuacaggcacccgccaccacacccggcuaaguuuuguauuuuuaguagagacggugucucaccauguuggccaggcuggccucgaacucuuggccucaagugaucugccugccucugccucccaaaaugcugggaucacaggcaugagccaccaugcuuggccgucauucuuaauagacaccaggauacugaaaaaugcuuugccacucagaaaaacaaggguacaagcaugauacuauauggccacucucauuccacuucaguguguguguauggugggggcacaaaagggauggguggagacuguggcaaaccggugagcccacaccccucccaggugggcagcugcaccagcucuuguggcuggcacccugcaggcaugcugccucgacuggaaaucuacauuuuuauguguaaucucucucacacauccugaagccaaacacaacuugccugugggcuaucaucuaaaauucggaggcuagcuggaguccgcucuggaauaagucugccuggccauccuucccagcucuuccccuuauuaacuguguuaucaagauguuaaucucucaguuauuuaauaccucaguuuccucaucugucaagugcagaucagaauuuugccuacaucugaggguuguuauaaggauuaaugaaaagccuuggaacccacugucuggugccuggacgcgcaugguuaaugccuggcauucuuugugucucuuuuuacaagcgcagggugaccacaggucccaguuugccgggggcaggccugguucaugcuuguggugcugguguaaugaucacuaacuugccauuucauugucgguauugacguaaaugauaugauuugccuagagaagcaaauacuggcacagugcuguuuaggacucugaugagguuuagaccuaauagaaaggccaugguccagguuccuugaacaucccuggacaagucacuuaaccuuucuguguucaguuucccguucuaaacgauuggcaagaugaauucuaagaucccuccauucacagucauucugucauuugacaaacaucuuuuuuuuuuuuuuuuuaaacgcagucucgcucugucgccaggcuggagugcaguagugcgaucucggcucacugcaaccuccgccuccuggguucaagcaauucuucugccucagccucccaaguagcugggacuacaggcgaacgccaccacgcccagcaaauuuuuguacuuuuaguagagacaggguuucaccauguuggccagaauggucucuaucucuugaccucgugauccacccaccucggccucccagagugcugggauuacaggcgugagccacugcgcccggccgacaaacaucuuucacaagcucagacucaugccaggcaaagguccagggcauggagaagccaggggcagagccuggguccucagugggcacuuggccagugaaaaccuccagugcagguuguugggaaucucuaccuuuuuugucaaguguuacuugaaagaccauuaccaagaaauugaauugaaaguuaauuuuuuucuccuucuuuacggagacgaguuucacucugucccccaggcuagagugcaguggugcgaucugggcucacuguaaccuccuccucccggguucaagcaauucuccugccucagucuccucaggcauacaccaccacaucugccaccauacccagcuaauuuuuguauuuuuauuagagauggaguuucaccauguuggccaggcuggucucaaacuccuggccuuaagugauccaccugccucggccucccaaaaugcuggaauuaaaggcgugagccaccgcgcccugccugacuguuaauauuuuaaaccucaguuucucaggaacuaaucauucugguugaauacauuuugcuacacauuucuuuuguuuguggggggguaucuaaguuguuuuuuucuuuuaagucagaaaacauaaauuuucacuauggaaaauuguaaauuacagaaaggcccaaagauuuucuucauuucugcugacucuucaaugaaccagaggggcacguguaauauuuccgcuuucgguuacuccccaccccacacaccuuguagacacuuugucaaaacuacauuuuaaaaaaaugcuuucccccaaauucguauggaugucuccuaauaaagucacgcagucacucacugguucguccucaaucaaccaggcguggaguccuaaccuguccaugauuuuaagaaagggcaggcgcacaacacccccgcacggagaaaugaacagguguggcucggcagaggccuuccgcaccugcguuauggagugguggccgcugucggcgaugggguccccgcgagggcacaagugaucgcguggccacggcgaggcucugccuccgcccccgcgcuccgggucccauucccgaauucugcccucagcggccuggucaaugagguuggaucguuggcccagaaagccacuuccugccgcgacuggagccagccgucguugugaaaauuccccccacggggaaggaaguggcucuugggcuguuuauuuuggcugcgggcuagcagacggcgccaggggcagcggccacgcagaccgggcauuugucuagcugggcgggaggcggcggagcgggaagugccacagauugaggggcgcacggcgguggagggaggggcgcccaguggagagggggcucacggugacagaggaaguggcgccgcuugggggggugcacgauggcagggggaggggugcucgguggagggaggggcacacgguggcggggggaggggcgugccgcagauugagggcgaacgguggcuuggggaggggcgcuccuuggaguugggggcgcacgauggcgggggcaggggugccccuugggagcagaagcagagaagacucggaacuccaagagcagguggaucugggagccccagauccugggcacuggguugggggagaaaggggucaaggugugcccgcccccgggaugcucggacucuggggauccaggccuggugacccccggugaggaagagccagugggaggaaagggccgggcgcugcccggagcagaggcuggaggcgagagcgauugcugcuugcuguagcgcggccgcucuccaguuccuccggcaaggggggccugggggaggacuggccgaaaauacugugaugcuuuggucuaagacaaaagccagcaggggaugagaucaaacaccaugacacugcgaaggggaaggccagcgcgggugaggauuugccuucccagagaaccccaggggcggggcuagcuuccacucagcccgcauuacccccacccccgcccccacccccggggcggggucuggaggaucagcaaaaccgcgggaaaggugacagucgccuuccccaccaccgccugcauuuaguagguggagggacagucccaccucuccacccauucccugccagagugugauuuaaugucuuccuagaacacaggauaucacagucugcagcacagagauuugaaguggggagaaaagcaucucuggaaaugacuggugggggaagcccgccacugcucuacaaaggguggccugugacagcaacagcgcaacacugggacuguguguguagguuuuaggcacaagcacuuuaagcugugggaggaaagcaguuuggccuggcugggauggaggggcuguuggggaggagggaggagggugugaaaaggggaagguggccgguagagggaaacccaccaugguucaggaugucgguggggauguugcacaguugggcgggguauugggcuucgauaucauguaacccccguccuccauggaagcaaugccccccucguccagcccaggaucuaaugugcaugcauguacguggacacagucucuagccagggguggugcaggguggggugcuggguccccaggguuggccucuuagcaggguggggcuggcagcuucugcugacucaaggacauuuccaggccuggccuggagguuaagcagcucauugaaaacagcugcuccucuuggcuggcggcccuuucaggcggccucuggcucucccugggaugaccccucgccucugcguggccuggggaggggcagugaagggagagaggcucagaggcuggaggccacccugccaugcccucagggauggaacugaguccccuccagggcuggccagcuguccuccagcccccagcuuuccaggagcuaagccagguggucgcugggcccugcguuccugccugcagccuuugcuccugcgguugggcagcuuggaccgccuuccuuguccuuggaaugccuuccuuguccuugucucugcuugugccuuucaggguuuuaugugacaugccucucauucaacacauauuuguugagaguccgcugcaugccaggcaccaugcuagaauuaacuucucaucugccuccuucaucugugaugucuuguggagagcagccgucuuaucugaggucagaccucuggcugccucuguggaugggcugaguccggggaaacugcagcaacagcugaggguuuugcuccagagacacaaacuguugucaagccuuugcacucagccucgcgacuucaccaaagcauugugugccuugaagcagacaggacgggagaggaggccucagugaccaucaaggaggaaggagauggguuacucaauguagggcaaauugcuuuaaaacccaguugcccaugagcacaggcauguuucccaggugaugaccuggaugucugagaaacaagaaguguggacuacaucagaaauauuccuaucaaacuagacacgguggcucacaccuagaaauccugcacuuuggaaggccaagguaggaggaucaggagguuggggccaggaguucaagaucagcuugggcaacaaagcaagacuccgucucuacaaaaaguaaaaacaauuagcuggggcugcgugcgguggcucacaccuguaaucccagcacuuugggaggccgaggcaggcggaucacgaggucaggagaucgagaccauccuggcuaaugcggugaaacccugucucuacuauaaauacaaaaaaauuagccgggcgugguggcgggcgccuguagucccagcuacucgggaggcugaggcaggagaauggcaugaaccccagggguggagccugcagugaguggagaucgcuccacugcacuccaggcugggcaacagagcagacuccgucucaaacacaaacacuuugggaggccaagguggguagaucacgaggucaggagauugagaccauccuggcuaacauggugaaaccccguuucuacuaaaaauacaaaaaaauuagccgggcaugguggcgggcgccuguagucccagcuacucgggaggcugaggcaggagaauggugugaacccuggaggaggagcuugcagugagccgagaucgcgccacugcacuccagccugggcaacagagcgagacuccaucucaaaacaaacaaacaaacaaacaacaauuagcugggcaugguggggugcaugccuauagucccaguuauucugggggcuuaggugggaggaucacuugagcccaggaauucaaggcugcagugagcuaugaucaugccacugcacuccagccuggacaacagaacgaaacucugucucuuuaaaaaaaaaaaaaaaaagaaaaagaaaagaaaaaaagaaagaaagaaauauuucuaucacacuucauuuaucuggaaaguucauuucuaucuaucaccuucacccccaaccgugcagacuuaaacuuuuccauggauugcuucaugaguucagccucuccagcuucauuauaaacgcaugagggcagaggcuguaucuucuuuugauuccuaggcuggaaugcaguggcgugauuauagcucacuacugccucagacuccucggcucaguuauuccuccugccucagacucccgaguagcugggaccacaggcacaugccaccacaccuggcuaauuuuuuuuugagauggaacaucacucuguugccagguuggaguacaguggugcaaucucagcucacugcaaccuccgccuccuggguucaagcgauucuccuaccucagccuccugaguaguugggauuacaggugugcgccaccaugccccgcuaauuuuuguacuuuuaguagagauggaguuucaccauguuggccaggcuggucucaaacuccugaccucgugauucacccgccucggccucccaaagugcugggauuacaggugugagccaccacgcccagccuacaccuggcuaauuuuuaaauuuuuuuguagagacgggaucucaccauguuaccuaggcuugucuugaacuccugggcucaaacgaucuucccaccuuagccuuucaaagugcagggauuacaggcaugagccacugugcccagcaucugguucauuuuuaauuucccuuacagugcuucauaaaugauuaucaucuguaugggauaagaaagcccccaagggagcagccagaaggaugauuaggagaaugggcugaggguccagccuccaggcaccuccucugacauggccuuggugcugcagccgacccaagaggcuggucugacaggucagaggagguccuagagcaguaaccucccaggaaauaaggagaaugggacagaaacccaaugcagacaagcuaauuaaaaaaggaaugcaggagcccagcuggcugcagaugauccugaguguuucacagaauggaggaaagagccucagggauucagggacaggacauccagcaucuuugggacucacuuccucucuuuccaucucuuugucccguuucacucugcuucucuuuauauauuauccccucaucguaggaagcauggccauuggcagccccagccuagcaaucuuaacaaaaagggaaagcuuuauguguuccaggggaguucucugaucagcccuguuugaguuaugugccccaucacuguggccaaggggauagacacugucaucagcucaagagugagccuugugcccacccacacauccacauagccagagguacacaauacaaggagaacaagaaggggaugggaaguuuccugggcagauaaaggcagcucaaugaggucacagauuguuaucguugccaugucuucauuguagagcccagcgcccugccagaccauauggugauaagggcugggaucaugucuauauuguucacaauacccucagugccugaugcccugcuggcaucuaugaaauucucaauacaucauuguuggaugaaugaaugaauaaaugaaugaaucacacccagccagugcucagugcacagcucccugccuagcuucauucauuucuccauuuacucaguaagaacauauugagccacagcuugaugcguagcacugugcuaggcauggguugauugccuacaaaaugcaagaaguggucuuuguccuuggggaggagaaucccaagauccuugugaggggcccugcaccuucuguggggggcacuuuugcucccugcacugacaccugaugcucccaugcauauggaugaggcuggggggugggugaggcuggaggggcccucucuggauggggguggggggcaucaggccucugcacucugagcucccucugcccgcuuuguaugugcuugaugaagcacggguacaaagaacacagagccagcucucaggacgccuuuucucuuuccccagcaguuccagcccagccugagcgugcacucccccuccacuaggccuuggagaaagagccucuuuucauugagggcccaggcccaccggccacuucggguggaaaaugcucucaagaacccccugaccccggcuuggcagaguccccccggauccaccuacaggaauccccccucagcuucuccuuugcuuugcagagcuccugcacgccucuccucugcuuuuugauuccucagccuuuucucauuugcugccaaaugagaaaaugcaagagguugccuuuguccucuuuugcugccaaaugagaaaaugugaccuguguucuucagugccuccuccacauugcagucuucagaucucugcccagcggagucucucggcccuugggaggcacagagcuccuuguaacgcccccagacaccugggauuuuaaagguuuguuugcucuuaugcccggcauuucuccucuaacuggauuacaaauccugcgaggggagggacggugcugcgaguuuccuuguggucccagcauugccuggaacaugccaugcaccuagcagaaaguuggguggauuugaacccagagccuaggaugucagagggaggaggggccuugaagcugugccucaugugacaaaggaggaaacugaggccugaaagguacuucuguuggacauucuaaucccguccccuuucuggacuucaguuuccucugucaagugaggggagguuggccugacccugggaaaagccccucccgacuaaccuggaccucuuucagacccuucauucaccguuugcuacaacugcuacagcccaccuggcauugauuuagcacacuuguggauuuucuggcuggggaggagaggaagauaacguccucuugggcuauugugggcucacgugaaguuuugggcuucguuuuccagucguaucucugagaaacaucuacaaaacaagcaauaauuuuuuuccuuuuccggccccaggccccuuuggcuaccuccugccaaggccauuuucuguuacuacugccuggaguagaguuucugagaaccagauaccuacuccuuaaaggaagcuugggcaggcauggaucaaguccuggagcugguuucugguuucugguggguggcugaaaggugaccuagucuguuuggguuguuauaacacaauaccguuaacagauggcuuguaaacaauagaaauguauuucucauggcuuuggaggcugagaagucuaagaucaagguuccugccgauucaaugucuggugagggccacuuccucguggacagcugucuucucacuguacccucacaugguggaauaggugagggucucucuggggugucuuuuauuaggacgcucauccuauccaugaaggcucuucccuaaugaccuaagcaccucccaaaggucucacauccuaaugccaucaccauggggguuuaagauuucaacacaggccgggcgugguggcucacucuuguaauccuaguacucugggaggccaaggugggaggcucaccugaggucaggaguuugagaccagccuggccaacauggugaaacugcgucuguacuaaaaauacaaaaauuagcugagcauggugacgcaggccuguaguuccagcuacuugggaggcugcugaggcagaagaaucgcuugaaccggggaggcggagguugcagcagugagcagagaucgcgccacugcacuccagcuggggcaacagagcgagacucuguaucaaaaaaaaaaaaaaagcuuucagcacaugaauuuuuggagguugacacauucuguucauggcaggagggaaggagcagguucaaggcaggggacccagagauuagcuguggcaguuguccuagggguacuuuaggaagcucacuuuguccugcccagagaggaaccccauccaagugcuguuagaggacagaggggcagggucccugccccaaccuacauucccauggugguguuuugagcaucagugacaggagcuguggguacuauguuuuaggaaaauuaaucuggcuguuggaacaaggagcagaaagauaggcugguuguuugugauuauuaucuaggcaugaaauucguucauucaugcauguguucauuuguuccuucaguauuuaagcaucacugugugucaggcagaacuguaggugcugggguuacagugguggagaagacagaaaacaagagugucagauagcgaguucugguucuggaaguggcagaguagcuugugucagucuaacucucuggccaagaaugcuuuuagacuaagggaaaauuauaaaauauggugauuauggugauuugaaggcaaugaacagcaauuaaaaccagacagagguagagaggaaaaaauccuugaaaguaaaaaguaaaccuggcacauuuaaccagcuuuucccugaacacacuaccugguuugaggagcucauacagaaaguggcaguuuuaccgguuagagcuuggggccacuagaaaggcuaacauugagaggaaauguuaggaaagcaaggagccauagaaauuccuucuacagauucuccuuaaauccuuggugacuccugaacugugcauuugcaggguaggguucuaagcagcccagcaagaaacagcagcugggagguagagguuucaguugcuaucuggugcugaggaaacagaguuuaaaauuuaaguuccaccaaguuugaggggcuuaguaaucaccuaagguuuucuuuugaaaucccagaagggccucaccuuaugauuaaauccaagguuaagagccacaucugaagacuaaaggcaaaacucaaacaaccccacccuagcaaagcuuaaaaccaaaccuccacaagagcaagguaauccacugguaauuuaacugccugccauaacaaaauccagcauucuuuagaggaagauuuuuuuaaaauccagauucccuuuaacauagcaucccugacguucaguauacaacaaaaaaguccagacuccuuaugacauuauccacaauguccagcauauaauaaaaauuugcagauaguaggcagcaggagaugacccauaaucaaaagaaaaaacagucaauagaugcagaugcacagacaacccagauggugaaaaaaaucagauaauaaaugccaugaagagcauuauaaucaagugauaugauagagaguaacuguggucacuuuacgauugggaggccaggaggaucucucuaaagauguuacccuuuuuuguuguuugaaaugugaaaugccagguagaggaaauaaugcauaggcccagagauaggaaacagccaggcuuguucaaggaagaacaaggaggucaaagcgacuugagcaagguggaguaacaagauuugagaucaggccguuagacaggaccagaucauguuaaauuguggcucauaguaagaggcugaaucucauuugaagaaugaugaauuaucuuugaaguaauucaagcaggaggaagacuuaccugccuucuguuguuguuguuuuuuucccuuuuacuaugagcgaggcugucauuucaaauauuuaagaggcaauugcauuuucuucuuuugcugucuaugcauaucucuucuucauuuucuacugcauuguugauacuuucccuaaguuucauguaucuauuuuuuugguagaagcucuucuuucuuuucuuuucuuuccuuccuuccuuucuuucuuuucuuucuuucuuucucuuucuuuuucuuucuuucucuuucuuucuuucuccuuccuuccuucauuccuuccuuccuuccuuccuuccuuccuuccuuccuucuuucuuaagacuaguaaagucagaaaggaggaaagaguagaacaaagacuuuggucuguaacugacuaugaacaaccaauugagauaacucaccaucuuuggaccagccagaggcucuuuuaauauuguggacuuaacuauuugccucuaauaaggcacauauauuuuugucauuuauuugaauuuugaccuugcugauggcaucauauguuggcauuaaaaaaaucuuuuuaugggaaaaaaguucuuaugcuauugaauucaucaguguugucuaugaccuucaacauuccaauaauauuuuuaaauuuuuucuaggacugauuuauaucuuuaaaagauuauucuaggccaggugcgguggcucaugccuguaauccuagcacuuugggagucugaggagggcagauucccugagcucaggaguuugagaucagacugggcaacauggagaaacacugucucuacuaaaaauacaaaaaaauuagccaggcaugguggcaugugccuguagucccagcuacucgggaggcugagacagaagaaucgcuugaaccugggaggcagaaguugcagugagccaagauugcgccacugcacucuagccugggugacagagcgggacucugucucaaaaaaaaaaaaaauagauuauucugacugucuuuggagaauggacuauaauaggaugaugagaucagcaucggggaagagagagaacuugagauuuggacccaggagaugagggccacauuucagcuccuucccuuaacaaucuuacgacucuugucaucaaauugcuucaccacccucagccaauuucuuuaccaauaacauagcauaaugcugauuuauagucuucuuacugugccagauccuguuccaaaugcuuuacauguauuaucucauuucaucguuaccagagucuuaagaugaggaaacggcauagagagaugaagcacuuugcccaagucccauauucaguggcagaccuagaaucgaagcacuagcugccgggcacgguggcucaugccuguaaucccagcacuuugggagaccaaggugggcggaucacccgagguugggaguuugagaccacccugaccaacauggagaaaucucaucucuacuaaaaauacaaaaaaauuagccaggugugguggugcaugccuguaaucccagcuacucaggaggcugaggcagaauugcuugaacccaggaggcagagguugcagugagccgagaucgagccauugcacuccagccugggcaacacgagcaauaguccgucucaaaaaagaaacaaaaaaaagaaacaaaagaaaauaaacacuagcagucggauucaucauuucaacacaugaaaaguauccuggggagcuaguggcuaguggaugcaaaaguucuuuggagauuggauguacuccauauguguguuguguacauaaguggcagucagggaacaagaggaaggugauggaugucacagagaucuggguuugcuuacugggcgugggacacugggaguaggucacuucaugucucuaagacucugucugucuuuucuuaccuuccuucccucccucccucccucccucauucccuccuuccuaccauccaucccucccucccuccuuccucccuaguuucuuccuuucuuucucuuuccuccuuccuacccucccuugcuccuuccuuucuuuuucuucacugaaacauaacucacauauagaauuuacccauuuaaaacauauauuuaauugggauuuaguuuuuucacagcauugugcaacuaucaugacaaucuaauuuuagaacauuuucgucauauccccaaaagaagcaccgugcccuuuagcagccacuccccuuucucgucacccacaggcaaccauuaauuugcuuucugucucuaugcauugaagcuucauuucuuacucuguaaagugggugugcugugguggggggcagguuggauuucccccagugacuucuacagagggugccugcucagcgaggagauagguggaaagaggaaagguugaggaagccaaagaauuaaauugcugcguaaaaauuaaggcgugaaauaguucaggggugggaugaguggucugggaagauccuagaagaaggaaaggauggaaccagugcaaggggcagggggaagggugagacacaaugccuccggaucaaaggagaauuuuggcagaaaaaccacgccauguaauagagauugagauugagguugcaacguggugugugguguaaaugccuccacuccuccucauaaaaucuucagaaaaguauacaggugaugugccggguggaguuggguuugcuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuggguuugcuuuugagggugguacagaggacugaguccucccuccuggugagcaggggcuagaacagagguaguccugcaggccucugccucaucugggcacaagggcuuagcacugccacucauuuccaccucagaggguugguagugaguaccgagugauuuaacguaugagugacggcucaccauccugcacugggcacaugguaggugccugucagccacaccggucaucaagggccaaccaggagagccccugugaugccuucgugucuugccuucccuuccagaacccaacgucuuccucaucuucagccauggacugcagggcugccuggaggcccagggcgggcaggucagagucaccccggcuugcaauaccagccucccugcccagcgcuggaagugggucucccgaaaccggcuauucaaccuggguaccaugcagugccugggcacaggcuggccaggcaccaacaccacggccucccugggcauguaugagugugaccgggaagcacugaaucuucgcuggcauugucguacacugggugaccagcuguccuugcuccugggggcccgcaccagcaacauauccaagccuggcacccuugagcguggugaccagacccgcaguggccaguggcgcaucuacggcagcgaggaggaccuaugugcucugcccuaccacggugaggggccgcuugcaggcgggagggugggguccccgauguccaggggacuggagccaugagggacagauucccagugacaaggccuuuggccucuguggacccuuggcagucacauguuuaauuauaauaggaagcauuuuuuaauaauuaagaaaauuaacuucaggccaggugcgguggcucacgccuguaaucccagcacuuugggaggccaagguggguggaucacuugaggucaggaguucaagaccagccuggccaacauggaaaaaccccaucucuacuaaaaauucaaaaauuagccaggugugguggagcaugcccaucauagucccagcuacuugggaggcugaggaaggagaaucgcuugaacccaggaggcagagguugcacugagcugagauugcgccacugcacugugcagccugggugacagagcaagacucuguccccccccccacaaaaaaaaaaagaaaagaaaagaaaaaagaaaaauuaacuucaaagcauuuaauuuacuuuuguaaaaauugcaaaauacaugcuuguaaagucuucaaauaguauacaaguauauaacauaaaauuaaaugaaaauucccuucccccaggcccacucuccaggugaaaccccauuguagccccccauguugucuuaaugccugucuugcauguggugaauggggaccagagucaccaugugaggggcuggccucuugugguggacagccccguccugggggggccuuuccugggagacccccugaguuccgagauagaacuuuguggggacacagagcccaugggcuggguagcugagcagagauuccaccgggcucagcccucugugggugacuuggaggcccucuugcccagcuggaguuuggaugggauuagggguacuagggagccccuucccagcccuaugaggugugcagcaagaccucucucugguuccugggcugacucaacagcagaagaagccuuaaagccacuauggggugccauugccucucccaccugcugaucccugugaacacccagcacucuggguuuuaggggauuucuccugagggucgaggggcuuggcagccucugguguccagaugccaagggccuggccccuguccacccccugcagaggucuacaccauccagggaaacucccacggaaagccgugcaccauccccuucaaauaugacaaccagugguuccacggcugcaccagcacgggccgcgaggauggucaccuguggugugccaccacccaggacuacggcaaagacgagcgcuggggcuucugccccaucaagagugagagcuguuggagccgugggggcgggggcaguguuccuggagggaggcuggugcugaggggccccggggcccagggugagauacugcccccuccccuaccuaguguagccuuuuggugggggagggucugcacucccgagggacccuggagggggccugaaggagagggcugucgugguggcagguaacgacugcgagaccuucugggacaaggaccagcugacugacagcugcuaccaguuuaacuuccaguccacgcugucguggagggaggccugggccagcugcgagcagcagggugcggaucugcugagcaucacggagauccacgagcagaccuacaucaacggugagccggggccugaugccugcucgugccucuggagggcccgggcccuuuccgcuuguggguuggggagagggcgauggggagcgggggaggcuggggcuggggauccccuguucagugucccuccuugcugucaggccuccucacuggguacagcuccacccuguggaucggcuugaaugacuuggacacgagcggaggcuggcaguggucggacaacucgccccucaaguaccucaacugggagaguggugaggcacaagguugggggcgcagggcagcauaggggccccgcgggcucuuggccucccauggacuccucuccucauguccuccugcagaggggcaguguggguaggggaagcaccgaccuccaccccccuccccagacugcgccccccuagcccauguagggcggcgcugccccaggccgaaggucuuggugcauauggacugggugccagccuccacucaccucuucagccaccccugugggcagcgggcaccagcgcacccagcagccuggacggggaggccggggcggggcugguacugguuacuggguagaagguucaaggcgacgugcacccagguuagaaagcgcggaggaccccguggucuggggcggagcuggagcugagcaccaggcuucccgaacuggcucaggcuuccgagggagcagagggagguaggagguucugagcagggccccgggagccacggugugagcuucucucuccgggggugcuggcgcccugcccuccccacagaccagccggacaaccccagugaggagaacuguggagugauccgcacugaguccucgggcggcuggcagaaccgugacugcagcaucgcgcugcccuaugugugcaagaagaagcccaacgccacggccgagcccaccccuccaggugagccagggacugugccgcaggguggggaggggcucccagggccagggacacagccacagagccguggcaggcccagccucuccuccgguuaccaccacagcacaaggggacucuggauccucugacucuuauuucauuguucaguuaaagucugagcaaauuggaauaugucauuaauucauuuggggaacaugugcugagaucuguguuaaaugcuggcaauacccacuguuaccucguagagaccacagucugcuggaggugacagacaucucaaugcaguuagacuaucccaggucaugagugauuauagaaauauggaucaguguuagaggagcauagagaagaaacugauucagcuucugagaguuaaggagggguuuauggaaauaacauuugauuugggccuuucaaauugagucuaaguuuaaaagauauaaagaggugugggggaagggcauuccuggcagagggaagagcauaugcaaagguguggaggccuagaacuacacugcagcuuuaagggguggugagugauggccgggcaccguggcucacaccuauaaucccagcacuuugggaggccaaggcaggaggauugcuugagcucaguaguucaagaccagccugggcaacauagcgagacccugucucugcaaaauauuuuuaaaaaauuagcugaguguggugaugcacgccugucuacuagggaggucgaggugggaggauugcuugagccugcaagguugaggcugcagugagccucgcuugcaccacugcacuccaaccugggcaacagagcgagacgagacccugccucaaaaaauaaauaaauaaauaaauaaauaaauuuaaaaaaaaaaagaaaaaagaaagaaaaagaaaaaaauggauggugccuguugcaguuuggguggaguauagauucuaaccacuucaaguauggucauccaaccagcagcacagcauccccggagggcuuguuagaaaugcacagucaggcccgccccagaguaauugaaucagaaccugcauuuaacaagauccucagaugauucaugugcagacacaguuugggaagcccuggcuuaaagggcauggugaagaagaggcagguugcagccagucucugcagggucuuggcugcugggccaaguuuggguggggccagguaggcuguggggagccuuugaagauguuuaagccagggagugucugguucucguuugugaucauagagacagcuuuaggggccucguggaggaguuggggcaauggacagggucugcuuuagggauucugccccuuacugcuguguggcccugggcaagcagcuuagucucuggggugcagaguccucauugcaaauggagaaugaagccaccccccuugcaagguuguugugaggaaggcuggagaucuggccuggcacgaaggaguuuuucuguaguuggcuguggauguuuacugugguguagguuggaggggcugugcaguuuccugcgaagcugugggguggugaggagacuuuuacaaagaaaauauggcaacacacacacacacacacacacacacacacacacacacacaacacuaacuacagacaguaaagaguuuacagagcaaaacuucugcuccugaccauggaagucuugccaaugaucgacucaggacugguuuuuuuguuuguuuguuugagacagggucucacucugucacccaggcuggaguguaguggugcgaucuuggcucaccacaaccucugccuccuaggcucaagagauucucgugccucagccuccugaguagcugggauuacaggcgggcaucacuacuucccggcuaacuuuuguauuuuuaguagagacgggguuucaccauguuggccaggcuggucuugaacuccugaccucaggugaucugcccaccucggccucccaaagugcugggauuacaggcgugagccaccgcaccccgccuuuuuauuuuuauuuuuauuuauuuauuuuuugaaacagagucucgcucugucgcccaggcuggagugcaguggcacaaucuccacucacugcaaccuccgccucccagguucaagcgauucucaucuccagguucaagcgauucucaugcuccagccucccgaguagcugggauuauaggcaugagugugccaccacgcccggcuaauuuuuuuguauuuuuagagaugggguuucaccauguugcccaggcuggucucgaacuccugucuucaagugauucacccgccucggccucccaaagugcuggaauuacaggcgugagccacggcucuggccugauucaggacugcugaccacugcuuuaucucccauuccguaaggggccaggagcagaagcuugaaacgucagcaacccgaucuagggcaccuccaccucuagcuggagggagccuugggcccuaguccaguccucccacaagcaccuuucugaaggaaggggcccgcugggaggcccgggugugggcaugccuagccuaucuguggccccuuaccaaguccucuguccucugggucuucccggaccugcagacagauguaaggccucggauuuccgccccucugcccagcccauaucucucugcacgaggcauauucuaggcagguucugcuuucccggucucaucacuuaaguccugucauuucgaaggcaggcgccccgucguguccccaaagcauccacauuucccaagcucccuuccgguccuugaggccccucgggucucagcagccacuaaaauccgcuugucuggggcggcagccucaggucuuagcucauuggcuaacaagagaugauugacagguccugagccagagagcgagcccaccgggcucucaguccgcccagcuuugccgggucuccaggagcagguguggcuggaccacuggaaucccagucugaggccguguucuagugggcgcgcaguuuccugcccgacuaggcagaauccugcccgagcaugacacugugggugguuuggugaaguccuguuuucucuugccaagaccaaguaagggcuuguuugccucagcugcccucggaucccaaccccuagaaggugaaccugaaaggcauggaaaucggggcaagggagggccugggacggguggauuucucagcccugggguucaggguuaggaguuaggagcggggaaggagucccagcugggggauggggccgaucuguagugacuuugagcaccuccuaauguucucgguugcccguccaccaagaccucagauuccuggugggcuugccugggccccauuaguggcucaaggucccguuucccaguuuucucccuccugggcuucccagaccugcacagagugggugcucaauaaauguuauuugagagaauaacagugauuccauuuacuaggcagggggccauaagccaagcuugaaucucauagcaggaaaccccauuuacagagggagaaacugagguucauggggcugguuuguccuuucuacccaucguuuauugacugauugauugaugcauugauugagauaaggucuugcugugucgcccaggcuggaguuuaguggugcaaucauggcucacugcagccuugaccuccccgggucaagugauccucccaccucagccuccugaguagcgggaccacaggcgcacaucaccaugccuggcuaauuuuuuauuuuuuauagagauggggucuccccuuuguugcccagucuguucuugaacuacugggcucaagcaauccuccagccuuagccuuccaaagugcugggauuacaggccugagccaccaugccuggcccacccaucguauucugagagccacagccagaggaaguguucuguccuggguggaaucugccaccacgacuugggucucugucccggggcuccagcagcccuguaaaguuuuguguuuuuuuagcauuuccaagaccugugguggggaccgggauugaucugggagaguuuggagaggaggugacugggaggccucgccuguguugacgucaacccaguggguugguucccagacugggcggcucagucccugagcagcagccucaugggucucugcagacaggugggccaaugugaagguggagugcgagccgagcuggcagcccuuccagggccacugcuaccgccugcaggccgagaagcgcagcuggcaggaguccaagaaggcaugucuacggggcgguggcgaccuggucagcauccacagcauggcggagcuggaauucaucaccaagcagaucaagcaaggugaggagcugcccgcccacgugucuggguggagggcagggccucccacugccccacccauccuguccaggagccucagagaauguuccuuccucccuacugguggcugaggcugaccucucaauguuuucucuccccuccucuccugcugcacccccagagguggaggagcuguggaucggccucaacgauuugaaacugcagaugaauuuugaguggucugacgggagccuugugagcuucacccacuggcaccccuuugagcccaacaacuuccgggacagucuggaggacugugucaccaucuggggcccggugagaucucccucucccuaucacagggccacaaaauacacccccaaccuccaggugccaccccagcugaaggacauccuaguuacuaucagaaccugccuggaaccucuuaccucucagcagucccccuccuccccaccaaugccuucccuuccaugugagagacugccggggcuugaauccuaccuccaccuccaccuccaaguagccaagucaccuugggcaaguuacuagagggucacuggggagaucagaggaguuaauucucgugaaaccuuaggcacagugccuggcgcauucuuggucuccucccagcugcccuucccugccagaagguggcaucagaacccacauuaugugcagauacuuugcaagcagggcugcacucugccagcccucgcccccagugcucuacccaguccaggguccugucaucucaagagauuguuggguuuuaugacaauuugccaugguuugggcuuagaugugguguaagugaaggaauugauggagggcuucaagcagagaugaaagacccuuaaaaaagggacaaagccagcugagugugguggcucaugccuauaaucccagcacauugggaggcugaggcaggcggaucacuugaggugaggaguucgagaccagccuggccaacauggugaaaccccaucucuacuaaaaauacaaaaauuagccaggcgugguggcagaugccuguaaucccagcuacuccagaggcugaggcaagagaaucgcuugaaccuggaaggcagaggcugcagugagcugagauugcaccacugcacuccagccugggugacagagcaagacccugucucaaaaaaaaaaaaauaaaauaaaaaggagaaagccguagggacacagaccacccuuccuagggacagacaggauguucugcugucacauacugcaaacagugcuguggacuguaguggcagucauuugccuuaggggaugcuauuuaagaauuuuaaaacaauuauguauugaguaucuaccaugugccagucauuuuucugggugcuaggauacacaaacacgccugcccucagaauggagcuuagagacagacauacugcuggcugggggccuguggauacuggggagggcgaagacagaagcaggggccgaggacuaaauuccuccucagcuucaucagcugagauucuggucugggcacacuggccucugcacacucuggcccugcaggcacuagcuagacgccuugggaauccaagcugucuauccugccaucaguuacucuaacaaucuuagccaguuuguuuuugauauuuauaaaacgaguuaucaauaauguaaaaggacgccuuuccuuuuuuuuuuuuuuuuuuugagauggaguuucacccugucgcccaggcuggagugcaauggcacgaucuuggcucacuggaaccucugccucccagguucaagcgauucuucugccugagccucccaaauagcugggauuacaggcaugcaccaccacaaccggcuaacuuuuuguauuuucaguagagaugggguuucaccauguuggccaggcuggucuugaacucuugaccucaagugauccgcccaccucggccucccaaaaugcugggauuacaggcaugagccaccgcgccgggccaggaugccuuucccauuuagacaaugcuuguuaaguuucaaggcguuugcacaugaacugcuugugcucucauccacccugugaggcuuauggguucaucccgccuuccccauugcacagcugggacacagacaugucagaaucacacaguaagucagagacagggccagcucuaggaaccagauuccaagaaggauuugggagauuuauggggagguggggguugagauucuuccucacccuguguccguaggaaggccgcuggaacgacagucccuguaaccaguccuugccauccaucugcaagaaggcaggccagcugagccagggggccgccgaggaggaccauggcugccggaaggugaggguguuucuggagcugcccugaguggggccaccugucagaggggcuaccaggggagggagagguggaugaacuccugcugccucgcauggcaucgcccucucgucggcacccccuucccugagcucuccaaacugcuccuuuauugaaggagugauacuggaugggaugggacgggugggcgcuguugggaggaagcagagcuccccacccccagcccaguccugagucccuccccaugggggaagccacuuccucgagacagcagagaacagggaggugggggcuggucuacccccgagugcccccucagaguccagccuagucaugucaagcaguggcugccgaagugaaguguggccccugugcaccgccaguccugacuucccccuccucugccgucugacacagggcgugugcuggucugucuccccuggaggagugaggccacucaggguggggcugcaccuucccccuccuuguguucccagccccagugggcuucuagaggauguuuagggagguugagggggggggugucaaggaaugaaagcuguguaagugaguggggggugagugacugagggugugagggggugacagacccucuccuccuccagggaguggagcaggggugcaaaugcugugaugggugcggggagcuugcuucuaaaagacacugcuuggcccuuggccccccccagcagccccuugcagccaggcuggcuccucacucuguuuuccuuuggauuaagccccuaccacacccaccuggaccccaaagccucccccagaaaaugagcaggaaacacuaacaggcauggccccaugggcgaggaagcagaggggagagcagagcccagcugcggagucuguggacuggcaaggacagugccuggcccaggggcugugucauggcugcgaagaggugaagggaggaguagagaggaauuaccaacuucucuggcaccaaggccagccuggaauuuguguggggaguguugaggguccaugguuaacagcccaggaucaccaggggucuuggcacagccccugccagcagaugaggcccccaccacacauaccacaucugcuucucuucugccuuggcuccugccagccucgccugccagggucucgucucugagccccuccugccauccccgggccaggagcauccugcgccgacuccagcuuugccaggcccucgaggacugcccauccccucuccauccuggcagcucuccccagccuuuagcugugguuucccagccaacaguaauuuccccacugugucucuugguuuaaaugcccaagagaggagccugaagggccauucaucuucccgagccgggucacuggccggucgcugguggccugccaaucagccacgcuggggcugggccuccaccccagcuuccacagcugugggugaugguggagggggaauguggagaaacgaggugcagaacacagcccaguacucaaaccaguccccuccguccugagcacguucagugaugucccugauggcaucucccaccacaggauuuaugggugaggguggagagucaucuucccuacagacaccccucuucuguccacucuugagccaggguuggacguggcacagcccauccugcuacuggcugggagaagaccaagugaccuacagugaggcccggcgccugugcacugaccauggcucucagcuggucaccaucaccaacagguacagcaggggcgggugcccugacuagcccuugcccaugucugggccuauuguggucccuucagcaaacaggguagcaucugccaucaugcccagagggaccuggaguccugugaaccucagugggcuccagggcauuuuaaaaucuugucagaagaaugacucucacuuguuaagugaccccaguguagggcagggcccgggcaggcacaggugugggcuggauacuugagaaagagaggccuugguugugucugauuuucucuacuuucuucucagcaaagcaaggggugcagagaauagaaggggcagcuggggguuccauaaaucagcugcagggcucccaggcgucccugcuuucuugagcaaguuauuggucgggugcagcacccgagcucccacgguagggcgucuggccugugacugggggauugggaagcagggagaucccugcccugaccagccugucuccugaagguucgagcaggccuucgucagcagccucaucuacaacugggagggcgaguacuucuggacggcccugcaggaccucaacagcaccggcuccuucuucuggcucaguggggaugaagucauguacacccacuggaaccgggaccagcccggugagccccuuauuugacuugccuuggugaagcgaggagggaggccaggguggacuggcccugccagcaccgagccccagggcuuccccauaaacagaucauuggugcacugugguguagugucuaugagcacaagcucugaaaccaaacugccuggcuccgaucaugacucugccaucuuuuagcugugcauccucugagccucaguuuucucaucuguccagugggaauaaugauccuuuccucauagggaugacaugagucuuaaauauguguaaagugcuaauauguguaaagaguuaauguguguaaagugucuagauuacuucucuaucugggcucacaaaaaagaaacaaauaaucucuucucuaucuggacucauuuaaaaaauguguucagaauacugagcgcaauacaagugcuuguuauuacuauuauuaccauuucacauucauuaucuuucuaaccccuucaauaaccugaugagguagaugaugaagcaggcucggugagguuaagcagcuugccugagcccucacagugggugaacccagagccagggcucugccuccauucccuuccucccuccuggcuccaaccccagagagcaugucucugaagagguggccaagcugguucccagugugagggccgugcuagugcccugccgggaugugagggaggaccagacuaugaauccuucucagagccugggucucccuucccucuccuucaggguacagccgugggggcugcguggcgcuggccacuggcagcgccauggggcugugggaggugaagaacuguaccucguuccgggcccgcuacaucugccggcagagccugggcacuccagugacgccggagcugccggggccagaucccacgcccagccucacuggcuccuguccccagggcugggccucggacaccaaacuccgguauugcuauaagguagggcagccuguuggccggguagggggcagggggaggacaggagcaaagagacaguuuggauggaggucccagugggaccagccacaauccagagacacaccaggcugcagacgggugauuucuggugagacuuguccauggaaucuggaggccuggugcucaguaaucauuugaggaauugagggaaccacagaucauugauuucagagguucccaaauguuggggccagccuagcuguucuucagaauugcuuggggaaccugauaaaaauaaaaucuuggccgggcgcaguggcucacaccuguaaucccagcacuuugggaggucaaggcggguggaucacgaggucaggagaucgagaccauccuggcuaacauggugaaaccccaucucuacuaaaauacaaaaaauuagccaggugugguggcaggcgccuguugucccagcuacucgggaggcugaggcaggagaauggcaugaacccaggaggcggagcuugcagugagccgagaucgugccacugcacgccagccugggugacagagcgagacuccgucucaaaaauaaauaaauaaauaaauaaagauaaaaaucuaggcugucacaauggagauuuagauucauuaggucuggauugggccugguaaucuguauuuuuaaucacgcuagguuugggagccacuggcagaguccgaggucuuuuauuaugcacagaaacugaagucuagggagaagaagggacuuacccacguuaagcuguggcucugcugggauuagagcccagaucucccugcuggucaggggauggggcucaggggcccucuccagaaggugacugugccagcuccccuccccagaccucugcagaugaacaggauuguccuuagcuagccuuagcccccuguccaguaaggcuccaggccccuccucugccauggugggaaaggcaguaggugcccccugaggggugggccaguggggacagcuuagacagcuggacucugccccugcagguguucagcucagagcggcugcaggacaagaagagcuggguccaggcccagggggccugccaggagcugggggcccagcugcugagccuggccagcuacgaggaggagcacuuuguggccaacaugcucaacaagaucuucggguacugagccgggcugaggcguguuaggagggcacccgcacacguguaggagcaggcauggccgacagacccuugguuuuguugggcgagcagggggauggcagaaugugggugaccccagggaggccugcaucugcugcuggugccaggaccaucuuguccucacucaaguagccauggugcccuggcaucuugggagaacaggcuggugugauccaugcacucauaggagacuguguuuugcucaccaucauccccccagcaaugcuccaacagacccacaaacuuacauauguaccccccaccccauugcaaaaucucccacaugcugguccuggcaaguguuuccccucaccuuacaccauccuacaaugacccacacuccucaauccacaguuuuuccugagagauaggaggagaaaggccgcagcuaugaggauuugcccaugggccucccucugagacaccaccucuguccugggcucugagcauuagcacguggaauccccuagcacugggaaaaucgagauggaucugggcuuccugauagcuuaauugaagggaucucuccucucagcaaacauugaaauuacauuauuugucucauaauuacaauagcucauggucaucacuucucaccacguaccaggcacugugcuaaacauauaguccucacucaagccucccgacaacccuauggagcagacguuaaccccugacccuuguggguugauagagagguuauuugcccaaguucaugggugaacggauacuugaauccagguuuauuuaacuccagagccguagaucccugccaccuccucaucugaacuuccuaaacuccguaaaguaaaagccugcagaaucuugcuggacagggcacccccacccaaaaggaacccaaacaaaggggaggggccacugccccuugaguggauggcuugguccagcucuccccagcucugucuuguggggagaacuuuaccgaagugaccucaacgcuguaucgaugggucaaugugaagcccagauggagaggccccaggcccugggggcugccccggucacagcugcaagggacagggggcacguuuggguuccugccccucucacuucccaucucuuccguccccacuccuggguugugcugaagugaaucagaacccgagauccacgagcagcacugguucuggaucggccugaaccgucgggaucccagagggggucagaguuggcgcuggagcgacggcguaggggugagggggccugggguacuugggacugcgaggccgggagcuuggugggcggggccuguuuggggcggggccuggaggugggcggguuuucuugagggccgggcccccagucggagccggcuucaggaaagcagguccgagaggggucacccggcccccggugagaauucgcagcucaggccaggccucuuguucaccuguuccgggcaugggggcggccugcaccuugcgccucacguuccucuucccuccacccgccuccuccaguucucuuaccacaauuucgaccggagccggcacgacgacgacgacauccgaggcugugcggugcuggaccuggccucccugcaguggguggccaugcagugcgacacacagcuggacuggaucugcaagauccccagagguuggccggaguggcgcugggggacgcgggauggagcgaaggguggcggggccaggaauuccagggagggucuccuuuccucacaacgucuuuguccuuguuccccuagguacggacgugcgggagcccgacgacagcccucaaggugagcaccccccagcccaucccgcuacccaucgcgugggagagggcgucaacucugggguaagucccgagaggccugaaugaaauggaggggaugaggaguuccggucgagagaagggggacgggguuggcucggacggaggcagccacagcccuguuugcuuccgugugggaggcgaggcaagccuggggccuggggccuggcacggugccugccuggguccggugugccugcaggcucgccugcugccgccuggcucugccccggcccugccgcgcccgccuccggggccuggcgugcagccucugccuggccgccgcucccacgcccgcgcugcuccugcaggccgacgggaauggcugcgcuuccaggaggccgaguacaaguucuuugagcaccacuccacgugggcgcaggcgcagcgcaucugcacgugguuccaggccgagcugaccucggugcacagccaggcggagcuagacuuccugagccacaacuugcagaaggugggcauuggauugagcagggggcugcaggcugggggagggcaggcccgggaugagggcagggggcugccuacccacaccugcccgccuggcuucuccaguucucccgggcccaggagcagcacugguggaucggccugcacaccucugagagcgaugggcgcuucagguaggaacccaggcaggcagcagauguggaagggggcuggcuguccacacacggagcacagaggcagacuugcauuugaauccagcccugccccuuccuugcuggcuguguggccuugagcaagauacuuaaccuuucugggccuugguuuucucaucugaaaaugggaauaugaggccugccugguaagauuuuugugaagauuagaaauaacauaugcgaagugcuuacgcagcauccagcacauuaguuacuaaauaauggcagcuccuguuacgucuggugucauucaucaugacuaaggcccucucggggaagugggcagaacauaugaugauccgggggccucuuuguauuuggugccuacuuaccauguacuggggggcuugaggcaggaaggaccaggagcaccugggacucagaauuugagcuugucuuuuugcccuugggcuuccugcccuggaguccucaggcuucuuuucuggagcagcaaguguccagggacagcuggggccuuaucuagaggcaccagguccuugggucuuugacugcccugagcucaguagcuccaccccucagccuacagccacuaaaccccagaaccugggcccuucccugcccccauuccugcggccuucauugcugcauccgguggaggcccagcugggggccggugcuggaguuaccucugcuccaugccauugcagauggacagaugguuccauuauaaacuucaucuccugggcaccaggcaaaccucggccugucggcaaggacaagaagugcguguacaugacagccagccgaggugagggcaaggugggggcagagugcgcagucagcugugcaaaggguuaaugcugggcgagccugggcagaagucaucagucuguucucauucucuuuguucccacaacccaauaaaggcuagacucagcgagggguggaccugucuccaugguccagaagacuugaauucggagcuggacacaggcccugagccucugcccagacuccucucagggcaugaggcugagugugcugccagccaugcccugcccugcucugcccugggggugacugcccuccccuccccuuuccgcagaggacuggggggaccagaggugccugacagccuugcccuacaucugcaagcgcagcaacgucaccaaagaaacgcagcccccagaccugccaacuacagcccuggggggcugccccucugacuggauccaguuccucaacaagguaggagguggcaauggggcacccaagggagucaggggagaggacgugaacagggaaaggcugagccucaggaguccuggccuuuuggcagcaccaaacucauggccucuugccuguacccaccaacuucucuuucaccuggcuccaguaccagggccagacuccuuggaaaaugacucacuguaguagcaccuuccaauccuccgggaagcaagguuguccaaauaauuuggugaguguucuagaucagugauugccaaagauuuuuuuuuuuuuuuuuugagaaggaguuucacucuugucacccaggcuggagugcaguggcgcgaucucggcucacugcaaccucugcuuccuggguucaaccaauucucuugccucagccucccgaguagcugggauuacaggcaccugccaccaccccuggcuaauuuuuguauuuuuaguagagaugggguuucaccauguuggccaggcuagucucgaaccccugaacucaggugaucaccugccuuggccucccaaagugcugggauuacagaugugagccaccgcgcccggccugauugccggccugauuaucaaagauuuugauaaugaacuccuauuaguaaaacaaaauauugagcuuacaugaccaaacuauguguguguacauuuaacuuauauauguauauguguguguaaauaaaaccuacuuccauacuaauaugacuaauauuauauauaguaaaauauguauaagaacaaaagaguauaaaacauuagcuaaagauuuuuaaauacuuuuaaguuuaaaacauuuuuuuggcugcgcguggugggucaugccuguaaucccagcccuuugggaggcugaggcgggugaaucaccugagauuaggaguucgagaccagccugaccaacauggagaaaccccaucucuacuaaaaauacaaaauuagcugagugugguggcacaugccuguaaucccagcuacucgggaggaugaggcaggagaauugcuugaauccuggaggcggaaguugcggugagucaagaucgugccauugcacuccagccugggcaacaaaagcgaaacuccgucucaaaaaaauaaacaaagaaaaaaaaaacaacaaaaaaaacaccuuuuuuuuuuuuuuuuuuuuuuacuagugguaugaaaacauuuuuuugugcucacucaaaagugauuaauuggcugggagagguggcucacaccuguaaucccagcacuuugggaggcugaggcaggaggaugacuugagcccaggaguucgagaccagucuggacaacauggagagaccaugucucuacaaaaaauaggaaaauuaaccaggugugauggugcacacuuguaguuccagcuacccaggaggugggaagugggaggaucuccugaacccaggagguagaggcuucaaugagccauggucaugccacuguauaccacccuggguaauggagugagacccuuucuccaaaaaaaaaaaagaucaauuauaauaauuauuguuuaauaugcucacuuuggcagcacauguacaaaaagugaaacaauacagagaagauuagcauggcccugcacaaggaugcuaugcaaauuccugaaggguccauauuuugcguaguucaugaaaguugaagguuguucaacaaaaaaauugucuaaauaauuuuaauaagagcaaugugauuacauguacuucacguuuuuaaaaaauuuuagucugacacuuuaugacucaugacucacaggucuaacguguugaaaaucaaaguuauuucaaaacaugcauuucaugguggcuauagauuaaauaugccucacaaagacaaauagauugaagugaaaaaaguucauccaucauuucuaaauaauucuccccauuuuuaguccuucuaccaauuaaacaaacauuuuuguuuaaaaauuggcuaguaggcugggacgcugagcacugggaggaucacuugaagccaggaguucgagaccagccugggcaauguagcaagacccuaucuagaaaauucuuuuuccaaguguuuugagugugcagguaggaaaguuuggggcacugacauuaaucacuauggaugcauuucucaacacguuuuuacaacacccccuccauagugugaguuucuuccccacagucguuauuuuuccaugcacaggcugauuuauuagaccugauuaguccuucauuguuuuuaccuggcgauugacaacgaguucauaccaggaagagaagguugucauuuuccuuguuaugugccaggguaauuggcauuaaucucaagccauggcuucuuugcaggacauuuuaagaacacuuagcccuguugugaagauuagauuaguuaacacugaauaauauaauccacaaauccuugucauacacaggaaggcagccagccucuuagugucauggaucuccugcccuccucagaauauucaaaagaacauuacacggccaggcgcuguggcucaugccuguaaucccagcacuuugggaggccgaggcggguggaucaccugagaucaggaguuugagaccaaccagggcaacaucgcaaaacccugucucuacuaaaaauacaaaaaauuaucugggcauggugguggacgccuguaaucucaccuacucgggaggcugaggcagcagaaucgcuugaaccugggaggcagagguugcagugagcugagaucgagccacugcacuccagccugggcgagagauugagacucucucucaaaacaaaacaaaacaaaaaccacacaaaaaaaaaauuacaccucuucuaccuuaaaaaauuaaggcauguauauuauuaaaacuuuggaaaauacagaagagaaaccaaaacucacccaacacucucuagagaucacagcuaucaauauuuguuauucuccuuccugccuuuuuccauggaauugagcucauacuaaauaauauaauuuccuacccaacucuucuuucucuguaucauauuuugagcaucucucauguuauaaaguuuuuccaaaaacuuguucuuuuuccauccacuuuuuaaacagaauguauuuuauauauguaauaggucccauucuuaaucaucauugucaagauaccaguuacucuccugcccuguggaaaguucuguuuguuuuuguuuuugagacagggucuugcucugucucaaaaacugcuggaguauggugguaccaucauggcuuacuuacugcagccucgaccuccuaggcuuaagugauccuccugccucagccuccugaguagcuggcacuacaggcuuaugccaccaugcccagcuaauuuuucuauuuuuuuuguagaaaugggguuuugccauguuguccaggcugguuuugaacuucugggcucaagcgauccuccugccuuggccuuccaaagggcagggauuacaggugugcgccacugugccuggccuguggaaagcucuggaaguaugcuaggguguucacuccuucacugccugcccucacacaucuugcuuuacuaguucugugcccuucuuugugucccuauagcauuuggauguagguaaagcauuuauggcagcuguccccaaccuuuuuggcaccagggacugguuucuuggaagacaauuuuuccauguacuaggggaggggagggaugguuuugggaugaaacuguuccaccucagaucaucaggcauuagauucucauaaggagcacgcaaccuagaucccuugcaugugcaauucacgguaggguucgcacuccuaugagaaucuuggcugggcgcgguggcucagccuauaaucccagcacuuugggaggccuaggugggcagauuaccugaggucaggaguuugaaaccagccuggccaacauggugaaacccugucucuacuaaaaauacaaaaauuagccaggugugguggugggcgccuguaaucccagcuacucgggaggcugaggcaggagaauagcuugaaccugggaggcggagguugcagugagcugagauugcgccauugcacuccagccugggcaacaaagcaagacuccaucucaacaacaacaacaacaacaacaacaacaacaacaaagaaucuaaugcccugcugauccaacaggagguggagcucaggcuguaaugccccuucgccccgcugcucaccuccuaagaggccggggaccccugguuugugggacagccucuuccacuagcuuuaagcuccuggagggcagggccacuagcaccugccauaccccuuaauacacuugcacauggcagggaugcccucagugucggcuggacugagcugaauacccucccccuuuagcugucacuucuugcugguacuggugugaccuugcugcuuccaaguuuaugaugaauucuacucaugauuuaaguugggccucagcauggcucugaaacuacuucugugaaaccaaauccuugaacuuugugacagaccuccaaaaaucugcauuauuucugggcuuacaauuuuuuaccccaaaucugccaucugcaucaguaaggauggugcuggagcuaauuauuaauagucacagcucucacugguuaagugccuacugugucauguacuguuaucuuuaauccuuaaaaugauccccaaagacaggcuuuguauuaccacuuuacagaagaguaaauugaggccauaagguugucagagcuggaaucugacaucucccccuuaccugaaucccaccccugucuuuaugacuccaaagcuucccuacacccuuucuuuuuuuuucuuuugagacagaguuucgcucuuguugcccaggcuggaguguaauggcgugaucucagcucacugcaaccuccgccuccuggguucaagcgauucuccugccucagccucccaaguagcugggauuacaggcaugugccaccacgccuggcuaauuuuauauuuuuaguagagaugggguuucuccauguuggucaggcuggucucgaacuccagaccucaggugauccacccgccuuggccucccaaagugcugggauuacaggugugagccaccgugccuggccaacacccuuuauuuuccaucacacugccucugagcagaaaaucauuagauauucauuuuccuaagaaagagucuucacuugaugagagauuuccuacccagggcuuuuguuuguuuguuuguuuggaaaccuuauagagcuaaugaaagugggaaaagagaaauguaaaauuacagaguuagaagcugcugcuaauagaucauucaacaauagagauaaaaguguccuagggcugggcgcggugaaaccccgucucuacuaaaaauacaaaaaauuagcugggcaugguggugggcgccugcagucccagcuacuggggaggcugaggcaggagaauggugugaacccuggagguggagcuugcagugagccgagauggcgccacugcacuccagccugggagacagagcgagacucugucuugaaaaaaaaaaaaguguccuagagaugaucauguaaguucaaagggcaagauaauggaugucagacaacauucggaaggguguuuagcagaaagcaagauagauccuuguccccaucuuccuagugcuuggccuaggcacuguugucauagccuuugacggcccaaagaaauccucccauuugaagauccccuggagugugggcaggugugugugaaucugcagugccaagcugggaggugcuggaggcugccaagcagacccagcuguccugguucucagauacuguucucucccggcccucaaaggccccccaggaccugcugcugaggggcgcacaguggccuuucuggguuuguggauggggugguggggcuggccauuacauccccaccucugccccacaguguuuucagguccagggccaggaaccccagagccgggugaaguggucagaggcacaguucuccugugaacagcaagaggcccagcuggucaccaucacaaaccccuuagagcaagguagggccagccuauggggagcccccaguauccucugacacuguccccccaaauagcuauagcagagucacucacaacugucuucuggggaccauagcauucaucacagccagccugcccaaugugaccuuugaccuuuggauuggccuccaugccucgcagagggacuuccaguggguggagcaggagccuuugauguaugccaacugggcaccuggggagcccucuggcccuagcccugcucccaguggcaacaaaccggugaggaugcccucccuguuccccuccgcaccgcgcugcccuaagccuguggggcugccuuugccccagcaucucuugccccagggucucccuucuuccagccucuuugcucacauugcagccuucuggggacaguagcacagggaggcagcugcuggggcuccccugagcagcucccuccccccagaccagcugugcagugguccugcacagccccucagcccacuucacuggccgcugggacgaucggagcugcacggaggagacccauggcuucaucugccagaagggcacggguaugugucaccagucaccugggaaaccccaguggggcccuggcaccgggcuggaugcugggaccaugccaggaggaaggaaucauggucccuggcagagcagggcucugcuugggaagcagaugggcagaaaggcaaggugccaauaagauggaaaagcaauagcacccacaggucucaggaggaagauuuggggguauggagggcucguugggucggggggagagcuagacgcugggcugcaugaagugcuggcacguguggcgucaaggacccugagguuccagguccaagacaccuccagcuccaugcguagguggccucugcgccggguuccuuggguaggaggaggucaaggcccucaccucccuguccauuuguuagcaaacauguauuauuaauaacaacagggcugacaccuaccaagccuuggucugggccaagcgccgagucugguggagaccgggucuuugccuggugugcggccuucuccuggccuugugccugggaacggggugagggaagcagagcccagccugaacccugaccccuucccuguagaccccucccugagcccguccccagcagcgcugccccccgccccgggcacugagcucuccuaccucaacggcaccuuccggcugcuucagaagccgcugcgcuggcacgaugcccuccugcugugugagagccgcaaugccagccuggccuacgugcccgaccccuacacccaggccuuccucacgcaggcugcccgagggcugcgcacgccgcucuggauugggcuggcuggcgaggaggugggcucccgacacuuuugcccugggccccagccuugcccggguuccccucccugccccuuccugcccccgccuuauccgcacccuauccugacuauucccuuccucccaccccauggccccccaugcccagggcucucggcgguacuccugggucucagaggagccgcugaacuacgugggcuggcaggacggggagccgcagcagccggggggcuguaccuacguagauguggacggggccuggcgcaccaccagcugugacaccaagcugcagggggcugugugugggguuagcaguggugagugcccaccugccagggcgggggcaugggcaagcugucgguggccccggggagggugcugagccacuucuuaauccuguacccccacagggcccccuccuccccgaagaauaagcuaccauggcagcuguccccagggacuggcagacuccgcguggauucccuuccgggagcacugcuauucuuuccacauggagcugcugcugggccacaaggaggcgcgacagcgcugccagagaggugggugaccaggccagagcccacacauggcgggcagguggcaccuccucucgugggcacucagacccaugaguacauccccacacugcucucuacccauaggcagcacuuacacaagaugcccucgugcucucacauguggagaccauacaugacacuauaugugcauaugcugcccccccacacacuugcacaugugcacacacacacacaugaauccacagacuccacaccauccucuacucaggcugcagagaagagggcuggagcagcucugggggacucugccccccccggagacccauccgcccugacgugggccuucuuugcauccagcggguggggccguccugucuauccuggaugagauggagaauguguuugucugggagcaccugcagagcuaugagggccagagucggggcgccuggcugggcaugaacuucaaccccaaaggugggugcccugugugugggguggagaggucaagccucaggcuguaaggggcugcccuccacuuugcccugagccuuguccuggggcuugucgggggacagggagucgguucuagaacacaccugcucuccuccaccuacuccugccccaccuugucccugcucccucagugccuucuuuccugcaggaggcacucuggucuggcaggacaacacagcugugaacuacuccaacugggggcccccgggcuugggccccagcaugcugagccacaacagcugcuacuggauucagagcaacagcgggcuauggcgccccggcgcuugcaccaacaucaccaugggugucgucugcaagcuuccucguggugagcgccgggcaggcccacgcucagccuccuuccaccccgugccgcugguccugggcuggggcugggggcugcuucacaacugcagggggcacagccgaugggaaggccugaacagaacggacugcgggcagcugggacccccgggauaaauuagucagugggauggacuggaccugaaacuuaucauccaaacuagaccacaaggcucgggggucagcaacccccugucacuuuguaguggucaagggcauggacagaguucaaguccuggccaugucacuuaucaguggugugaccuugggcagagucuguggccucaguuuccucguauguaaaaugggaauaauaguaguuccagacugaugugguggcucaugccuguaaucccagcacuuugggaggcugaggugggcggaucacuugaggucagggguucaagaccagccuggccaacauggugaaaccccgucucuaccaaaaaguacaaaaauuagcugggcgugguagcacaugccuguagucccagcuacuuaggaggcugaggcaugugaauugcuucaaccguggagguggaggcugcagugagccgagaucgcaccacugcauuccagccugggcaacacagcaagacccugucuccaaaaaaaaaaaaaaaaaaaaaaagucccgaccuccuagagugcuagugaagcuaguaaagaugaggugaguuagggaaggggcugacacccaggccucccacgagggcugggcugagaccuagcugagugcagcauggcguuuucccuuucugggggaaccugaagucuugucucuugggccugugcccccacaguaaccagagguaggaugggagggggaacuagagccucuuucuccccagaccucccggcccaggccugugugcuuuguauguuuacuuaagugauuauuacgaugaucacugcuauuauuaacuggcccccuccucuugcccacagcugagcagagcagcuucuccccaucaggugagugaaaggcaaugcccccaggugggcaggcaggaagcacugcugggccuaacgcccacuuggccuuucacgcccacucgccuuggcagcgcuuccagagaacccagcggcccuggugguggugcugauggcggugcugcugcuccuggccuugcugaccgcagcccucauccuuuaccggaggcgccagagcaucgagcgcggggccuuugagggugcccgcuacagccgcagcagcuccagccccaccgaggccacugagaagaacauccuggugucagacauggaaaugaaugagcaacaagaauagagccaggcgcgugggcagggccagggcgggaggagcuggggagcuggggcccugggucagucuggccccccaccagcugccuguccaguuggccuauggaagggugcccuugggagucgcuguugggagccggagcugggcagagccugggcugguggggugccacccucccacaagggcugggcugagacccagcugagugcagcguggcguuucccuuucugggggggccugaggucuugucaccugguccugugcccccacaggaaccagagguaggaugggagggggaacgagagccucuuucuccccagagcccccggcccaggccuguugauccgcgccccaggacccccuucuuugcagagcccgaggagccuccccuguccccucgggcagaucuguugugucucucuucccaccuggcagccucagcucugugccccucacccugcucccucucgccccuucucucccaccccuuccuucugagccgggcccuggggauuggggagcccucuuguuccugaugagggucagcugagggggcugagcauccaucacuccugugccugcugggguggcuguggggcguggcaggaggggccuagguggguugggccugagaaccagggcacggguguggugucugcugggcuggagauaagacuggggagagacaccccaaccucccagggugggagcugggccgggcugggaugucaucuccugccgggcgggggagggcucugccccuggaagaguccccuguggggaccaaaauaaguucccuaacaucuccagcuccuggcucugguuuggagcaaggggaaggguugccagaguccugggggccccagaggagcaggagucugggagggcccagaguucacccucuaguggauccaggaggagcagcacccgagcccuggaguggcccaguacccuuccaagaggccacagucccagccaggacaaaguaugcggcccauccuggugcgacagcgugggacaaugugaacauggacucgaagacauggcccuuucucuguaguugauuuuuuaaaugugccauuauuguuuuuaaaaaaaaaggaaaaaagaaaagcaaacaaauaaaacaccuuuaagaggcuugaaagagaagguucugccuuguccuguggugagccugcuucuucacgucugucccuucggagauaacuguuguuuuggagcuugcaccacagguguuuucugcagcuggccauuuugcgucugucucugggccucuaggggacacucucacccccgaucuuuaggagcucaccccucugggccugcgccucccucucucuguuccugggggcuugaaugugggugagaacucaggagccaggccaucugcugcugagcagccagccgugcaagcuugggcaacuuagcacaccucucaacaugugcacaguggggagaaccggacccaccuccuaggguuguuuuaaggauaugugaggaucaagggagcucaucugugcagagcacuuagaacagugccucugggcucugcaagcgcua

SEQ ID NO: 16893 - RNA, 26759 nt, Homo sapiens
agcccagaagguggccccgaaccugggccuuccuuugaagccaggccugguauuugccaagaucgugccuccugcccccacaucaccaacguuaacugcccuccauuagcuggugcugccugggugcugcgugggcgcuggcgugugaaauggcaacaugaggccgugucuacugagccaggcaucuuagugcuuuacacagagaagugaaaccuccuagcaacccugugaguuagguaccauuugauucccauuuuucagauaaggaaaccaaggcacaaagugguugguagguggacuaaggucacccaacaaauggaggcaaaacgggacacguguccccaccaggagccaccagcugucccuccuucuccaucccacagacugcgugaagcccugggcuacucuggcuggaugguaucaagugucacauucuguggagccaggauguuccuccaauccuuuaaucccaaaucuuuuauuguguuuguuuuguuuuguuuugacagagucuugcucugucguccaggcuggagugcuguggugcaaucucagcucacugcaaccucugccuccuggguucaagugauucuccugccucauccucccuaguagcugggacuacaggugcgcaccaccaagcccggcuaauuuuuguauuuuuuguugagacgggguuucaccauguuggccaggcugguuaugaacuccugaccucaaaugaucugccugccucagccucccaaagugcuggcauuacaggcaugagccaccaugccuggccuaaucccaaaucuuaaaccuacuuuuccugguucugccucuagugaaaucaaagaucccuccgcugcugucccuaugggaauguggacagggaugacaccucucgccagcucuggguggccccucuggucugguccuuugcugcccagcuccucaaguccuccucaacaccccucuucuccagcccugcugccacucuccccaccugaguacagacccucaucauuucccacugggcccccucuucucguccccccagucccucucccuaguccauuuauuuauucuauuuugagacggaguuuugcucuuguugcccaagcuggagugcaauggcgcgaucucagcucacugcaaccucugccucccagguucaagcgauuuuccugccucagccucccaaguagcugggauuacaggcaugcaccaccacacccggcuaauuuuguauuuuuaguagaggugggguuucuccauguuggucaggcuggucucgaacucccgaccucaggugauccaccugccucagccugccaaagugcugggauuacaggcgugagccacugugcccugccccuaguccauuuuuuuuuuuuuuaauugaucauucuuggguguuucucgcagagggggauuuggcagggucacaggacaauaguggagggaaggucagcagauaaacaagugaacaaaggucucugguuuuccuaggcagaggacccuguggccuuccgcaguguuugugucccuggguacuugagauuagggaguggugaugacucuuaaggagcaugcugccuucaagcaucuguuuaacaaagcacaucuugcaccgcccuuaauccauucaacccugaguggauacagcacauguuucagagagcacaggguuggggguaaggucacagaucaacaggaucccaaggcagaagaauuuuucuuaguacagaacaaaaugaaaagucucccacgucuaccucuuucuacacagacacggcaaccauccgauuucucaaucuuuuccccacccuuccccccuuucuauuccacaaaaccgccauugucaucauggcccguucucaaugagcuguuggguacaccucccagaccgggugguggccgggcagaggggcuccucacuucccaguaggggcggccgggcagaggcgccccucaccucccggacggggcggcuggccgggcggggggcugacccccccaccucccucccggacggggcggccggccaggcagaggggcuccucacuucccaguaggggcggccgggcagaggcgccccucaccucccggacagggcggcuggccgggcagggggcugauccccccaccucccucccggacggggaggcuggccgggcggggggcugacccccccaccucccucccggacggggcggcuggcugggcggggggcugacccccacaccucccucccggacggggcagcuggccgggcggggggcugacccccccaccucccuccuggacggagcggcuggccgggcagaggggcuccucacuucccaguaggggcggccgggcagaggcgccccucaccucccggacggggcggcuggccgggcagggggcugaucgccccaccucccucccggacggggaggcuggccgggcggggggcugacccccccaccucccugccggacgagguggcugccgggcagagacgcuccucacuucccagacgggguggcuucuggacggaugggcuccucacuucucagacggggcgguugccgggcggagggucuccucacuucucagagggggcggccgggcagagacgcuccucacaucccggacggggcggcagggcagaggugcuccccacaucucagacgaugggcggccgggcagagacgcuccucacuucccagaugggauggcugcagggaagaggcgcuccucacuuccuagaugggauggcggccaggcagagacgcuccucacgucccagacgaugggcggcugggcagagacgcuccucacuucccagacgggguggcggccgggcagaggcugcaaucucggcacuuugggaggccaaggcaggcugcugggaggugaagguuguagcgagccgagaucacgccacugcacuccagccugggcaccauugagcacggagugaacgagacuccgucugcaaucccggcaccucaggaugccgaggcuggcggaucacucgcgguuaggagcuggagaccagcccggccaacacagcaaaaccccgucuccaccaaaaaaauacgaaaaccagucagguguggcggcgcgcaccugcaaucgcaggcagucggcaggcugaggcaggagaaucaggcagcaguaccguccagcuucagcucggcaucagagggagaccguggagagagggagagggagaccguggggagagggagagggagagggagggagagggagagggagagggagagggagagagcuaguccauuuuuauacauggcucugaggaugcuccaaucugaccacagcuucuguucacuuagcgcccugccccggugucucaucaccuuggggauaaaauccacacucugagagugagugcaaaguccuuccuggcguggccucugccuccuccauuuccucaggccuugcucuaccacacaagucccucuauuagugccucccgauggccagcucccuggcagggcugauagugauaaaauguucaguagucagcaauaaagaggcaaaaacagcaacacugauuuauagauaugaaaucaaccagauguaucagccaaguugccagcauuccuuucuuggucacaauaucuuuuauuccaaacauccuuucuauuuauuuuuuguaguuaagauuuuauuacuucuuuuguaaaacgguggugagaauaagggacuauuuuuuuuaaauguccuuacuuggcaaacuaaaaaauguuugcaacucuaguaagacuccacugggagcucaggggcuggggugccugaucuggcccuaaagccccacgacacugaccuggugccugcgugauucuucuucauuguucccagacaggggccaggaaauggaaugaaagcagccacugucugaagagcuggagaccaucaucugccucuggaagcccagagaaccucggcucagacagaaggacagagacugagggaagggagagagacugugacagagaagcagaggagggugacagagucagggaggaacaaaacagccugcagugggagcagagacagaaaugugggggacccacagggaggggagggagggaaggggagggacggagggagggacaacugccguccaaguggcugugagagccuggggcuggggagaggcacccuccuccuguuggcuucucauacagucucuaucaggggacccaggacacaagaagcaaauucaucuuuggguccacccuucagcucuagaagucuagggccuggccagguccucugaaggggucucuggccccaggcagcuuccugccccccugcguggccccccaagcccuucucaagagcccuucaguaaauaaauucacuggaagacaucaaugaugggucauaggagguguuccuaggggagaaaaugacauuuaguuuuuagcucacuuggagccauuugcuuuaagaagcaccucuuggccaggcgcagugacucacgccuguaaucccaacaguuugggaggccgaggugggcggaucaccugaggucaggaguucaagaccagccuggucaacauggugaaacccugucucuacuaaaaauacaaaaauuaguugggugugguggcaugugccuguaaucccagcugcuugggaggcugaggugagagaaucgcuugaacucaggagguggaggcugcagugagcugagaucacaccacugcauuccagccugggugacacagugagacuaugucuaaaaaacaaaaaacaaaaacgaagcaccucuugagagagcuuugcaugcagaugucacaggcaaaaugccucauguuguggggaauguggcaguggacuucuggggccaggcugaggcccccacgugcugucccccuugggagcagggcaggguggcuggguugacagaugugcagagaaggagagaagugggggcaaugccuucucucugauggucagcuggcgggaaaggcuccaggggcuucugaggagagacccuaagaggacucuggaugggccucggcugggggaggcuggugcugaccuggcacgugggcacugugggggugcaaugggggacagugugggaggugucauggggggucuuuacacuggguacuaaagagcuuaggagccugagcuaccugguguggggcaaucacauuugcugcuguguccaggcaaggaggagcaggugggcuuggaccccaaagugacaugaaguggccaggacugagcgcugggccaacgugagccccagggggugcuuggauuuaucagcugaagaagggccuauggaaggggagaaaacaauccuccagacagaugagagcacucagucacauccaccuggaccugacaucaccucccaggcugugcaggggcacacacagaacuggaauggguaaugacuuauuagagccuccuuccaacagcugugggcccuggaaccuaagaacccaccuuuggagaacauuuuugggucugagagcuuugaggccaggccuugagacaaacccacccagaagcccugagcuacuuuugcuguaagaguaggagggcccugccccugcuccaggagccgccccuugaucccuggaagagaaggaagcacugacugauccagaggggcgaugaguccagaggcugagaucagcuggaaccgggccaccagcugagcgugugauuccucuggcuccaggccaccucugagggucucccaauggcugggagggauuagaggacuguggcuucuugggugagggagccucuggguuacagucaccgugcccuuugaaucuaaucugcucucgacaagaaucagcugaccugauaggcaugcucaggcaggaggcaauggccagggccaagagaagcauaaggauggaguagaggagggagcagagcagggucaggugaaaucucucacucaggacaauugugcagcugacuugcugauaccuuggaggagucacgaaguucagugugcccaguuggggcaucuuccaggcuguggcuccaucacccugcaguuuuggcucagaacagccaccacauccucacugcucuccugggaugagaagguggguggagaaccaggggcuuggugcguggccagagcuggagcagcuucaggagccaggugaaaccucagagccucacaggcuuugaacaaagugcaggagucccagcccugccauuuauggcggguuccuggcggugaucagucauuaucagcaguauguucacucugcugauaucacccaaggccaugaucaucccuuaccccaggccuugcacacuugcuucccuguccuagacagcuggggcuguuccugcucuucgcugccccuggcacucacagagcagcugacugacugaccuaccaacuuagggagaaaaguggggagguggggauggaggacacucuggggauacagccucuucgugauuuccuuccuggaggggagaggcggccagggcaaugcaaugcuggggcugcagugccuccgcucagccacagcacuggcugcagggcaaacccucaggaccagaugaggggagcucagccugauguccagguucgcuggcaugugagggacguggucaggcacagcuauagccaugggucuauggacgguuccuggaucccaggaauugcugguggggucccugauacacaccucacgucuucaaccucugcccucucugauggccuguuggcacuccuccugccuaucucugcacacucagcgacuuuccccuuugauggggacaggaguggaggagggcagggcaggauggagacaccauacacauuccugcucagugccuuugcccucccucuuccauccaugggagucaccuccccuagaccuucauguggccugcgcccccacuucucccucccagagccuuccuagugcccccaacaagugccugcccucgccugacgcccuguuuguccccuucugccucuucuucaugcugcuuguuagguugaaacauaacaucuguguuucaaaacacaugcagucagguuucugugcauguguguauguagauauagauuguggugcaaucucagcucacugcaaccuccuccucuuggguucaagcaauucucgugcuucagccucucgaguagcuaggacuacaggcaugcaccaccacgccuggcuaauuuuuguuuuucuuuuuguauuuuuuuuaguggagauggguuucgccauguuggccaggcuggucuggaacuccuggccucaagugaucagccugccuuggcuugccaaaguucugggauuacaggugugagccaccgcacccagacguuaguuuacuuuuuaauucccugucuacccacuucuuguaaguuacaugaaagcagacaccuugugugucugaucuguuacugucucuccagggccuaggauaagcaggugccaguaagccuuuguuggaagaaaggaaggagagaaaauggaccuccucuggaugggauccuuggcuccugcgugcugaugugcagccugugacccgggcucugcacugcuccucuggcuccaggcaaucaucauggaaagggcggccuccccagagggcugccugggaaugaacugggcaucuggggaagcccauuccuuuggcugccucuugccuguggcgcccagggcugccgugccaccuccuuugugaagcugguccccagcccugcuuaucagccccaugucccauucccuugggcccagcagagguaaaaguggcuaaguggcuuaacugggccaggugcaguggcucacgccgguaaucccagcacuuugggaggccaaggcggguggaucaccugaggucgggaguucgagaccagccugaccaacauggagaaaccccgucucuacuaaaaauacaaaauuagccaggcgugguggugcauuccuguaaucccagcuacuugggaggcugaggcaggaggaucacuugaaccacggaggcggcgguugcagugagcugucauugcacuccagccuggacaaggagagcgaaacuccgucuuaaaaaaaaaaaaaagguggcuuaacuguccucucugucauggccucucccucccucuugccccagugguauuuggcucuuuugucugucuuguuuuucccagacugaccagccuugggguuaaccaggggcagggugacaacucacaggcaaugacgucccucagccuccuuccccccacacuccagaggcugcaggugacucagggucuucgucgguggcuccggaagccuugcaggugcccugccacauggccgcugugcugcuggcugcucugacggguccugccggggcuacugcuuuccuguccccucccccgaagcugggagauggauuuccucccugagugauuaauuggucuauuuuaagcucaucaaaguagccucguacuuucaaguuccucagggagcaggcccggaagaugauaccugcggacuuaaggcugcuccacugcaggauauggggucgggggcugugucugucaauugugaggucccucagggcaggcccccuccugagcuggacagggcuuggcuccugagugcugauucugcaggcuguggcucaguucugcacuauuacucuggcuccggcaaauccucaugaaaauaagccugggagccccgaggguugcagguuagcccccuacagccuucccuugcaucauccuugcuccucuaaccagggacacuccugccuccucccugacuaucucugccggguuaacaccugagcaucuucuggcucgauaauucugucaugacccaauacgccuucccugacccucacaucuggguugagggccuuccuaugcccuguaccuaauccugguuuucccucuguaagguggucagagaugggcuugggcagaguaguuucaaaggcucuccccaaaucucugugcagcuccccugacugaaggccugugagaacaggguggugccugucuuguucacuguuccccaauaccucaccuagugccuggcacagagaagguacaaaaauaaaacuuucccaagaaugaauggugugcauuugaaucuuauagugucugaggacuggggaaccaucucuuaucccuuuguauccucugcugcccaaggucagggccucugccugaagucccuacugaaugaggguuaacugguucagagaugagggaggaagccauugcugggaggggcuagaacugggccccugcccuucccacacccgagcaagagcaguaggauugucagaugaaacacaggacaucugcucacaugugaggaauacaucuuuuuuuuaagacagauucucucucugucaccccaggcuggagugcaguggcaugaucuuggcucauuucaaccucuaccucuuggguucaugccauucuccugucguagccuccccaguagcugggauuacaggcauccaccaccaugccuggcuaauuguuguguuuuuaguagagacaggguuuugccucauuggcaggcuggucuuggacuccugaccucaagugauccgcucaccucagccucccaaagugcugggauuacaggcaugagccauggcacccagcuggaauacaucuuuaguauacugcauguaauauuugggacaugcucaugcugaaaaaacuaacugaauuugaauuuuuuuuugguuuucuuuuuuugagauggagucucacuccauugcccaggcuggagugcaguggcacaaucuuggcucacugcaaccuccgccuccuggguucaagcaauucuccugucucagccucccaaguagcugggauuacaggugccugccaccuugcccagcuaauuuuuguauuuuuaguagagacgggguuucaccuuguuggucaggcuggucucgaacucuugaccucaggugauccacccaccucggcaucccaaagugcugggauuacaggugugagccaccgcacccggccugaauuugaauuuaacugggaagccuuuuuuuauuuuuuccucuucuuucugaaucugguaacccuagcaagggagaagugacuagccaggugccaggugggucuacggccugagucuccagcucucuauucacauucugccugcuuccuugaugcuuccuccuccuuaaaugcuuucugucagagaccagggggcacucuaggccuggcugcccagcacgcggaauccaggagcacuccuaccuccuaaucccugccccagcugcccucuggauggucagggaaggccugaggaggugauguuugagcugagauuugagagaaugugaccagagaugauccaggaaagaacauuccauggagaggugggagugaacuuggugcaucugaaaacagaaaggcuagcgugguucugcgaugugggaagggaguggaaacauggaaacacagucagcauuuccuuuuuuuuuuuuuuuuuuuuuugagacggaguuuugcucuuguuguccaggcuggaguguaauggcgcggucuuggcucaccacaaccucugccuccuggguucaagugauucucuugccucagccuccggaguagcugggauuacaggcaugugccaccccgcccggcuaauuuuguauuuuuaguagagaugggguuucuccacguuggucaggcuggucucuagcucccgaucucaggugauccgcccgccucggccucccaaagugcugggauuacaggcguuagcacaacucaggaggcccuggaacucaucuugugccacucaagaaagggcaggagggguccucuccuuucccaccuuucccaagcugaaggacugcacacuucucaggcuuccaaggcaggagcuucggcagcaggaacaggguugcaagguaguuagucugggugucugucguccuggguugggacaucugggagcuggggcaaggccucugggcccuagugccagagagcaguuugguggcguugccuguucuuuaaaauggguuagguguagccaugagcccccccaugcagcgggugugcaggccucucccucagucagaacacccucacccaccccuccccacuugaagcaggcccuugagaacacugcuggcagggaggcggcugcucuuccuccuaagggaaaagccugcagccccgugcugcugggccguggggugagggggaagccaaagggccccuaucaccccucagcaggagucucuccuggcuuuggaaggggcugaaggcccggggcucucacgagggaacucagcccugcucagccggucaggacuccuccuccacgucuaaauccacagaccaaacaaaggacauggcucaguuccaccuucaauccacagggauucugccuguuagcacgcuaaggaaacuguuucuuacuuuaaauuauccauuaauuuccuccaacugaaagauacucuacaaauuuucuguuguuggaggguuuaagcuuggucccucugagggggugggcccugcugugucggccccuugugucugcucguggaaggugugccaugugccaccgugugccauaugcagcugacacgccugugcgucucgccuggcgcuggagacugcucucuguguacuaagcgaguacuggauccccagggccuaucuugcccacugccuguggcaauacacaggcaauacacaaagcgcauucaaguaagcaggucucccugccccccggccucccagaaccucggugccuggagggcaggugggggagggcguuccugaauggaggccgguuucccucugcggggaggaaaccccauuucccuccuaccccuaggcgcuugcuacaucuggcccggcaucagacaggaaagaacccuuucuucccagcuuguaggaagucugagcugggccccuuaucuacccacagcacuuccuggaccgggggccuggaccgggcuccgaaggggcuggcucccggucuuggucuuggccucggcgcccucguuucucugcgcuuugggcaggggaagcugcggacggcaagcucucggcuuucgugagagccugguggaaucgguguuccccgaaggcuacucugcgggggcgggggcuaguccgggccuucccggcaguaucgucucccccgugggggcuggggaggugcccccagggcucccggagcggcggcguggccaaggcccgaaccgggucugacaucuaguggccuccugggcccgggcagggcgagggcggggcagggaagaagguggagggcagaaugggaggcguggagcgagaaaaucaggaagcgcgggaccaagccggggaagggcggcgggucucgccccuggcacccgcucuccucggggcccgucccaucccccaggccuggccgaccccagguccuuccgugcgcagucggggcucgcaaggacgaaucccgcggcccucgaggcaggcccgggggagcucccggcccuccacccccgcaggccgcagaucccacgcacccccgaucaugggggccccggagggaggucgcgaggccgggcucacgguggccgcgguucgcccacgugcgggcccggagcuggcagggcccggucccgagcguggccgcaaccgcggggaccuggcacgugcggggcagccccgggggccgcguacgccacuuccggucccggagacaccgcccagcccgccgcccgguugccauggcgacgccgucgcgccacggcccgcagaaccggccaagcgacccgggcgcggcgcggggaggcugaagggacgcucggguaggcaagguaggaggccgggcugggggugggagcggagcgcgcaggggugcggggcgggggcggcccaggugagcccugacugcgcagggagggacagcgcggggcucccgaguagcagccggccucgcaccugccccuugcggccgcgcacuggacugcggcgccgacccgcacccugggcccgagggcugcagggcucgcccgcccucucggagccgagccucucccgguccaggcggccccugcccuggccugcccgggugccgggucucugcugaaguuagaaccgagacccccgcuugcuggugaccccgaguuuggaucuuugcuccugcgccgcguucuagagcaagguagggugcaaauggaccaaccagccuuugccacggcugcccucuugaaaucugaaaccggagccaccgccucuugccccgagcagggcccgggcugcaacguggagccgcagguccccgccugugucucccgacgcccccagcuucugagcgcgagggugggaguuucccgagugggaaagccccauggcuucgguggccucgguggcccuguggugggucaggccggugccaacugcgcugagggcggagcugccgccaccuugacaccugggagauggcagggccacccucccucccucccucccugcccuguccccgacuguaucacggagcgaggaucauccguguggaucugggguccccuucccagacuucuccuuucuggucguccuccucucauucauuccaccuuggcagccuuuguggauuuucugacuccguaaaugaaguuacaucuagggcgccuagauucugccccuuugguuuaauagcuaaugaaaaaaaaaaaaaaaaagcuuugccaccuccucuaggugccuggauuucucccggugaaauuugauggaggcaggaaaauacgaggcgguggcagccccaccuccuugcaugagggagccuccuagagcuggagguggaaccacccugcuugucccacuccuuuucuuucuugcuuuauugcuuucuugcuuuccuuacuuuccuuccuucuuuuuuuuuugagauggagucuugcucuguugccaggaggcuggagugcagagggcaauaucagcucacugcaaccuccaucuuccggguucaagcgauucuccuguuccagccucccuaguagcugggauuacaggugugugccacaacacgcagcuaauuuuugcauuuuuaggagagacgggguuucaccauguuggccaggcuggucucgaacuccuaaccucaagugaucugcccgccuuggcaucccaaagugcuaggauuacagacgugagccaccgugcccagccuuguccuacuacuuuucugcccucaccacuuuuccuuggcaggcagagcuugggcuccugcuaauacugggaugguucaguggcauuagauggcauugguggaggggaaugagaaauuaacccccucugaaagcguagcuucacugggaaaaagcacucuacugucugaacaauucauaaaugaauuuugggaauauacaaugucacagauuaaaagcagaccauccuguguucuuccagccccaggagcuucugcuuggugugcaggggcuaaugguggacagcaauggaguguagauuuauuagagacggcugccaucuggcucucuguggccccaaaccucaugugucagcagugugacucuuucuaaggugcucuuaggaccagauuucguuuuuguaagauuggucuuugauggaaugccuacuuuguggcaggcacugugcugggcgcuggcacaccuuuauccacuuacuccuucuguguucaauaagguagcuccagauauccuccacuuuauagauuaggaagcaggcuuggagaagggacuuggcuuguccaggagcugaugguuauaaauaaugagucuguuuugaaaucacaucucucuaaccugggcugcgcugggccuuucaugggccguuggcccucuggccuucacgggccccgucuuccauaaaaaaaauaauaacaauuggcccggcgcaguggugaaagcgcgucucuacaaaagauacaaaaaauuagccaggcaucguggagcacgccuguaaucccagacucggggagucugaggcaggagaauugcuuggacccggaaggcagagguugcggugacccgagaucuugccauugcacuccagccucaaaaaaaaaaaaauuaauaaaaauuauauuuuacaacugcauugguauaaauacaaguauaguccagacuggauuacaauuaauuuuaaaaacaaaacauuuuagggcuggcucaugucugucuguaaucccagagcuuugggaggcuggggcaggaggacugcuugagaccaggaguuugagacuagccugcacaacauagugagacccuaucucuccaaaaaaagaaaaaauuaacugggcauuucagcauagcuguaguuccagcuacuugagaggcugaggugggaggaucccucgagcccaggaguucgaggcugcugugagcuaugaucaugccaucguauuccagccugggugacagagguagacacuguuaacaacaacaacaaaaaaauuaauuaaaauaaguuuuaaaaaauugcaacauuuuccucaacccuaaauguucauuuuuuucuucugauuuucauggaaauggaaacauuuugguuuguaagcauugggagcccucugucuugugggagaaaggagcucaguguuugacuucaggcucugcugcuuccuggguaccuaguuccuugguaccugguccaagcagccuggauaccccgggucccugggcugccugggccaggacagccgcccuaggauaaauggaaaugcagccccugcggcuuguucacccuccuguaaugccuucucucuuacccuuuggucagggccuggugucucugcaugcaccagggcuuagugccaugcugguacaagcguggggaggaugcaggaggacuggcaugggauggggagcacugccugggaagccccuucuuccuggggcuacuggggugcuaagaaaguacccuaauagcucacaccacacuuugcuuucuccuucaucacaugcuaggacgcucuagggcaauugagcuguuuuccccuucacccaucaagaagagauaucggccuuuccgcagucacagucuuuccuaacucaauucaaacucugcuguugauaaggagggcuguagccagcccaggcugcccgcuucccagccuccccugcuccgccuuccgcccccgaggcugugcaccaugugcagugucugguccccaauaaugagauuagucuugguugccuuuuaauaaaacgcagugggcaccgggagggagagcgaugcuuggcucagugaagaucugcgggucaugcugucccuaaugcgcugauugcauuaaguggauucuggcugcagguagggugaguggguggggacgagggugacucucacagcucuaagauccagaaacugccagagaucugucacccucauccugagcugucacagaggaaggcaagugacugugugaggggcuacgugagcucccucugguugcaagguucuggucugcagggcaguggagcccuuggggguggggaguggcagcuuccaggccuugaagcugcugcccacaguucugcucugagaacacagagggcccaagaacagccggugucccagggcugcccagugaggagggaagagcgagagaguauucuugcugucaagacugggaaaugagggccacgauucaaagccuugcuuccuagggagaaaucucacccaauguccagguuugcaaaugcagcagacacauuugugggugggucagauucuguccagagauaccagaaugucuaucccuguacacccccaccucuggcaugggacagcccuucccugcacacaaauggguuaucaauuauguccaaugaauggccucacgagaguccuguugcggaagggaucuuccgcuuaucuccuguaaagcacagagccacgcucagaaccuacggacuguggucgccugcaggccagccaugggcuuuccuuucauccuuacacuuagauuuugaagccucgccuuugaaucagaagcaggcugcugucauuccagaggccgcuguucaucucuggcuuccucccagaugcccaggugccccgggugccugggcugccuaggccagggcacccgccuuaggagcaaauggaaaugcaucuuccucggcuuguuugcccuccuguaaccccuucccucuugccuucggucagggccugcugucuugcacgcaccagugcuuagugccaugguggaaccgaggcggggaggacgcaggaggacuggcacaggagggggggcaccgcccgggagcuuccccugcgucaaagcagcuuccucagugagcuccaacacagacccuugcuggccucagucucuggaaagacugacagcaccacccuaguuccugggccuuggaaaggccaaagccacgagcaggcagccacuguucggcaggagagcuagagaugcuauugcccacagacaucaaagcaggggugccgucuuccgugugcaugcugggacgggucuuggaggcccagauuagcuccuggcuugaacuuguaccacccuuaccugaaaauugggucuguaccaaagcucaucugcacgccccuuuagggcagggaccaggcccccucuguguggcccuagcaccuggccaagugcagguggcugcggguugaguugagcugcuauuugcugaugggaauuugggggccugucgcuuguccucuuugagccuccauuuccuggccugucaaauuggggcaaugcuccuguuauccacacagugucauuuaagggugacauuagagauggcaugaagugcccagcacagagcaggugcucacaggcuguuggguccccacccuacugacacaccaagcacacgucugcccugccaugguggggagcaaacaauguuaugguuccgacuccccgggaggccaggccgggcauuucacuguaggauguugaagccgcaggcagucgucgcugcgagaagagagccuggcucugauguccacugucuuccagggagccuggugggaaggaaggagugggcagcggccccucgcucugcgggccucuccugcccuuuguacuccacgaggugugaggaaguugccgggucacccagcagagggagaggugauguccccucuguucuuccuaauuuguagcuaaucagauucugccugcagccaggcucucuggggaugaaucuaauaaaggaggcggcgaccuggagaggaggacagacaacaagugaccaggggggacagcacuucuuucaguacauuuuccuguuagacucgggguauuagagacccaaagauacccaaggaggagugagagcgucccugccuucgaggagcagacagggcaccgcgaggguaaggaggcuccgggagagccuggggacagagugaucugcgcaccgcggugccugaggaguggaggcaggggugugggcccacagcagggagccaggcugggccauguccuuggauucugugagcccaggcgucuccucuagagggccuagcaggaacagugggggcugcagauggaaacgggcaggaucaugccaugcaguuggcauuucacuggcacucgggggcacuuacgcaggggacagcaugauguugggagcuggcuuugucccuggcaugucugucacguugaagagggagaagcugcaggcccugacuuggguggggcagugaggaugcucaggagggaagugaggggaggggugccagcaugcggcggccugggcagccuucuguggaggagcugaggugucaccugggcccggaagaagggcagcccugcuagcuaguggggagggcaugagagaacuuggcgacgaugggagagaaggugacuugggacgagcuggguuugaagcgucugugggauguccagguagagaugaguagugaaccgucagaaauggggcuugaauuugggguggcggggacagaacugauacccguguaggugacagauaaggacagaggcaggaguuccaaaaauaggauuuauuguuggcuggggcuucuggaaucccguauucccguccacccugggaauguggauuggagcuauguuucugggagaugauuugauggaaugugucagaagucuaaaacagaaccuagcccuuguuucaggauucccugcagagaaguuugcagaugaccacauccuguuguuuauuugguggaaaacugaaaucgaaagcuagcuaaaugcugaacaaugggaacuaguuggcuaaaaaauggccgugcaaugcaagagugugagguuacgaaaaugaugaugugggcgcguauccauugacacaaacauccaugugugcuacgcccucaguuaaaaagcagguuagaaaauggaauaaaugauccugcuucuauaaaaggaugcauauguguuuuaggaagaaggugugugaggauauagaucaaauucugauggccugucauuuuaccuuuuuugcugauccauauucuacugcagugcguguggauuauuagcacacacacacacccuuuuuuuuuuaauuaaaaaaaauuuuuuuugagacagagucucauucugucacccaggcuggaaugcaguggugcgaucuuggcccacugcaaacucugccuccugagcucaagggauucuagugccucagccucccaaguagcugggauuacaggugugagccaccaugcccggcuaauuuuuauauuuuuaguagagauaggguuucaccauguuguggcuggucuugaacuccuggccucaggugauccacucgccuuggccuccccaggugcugggauuauaggugugagccaucgcacccggcccacacacacacccccccuuuaaugguggaguugccaacaguuguccgauguggcagagagaacuggggagcagagaaggagcccaucacugggagggacugaaaaccagcuccugggcacugcagggcagagcgugugccgggugugaagggggucagugccccugugcuggccacugucccccuaguucugauacaguugcugccaggagaggcuggaccguggcaaggggccaguggggaaccggggcgggauggggggcagcagcagugcucuggggucugcuugugguggccauggugguggcaguugcaguggcaacugugggccauggcagcacuuuuccguggcgcacaggccgcugccgggugaggggagagccccgcuuguucuccuccugccgccucuccucccauccccagcugcugggugcucuccggccggcaugaagcugugcaggcacugggcacucccuugggcucuuagcggggccuucucauugcugcuucgcuaggaaccacccgcucuccuuuccuccuggagggccacguggggccgagcaccugggacagccgugcugagcucuacccggccccuucgcaggccucguuucugggggccuucaguuuuggaaaccucccugagggccccucuagagugcggguccgccccgccccugguguggaggggaagugcccugucccugugugcugacaggucccugugugcagcauggucggggcacuucuacucugcaggcgcggccgggcggggagcgggguggggggcgggcgggggcguggggggagcggggcuggcucuccugggugugggguggggaggccuccucaucgccagcauggaguuaaaaaccaggaugggggagggagacuucccauuucucccgagauguacuucaugacgcgucuggagaaaaggugugaccagccccuuccuucccgucaaggagcgcgcuugccuguguaacucaccuguaaagcccacccagggaaggccagggccucaugaaacagaaaacaaagccgggcacugggcccuugagcucacuagaauuugggguaucuuuccuugcacccucaccgcauauggaacuccuggcgucgugucccaggucacgccuguccccguggggaggcugggccccuccccccagccacucccgagacuugagaccucugccucaggacgaugggugggaaggggcuugcggguaggagagcgagcgcugcuuccagcgggagccucgggggaggguggcggggccgccgugggaggagccgcgccgcaucucaggcgcagucucuaggggcugugcgcauccgugggggggacaugcgcaucucaggggggcugcucgcaucugggggugcugugugcaucucgggggggcugugcccaucuagcgggguggcugugcgcaucuggagggggcugugcgcaacccgggggggguguugcgcgcaucuagcaggggcggcugugcgcauuucggggggggcugugcauaucuggggggaccgugcuuaucuccgggggcggcugugcgcaucuugagggguguguacaucucggggggccugugcgcaucuuggggggcugugugcauccgcgggggcugugcgcaucucggggugcugugcgcugcuccucugagcucugcucuuucuugcagcguuugccucagcauggagggcggggccgcggcagccacccccacagcacugccuuacuacguggccuucucccagcugcugggccugaccuugguggccaugaccggcgcguggcucgggcuguaccgaggcggcauugccugggagagcgaccugcaguucaacgcgcacccccucugcauggucauaggccugaucuuccugcagggaaauggugagucccaugggccgcuccucuuuucccgggcuugugggggucccugagaggcaguuugcaggggucuugucaccccugcggucucuucugguuggacaaaucuaagauucuagaaaagacagagacagaagcugguucagagccuggggagauggaauccaaacccaggcucugagguuggugaguggcagcuccucuccagccugguccagcauuuucaccucguuuccacacacagcauccaaggcgggcacuucuugcagcagagggaaaggaaugaggcuccgagccaggcccugcugcaggggugguuugaauugagggaaaaaaaguaaucauaugugagaguuuguaugcgugcgugcgugcgcgcgcauguguguuguuggucuuggacuuggcagagcuagagcgccucccccuggggcaggagcaaggcagugcuuggccuccaccugccuccaggccagggauccaggaagcgggaucugcauccgguugacccgcucuuccuagaggugguccuggugacagccauuccugagcagcagaaagcuaagaggcauuccucacgugaccuggccuugcccaccucuucuggacgcgggagaucaggcugggaucacaagguucugcuugggagccaggcgccugcuugcuaggaguaggaccaucugcccaggcuuaggugggggccugugugaggagccacguggcuaacaggugaacucagaggcugcuuguugccucagugugaccaacaguggaccucaaacacagccuggaauuugcaggacaccugacaagaagguggguggaggggggcgucugcugggccgggcagcuccuuuagguggggacgagggcagaggcgcugccuucacugccuguccuggugguggggacuguggugcagccuccggcccugcccucuuugugcacagcugggggagguuggagggugggggagggguguuaaggugcacacagcccuaggugcccucagagaaggccaggagcugcccaggguccccagggaaccuggcuuucuccuccgguuccugcagcuaggcuccuguuacaagccgucagcucacaucaccucuccaccaaggugccuccuugcugcuggggcaggaggccucacgcacaggcggaugcacucacguucccucucucaccucccacagcccugcugguuuaccgugucuucaggaacgaagcuaaacgcaccaccaagguccugcacgggcugcugcacaucuuugcgcucgucaucgcccugguuggugaguucccgggcgcggccuuccccgccaccugccugccucuucagguauggcaaacagccgcuucaccugcucuguucccuccccagagcugugaugggcccgcccccaccccaaacauccccugcagggccacuaggugcuggcagcccucgagcugggacuaaagcccagaagucccgcuagcugguuccccugggucaucuuacaccuuccuuuuccacauccaacccuguccucauaugaccugucucuggcccaggcuugguggcgguguucgacuaccacaggaagaagggcuacgcugaccuguacagccuacacagcuggugcgggauccuugucuuuguccuguacuuugugcaggugaguccuuccaacaccccgggccuggggccaccuaccagggaggugggaggaggaggggagcugggcugaaauguaccucauggaagggccugauuucuggggugugugcaggugagagagcugccuucccaggccugugcgggugcaaagcuaggauuggcggccaagggugcccagcucccaggcgccccauggcugacucagcacuuuuggccacaagcccagcuuucugagugugccaaggccucaagcguugggggaccggucccuugucccuaagcgcuuagugcuccucccaccacugugcugaggaggaaggaaaccaggcagggcugaggggcucacagucgccacgugggcacgugggugugggccuggccgaccucggcugcugggguguccggccgcccugucccggaaccgucuccuuucaaauccuaguggcuggugggcuucagcuucuuccuguuccccggagcuucauucucccugcggagccgcuaccgcccacagcacaucuucuuuggugcuaccaucuuccuccuuuccgugggcaccgcccugcugggccugaaggaggcacugcuguucaaccucgggugaguguccugggugggagagggcagggccugggccacccuugcacagaccucacccugccuucagcuuccccagcuguggcuuccugagccgccucucguggcgucacaacugguggcuguaguuaugcuugcuaagauuugggugcuuggggcuuggcuuugguuagcuuucuugauuuuacccuuucaaagaaacuucugggcuaugggcacccuauuuauucccaccacgcagcaggaucugcaggacaacugcuuagagcuagaauauugaucuagguuuuuacauugcccaucucuuuuugucugugagccauagcuggagauugcugguugggggcggggggaugguuguucucuucaggcagggcagggaggcaggggcuggugcuggaauccccauggcaucuuuaaggcccaggauacaaagggcauuuggccuaauugugaccccuugggcagcuucucccuuccucucaccccugcaggggcaaguauagcgcauuugagcccgaggguguccuggccaacgugcugggccugcugcuggccugcuucgguggggcggugcucuacaucuugacccgggccgacuggaagcggccuucccaggcggaagagcaggcccucuccauggacuucaagacgcugacggagggagauagccccggcucccagugaugcgcccggccggcccuggggguucgcggggugucuucuugccugccccugcugaggcgucuucaggacugcaggcuccggagaguggcucuggcagcaggcgggcgcgugggugcagcugcaucuguuugagugcugcuuucuggggucaggucuccgccuccucugcuucuccuuucuccgcugcuauagaccaguucauuguguguggcucccgugucucuguugcccccuucagugcagaaggcuuuggguaggacuucggguguucgguccuggucgcagagcacagaucuuuaaagaagcgagagaggaggccccacccuccuggcagcagaugccuggggcaaggccaggggaaacugggggggccucagggacaggccuggaaaggccacgauggcugcugaauucaaacaaggagucccuccagccugaauaacacguggcacaaaugggcccggccuuuggcagaggagcaagugauaugauguguaaaguauguugguggugaaagcaagguuccccaggagaggggagggacuggccccugggaagcucugagaugaggcuguggcccagcuguaguccugaccuuccucuucuuuaacccuuuagcccuaggauggcuuuggugggagaggggauagaagcccaugacuucagacagacuuucucuuggcagaugcaggcgggccuccucccaggcugcuccagacauggggguuggggauggggggcaccuugcagccccuuccugcuggggcucccuccuuguagcaccccccuugcggcucagcucugguuuccucucccaggcucacccaggcucugcucaggcugggaggcagagggcacaaaccuuauaauuuuuuaaaugaaaaaccgcugcugcuggcuguggcuagagcccccuggggcugcuggagcugcugccucuguucuggaggacgagccuucuccuuaucugcugcccaucuuuccaggaagucaggauggagucagaacaacuacagucaucccccguggugucugcacaucacuccagccccauaaagagugucauguuagcugagucaccauuuggcuucggccuggaaauagugugauuagaacacugaucgugugcgaggccaggagaucaagaccauccugacuaacaaacacagugaaaccccgucucuacuaaaaauacaaaaaaauuagccaggcgugguggugggcgccuguagucccagcuacuugggaggcugaggcaggagaauggugugaacccgggagauggcgcuugcagugagcugagauugcacuccagccugggcgacaggcucaaaaaagaaaaaaaaaagaacaccgaucaugugcuucuuggaucuggugacuguucucucccuguuuuccuuucuuuuuggguguuugaggagcauggcuuagcuugagacacacacagacacuguguacuucagugaagggcuuaauauacaguuuccaaaccugacgacucuucuucuuguaauggcugcccuuuuccuaccugaggccgucuuagagaaaggggccagucuccucuaaugcucagauuucccauaguuggcuuuugcugugucuccugccucaggcagugucauuucugggagcaggugguuguaguccaggccccuccccagcagggucugcccaggcuccuucgagccccuuuccccgccuccucucagccuguccggaugacaguguucgccuccuguuuagacuguacacucuucagggguaggggugccgucaguucuucaaucagcuggcacacacuuguauagugaaauguuuacaugugggaaaacuccgccuuagacaaacuaccaaaguacaaucgugucucucucuagccggaaugcuacagagagaaauggaaccuuagauuugcaacaaaagucuguaaacuggucuguuugccaaagugaacacuggaugacuaaggagcugaagaaggcccccagaagcggauuugugguggguuauuuuauuuugccuguggccaaucuucugugaaauacaaugugcuguuggugcaacagaugauucaauaaaugucuacagcagaccucu

SEQ ID NO: 16894 - RNA, 43856 nt, Homo sapiens
cggcuuccguuccgagagggcggggcggcgucccaaaacggaaggugguugucguccguucccaagcugguuugaaacuaggggucgggcucggccgucgucguuguuugucgccgcauccccgcuuccggguuaggccguuccugcccgcccccuccucuccucccuucggacccauagaucucaggcucggcuccccgcccgccgcagcccacuguugacccggcccguacugcggccccguggccaccaugucccugcacggcaaacggaaggagaucuacaaguaugaagcgcccuggacagucuacgcgaugaacuggagugugcggcccgauaagcgcuuucgcuuggcgcugggcagcuucguggaggaguacaacaacaaggugggccgggcaggggcucggaacccagcuggcggggagcgggccccgggagcgcccuuuccgggccggagcccaggccucagaacccucuugcggacucgcccuagggccacggagcgguuccucugucuggcccugugcugaagguuucguacucguugucugucuccuuuaauccaggcagcauucuuguguagucggcaguguaguggggaaacugaggcacgguuuugugacuugccugggucaggcagcuauuucgggguggaaacaggucuuaaaaccggguuuacgccccaaagauacuccauuuauucaucccgugcucuccacuccugccgcauugcuuucguuggugggcggggaagggaagagagagugauagcugugaaggaaaaugcaggcgcuucuauugguggucgugcacuccuggccacacuagauuucuauuaagacgaucuauuguacaagcuuccccgcccccuacucccaccccccccggguacucauggauccuagcccuucugccagaauuacuguugcucuugcuuccugauauccauucucucuaaagcaaucucuuuggaaaucuuggccuguggcaugaucccgccguuguuuccugaacacagaaggaugacagggccuuaucucuuggcuuguuucgugcuaguacaguugugugaccuuuaguaguaagucuugcuggacauacaucaauuugagaauccuuuauagaagcacgguguaguaggggagcuuuuaaacuggcauugcaacaaacucauuuuugaaaguugaauaagucaguuggaagaauuuucuuucuuccuuuuacucaaaguugugaaugauagcgaucagagcaacugaaagcuguggcuagugauauuuaaagccacuacuccugcuuuaugccaugaacaucagauuuaagaagaguaaaacuggccgggcgcgguggcucacgccuguaaucccaggacuuugggaggccgaggcgggcggauuaccugagcucaggaguucgcgaccagccuggguaacacggugaaaccccgucucuacuaaaauacaaaaaaaaaaaaaaaaaaaaaaaaaaaaaaaaaaaaaaaagccgggcguagcuuagugcgccuguagucccagcuacucggaagucugaggcuggagaauugcuugaaccugggaggcggagguugcagugagccgagauggcgccacugcacuccagccugggcgacagagugagacucugucucagaaaaaaaaagaagaauaaaacuguucagugacaaggcugaugcaggggggaagaaaccaggugguccugucugguuauugacuagcugugagauguugcacaggccuguuuuauuaucugugacccacaguuuguacggaagggguucugguuuacaugugagggucuuguaaaaaagaaauuugaacauuucacaguuuguuuacaguuuuucaggagcacauuuguuucucuagaguagguccucuuuggaguccacuuugagaagcugaugaaagcuauggauucucauuguccagacauuacacauacaugaacaauuuacaaacaaauccaaggaauaugcacugaucuuuaaguccacccauugcccgggcgagauagagcuuucuuuccucuguugcuucuuucuuccuuauggcccauaguggacagcagaacuggaaaugggauucacgauucugauguggacaccguguuaauaaaauuaagaccacuagaacuauuguuuaaagauacacguggaaaauaaaaaaguaugucuuucaaagggcuuaagucuuuuuacacaaauuaauguuuuuucuuguaaguuuuuccagggucguuggguaagcaauaguuacuccuauuccucagagaggagaaacugagccacaguuaggcugcuugguaggaucaguggaguagucaaacugcuguugcaggaacucuaccccaguuuguccuuucauuuagcaacuaucuggagcuuccucuuugugacaggcacacagguagcauggcuuagcagugaaaugcaaacuaauaaccccacuaucaacagcauuagcaguuaacuauaucuuaacucacaugauguaggcaaugcgcugucuuaaaaucauuuuugugccuccaccuaucaguagaucaggguucuuaaauucugugugccauggucaucugauaccaauagaccccuucucauaguuauguuuucaaaugcauaaaacacauagaauuacaaaagaaaccacuuauguugcacuacagauauaaacaacauguuuuuuaaaguggugauguagucauauguacuuuuaauaaauuaacuuauugauuuacaccauccacuguaauuauuaauguaauuuugaaauggugacaaggguaaacagcauuucaagaugcuuaacaacugugcuguggugggaaaaaaaaauucucuugcuggcaaagucacagacagucauaccacugugagcaccugaccccauuuguaauugaaggaaacaaaaaaauuuagcuagagguuaauggaaauauggggauaauuuuccaauucaaguucacagaccccaaguuaagaaacccugcgagagagaaguauguguagugguuggugagcagcaaauccugccuuaaagugauucucaggcuaaguuugugagaaacccugccaaagagguggucgacuucauaauuuggaggaacuuuagaauuauugguuggaauuuuuagaccauugguuccugcuugccauggauaguggucaccagcagaggauaaaguaaaauggacacagcaaauuaacacugaugaaaaaggcuagaaguggucaucuuuuuaguguggagacauucacuaagaaaacaugguuguaauuuuuaaaaauuugcauuagcauaaucauguuuuccuaacguaaaauuguaccuaguugauccauagaauuaagucuaucaacaguuuaagaaauugacuuccagguguuccuucaugugaauaaauuugggaauuguugcagaguaaagaaacagauucuaucaacuacacuuggaauaaaaagccccauuauagggcugggcgugguggcucacaccuguaaucuuagcacuuugggaggcugagaugggagaaucgcuugagcccgggaguuugauaccaaccugggcaacauggagaaacccugacucuacaaaaacauuaaaaaauuagccagguaugguggcaucugccuguaguaccagcuacuugggaagcugagguaggaggaugcuuuaagcucaggaggcagagguuauagugagccaagaucacgccacugcacuccagccugggcgacagagccagacccugucucaaaaaacagccucauuauugguuauuauguuucuaccuucuuuuguuguggucucuugagggauacagcaagauugguguuggagcaacagguucucuaaauuuuagugugugagaauccugagggagcugcacauuccugggcuccaccccugaaguuaacagacuuggagauaggugacagacacacuagugguugagugguccagauggcacucucagaacauggcccuggagcugccuuggcaucuguuggccagaggcgagaaugugaucuuuuugugucugcaugcuccuaaacauugguucugcccuuccauccaaguucacccaugaaaaaagcucugugauuagccuggguuaucuaaguccugccacuucccaguuuuguauugccuugggcaaguuauccucugugucucaguuucaucaucuguaaaauuagggcaauaaauaauaacaucuaccuuguucaaagauuaaaugaguuaauauauguaauggacuuaggaacgccacccgguguggaauaagccauauagagauguuagcuguuauuuaauuauuaucauuacuguaccuguaauugaaauauaaccaaagagaauuauauggcuguuuaguaaauuuacuuuuguauuuuccagaaaggauucaggaauaagaggucagaaagguagcugaaaaggucauuauuucauucucugccuuuuaaagacucuggggggaaaauucccuuaucucuuucaacccaacucauuuuguagucuagcagauucuuauagucagacuccaaguaguguaauuuucuaguuuaaauccauuuucucuuguucuaccuggcuuaccuacguaagucagauauaagaauuuggcauuucuccuguguuuugacaauauguuuggucuuuaggcccagguguuauuuccccucuuuuauugggaaaagcuggguagcaguuccugggcuucuguuccacuuaagugcauguuucaggguugguuuugauaaagauggcagugugauugggauuuaguuugccccaguauuuaacugacuacuugugcucuaagauuuggcauccagagaguauuuuugagguucugaggagagacuguagguauaucugaugcuuuuuggagaauccuaguagugagucuggguggcaugaccaccuuguacuugaaacacugggauggguacucaccucaccagccuguguugauuccucugagguuuuuaauacaauuacuuuauauguuugaugcauaauuauuucgacuccgguauuuaauuuuucaucuugguauuugcgguagcccuucaggauuaucauucauuugcucauuaauuuagccggucuguauugaacacauacucauguguuuuaggcacaauguguuuugguacacaucaguacuuuugauagauauuuagaaugucgcaguguuccacgagucccugucaagacugucagcaggggaauuuaagacauaaaacucuucugguuuuaacuuccuccuuuuucuagacagugagaggacucauucccuguugugaccacuggauaaaagugauaaugcuuuaaaaaaaaaugcuacuuuauugcuuuuuguccuaaucuuguucacauagacuuauuggagaugcugucacuugaacaaggagugaaucuaugcucuguagguagccuggcuugccuaaggacuugcugccaaagcucucgcugccagagcucucuggucagccucugagccacgagccaaaggugugcugugccagaauucaucuuaaaguuuaauagggcaggaccuuggguaccugcagacacugguccuugguaaucagucaggaagaggcuugaagagaaagcaaauagaaaagaccaggaaaagcuaguguauauucucagaauauuguguuagccgauuuuuguuuuauuaacaauugugggaaaauguuccagugacuggaguguuauguugauuuggauaacuugggagcuuauuuuaaaaauuacauauacauacacacauucaccuucuucuucugcacuaggacuguguguguuaaaguggaauauggccaggcgcaguggcucaugccuguaaucccugcacuuugggagguggaugcaggcagaucaccugaggucgggaguucaagaccagccugaccaacauggagaaacccugucucuacuaaaaauacaaaauuagccagacaugguggcacaugccuguaauccuagcuacuugggaggcugaggcaggagaauaguuugaaccugggaggcagaaguugcagugaacggagauugugccacugcacuccagccuaggcaacagagcaagacuguuucaaaaagaaaaaauaaaucagggccgggcgcaguggcucaugccuguaaucccagcacuuugggaggcugaggcuggcggaucacgaggucaggaguuugagaccagccugaccaacauggugaaaccccggcucuacuaaaaauauaaaaauuagccagaugugguggugcgugccuguaauccaagcuacuugggaggcugaggcaggagaaucacuugaaccugggaggcggagguguggugagccaagauugugccacugcaccagccugggugacagagugaaacuccaucucaaaagaaaaaacaaauuagcugggagugguagcaugcaccuguagucccagcuacucaggaggcugagauggaaggaucacuugagcccaggaggucaaggcugcagugagccaagaucuugccacugaacucccgcuggggugacagagcgagaccgccaucucaaaaccaaaaaaacaaaacaaauggaaucagcacaauagcuguagaaagaugcuauuagaaaggauggggggaaauggaaaauaaguggcagauaaaguacccauacuaaaaagaugucuuuagcuugguugaaaaauaauugucaguccuaccacugugaguucaaagaacuuaagaaaauacagaacuucaagcagagauauagaggauuggguaaaauaaggcauggcaaagagaaaauauaacaucagcuggcagagcacacaggaaaguaguggaagagaaaacuaaaauuaucacaggauuaaaagccacauuggaaacagaauaaaggcugggcacagugguucacuccuguaaucccagcuacuugggacacugaggcaggagacuuacuugaaccugggaagaggagguugcagugagccgagaucaugucacuguacuccagccugggugaugaagugagacugucaaaaaaaaaaagaaagaaagaaacagaauaaagaugaacacacagugcugaaaacaguaaagguuagggaggacagauugaaaaaugaaacugaagaaaacaaugagaacauaauagaugcagaaaguaaaagagaucugacguaaguauaauuggugucccucaagaagaggaccaaagaaaugaaacaaacucaaauauaugguuaaagaagaacuuagaaguaaagauuugaagugauaaguucaaauuggcaugauuugaacuugccaaagauuugaagugauaaguucaaauuggcaugaagugauaagaaaaauuggcacugaacaguuggcacugaaacauuuccuaggaaaauuucuuuuuuaaaaaauuuaucuuauuuuucguguguuuuguuuuguuuugagacagugucucacucuguugcccaggcugggugcagaggcaugaucccagcucacugcacucuugaccuccuaggcuuaaucgauugucccaccucugccucccgaguagcugagacuacaggugcacaccaccacgcccgcuaauuuuuguauuucuuguagaggcaggguuuugccauguugcccaggcuggucucaaacugugggcucaagugauccacuaaccucagucucccaaagugcugggacuacaggccuggcacagagccuggcaucccuaggaacauuucuauguuuuaaggaugaagaaagaauuauuuggacacccagacaaaaugaucaaguccucuuuaagaggggaaaagaaauuaggcuagcuacauuugaugacagaaggccauggagcaaugucuaggaauguacaaauacuguagauugugcugcuauaaauacuuggggauauacuuaggcauauguaagguuuauguggaaauaauaaugcuggggaacacaaaacaauacucgaaaaaugggaagguauucucuuuucuuguauaguaaagcuugguauccuaaagaugucagugucccuaaacuuaauguaaucccuguuuaaaauaccacaguuguuuuuucuggagacagggucucgcucugucgcccaggcuagagugcaguagugugaguauaacucacuguaaccucaaacuccugggcuuaaucaguaggugucucacuauguugcucagacuggucuugagcuccugaccucaaacaguccuccugccugcccaacccaaagugcugggguuacaggcauaggccaccauaccuggccaaaaauacuccagauuuuuaauaaugguuuuuuagaaccaggcaaacugauuguuucuacagauaaauuuuacaaacaugcacacauugucaaaaaacuucugaaaagguggacuaaugauggauauuaaaacauaaugcaaagauauaauaaauaagaucguuugauacucuaagaacugauguauaaacagagucuagaaaugaacucagaauacaaaaagaaauguagucugugcuaaaggugauaggaaaugaagaaaaaauauuuuuaaggccaggcacaguggcucacgccuguaauuccagcacuuugggaggcgggggcaggcagaucacgaggucaggaguucgagaccagccuggccaacauagugaaagcccgucucuacuaaaaauacgaaaaauuagccaggcaugguggugggcaccuguaauccucgcuacuugggaggcugaggcaggagaaucacuugaacccaggagguggagguugcagugagccaagauugcaucauugcacuccagcccgggugacagugugagacccauauauauauauauauguauauauauauacauacauauauauacguauauauauguauguauauauauauguguauauauauguauauauauauguauauauauguauauauauacguauauauauauguguguguauauauauauauauauauuuuuaauaauugguauugaaaccagaaaaaaaaauuggaucucuaccuuaagcuuuguaccagccgggugcaguggcucacaccuguaaucccagcacuuugggaggcugaggcggguggaucgccuaaggucaggaguuugagaccagucuggucagcauggugaaacccugucucuacuaaaaaugcaaaaaguagccgggcaugguggcaggugccuguaaucccagcuacucgggaagcugaggcaggagaaucgcuugaacccaggaggcagagauugcagugagccgagauggcaccauugcacuccagccugggcaacagagugggacuccgucucaaagaaaaaaaaaccuuguaccagaauuccagauaaauggaagaauguaaacauauaacuguaaaacacgggagaaucuuggugugagaaagccaugaaaguagaaguaaacuauauaaaaauaaaaucucuguaacaaaaccaaagucaaaagauaagugacaaacugaaaaaauacauguaauguccuagacaaagaacaaaucccuuaauaacugcauauaaagaucugcaaaucaccaggagaccagucacccaguagaaaaagagaaauagauaggaagaguuuccagaaaggauauguaaaugauucuugaacguaugaagaacugaaccucauaagaaaaaaaaaaaauggaguuucagcuagauuaggaaaaauaaaaaaccgugguaaucuacuguguguguguguauacacguauguguagcuuucccaugcaguugcuaucaaaauuuaaauuggcauuauuuuccaccugguaguuccgcuagugguaauucauccuacagcuauacucaugugguugaaaugacuaaagugcaaggauauucauuuuagcauuauuuguaaaagaaaaauaugaaaauauuauuauuagggaaauuguugaauaaauuaugcuaccuccaugcagcuguuaaaagaaugagcuagcuuuucauauacugauauggaauauuuuaaaauaaauauucgguggaaaaauauguagaagaguaaacaccuguguuuuuuaaaagcauaugcauauacauauguacacccauaugugguuguguguagaagggauacacaagaaauugauaacauugauuuuuccagggaaagggacugggauguaggggcucuaauuuguacuguaauugcuuugcuuuuaugccuuucaaaauuugggccuuguguauguauuaccuaguaagaaaguuaguaauaaaaaagcuaacauuaauaaaaauuaaaucuuaguagaacuucagaaagaggaauaaacagaaaggaaugaaugaagaagcacuaggcauauaguagcaagaagcaguucuuuuuauagagaagaagucaggcaugauaauauuaacaucagauaaaauucaaggcaaaaauguugaaacaaaaggaaauauuuuacauguuaaacauacaggcugggcgugauggcucacaccuguaauccccacuacaggcugggugcaguggcucaugccuguaaucccagcacuuugggaggcugaggcagucagaucacuugaggucaggaguucaagaccagccuggccaacauggugaaaccuugucucaaaauacaaaaauuaguuggguguaguggugugugccuguaaucccagcuacuuaggaggcugaggcaggagaaugacuugaacccgggaggcggagguugcagugagcugagaucacgccacugcacuccagccugggcaauagagcaagacucuaucucaaaaaauaaaaaagaaaaguacaaccgacuaagaauaaaaagucauaagucuuuacauaucuaagaguauagcguuuaaauagaaagcaaaaauuuuguaaauauagggagaauuugguucauauguuggaaauuguuaagugaaguagacaaaacaaggauauagaggguuagaaaauuacaguuuguucacaccuguaaucccagcgcuuugggaggcugaggcuggcagaucauugggcccaggaguuugagaucagccugggcaacauggugaaacuccaucucuaucaaaauauaaaaaauagccagaugugguggcaccaugccugugguuucagcuacuugggagggugaggugggaggaucgcuugagcccagaaggcaguggcuugcagugagccuagaucgagccacuguacuucagucugggugacagagugagaccccaucucgaaagaagaaaauguguuauaaguauagagagcuuugcauucaacggaaaauucacuuuaaacaauaacccaauuuacaaaaacuguguauuuagaaaaaaaauuuuuuuaaguugaaaucaacugauuggaaaaaaaaugcuacauaucaaaacuuacaggaaggugaggaaccugaagcucagcuaugugcuaaguggcuugcccaaagucauauaagggguaaaggagggccagaacuagagugcugucugucuccagaguguucagaauaaauguaugucaauguccaaaaaaaaaaaaaaaaaacuuagggggaaaaagaacauguugaaaaacagaggaacacuuacccuaccagauuagaauaaacauacuggaauugauauagccagagagauagguggaacugaauagaauauuucaaagacaacuuuaguauauauaaaugugaaauaugugauaagauagaacuguaauucacuggguaaaagauuacaucguauggcacaguuguucaucuagcagaaaaauuuagaaccccuaauucacaguguaugaugaaaacuaauuccagaucaaacgucuaauuauaaaggaaaguccacaaacauuauuagaaaguugaucaggaaauuugucaugaggcagugggggugcgcacggacacucauuaauuaauuccagagucaacaaaggaaaagauuggcagauucuauaguacauacaaauaaaacauuucucugugaaagauaugccauggacaaagucaaaagacagcagaaaauauuuucuuuuuuuauuuuuuauuuuuuauuuuuuauuauuauuauuauacuuuaaguuuuaggguacaugugcacaaugugcagguuaguuacauauguauacacgugccaugcuggugcgcugcacccacuaacucgucaucuagcauuagguauaucucccagugcuaucccuccccccuccccccaccccacaacaguccccagagugugauguuccccuuccuguguccguguguucucauuguucaauucccaccuaugagugagaauaugcacaagaacaaaaaaccaaacaccgcagaaaauauuuucuuuuuuuuuuuuuucuuuugagacacugucuugcucuaugagcugggcuggaguacaguggcacaauucacagcucacugcagccucaaccucucaggcucaagagauucuuccaccucagccucccaaguugcuagaauuacagacgcacaacacccugccuggcuaguuauuuuuauuuuuuguagagaugggaucucgccauauugcccaggcuggucuugaacucugggcucaagcaauccucccaccuuagcuucccaaaauagugggauaaugggcaugagccaccaagcccugccuggcggaaaauauuuucaaaacaugacagacaauaguagcuaauacucaaugcaauagaaaaauggacaaaggguaugaauaucuaguucauaggagaggaaaugcaagugaucaguaaacaggaaaaaugcugaaccucacagguaguuaagggaaaugagaauugugauaucaucuuucccuuuuaaauuuauaaaaauuaaguuauugcuucuagugcuguugacaguauggagaaaugaacaccuuuacauacugcugcuaagaauguuaguugcuacagucuauuugaaaaguaaguuggugucuauuaaaauuuaaaaugcacauacuuucuaauacagaaaucccacuguuaggacauuggccuccagaaaaaaauacagcaguucauaaacacauauguacaaaggcauauaaauaaguagugguggcugggcgugguggcucaugccuguaaucccuggagcucaagaguuugaaaucagccugggcaacauggugaaaucccaucucuauaaaacaaaacaaaacaaaaauuuagccuagcaugguggugggcaccucuagucucagcuacucgggaggcugagaugggaggaucacuugaacccaggagguggagguugcagugagcugagaucgugccacugcacuccagcuugggcgacagagugagauucugucucaaauaaauaaauaaauaaauaaauaaauaaauaauaaaaauaaguagcggcaaguaagagaaaacaguguacagcacugggggaaucccgguacauagauuaaaaaaaugauuuggcucuucauauugcucugagggauguccauuauuuugucaaauuaauagagauucauagccuuggcucuagaauuucauuuuucuaaaaguugagggaaaacuuuacacuuaauguauauauguuugaccauauagaagaauguagaagcaacacacaacaaauuaugugauaucuuggggaugacauagagggauguuaacuuuauacacacacacacacacacacacacacauacacauauauacacacacaccuguguuuuguuugauuuuauaugaugugauacacuuuauaauccucuuacaaucuaaaaguacauuuaaagaauguaauaaacccaauuggaaugucaucaaaauagauaaaacuuguaaaaauggacaagaaaauguuagaggauauaaugguaagggguucaggcuagaacucugguaucuaaauucuagcacucaccucuuuuuccacuggagucuuaucaaggaaauuauauacaaauaauaguagccaaaggggaaaccuagcaucauuuuauuaauaaccgaacaagaaccacuaauguggugcugcucccuggugaacuaaguggggaaaaugcaguuuggccuugaagccucagugaaacuuucugcuuuucuaccucugacucaaggacagacccaaucugaccucuccuacccaguuguagguucagagaaacuggagcggaggauggucaggcccauucugaggaggccaauuugccuguccauguaggagcaggauaagccagagccagagagccaugggacaugucugacuguagaguggucaggcccaugcaccugucucgggcuucagccaaucacuucagcaauucuucccccaccggaggagcuagugagugguggggacagaagagcagaacucccacgcucaguauucccuccaugggggacuggggcaaaaacucauccuuccuaugggcauaggcggaaaugugguguugggggaugaggagcuuaaagaaugagagugcuacuaacaauuuguaacaguacagucacgaaucuagaugaggaguugggcucaguggcucaugccuauaauucccagcacuuugggaggaccaaggugucaggauugcuugaggccaguaauuggaggcugugguaagcuaugaucaugccacugcguuccagccugggugagagugagaccccaucucuuagaaaaagagagaaaguccuuacaaaucaauaagaaagagauauccacaacccaguagaaaaacuggacaaauguucuaagcuggugauuuccguguaauggugaagaguuuggguagugggaugggacugccuguauuuaaaauagagcuuuguggccgggcaugguggcucacaccugcaaucccagcacuuugggaggcugaggugggcggaucaccugggguugggaguuggagaccagcuugaccaccauggagaaaccccgucucuacuaaaaauacaaaaauuagcugggcgugguggugcaugccuauaauccuagcuacugaggcaggagaaucacuugaacccgggagguagaaguuguggugagccaagaucgcaccauugcacuccagccugggcaacaagagcaaaacucugucucaaaaaaauaauaaauaauaauaauaauaaaauggagcuuugugauauugggcaagauauuuaacucaacauucuuuacugaaagugggaagaauaauaguaccuaccucauggcaguauugagaggauuaaaugagaugauguguguaaagcauuaauaaugcuuauacuugguccauguaagugcucaguuauuaaugauuauuguuauucaaaaguaaagguagucaaugaacaaauguacucagccucuggccaggugcaguggcucacgccuguaaucucagcacuuuggaaggccuagguaggcaaaucacuugaggucaggaguucgagaccagccugaucaacauggcgaaacccugucucuacuaaaaauacaaaaauuagcugggcauggugguguguaccuauaauccuagcuacucaggaaacugaggcaggagaaucgcuugaacccaggaggcagaaguugcaaugagccaagauuacaccacugcacuccagccugggcaagagagugagacuccgucucaaaaacaaaacgaaaaucccagcacuuugggaggccgaggugggcggaccaugaggucaggagaucgagaccauccuggcuaacacugugaaacccugucucuacuaaaaauacaaaaaaauuagccgggcguggugguaggcgccuguagucccagcuacucgggaggcugaggcaggagaauggcgugaaccugggaggcggaacuuagagugagcagagauggcgccacugcacaccagccugggcaaaagagcgagacucugucucaaaaaaaaaaaaacaacaguuacacuuauagaaucuguccaauaaaaacauuugcacacacauacaaaaauaaaugaguaagaguaguaguauuagcaaaaguagaguaguauuguauuagcaaacaaugguacauaaccaaaacaacugaauaguuaaauaaauuauggugugcuuaccauaaucugcuauagaagaaugagggaaaggagagcuauuuguacugaagaucuucuaagauuauuguuaaaagcaaauugcagaauacagcugacaacgguggcugacacugguaaucccagcaauaugggaggccagggcgggaggauuguuugagcccaggaguucgagggagacccuaucucuacagacaauucaaaaauuagcuagguguggugucuguguaccuguggucccagcuccuuaagaggcugaaggaucgccugagcaggaggaucgccugagccugggaggucaaggcugcagugagcugugaucaugccaccgcucuacaguuugggugacagaaugagaccuugucucaaaaaaaaguugcagaauacauuuuaugaugcaagucuauuuaagcuuuuuucuuucuuucuuucuuuuuuaaacagaugaggucucauuauguugcccaggcuggucucaaacuacugggcucaagugauacucccuucucagucucccaaagugcugggauuacaggugugagccacugcaccuagcaccuauuuaugcuuuuuuaaaaaaagaaaaaaccacacacaaauacauggagaaguauuuggaaagaugcacaccaaauagcaucaguaaggauuuuugagggucaguaagcagaugggaggcuuuacucuuuuacucuguauuauaugcauauucagagagaacuuauauuuucuuucaucauuaaauuuaaauggauaucugaacaaaaaaaaauugaacaacaugagagccaauuguaauuccucucaauauuugguuggcaacuuggagcagaagagccagugucaguuuggcugaggcuaaaacacacacuugugcaaacacaauguagucuuuggaaagagaaacuaggcugugugauuagaacauucaggugggccaggacugucuauuguaaguaguacaaucuugaaauguugaagaaaacacaaucaauuuuggaaagagaugaauuucuggucagaaauauuauaaagcacacaacaugcuaaacucuagucguaggcaaagcuuacauuguuuuguaacaguacaugagauuuuauuuggcguccuucuuuuuuuuccccccuaagacaaggucucacuuuguugcccaggcuggagugcgguggcacaaucacagcucacuacagccuugacuuucuggguucgggugguccucccaucucagccuccugaguaacugggacuacaggcccgugcaaccacaccuggcuaauuuuuuuuuacuucuuacagagaugggauuuugucauguugcccaggcuggucucaaauuccucuugggcucaaguaauccucuggccuuggcaucccaggguguugggauuauagucaugagccaccgcacccagccuggcauccuucuuaaauauagcauguacccugaaauuuuacccugauuuuguuuuguuauuguuuuuguuuuuugagauggagucucgcucuguugcccaggcuggagugcaguggcgugaucucagcucaccauaaccuccaccuccuggguucaagcgauucuccugccucagccucccaaguagcugggacuacaggcaugcaccaccucacccagcuaauuuuuguauuuuuaguagagccaggcuggccucgaacuccugaccucaagugauccacccgccucagccucccaaagugcugggauuacaagagugagccaccgugcccaggucugauuucggauguagaaagauacaugguagaauugggcaugcccuaagauauuccagagaagcuuugcauuuuauucgggguacuauauguagaaaguucuuagucuuugcuuugguuaucaguuauauuagguuagugcaaagguaauuugcaguuuuggccaucacuuaugauggcaaaaaaacacaauuaccuuugcaccaaccuaacauuaaacucaggcgcuuuaaauuuuacacugaaauacguugaaagcuagcuuaguugaucucugucauuaacagaaaccaucucuguuuuuguuauuuucuuggcuugauuuaacguucguugcucgcaagaaacagaaacccacucaagguaguugaaggaaagggagguuuucauucaagggaguuggagaaucggaaggcaagaaugagccucaggccucucaugggacuggacccggccaguggaaagcuguugucucacacccugccccaccucacaauacaugucucuuuucugccucuuuccuugcaugcuugucauucucacucgcuauguaugccagcuuucccugcagcuccaugcacgcugcgucuguggcccuuuccugccuuuugccuuccaggcuaaaacuagauagcuuuugggucuuaauuccaaaugcuuaggagugaaucgguuagcucagaaguccaaccaguucaaacaccugugucaaucuagcacauuaauucucaaccuuggcuauuauuugaugucacugggagcuuuaauagauaccaaagccugugucccauuaccagaaauucugguuuuaguggucugggauguuacuaaaccuaauuuguugggauauguuuaaguucccagaggauucuaacauagagcugugguccaugguuaagaagcacugaucuaggagagaagagggucaucuuauaggcguggaaugcucagauaguggggucuuggccuagguagauuauucucccaaagauguccucuaggguguccccauuuuuggcuuuaaccuaccaguccucuuucuuauaggguguguuggaauaaccuauggagcucuacuuuaaggaaaaaaaaaaaaaaaagcucaugcccagaccuaguaaaucagaaccuucagaggguggggaccaagcaggcauaguuuuuaagcugcccugcaaauuccaacaguaccaccaggccugaucuccaggccgugcacucucacauagcagcaccauccacagucauggcuucauauauaccacuuuggugguuuuuuguuuuuguuuuuguuuuuguuuaauucuaaggugucucaaaucuuggucagauauuuaggagccaauacuaucugaccucugaguaacaaauguaccuuuuuauuuuuaaauagucuagaugucuuuuuguuuuuguuucugucuuuguuuugagauggagugucacucuguugcucaggguggggugcaguaguacaaucuuggcucacugcaaauucugccucccggguucaagugauucuccugccucagccuucugagaagcugggauuacaggugugcaccaccacgcuuugcuaaucuuuguauuuuuuguagagacgggcuuucgccauguuggccaggcuggucuugaacuucugaccucagguaagcugccugccucaaccucccaaagugcugggauuacaggugugagccaccacacccggucuagaugucuuuuuccaaguacuuugguaagagaaacugggaagcaccagcuaugucaaguguguguacuacaguggguuaaacauuacugguggggagggugauucauuacagggauguuggucacaucagccuaacagcugacagaaaugauaggaaaggcaaggcgugauggcucacaccucuaaucccagcacuuugggaggccaaugcaggcagauugcuugagcucaggaguuccagaccagccugggcaacgcagcaaaaccccgucucuacaaaauauggaaaaauuagccaggcguggugguaugcaccuguaaucccagcuacucgggaggcugaggcacaagaaucgcuugaaccugggaagcggagguugcagugagcugagauugcgccacugcacuccagccugggcaacagugagacuccgucucaaaaaaaaagaaaaaaaaagauaggaaaaauguuuauuauauucuuugccuccuagauacugguccucucauauauauccuugauagggaagccuccucuucccuugugagggaggguguagggaaacaggcauuugcauaguuaggugguaagaguguaaauugcaaggcaagucagaaaguagugcucugcucuauagagcacuauaacuuacuagugcagaaaaacauuauuaggauauauauugaggcauuguuuuucauagggaaaaugggaaguagucuaacugucuuuugggauuaaauacauuguaauuuggcuaucuuguggaaugcuauacaguugugacaauuagacagauuuauuuguauuggcaccagcaugaaaaagaaaauugucaugcagaauaugauuggaaaaaauuuuaaaauuuuuugaaaagagaaaagauggccaggcacgguggcucaugccuguaaucccagcacuuugggaggccgaggcugguagaucacuugaggucagaaguucaagaccagcuuggccaacauggcgaagcccugucucuacuaaaaauacaaaaauuagccaggugcgauggcgggugccuguaaucccagcuacucaggaggcugaggcaagagaaucacuugaauccaggaaguggagguuguagugagccaagaucgugccacugcauugcagucugggcgagaaagugagucuccgucucaaaaaaaaaaaagaaaagaaaauugauauauuguguaaaggaagugaguugcagaauaguauaauuauauuuauguaaagaaaauuuguaucuguaaaucuguaggcaagaucuggaaguaguuauaucaaaccaaauggcaauuacugguauagagggaugggguggcauugaaagagggacuuguacuuuuaauucucuauacuuaguaccuuaauuauuuacaguuaguauaaauuacuucuguaaugcuugaaaauacuuaaaaacuauaaagaaccaugggaaaaaagaaaaugaaugguuaucuuuauguggugggauuuuaauuuuaauuuuuugugugugggggggcaguauuuuuuauaaagaaaaaguuuuaauuuucuaauuggggaaaaucauuuuuaaaaauuacgucaggacuugaauuucaugagccuuuucugaaaaaugaggauggcuuuuuucuugaauucaaauuaaaaauuuaagucauuaccucuucugaaagcauugauaaggucaaggaaagaucgaaucucagcuauuuccugacuucucucuuagguuagguacuauuuuucagagauugucaaacuuugcugaaaucacaucaccaggggugaugaauuccuaagaauagagaguccugggccucacuugacacuuacugaaucagaaucuuaggcuggaguugaaggccuaggaauguaaaccucuucaggcaagucugauagcuaaguuggaaaaccauugcuguaggcaguacaagcagaaguaagacacaggccuauauuuaaggcauuuacuaagugaaauagcauaagacaguaaugucagugcuuucaugaggcacuaugggauuagucaccaaacagauguuagagauaagcacugaaagaaagagcacuggaccaggaagacugugaaugccuuaugaaggaggcaagaugucauaauauucaaagcucauauauugaguaagacaguucuauguagagcuguuacauacaacucaagguagguacugugaauauccucacuuuacagauugggaaacaagaugagcagaguuaaguaacauguccaaagucuuacagcuagcaggugguuaaguggggagcccuagaagcccaauuccacugugccguauuaacauugggcaggauuugggucaguggaaaggauguaugaggauuuuacagguauagagggaaguguaaggaaagggaugggaagcagugacuagauaaaugaagguggaauauaagguaaguuagggcugggugguagaaagucuuguuaggcuaagaggaucccaagugucaaaugcucacaagauuggauauuugaagcuugggaggaaaucucugaugacuugaaagacauuuucucuuccaguugaacuucacaguguuaucugcaaaguuagagagggauuugggguuucaugcucccugguguauccacagcacuuaaaacagugccugacuccuaagagcugucuacuaaauacuucuugaaugaauauauaaauaucuggcucacaaucuacaucagagacuuauucuuucuuuuuucuuuguuuuucugagacaaggccucgcucuguugcccaggcugcagugugguggcaugaucucagcucacugcaaccucuaccuccuaggcucaaaccauccucccaccucagcuucccaauuagcugggacuacaggcaugcgcuaccacacccggcuaauuuuuguauuuuuuguagagaugaaguuucaccauguugcccagucuagucucgaauuccugggcucaagccauccacccuccuuggccucccaaagugcugagacuacaggugugagccaccacacccagccucagagguuuauucuuuauucugcccaaugagccucagaauuuagccuuucauguuuuuguuguuguuguuguuguguggguacauaauagguguaucuauuuugguauaggcaugcaaaacauaauaaucacaacuuggaaaauuggguauccauugccccaagcauuuauccuuugugaaaauacagaacacuuuacaaauuuccaugucauccuugugcagggaccaugcuaaccuuuguauaguucugauuugagugugugugcugcugaagcaagcacucucaucuggguuuuuuucccguuucuccuccacaaaggcugauaccaaaaauuccacauuucaucuagaaucuuccuucuuuauguaauauuuucuggcugggcgugguggcuuaugccuguaaucccagcacuuugggaggccaaggcggguggaucaccugagaucaggagcuugagagcagccugaccgacauggugaaaccccaucucuacgaaaaauacaaaaaaaaaauuagcaggguacaguggcaucugccuguaaucccagcuacuugggaggcugaggcaggagaaucgcuuaaaccugagaggcugagguagcagugaaccaagauugcgccauugcacuccagccugggugacaagagugaaaauccgucucaaaaaaaaaaaaaaaauuaugcaaaggugagaaugucaacuuuuuaguuccauguaaaaacuguucauuuggucacagucccucuuguggccauuccugguuaucccuugccauucucacuaucccuuaauuuuuccccuguuccccucugggcucccugccuccagccaccuccuugauccagucugucccgcccagcacuaccagauguguggcccucagaggccuuguaaucauaccacugucuucucagacaccuucaucgggggaaggugaagguugcuuuuggugccuuccagccuacccucagcacaccuucccagcugcaucuccgcugcacucccacguggcucucucaaacaggccugcuugcugcuaucaaaugggucauuuaguuugccaccuuuguaugugugacccuucuguucuaccuaccugggaugcccuucccuuuccuauuugccuacccagauccuuccuauucuccuuugaagacucugcucagaugcuuacuuuuuuccucaggugccccauuugaauuauugcuguuuccucucaauuguuaucgauuauuaucugugucauaaauaagaagccaaucauguauuaccuugugacauuacuugcauugcuaucuuaaguguuuuaggacacuggguuuugucuccuuuuacaucuuuauacguuaacuccccuaacaauuauaugauuguugaaagucugugggugcuccauaaaaugaauauuuagacuuagucauauggauuuuuaagaguuaaacauggaugacaagaucuaugaauauauguagaaaaauccuuaggaaucuacaaaaaagcuacuaaaacuaauaacuaauguagcaaaguuauagaagccaagauuaauguacaaaaaucaguuguauuucuauauacaguaccaaugaacaauuggaaauggaauuuaaaacaguuucauggucaagcacaguggcucauauguguaagcccagcauacugggaggccagaguggguggaucacuugagcccaggaguucaagaccagccugggcaacauggcaaaacccugucucuacaaaaaauacaaaaauuagcuggguacgguggcuuguaccuguagucccagcuacuugggaggcugaggugguaggaucaauugagccuaggaggucaaggcuguagugagcugugauugagccacuacacuccacccugggugacaagcaagauccuaucuuaaaaaaaauaaaacacaauuucauuuauaauagcauaaaacuuguguagaaaucaaguuaaugggccaggcgcaguagcucaugccaauaaucccagaacucugucaggcugagaugggcagaucacuugaggucaggaguuugagaccagccuggccaacauggugaaacccugucucuacuaaaaaauacaaaaaauaaaaauuaaaauuagccaggcguggucacgcacgccuauaauuccagcaacaugggaggcugaggcaggagaauugcuugaaccugggaaacggagguuucaguaagcggagaucaugccccuacacuccagcugaggcgacagagcgagacucagucucagaaaaagaaauaaagaaauaaaauuaaugaaagaaucauaagaaguacacugaaaacuuuaaaacauugcugaaagaaauuaaggcagccgggcguagugguucacgccuguaauaucagcacccugagagggcgagacaggcagaucacuugaggccaggaguuagcgaccagccuagccgacauggcaaaaccccaucucuacuaaaaauacaaaaauugccugggcgugguggugcgcaccuguagucccagcuaaggcaugagaaucacuugaacaugggaggcagagguugcagugagccaagaucgugccacugcacuccagcuugggugcuagagcgagacucugucugaaaaaaaagaacuuaaaaaaggcguaaauuaauggagaaaugugcuauguuuaugcguuggaagacuuaauauuguaagaugucaguucuccccagacugcucaauagauucaacacaaucccaaucagaaucucagcaggcuuuuuguaaaauucgacaagcugauuguaaaauguacauggaaaagcaaaaguagagaauagcaaaacaauuuugaaacagaagaacaaaguuggagaacucacugucugauuuuagaacuuacuagaaagcuacuauaaucaagacaguuugccuacuagcagacagauaggcaaauaaauaauggaacagaauagaguccagaaauagaugaauaaauacauggucaacugauuuucaauaaaggggucaagguaaugcaaaggagaaagaauucucaaccaaugaugcuggaagagucagacguucauauguaaaaaagcaaaccuuguucgggagcuguagcucacgccuguaauccuagcacuuugggaggccgaggcguguggaucaccugaggucaagaguucgagacuagacuggccaaaauggugaagacccuucucuacuaaaaauauuaaaaaauuagccgggcguaguggcacaugccuguagucccagcuacuuaggaggcagagagguaggagaauugcuugaaccaaggagguggagguugccguaagccaagacugugcccauugcacuccagccugggugacaagagcaaaacuccgucucaaaaggaaaaacaacaacaaaaagcaaaccuugauucauaucuuguaccauauaaaaauuuaacuugaaaugacucagagaccuaaauaugaagccuaaaacuagaaaacuuuuagaagaaaacagggaaaaauauuugggaccugggauuaggcaaagauuucucaacuaggacauaaaaaauuuuuugggugcggugcuuacgccuguaaucccagcacuuugggaggccaagccaggaggaucacuugagcccagaaguucgaggccagccugggcaacauaaggagaccccaucucuacaaaaaauuuagaaauuagcugggugugguggcacaugccuguggucccagcuacucaggaggcugaagcuggaggauugcuuaagcccaggagguugagccugcagugaaccacgauugcaccacugcacucgaaccagugcaacagagugagacccuaucucaacaacccaaaauuauacugccacauugcacauaaugcaauauuauucagcaguaagaaaagaagcaacuacugauacacacaagaacauggaugaaucucaagagcaguguacugaugaaaguagccagacacaaagacucaagaccaucugauucuauuuauaucguauuauggagagacaaaaccauagaucaguggcuacuugggguagguaugagggguugacugcggaggagccugggagagcuuucuggguuaauggaaauguuuuauaucuuacuguggggguuauacaacuguacauuugccaaaacucauuuaacuguacacuugaguggguuuuauuauaugcaacuauaccuaacuuuggggggaaaaugucuggaagauacuggugugucugagacugaggucagaaagaugaguagaaggaauuuuauuuuguguugucugguuagugcuuuuccccuuauuguggauguuuaccaaauauccccacuauuccaucuuccaguuggaaguucauaagcaaauguacaguuagugucccauugagccagauugaguuugacagcaaagauuggaaguuaauggugggcuaaaauugacucuaagaaaaagugaucagagcuaggugggacuuucucaucaauggcgccgacuuuuuuuuugccagucacagugguuugggcucucaaacggucauuugacauaccuuuauguguaaacauaaugagccaguguugaguuugggguuggugaggguugugcacuauuggauuuuuaagugagcauuaguuuguuuaaugaaauugcaaaggguguuucauauuccuggccccugagcaccaaauguccucagcacuucagucauuguggcagccaagaaccaccccuggucauuuucaaauaccuuagggguuucaggggaaggugugccuggccuggcagauagugcacuuauguaguuggagucaagaaugcagacuugagucagaaaaccuguaaucucugucuccuacuggcuuugcaguguugaguguaaccaccccuuugagucuggguguccuugucugccagaggaugguuggacuagauacccucucauggcaaucguuuuugauucugcaguuuaguguaguacagugucaagacuucugucacuggccaggcauagugacucaugucuguaaucccagcacuuuugggaggcugaggugggaggaucaguugagcccaggaguucaaggccagccugggcaacaugugaggccuugucucuacaaaaaaugaacaaaauuagcugugucugguggugcaugccucuaaccccagcuacuugagaggcugagguggaaggaucacuugagaccaggagguggaggcugcacugagcugugguugcaccacugcacuccagccugggcaacagagcaagauccugucuuuaaaacaaaaaacaaacaaaaaaaaccucugucacugaccagggaucuaauguauuugcuguacugcucacaaaugcuuauguggcucaacuuugguauguuacagguucagcuuguugguuuagaugaggagaguucagaguuuauuugcagaaacaccuuugaccacccauaccccaccacaaagcucauguggaucccugacacaaaaggcgucuauccagaccuacuggcaacaagcggugacuaucuccguguguggaggguaagcggaugcuuuauuagcagccagacaagugggcuuucucagccucagcuguuagcagugaaaagucacagaacagacaggggucagaggcagcgagugucauugcagcacaggagaagcaagcgaagcuuaaauggacuggccucguuuggcucagcagauuuucuaguauaucaagucaagauuccaugaagucuggcugcuggcugcagucagcucagucaacccgaggugaugaugacggccuucaguggaggugggaauacuugggaacucauauucuguuugcagccaagguauuuuugaguaaacuaaaugaaauaccaggccauugauucugauaaagugugugaguggaucuuggaggcuucccuccacccucagcugagcucaucagcagcagcguccucuguagcaugggcguggccuuaguacaccugugcagagguuccaggcugggcaaagugagaagaccucuccucuaggaaggugcagggaugaaaauguagaaaacaaagcugggcagaggagaaaguaugggaaaaaguagcauucagggaguccuggguuuauuacuguuuuugauaaaaauguuuuccccucaugucuuauguuugcuaagauauuuucuaaacagggauuuuuuaaaagacuuuuuaugaggauaagacuggcugauuuuuuuuaaaauucuuguuccuucagguuggugaaacagagaccaggcuggaguguuugcuaaacaauaauaagaacucugauuucugugcuccccugaccuccuuugacuggaaugagguggauccuuaucuuuuagguaagggaguuagggaguauguauuucagcuggaagaagccaaaauaaauuuucucagaugucacacugggccauacauccuagaacaaggcucagugggaaguaggcuaggcguggaaugugguuauuuauuaauuccuuugugugggugagcuuuccguguguauagaucuugucucuccaguuagaaucuaagguccuacggugaggacugaagacuugacugccucgguggcucugccgguagcccccaccuuguuuucuguagucuuuaugguaugcugcucccugggcugagcagaugaguaaacacaagagggaagcuugcaugagaaccuuggucccgucagcccugacuugcacugguuguuugcagguaccucaagcauugauacgacaugcaccaucugggggcuggagacagggcagguguuagggcgagugaaucucgugucuggccacgugaagacccagcugaucgcccaugacaaagagguaagaugcuuuuccauuucgucuuuccucaaaugcuuccugugccuuccgcacaggaagaggucagcuuguucucucauuguucugcaauuuauguagaaaaucauaacauaacaucuucuugucuaaauugacaauaguaauguaucaaaaacgggaaaacaacacuauuguaaacuaaugcuuuuuuuuggcuaauguaaaugaccuauucuacggucugucauuguucuuuucaugccagagguugcuuuuuuuaaauaacaaagucucuuauagaggagcugggaacugaugugauuaaaaaauaacuuuagaguaauacuuaucuugaaacagauuagauuuggggaggaaagaagggagacaggaagagaaaaaauuuucugagagacaaacguaauuauucauuuuucucuauaaauguuuuaccaaauccuaguauguucacuuaaucuuuauacuuucauuacuguuggcaguggaggcaauggaauauauuuuauuuugauggcgaugcuucuguguuuauugggaaaacugagaagagcuauuugugauugcuuuuuuuuuuuuuuuuuuuuuuuuuuuugagacaaaguuuuccucuuguugcccaggcuggagugcaauggcgcaaucugggcucacugcauccucugccuucuggguucaagcaauucuccugccucagcuuccggaguagcugagauuacaggugcccgcaaccacgccuggcuaauuuuuguauuuuuuagcagagacaggguuucaccauguuggccaggauugucucgaacucuccugaccucaggugauccacccaccuuggccucccaaagugcugggauuacaggcgugagccacugcgcccggccaauugcauuuuaaucaaagcauucuucucagugauuuuggaaaauccccauaagucuuuuccuccuagagccauugcaugcuccugguacucucaucuccuguggguacuauuuccuguucuuuucuaccuuacccugcacagcuagggguauuaauaucuauacagauaaaaggaaugccuugaucuuaggucagaaacuugagguugucaacagcauaggaagaugugacccagguuaucauucuuaguaagggguugucuuuggcuuucuguacuccugaagguaagcccuguuacaagacuucuagaguugacugcugcuaaaccaggggucaaaugaagaguuugucccacagagaggaccaguaaggaacuucuggaaacccucuuggcaucaaguugaacaagcggcuacauuuuaguuauaugacaacuuagccugcuguugucuguuagguccaacccagaaaaugggaacuacucuuaaguauuugaacugcagggauuuaauccaggggcugcuuauacagaagaugguaaagcugagaagccacauagguagcagugaggucauccauagaaugggagcagcaggaagcugcagcugccuauaggccagagggaccaugggaggaggcaggguuccuggagcccaggggcuggauuuaccuggcagagacgcuucuaggaacagagagaggggaggagaaauaccuuagcuuuucccugccucccaucauccauuuucccaccaaagccucccaugacugaaccagccagaagcagccagcagaucugagacccugccaaaugcacgcuguaggaaucaguucucuugugacacagagaagaagagcagggagaaaggccaggaauggaucuugacagcagacaggccuggaccggcagccuugucuugaaggaauaaaccugagaaaggauaguggcucuagagaaacaguaauagcaccuuucuagcaccuuugauuuuucucaguccaccuuucucuaggaaaagacuuguuuggaaggcucucauugauaccuggcagaucaguguagaagaggguuuaguguacuugggaguugucaccuucccuugguuucccagugaaccaugcuagcggagcacugaaggagcagucacuuagagccgagagagcauuacacacucagccacgcugcccauggcaccugugggaucucugucccugaggguuaccaggagcugucauugggggguauacauauugauaaacauggcugugccuuaaagcagcuguacaguacuagagaaagccucgaucugucaggcacgucaggccugagugccuccuuguugaugacuggcccggucccuuuugaaccacuucuacuuccugccauagaaagacaagcauaauuucuucauagccagaaaaaaaaggaauucgugagguuaaauagcaauagaugcucauuuggcagugucccucuguaggcagaacuucaacacuggagcuguaauauuuagugagaaauucuagucgugucuccccagaagucagcuguuauuauccccagaagaugaguuuuguuuggcauuaguuuuucuguuucucucucuauuugucugucucuggcucucucuucgucccucuucguccucuuuuuuuuuuuuucuuuaagacagaguuucgcucugucccaggcuggagugcaauggccugaucucagcucacuguaaucuccgccucccggguucaagcgauucuccugccuuagccucccauguagcugggauuaccggcaccagacaccacacucagcuaauuuuuuuguauuuuuaguagagaugggguuucacuggguuggcccggauggucuugaucucuugaccuugugauccgcccgccucagccucccaaagugcugggauuacagguguaauccgcacccggccuucguccuuucucugaagcucuccguugcucucugccucuguuuccucauagacguuagugauaugcaauguuugcagcaaauaaaagcagaaaacagugauucagaaccuaaauugauucacuuaugaucucaaaccaacuaggagaagaaaaaacauguccuaggacaagcgggugcuacuaaccuauuugugaauacaggaacaucuaggccucccgugacucaaaauuucuguuaccucuuucuugcaaaugagucucagguccagguuucacagaaucagcuuggcugcuauuaaguggccacaggagggcugcuuucaccucugugauugaugaucuaggccuuaaugagcucguagaccugccucugauugugcacaaggcccaggaaauaagugucucauucuuguuguguggcagaagacagccacuguucuguuggucagcagggcaugugccuuuguuuuaucacggguuggaggaagaagacuuggaaagcaggaaugugggaagaagccagccaauuucuauagcagaaugaucuuccaucuuugggaagccacugauauuagagcucucggguuucaguacucacagacacuguuugggcuucauuuaucugcuuuugugucaugagcgagguuuagaugaacuggacguggcagauuucccuccuauaggaagaagagguaauggaucugaaucugacuggagcuucuuguucaccaacaggucuaugauauugcauuuagccgggccgggggguggcagggacauguuugccucugugggugcugauggcucggugcggauguuugaccuccgccaucuagaacacagcaccaucauuuacgaagacccacagcaucacccacugcuucgccucugcuggaacaagcaggacccuaacuaccuggccaccauggccauggauggaauggaggugagcacuccucucaggcuaccaugggcccugccuaacuccagcacugcuuaguauaucuagaaggcugguucucaacuggagcaguuuggcucccggaguaucuuugggaaugucuggaggcauuuuugauugucacagcucuagagacgcaguugguacuauggcaucuaggggguagagaccagggaggcugcuaaauauccuacagugcccaggacagucccccagcaaaguauauccuaccuaaaaugacagcagucccgggacugagaaagccuaaucuggaauaagaauuacuuguuaagaacuuuuaauuuuugaagaguuggaguuagagccaggaaaagcaauaucuaaagaguaaaccaaaucguaugugccuauggugcugagugaaaaagcagauuuucccuucuguagucuggacagauucaucuagcuuuagcaaacagauguagaaauggcagcccucuggccgggcgcucugggucacgccuguaaucccaacacuuugggaggcugaggcagguggaucacgaggucaagagauggagaccauccuggccaacauggcgaaaccucgucucuacuaaaaauacaaaaauuagcugggugugguggcauacgccuguaguuccagcuauucgggaggcugaggcaagagaauuguuugaaccugguaggcagagguugcagugagccaagaucgugccauugcacucaagccugggagauagagcaagacuccaucugaaaaaaaaaaaaggccaggcacgguggcucacaccuguaaucccagcacuuugggaggccaaggugggcggaucacaggucaggagaucaagaccauccuagcuaacacggugaaaccccgucucugcuaaaaaaauacaaaaaauuagccgggcguggugucaggcaccuguagucccagcuacucgggaggcugaggcaggagaauagcuugaaccugggaagcggagcuugcagugagcggagaucaugccacugcacuccagccuggugacagggcaugcucugucucaaaaaaaaagaaaaacaaauggcagcucucucuagucuguuacuugauuaaagaggugaauuguggguggggagaaugcauugguuguccuugguuugguggcgcuagcaccucagauucugcuuuggcugggcucucauuccauucaucugagaugcauagaauucuuaccacaugcaccugcugggacccaggauuacccagacuccuguugucuguuucugcaucuccccuaucagucuaaaggcccaguguugcucaagauagagacuaucaacuacccguguccuuugucuucuuuucccucaauccuauggaaauccugucucuaguucuuuaaauccacaaaugaaaaauuaugccuaaaaagauuuuugcauguggauaguauuuuuuguuuuuuucuaugaaacucugaugaucccaggccuuuuacuuguuauuuccgcagguggugauucuagauguccggguucccugcacaccugucgccagguuaaacaaccaucgagcaugugucaauggcauugcuugggccccacauucauccugccacaucugcacugcagguaaucaugguggggagaaagaaaucugggaaggauggaggaaaucuguucucuuggcuccuuagaauuguaguuguuacuguuuucuaagcacagucuugagagauuuauacaaaaugacuaguuggagccucuccacacuugugaaauucaaucaguacaaauuuuuagacgaucuuguacccucauggacaucagaacaucuuccauauaugauuuacaucaugugucaguuauagggcugugccuuguacugugccccugaaaucuggauggcacagaggacucaauuccaggaauauggggaaagggaggcaucccucauggauauaacagaaucuuugggacugugaagaucaacaucuccaugggaccuuucagguuucacuauaacaaacccacagugugcucuggaugcaucggagggccccacagaacuuugccugguugugguuugugacuugugguuuucauuucacuguuucccagaccaaagcuagcaccccuuacgggcugggugcagugguucacgccuguaaucccagcacuuugggaggcugaggcggguggaucaccugaggucaggaguucgugaccagccugacaaacauggugaaacccugucucuacuaaaaauacaaaaaaaauuagccaggcaugguggcacgcaccuguaguccaagcuacuuaggaggcugaggcaggagaagcacuucaacccaggagguggagguugcauugaccagagauuaugccacugcccuccagccagggcaacagagcaagacucugucuccaaaaaaaaaaaaaaaaaaaaaaaaguaccccuuaaaaauauguugggccaggcacaguguuucaggccuguaauugcagcacuuugggaggcuaaagugggaggauugcuugaggccaagaguucaagaccagccugggcaguauagugagaccucaucucuacagaaaguuaaaaaaagacuaucugggugugguggugaauuccuguagucccagcuacuuagaggcugaggugagaggaucccuugagcccaggaguuugagguuacagugagcugugauugugccacuguacuccagccugggcaaccaagcaagacccugccucuaaaauaaauuuuaaaaaaagaaaagaaaggcugggugcaguggcucacaucuguaauaccagcacuuugggaggccgaggcagguggaucacgaggucaggagaucaagaccauccuggccaacauggugaaacccugucucuacuaaauacaaaaauuagcugggcgugguggcacaugccuguagucccagcuacucgggaggcugaggcaggagaaucgcuugaaccugggagguggagguugcagugagcugagaucgugccacuacccuccagccuggugacagagugagaccccgucucaaaaaaaaaaaaagaaaaauaugcugguugucaaugcacuuuuauuguagaaauaaugccaaucuguuauuuaaauugaaaacaguacagaagcauauuuaagagcaaggcgaaagucaucuuuucuccuuccuauaucauuucugccuccaucccccucugcauagaugaccucuaucaacagguaaugugucuccuuccagacccuuuugguauacuuucagggauguacaucuaugcccccaaauacaacuauauacuucuuccuuuugcacugauaggauucuguccuaguccugugauguuuugcuccuuaacuuuuuuaguguguuuuuuuucuucuccucacuaaucaggagccuuauaauggacaagguuuguuauggagcccaagaagcaauguacucugguguuuuucugccauuugagcauuauuuggaaggcaugaagcuuuuccugauuuuggcccucugcucaugccuguaugucuccuugaagagcagcugggggccugcugcugccuucuguaccucagauuguggucugucuucuucauuauugcccucuuuuuuuuuuuuucccagggguguggauagggagggauagaagaagcagaagagaaaggugucauccauuauucauggaaagcaggacuggccccguagaagccccauuuucugcuccuggcugcugccuuugucuggcucgcuguuguuuuguguguugcaccugccuugagccccuucaaccgaaggagcuguugcucaagugugcucgguugagcauugaggaaaagggccuuagugcucuagaggugcaauucccugaccucuuggcauugauugucccugggagagggaucuugcaccuggcccagacuaugcggccuuggcaggagacuaguauugcccacaauuagucuauuaggguuuaguuuauucagauuuucuuuguaucugagaccagcuuucaucagaaugcauggcagagucaggguacacugcagcucugaaggccauugccuuauuuuuuucuuuuuuaaaaauuaacuuacuauuuugauuauaaaaguaauauaggccaggugcggugguucaugccuguaaucccagcauuuugggaggccgaggcaggagaaucgcuugaaccugggaggcuuugguugcagugagccgagauugcaccauugcacucaagccugggcaacagaaugagacuccauuuaaaaaaaaaaaaaaaaaaaaguaauaugagcacauuacgaaucacuuaggaacuagagaaaaguaaacauaaauccuaaccuugccaucuuaguauugccaucauucucauuuuaauauauuuccuucuacuuauuuuucaugugcuuuuauauauuuaaagugauuaccaucuuucugguguuucccauagcuauuuucuuggauuuuuuuuuuuuuuuugagaugaagucucacucugucacccaugcuggagugcggugguaugaucucggcucacugcaaccucugccucccgaguuaaagcgauucuccugccucagccaccgaaguagcugggauuacaggugugugccaccacaccuggcuaauuuguauuuuuuuuuuuuuuuuaguagagaugggguuucaccauguuguccaggcuggucuugaacuccugaccucaggugauccgccugccucagccuuccaaaguguugggauuacaggugugagccaccaugccuggccaggaaagaauuuuuuaacagcacauaucagcacuacuuuaucagucuucuauauaacaccucacugaagcauaaauguccaucaaacagggaagaaacgcucucauuauauugaaugaucagagaaugaucuuuguaaccacucaaguauuuuaaguggcugcaaaugacauguuugguauccccuuguccacuccugauaccugacccagaugagaaggacucauuagugcaguggauagagccuggggacaucugggagauggagucagggccuagauuugaguucuggcucugccacucacuuggcugaauagcugugugauuuggaacaagugccuuaacauuucugaaucucgauuuccucaucgauaaaaugggggcuuaaaauagaaccgccaucacgggggugcuuuguaaacugugacuugcuccugaaaugcagggaucaucauccgcauugccucacuugugaccuugcuugcuggcuuucuuugucccuagcggaugaccaccaggcucucaucugggacauccagcaaaugccccgagccauugaggacccuauccuggccuacacagcugaaggagagaucaacaaugugcagugggcaucaacucagcccgacuggaucgccaucugcuacaacaacugccuggagauacucagaguguaguguugguggcgcugugcccacgaggcaggggcuuuuguauuuccugccucugccccacccccaaaguaagaagaaacauguuuccaguggccaguaugucuuucauugcuuugcacccacuguuaccagaagcugcucuaggaguuccuggccagucaccccaucgcccucuguggcagacucagugcuguguggcgccuccucagcccagggcugaguuuuaagauuuucucuccuuuccucuucuccuuugguuccucaauuaaaaaauguguguauauuuguuugucaggcguuguguugaggagcaguucacgcacuggcugugucuauuccucugcccaggugucucuguuugcugcccaaggcagcaguucaugucucguccauguccauguucguguuagcacuuacgugggaacaaauaccaauuugucuuuucuccuaguaucaguguguuuaacaaauuuuaacuuuguauauuuguuaucuaucaggcuaauuuuuuuaugaaaagaauuuuacucuccugcuucauuucuuugucuuauaguccucccucuuugcaccuucuucucuucccucagugccuggagcugguacugggccccuggccccaugagcaguuugccuucuugagucacugccuguguaguacauaccugaccgggaguccaaaccaccuuggugcucugaaguccacugacucaucacaccuuucuuagccuggcuccucucaagggcauucugggcuuguaaacagacauaggaagccucuguuuacccugaagcaccacuguccagcccauugguucccacuggcagcaugguagagcugagagaaacaggcucucaggguaccugacuugaggggaaucguuucaugaagcugaacuucaagcauauuuccaguacauucuuucagagucuguuuuuccauccaaauauaagccccaggccauuccacuuagugucuuuucaaugauaggcaagaaugauaucugaguugaacuucggugcuucuguuguuugaguuuacugugccuggugguauauugggcauucuuuggauugaguguucugaggugagagagucuucccgaggcauccugucugugcuuccaacccugaacaagaccuuacaugagagauggacugauggacugcggcaauccugggcugucaaguggauagauaguuaaaaagcauuauacuguggguaaugaaaagggaggaaaaaaaaagaaggaaaaggaauuauagacccccagggucagccaguuaagagcucuacccacaccugucaaccccucucucccccaguuuagguucugagcaguauuggacuuguagccugcaguugucuuuugacuugcaggccgcaggugucuuucuguuaugugaaugaguuccauggaggggcauaugugugauuccaccguuagaugagcccuuggggcaggcaguuugggaugugcucuugggggaaaguuggcuguuuccuugcgcucugcuccuacccgaagguuuuuaagucccucugaauugcucaucugagauuaguagaguagcaggccugaaggaugaugguuuuguccucuuugguucucaccugcuugagaaguaaaacaguaacuuuguucuucugggcccuuaagcuuuuuugguuaagucuuccuuuucagaaguagaugucauuauaugccaaaagucuagcucuuugcuuuaccauacagggaccugucccaaagaaaaaggcucuuuuuuuagccagcauauuuccccuucuacccuuuuacuuuguuguucugauuuuaggacucuggcuggccaugugcuugugguugccucuccugcauuugccacuggauuugcacugcaucguuuggagauacaaagcgagcaguucuuggucagaacccuccucugcuuuucauuguguuugauaaugguuacuggguccuucucucaaggguagcaaggccaagcugauggcugcuuguuuaggaggccaucaguuccuuccuguggagaagggucugaaauggaagucagugguagaaggggcuggucugcugggcagggcuuacauccacugaguucuaagauuccuuuccugaucugcaccuacgccuggucuguaugguggaauuugucagcuggaacucagaaacaacaacuugaaaaaaaaauaauaauuagaacauauuugcauaagauagcuauuuacucuggaaaccaacaacuuuugagauuucccuugcccuguggacgcccagcuccugucauccuuccuuagguccugcaguacagucuuccccugaaugccaccggggacccagggggacuccaccccccuaagcaagcacacacauacucacaguugaugaguugcuggucuuugagucccagcucucuuacccucccuuuacuccaccagcccgacgacccaugacugaggaggggauuucuacagucucaggauuuagaaagucuguaagccauccaugcuccagaaagcaccgaucuguuguaguugcaaaaacaacucuguaauuuguugagguucucaaacugacagccagcgagacugggugggaggcccuggaucuguucucccugacugcgggaggagcagccacuaggacuuuagcaggaagcccacauggaggcuccgccaggcuguggcccagcuggugauggcccuuuugcuccuggcagccugaggcacagcugccuguauuguccucaucuguucugacugaaggauggaggugcugaauaaauuaggccucaggccucuaccaccagagagcuggagaauggguccacgucauucaaggaccugaauuuuuuaugcucaggagcauuggaauccucuucuuccagggaggaauuagccugcaagguuaggacuugaagagggaagguauuuaauaacugggcgaggaugggugugguggcucacaccuguaaucccagcauuuugggaggcugagguggccagaucccaaggucagaagaucgagaccauccuggcuaacauggugaaaccccaucucuacuaaaaauacaaaaaaaaauuagccgggggugguggcggguaccuguaguccuagcuacuugggaggcugaggcaggagaauggcgugaaccugggagguggagcuugcagugagccaagaucgugccacugcacuccagccugggcgacagagcaagacuccgucucaaaaaauaaaaaaaaaaaaaaaauaggugaaaauuccuuauaaauccaggauuggcucugagagaacuggcuaagauucaggaagaaacaaaaaauucagaauccuacaagguuuugaugacaauuagggccaaaauuuuaggaggagauguaggaugcaggagaaaauuaaaguguuuucuuuauaucagaggaggaaauaguagaggucagugaaggucugggguagggaaacauucagacuguccauugcauggcuguggagugagacugcccuuagccugggucagccuuccugggccauaaauugggcauccgugaugcuagguaacugugggaacaaaaugacagcuuagagcagccaugggugauguuuggugguaaaaaaccuacaggcguuuggggucccaugauuguuccagaccaugacucuuccugguuguggguuuguuacagagcaggagaagcagagguuaugacaguuaugcagacuuucccccuccuuuuucucuuuucucuuccccuugcuuuuccacuguuucuuccugcugccaccugggccuugaauuccugggcugugaagacauguagcagcugcaggguuuaccacacgugggagggcagcccaguacugucccucugccuuccccacuuugagaauauggcagccccuuucauuccuggcuugggguaggggagaccauugaaguagaagccucaaagcagacuuuucccuuuacuguguguacuccaggacgaagaaggaagaucaugcuugauacuuagauugguuuucccagggaagagggcggagcagagcaaagucacugugaacccugggccaggcccuggcugggccagcuccugagagcgucucguguugcagacccuugcccacuucacccaccugcaccuucucccccucucacagugucacugcugcuaauggucaaagucaaauguguggccacaugggaugggccagguccucucaggcuacuuucuggaugucauuuuuaaaauauggaaacaugcaggugccuucccaaagaggcuuggacugguauauccaacgagaaacaaauaagcuaaagaaaguuuaaacucaagaagaaagauguugacagucuauguaacagcuggaaaguuuauaggcacccaccuuugggacaacccagugauuaugaacaugugauaucuacuauuuaaaagaaauguucucaccuuggguugauugugguauaccauguguuaugaaaauuguugagcugaagcuuugaaucgauuuaguugagucugacucacuugcuuugguuccuguguauuuuacuaccccucuugucagugaccuuccuuccccaccccacccagagugaauuuguagcaugauuguauaaaccucuauguagaaaauggagauuucuugcucugaaauguuaagcucuaacugauccauuucuguguccuuuagccuaguaugucugaacuuccauucuuguuauauauuuaaacuuucccucuauauuauagguuuuguggcauccacggucagguguagaggaagcugccccuugcagaacuguacuguaauauuuuucuuuuauaaauauuuucacaggacugauuguacacagggcuuguaauaaaauuuuaacacugugcugugaaacaacuauggggaaucuccauugaaggcuacuucaugggcaccugaaaguggaguguuauagcuaugacuuucuauuucuuguuuccuaaguaaauuaaaccuaauuuucacccuuucauucuguuucagccuccuguauaagaaguaccguauuuucugcccaucauacuuuguaauaaaacuugaacauguauagauugacugaauu

SEQ ID NO: 16895 - RNA, 1345 nt, Homo sapiens
cucaccagcaugggagucacuacaaagcuuuucagcagcugccgcuuuguuucucuccaucuucuaacggauucgguuuucucuuucgagacagcagagagaaaaugaagaggggaguuuagcuccaaagggcuugucugaucauucucccucucccaaaggccugugacucaucugagucugucccaaaccaucucuugcaucuaggggcuuaagugcacuguggcuauuuacauaaaacuuuauuacuuuaaagcucuaagggcucauuuuguguuucuaacuuuccuauguugauaaagcaaauauuagauccuuauuuauaaauagggaagacguucagagagauuaaacauuugggcaauucacuucucuggcagcaguuucuuucccaguacaaugaggcaacaacaaaauaucauucuggacuugcucagauuuaggcagcaauuuggaagcaaagucaguuucauaacucagaugugucuccacuaaaacauuaugagaaacaaaguccggcgcucucuaggcaaccgugagggcuugagcacuaacuagaucugcucaagggcaagagaggagcgaguaccgugcagccacggaacggacuuugcgggcaguggggacguguuuuuggagcgaacccgguaaaggaagugugcuacgccaucaagggcccccagucccgggugccgcggggacaguguagggucauuagcuguugagccgccccgggcgggcccaagccuuuggaucucaggugaccggcacaggcggccgcgggguccggaacugcuuguuccggcaguggaagagacgcgccggcguuggccgcugcugcuagcagcuugaaccccagggucgggaccgaugucggcuugggcugcugccagccuaagcagggccgcugcccgaugcuugcuggcacgaggccccggggucagggcggcuccuccgcgcgacccccggcccucccaccccgagccccggggcugcggugccgcuccgggcaggacgcugcacuuuaccgcggcuguccccgccgggcacaacaagugguccaaagucaggcacaucaaggguccgaaggacgucgaaaggagucgcaucuucuccaaacucuguuugaacauccgccuggcagugaaaggugagacccugacggucacccagcacuggcugccgcugcccucucagugcccgcagccucgcuugccucucggaauugggcccaccuagaucuccggcccuucacuuuguuuuccuuccccaguacccaccauugcccaccucauaaauccucaaaacaccuacccuacguuggagguucucacucacuuuucca

SEQ ID NO: 16896 - RNA, 1345 nt, Homo sapiens
uggaaaagugagugagaaccuccaacguaggguagguguuuugaggauuuaugaggugggcaaugguggguacuggggaaggaaaacaaagugaagggccggagaucuaggugggcccaauuccgagaggcaagcgaggcugcgggcacugagagggcagcggcagccagugcugggugaccgucagggucucaccuuucacugccaggcggauguucaaacagaguuuggagaagaugcgacuccuuucgacguccuucggacccuugaugugccugacuuuggaccacuuguugugcccggcggggacagccgcgguaaagugcagcguccugcccggagcggcaccgcagccccggggcucggggugggagggccgggggucgcgcggaggagccgcccugaccccggggccucgugccagcaagcaucgggcagcggcccugcuuaggcuggcagcagcccaagccgacaucggucccgacccugggguucaagcugcuagcagcagcggccaacgccggcgcgucucuuccacugccggaacaagcaguuccggaccccgcggccgccugugccggucaccugagauccaaaggcuugggcccgcccggggcggcucaacagcuaaugacccuacacuguccccgcggcacccgggacugggggcccuugauggcguagcacacuuccuuuaccggguucgcuccaaaaacacguccccacugcccgcaaaguccguuccguggcugcacgguacucgcuccucucuugcccuugagcagaucuaguuagugcucaagcccucacgguugccuagagagcgccggacuuuguuucucauaauguuuuaguggagacacaucugaguuaugaaacugacuuugcuuccaaauugcugccuaaaucugagcaaguccagaaugauauuuuguuguugccucauuguacugggaaagaaacugcugccagagaagugaauugcccaaauguuuaaucucucugaacgucuucccuauuuauaaauaaggaucuaauauuugcuuuaucaacauaggaaaguuagaaacacaaaaugagcccuuagagcuuuaaaguaauaaaguuuuauguaaauagccacagugcacuuaagccccuagaugcaagagaugguuugggacagacucagaugagucacaggccuuugggagagggagaaugaucagacaagcccuuuggagcuaaacuccccucuucauuuucucucugcugucucgaaagagaaaaccgaauccguuagaagauggagagaaacaaagcggcagcugcugaaaagcuuuguagugacucccaugcuggugag

SEQ ID NO: 16897 - RNA, 10698 nt, Homo sapiens
ccgguaaaggaagugugcuacgccaucaagggcccccagucccgggugccgcggggacaguguagggucauuagcuguugagccgccccgggcgggcccaagccuuuggaucucaggugaccggcacaggcggccgcgggguccggaacugcuuguuccggcaguggaagagacgcgccggcguuggccgcugcugcuagcagcuugaaccccagggucgggaccgaugucggcuugggcugcugccagccuaagcagggccgcugcccgaugcuugcuggcacgaggccccggggucagggcggcuccuccgcgcgacccccggcccucccaccccgagccccggggcugcggugccgcuccgggcaggacgcugcacuuuaccgcggcuguccccgccgggcacaacaagugguccaaagucaggcacaucaaggguccgaaggacgucgaaaggagucgcaucuucuccaaacucuguuugaacauccgccuggcagugaaaggugagacccugacggucacccagcacuggcugccgcugcccucucagugcccgcagccucgcuugccucucggaauugggcccaccuagaucuccggcccuucacuuuguuuuccuuccccaguacccaccauugcccaccucauaaauccucaaaacaccuacccuacguuggagguucucacucacuuuuccagacgcugagcaucuggccaguuugucagagagggagcugcucuuaagaagauaagccgguaagguagaagugacuucauccuaaucuagcuggguacuuaauagaaacaagcccuaagagucagggcagaugugugucucuccugaagagacaaaucaaccccucugaagucgccucaaguaccuuauugguuguggcaggggcacugaguaaagcuauuacuuaagugcuuaggccuuagcuuaggccuuaguuugcuucauuaauguuuccccaagacacauuuccuuggaagguagauuugcagccaugucuuuucucccuuaggucgccacacugaaaaggcuuuuuuucuguuuagggccagacaucuguaggagcaaaggaaaaguccuguagaaagcauggacuuuggacugggcgcaguggcacagccuguaaucccaggccagaggcaggcagaucacuugaggucaggaguucaggacuagccuggccaacauggggaaacccugugucuacuaaaaauaacaaaaaaaaaaaaaaaaaaaaaacagcugggcaugguggugcaugccuguaaugcuggcuacucgggaggcugaagcaggagaauugcuugaacccaggaguugaaggcugcaguaagcgagauugcucuacuguacuccauccagccugggugacagagcaagacuccaucucaaaaaaaaaaaaaaaaaaagagagagaaacuguggacuuuggagucaggaagacugguuucugucacugacuaaccuugaacaaguagcuuaacuugaguuucucugaaacaaggauaauacccaccuugagguaguuuaugguuuauggcacaucauaggcauucaguuaauguuaauuuacccccucagcucaugccugguauuuguuugcuuccuuuucuucaaaauucuugauauuaaguucaagcaacuuuuauuuauuuauuuauuuauuuauuuugagacagagucucacucugucacccaggguagagugcaguggcgugaucuuggcccauugcaaccuccaccucccaggcucaagugauucuccugcuuuagccuccggaguagcugggacuacaagugugcaccaccaugccuggcuaaauuuuuuuguauuuuuaauagagacaggguuucaccauguuggccaggcuggucucgaacuccugaccucaaaugaucuacccaccuccaccucccaaagugcugggauugcagguaucagccacugcaucccaaugaaguucaaccaacuuguguuuauuuugugccaggcaugccauugguacuagaaagaugaugagauacagccccuacccucagaucacaaugucaugugaacauuucaauaauuaugcacaaagugcugggcacgguggcucacaccuguaaucucaacacuuugggaggcugaggccggcggaucacgaggucagaucgagaccauccuggcuaacacggugaaaccccgucucuacuaaaaauacaaaaaaauuagccaggcguggugguggcgggcgccuauagucccagcuacucaggaggcugaggcaggagaauggcgugaacccagaaggcggcgcuugcagugagccgagauuacaccacugcacuccagccugggcaacagaggaaaacucugucucaaaaaauaauaauaaaaauaaaauaaaauaaaaauaauuauuaugcacaaaguaguagaguaagagcaguaaugaguccaggaaguguuguuaccaucuauaacccuucuucaucugacacaaaguagagaucgcugaaaccuagcagaaugaaaaccaucccuaaagacaaugaauuagaaaguucuggccaggcacggugccucaugccuguaaccccagcacuuuggaaggccaaggugaguggaucacuugaggucaggaguucgagaccaaccuggccaacguggugaaaccucaucucuacuaaaaauacaaaaauuagcugggcaugguggcagacaccuguaaucccagcuacuuaggaggcugaggcaggagaaucccuugaacccgggagugggagguugcauugagccaagaugagccaagaucaugccacugcacuccagcauggaugacagagugagacucugucucaaaaaaaaggucuuuucuggccagacaugguggcccacaccuguaaucccggcacuuugggaggccgagucaggcagaucacuugagcucaggaguuugagaccagccugggcgacauggugaaaaccugaaucuacaaaaaauacgaaaaaaauuaccugggugugguggugcacaccaguggucccagcuacuugggaggcugaggcaggaggaucgcuugaacccuggagguugaggcuacagugagcuaaaaucaugccacugcacuccagccugggugacaaagugagacuuugucucaaaaaaaaaaaaaguacuuuuccaaaauacuuauccaggccaggggcaguggcucacacuuguaaucccagcacuuucggaggccaagguguguggaucaccugaggucaggaguucgagaccagccuggccaacauggcgaaaccuggucucuacuaaaaauacaaaaauuagccgggugugguggugugcaccuguaaucccagcuacucaggaggcugaggcaggagaaucacuugaacccaggagguggauguugcagugagccaagaucgugccacugcacuccagccagcaacagagugagacuccaucucaaaaaacaaaccaaaaaaacccgaaaauacuucuccguaucccacugaaacacuaguuaagguauucuaagguaacugagagcuaaauggugauuugccacuccuuuggcuugguggggcuggaaaucccuuuuauucucccauguuguaaugagaugucuuugcucacucuuuuuuuucuuuuucuuuaaaucucagaaggaggccccaacccugagcacaacagcaaccuggccaauaucuuagaggugugucgcagcaaacauaugcccaagucaacgauugagacagcacugaaaauggagguguguacuguuugacaugcuuuuuauugaucacagccucuaccgggcucaugucuggauggccaacaaacacacuguaaauuaucagaggggccaagugcaguggcucacgacuauaaucccagcacuuugggaggcuaagguggguggaucacuugaggccaggaguuuggagaccagccuggccagcauggugaaacuccaucucuacuaaaaauacaaaaauuagcugggcgugguggcauaugcuuguaaucccagcuacuggggaggcugagguggaggaucgcuugaacccaggagguagagauugcggugagccgagauugcaccacugcacuccagccugggcgacagagcgagacucugucucaaaaaaaaaaaaaaaaauuaucagagagaacgguagcaauguaguugacgcccucagccuagagucuucugagagcucaccguccuuggucauugguucuaggagcacaacugggaguaggaugcauaggcaguaugcagggccauacagucaagaccgggacugcucagccaaguuguagggagaugagguauuauagaaagaaggggcagugugggagaaagcccuuacguuagguggaggaaguguuuguuuuucagauguuuaugcccuaaaggagaaaagccaguagaaagggagaggaugggggugauagagauggugggaggggcagguauauagaguccacguaaggguacaccuuucucuggggcagguagggaggcucugaggaaguaauaguuaucuuaauagcucaaaauuauugagugcuuccugcaggcuaagcauggauaaaaacucuauguguguuaucucaucgaauccucaaaaccaccguaaguagaaacugaggcacaggaauguuaggugaguugacucaagucgcauagaaaaugacagacuugaaaccagauagucagacuuuagagccugugcucuaaccguuaugcuuauugccuucauguaggccauggugcagagaaggugguggagacagcaacuauuuuccccaccuaguggcccuuuuuaccuuugugaaagaggaagggagaaguuaugaguugagaauuccuggaaaguugcaggacagggugcuuggaguggggaauauugaauacauggacaagggaugaguaggggcauggaagguccagaagagauuagucccuagagcucuggauuaauuguuucaauuuugagaccaugcuguuuucagcagcucuuacgacaaggccuaggugugugauauuucacagcaguacucagcagcccaggguagggaccuugagacuugaccgguggguuucuuacaggauggggguguaggaggaugagucugagugggauuggguagggacuagauguggcauuugguuagggaugguaggaagcaaagcugagagauggcugauggauuguucagggaccggagaaacagacuccuuccaaguuagggguaguacuuccuguuaccucaaaaguugguuagaggguggggacaaaaauaaagauugagagcucaggcuccagccuagagagcccaucccauggaguuaguuuugcgauacuuguaguucugggcugacaugugggaaggaauugggaaacaggaaaaugugcuuguguuguuuauugcagaaauccaaggacacuuauuugcuguaugagggucgaggcccugguggcucuucucugcucaucgaggcauuaucuaacaguagccacaagugccaagcagacauuagacauauccugaauaagaauggguaagugugcgucugggaggagugguaggggacagagccuuuauguuccaauucucugcaaggcaaguacuguugaucucugcuaguguuucaggguuuuguuuuuuguuuuuuuguuuuuugagacggagucucacucuugucgcccaggcuggagugcaauggcaugaucuuggcucacugcaaccucugcuuucuggguucaagugauucuccugccucagccuccugaguagcugggauuaaagauacccacagccaugcccagcuaauuuuuguauuuuuaguagaggugacaggguuucaucauguuggccagacuggucucgaacuccugaucucaggugauccaccugccucagccucccaaagugcugggagccaccaugccuggccauguuucagguuuuaagcacacuugcuccuuagcagaaucuaaugaguuaauugacuuucccuuaauguaguuucuacuagcaggaucccaaagacuuguucaucggauguagaaggggaucuuuguccuauuauccccaucuguagccauauaaugccuaagucuuaaaaugcuccaccaggacuggcaucuuaauggcacaggaaauuaucagcuaagucugcuuccucccaacugcaaucagggcagaaaaucgagcguggggacauucuugggcuguucccuuacccagcagcagcugcauuuucuccuugaggaugcgaucugcuccaugucuguguguacuucauagacuggguaagaaagagacagugauagaaugaugagcuuuauggaggcugagcuucuagaggcauccacucaugccagccuguuuccuucccugucagaggagugauggcuguaggagcucgucacucuuuugacaaaaagggggugauugugguugaaguggaggacagagagaagaaggcugugaaccuagagcgugcccuggagauggcaaucgaagcaggagcugaggaugucaaggaaacugaagaugaagaagaaaggaacguuuuuaaaguaagcaugaaaacauggguguuuggugggcuuccgggaggacccugauagaugccuuaugcaugccucuugguuucuuccuucaugugccccaggguauaggugagacaguucacauauuguacaaacauuuauuaagugaauacugaauaggaccgacucuagugaggacuaugagaaagaaagagucaaaacauugaaaacgaugucccugccagugaagagcucaaacccagugauccauuccaguacugacauucaggacuuugcaagguccuguguggcuuugucucauuaccuccuggcuccucaccuccugacuuuccuuuaucccuaguuuauuugugaugccucuucacugcaccaagugaggaagaagcuggacucccugggccuguguucuguguccugugcacuagaguucauccccaacucaaaggugcagcuggcugagcccgaccuggaacaggccgcacaucucauucaggcucucagcaaccacgaggaugugauucacgucuaugauaacauugaauaaccaggcuacaugugcccccggguuccuuccuagaaauguggcagcccauuccagcacacaggcuucugcagcaaucucugaggguaaagccggugggaggcucagcaggccaggaggcccaaggacaggacuugcgaccuugaagccaaaggaaucucacuuguggggccuccuugucagcucugcugcugucucagagccaucuggaugagugucccgacacccucucggaugcagggcaggaccacccagcuggucagacucugauguuggguagcuggccucuguggggauuguaagugcccugaggcgcucuguacuagaaacugcucuuaauaauaacggugauuauugguugcugcauugcuguuguauggcucuugagucuuccugaguuuguguccagcuguugggauccucuggacuaacuuucaagucccuaggcuuagcucuacuacuccaaucccaggauuauuuuuuuaauuggccauagaaauguaguuguauccaggcacuccauggucugaugcuggucuuacagccuaaaccugucauucauucaugcaacuaauauuucuggaacacuagcuauauaccaagaacuguacuuaucuagagcauaagcuauucaacugguguccuguguuagauccugcucuagaagguaggaccugaacacaggacugcucuuuacuggagcugucccagggcagugugagcugcugugcaagcaucuguugcucucuuugugugacuucugugcccuucuuucaccaaacagcuuaagguucuagcccaguaggaaaucaagugccagugauaagggacuuggcaguggcucacaccuauaaucccaucuacucgagaggcugaggcgggaggaucacuugagcccaggagucuaaggcuacagugagcuaugauugcaccauugcauuccagcuugggugacagagugagaacucuucuuuuuuuuuuuuuuuuuuuuuuuuuugaggcagagucucacucuguugcccaggcuggagagcaguggcacaaucucagcucauugcagccuugaccuccuggacucaagcaguccuuccaccucagccucccaaguagcuagaacuacaggugcaugccaccacgcccagcuaauuuauauauauuuuuguagagaugggguuucacuauguuguccagguuggugucgagcuccugagcucaaguggucugcacacucggccucccaaagugcugggauuacaggcaugagccaccacgcccggcugagucugucucuuuuuuuuuugagacagagucuugcucuguggcccaggcuggagugcaguagcaugaucuuggcucacugcaaccuccaccucccagguucaagugauucuccuccuucagccucccaaguagcugggauuacaagcaggcaccaccaugcccggcuaauuuuuuuguggagggggaggggagaaaauuaaacuuuauuuauuuuuaaaagcaaaccaccgggaaaauauaacacagccuggaagcagcaaauggacaggcuauauuaucauuucaaguaguaaguugaugaaaauacaaugagguugcuaucaaaacaauaacgugccaugccggggcaggaacacugcaaguugcgaaagccccaggcaaaaaugguuuuugguacuggggucugccucuccuuugcuauaagggagucagcucauccuagcccaaguugcuuacuuuuucuuccuuggauuuccuguugccaggguuugucucaauugugcuuuguuaauucagggggcuaaguaggcagugcuagguuuaggcuuucauuccauccguucuauaaaaaccagguuuuuccaaauccaguacuucauaacucuguuauaaucaaguagccaacugcucuucuuuuacuguucauuucuagauacuaguauauaucacaaucaaaacccccuucucuucaccgggaaaguguuacugcaagauuguccugucauuuugcuacacacagccucggcccaucagccaguaauuaugcuucccauaauuaguaugucaucaccucucauguuuuugcauggucuccaggcugaaagaugcagcauguaauaauuuuaagaaaucuacaucuacaucuugaugaccagaaauggggauccucaaggaaacuuucaaaguucuuauccaaacuagucucccucccaauuccacaucuuaaaaucaauuuguaucgccuuguauaaauuacacaaaaccaagaaaacaaagacccagaaaacuuuuuugcccuucuaagcgggugaccucauggauuuuguuucacagcuuacggaaaaugguguggugacacuucugguaaacaggauguuggcaacaaagagaaaauaucucuccucaaacuccaccaacucuaaccugccagccuguugguaccuguguaauaagaagaguuuagugccuuggagggcucuggcuuguuacaggggagauccuuacuggcaggacaagcacuggccauaggauauauaagcucuaaaacucuccuguaauaucucugacccaauuuagcaccacuuuuuuccauuucauuuuuuaggacugaaacauaaaagaaccaguguccagaggcaagugacauaugucuuacacuuguggccauccuucauuucuucauaaacuuugcuuaaaagacuaaaauucccaauuccuuauaaaaaauauauucuugcccucagccccaguggccacuggcaaagacuguuauuucccaauggauaagagagccuccuucaucuucuuggccauaguugggaugaggugcguguggucauccacacacuuggucacacaaccguccagcugcugcuucaccugaagcuccuuacucccaguauccauugaaucuuuggcuuuguuguugcaaugcauggcgcaccgggccagguggugccggaacuucuccaacucacuggugagcaaagcccgggcuugagccagaggcacauggcagugcuuugauguacuggugcaccuacugcauggaggccuggcuguccucacaacagcuggugcugcaccggaacaugagacccugcaucuuccagauguucucucucuccagacucuucaccauggaguccaccaccuccugcacccacagcugcugcagcucugccauggcguccccauaccgcccugcaccgugccaccccggcuaauuuuuguaucuuuaguagagaccagguuuggccauguuggccaggcuggucucgaacuccugaccuuaggugauccguccaucuuggccucccaaagugcugggauuacaggcaugagccauggcgcccagccucugucuuucaaaaaaaaaaaaagggacuuacuagggccugcuuugccugggucccuaugcauccugggauuggucagagugaaccaaugagaagacugagcugcucucaagaagggcuaccacaagcugguuuugaaagcuucuugguucugagaacaaccagcccuagauccuuuucaucucugaugccaaau

SEQ ID NO: 16898 - RNA, 1070 nt, Homo sapiens
ggccgccagugcuauuccugccacagugugggaaggcgcugggcuaagggcugugcuucccggagcugcuucuagccugauuuccggccaagccacgcagucccuggugcccgggaaggcgccggccucgccgccgcuccaaagcgaguggccgucucucgccggcugugccuccggccugcugugcggcugcagggagggagcagcucugcggcccaagcucugucaccucagcucucugggccgcggcucccacgugagaaaugaggugcgcuuguuggagagggggcccccguugcugcccacagaauuccgccccagaaacgcuugaguacguggagccucgggggacgggugcuccgggaaccacgcauaccggccuccccagcccgucgcaggguugcagaggcgccgagggcugggggggcugccggggcugccgggcccucgugcaggcuccuccccgcagccucgcggccgggccuggagaccgcgugcccggacgccgccgccagccucgugggccgcaaaggggcgggggcggccccuggcggcgggaggacucggccgcccgagggaccccgggccaggcuccggggucgccccggcugggucucugcggccccacagcucugggcggggaugggggcgccggcgccuacgcgcgaggccaaccgggggaaaccgaggcagugaauggcccaggccccgcccgguuaucccggagccaggccgggagcgcccagugucccgcgaccgcagccgccgcagccugaacucguccccucccaguaggaugcggagcgcggcccuuccauccugucccugccaccguugcuuccccacgccgggccgccgucgggaugggcagacggcgcggccgguacccgaggccugcgagcgcgaggcccgcggggcgcugcggagccgggagcgcggagccggggcgggggacagacaaaggcggggacggcggcgaggggaagacaaagcgcggaggggggucggcggcggcgccggggccccgaaggcggcuccgggcgcggcggagccaaugggcgggcgcgggg

SEQ ID NO: 16899 - RNA, 46243 nt, Homo sapiens
cgccuaucccaauccuccuaccuaggauuccgucaaguugacgucacacggaaccggugcuccggaagcuaaagguggccaugcugugugggaccacguggccagaggcaagagugucgcucuaguaguauaugcaacaguuuaaacuauaggcauguucauguaaauaugguuucuguccaacccguuuucucuugggauuuuuggcuagccccuugacgccacuuuuucuucauucgcagacccacuuucuagaugggucaugaacacuguccacccaacugcaguuucccgucagaguaucugaggagccugugaggcguucuggagcuuuaaggucaggcgccuuccgggagccguagccccggccccgcccuucugcccgcgcguuccucacugcgcaugucgcguuuuuguuccccuccccccuucagcaacgggccgugaggcgguggcggugguggcgguggcggcggcggugguggugguggcggcggcggcggcgaagggggcggagaggaaggagcgcggcgggaccgggccgggacagcgcguacuuugggcuccgggauucgcuccgcgcccgcgguuguagcagcugccgcugcagccauagcagcagguuugugcgugggguuucuggacgcaaggccgccaguccuugggggcacuggaggcaacugcugggccuagcgagggcggaggaaccgcggccucgcuuaacaaagagucggcagagccucggggcaccggcggccggggugccgggaaggggugggagugggggcugaggccucuaggguuccuuccuagccgcgucgcccucccacagcucccgcuucccucacaagucuuaccgaggcccaguuggcggcuuuccggaggcggcgcccccucgccuaggaaaaggauuugcagggugcccggcuccagggcaggaauagcgcggggagaauucugacccaaggaggcagcgcuugggagaugcaggccuccgaauuugggguccugagaggcaaaagcugccaaaugagaggagugaaaagauauaggcgaugaucuuugugcagcguugaguaggucgauuauuagcaucacuguagucacacaaacuuuuuugcggccuacuugagagcguaucugaugugaauaaauaauuuacauggaauugcaaacauaugcaucaaaaacaggagaagcugucgagaguuuuggggaauuacauucucaucacugagaauuucccucuugcccccacuccuauaggcaguuauccaauuucuuguggcuucccuguguuuucuuuuugucaaugauguuucuaugucuguccucucucguauacacacccaggacuuccucaagcgcagggacuaugucuuaaggcgcuuugcagagccaagcucauuucuggcacauaagaggugagcaaugaguguuucguacaaaaauuaauguuuauauuuugacagcugggaaaagaaaauauaucuuccuguaccuggaagaagcauuguguagccuaaugugcaauucguucauucaagggguauuuuuauuggugccuauucucuagcgccguucuaggugauagggauagguguuagaccccugccuuuggggaacuuaacuuucuaguagcgggaggagaggcaaacagauacauauauuauacugaauguuagaagaugaucaguaucuuagggaaaagaaagcuggaaaggggguuggggagguggugguguuggaauuugcaauaaaguggucagggaaguccauacagacaagcugauauuuaagcggacuagaagguggagugagagccuacguuuaucuggggaaaggaacguuccaagcuagagaauaacaaacauaaaagccuugaggaggacaaagcuggcccguuaagagugugaagaccaacgcguuuggagcacugugagcugagggaguauuaggagauaaggucagggaagaauugggggaagggagugagcggaacaaccaaagccuuuuaggcuguuacuuaggaaggaucugaggguuucgaucagaggaaugauaauaucugauuuauauuguaacaauuuaauauaagagaggagugcaguuauuuaaauuuguuuuguuacauugauagucauauaaucagcucuuaguugcuuuaagcugacaggagaagggaugcuucuaaaauaaccauaaccuagcauuuacuuguauuugguuuagaagaaugugauuacguucuugaguuuuuauuuagauucucaucaaagaacugaccuguauauagugugugagguacucucaaaguauauguagaguagaugcuaaucacugucacuagaacucuuccuuccaccuccaaaaauacaagugauaaaguaauguggcuuauauaaucaguuguuuuuaguccacuauauuuaaagucauuuagaucauaucuuauuuuccgccauugccgaaaacacaaacuagcuaaauugucuuccuuuauaaguguguuccacauuuauucucacuuccuagccuuugcuaguucagucuuucucccuggaaugucuucgucugcacgucucuacccagcuuucaucuuucugugccuagccuggcuucugacucuguuaugacacuugcccuugcuuguuagcucauggugaucucugacaucuucaguguucuuguggcgcuuauguaugaaauaccugaguugaaagaagucugauagucucaauuuaccgaugaagaaauugguucuucagaaauaauguaauaaugaaaaacacgaugguagcugacauauugaacaaguacauuuuuguguaugaacuuaauuuuucacgccaacucuugagauaggugauagucucaucuuuuuuuuuuuuuuuugagauggugucuggcuguguugcccaggcuggucuugaacuccugagcucaaguaauccgccugccucagccucccagagugcugggauuacaggcgugagccaccacacacagccucuuaccauuuuuuauagaugaggaaacugaacccagagaagcuaaauaacuucccugagguucauaucaaguuaguagcaaagauaguuuacacauagccugugcuacuuuacuauucuguuaagauuuccuaggaaaccaccguguuuuauuuauuuuuuagagacugucuugcuguguugcccagguuggagugcagugguccagucagcucauuguaaccuggaacuccuggguucaagcaauccucuugccucagccuccugagcagcuaggacuacaggcgugugccaccaugccuggcuaauuuuuuaaauuuuuuuguaaagacaggguuuuauuguguugcccaggcuggucucaaacucguggccuuaagugauccucccaccuuggccucccaaagggcgaggauuacaggugugagccaccuugcccagccagccauaggauuuagugccuagaaccauaccaaauaggacuugaugccaucuugacuguuucucuucagccuaguuguagaucuccuuuagucuuuuacauauugaauaaaugaguaucuaauauugaaaacaugcuauaagagaaaagugaauaagccuguuucuucagccaugaauccuauaauacggaguuggacuggaaagggaguuugaggaaggagaugccauuucuuuuucuuucuuuuuuuuuuuuuuugagacggagucucacucugucgcccaggcuggagugcaguggcgcgaucuuggcucacugcaagcuccgucucccggguucaagugauucuccugccucagccuccggaguagcugggacuacaggugcccaccaccacgccuggcuaauuuuuuuguaucuuuaauagagaugggguuucagcauguuagccaggauugucucgaucuccugacuucgugauccacccgucucggccucccaaagugcugagauuacaggcgugagccaccgugcccagccaggagaugccauuucuuuggggauaucauauucaugucuuuaggaguugguauuugagauaugcuuugaaggauaggacuuugguagguacucacaguuuauaggaaagagauuugaugugaaggggauccaguuagagggaagaggauucacuagagugcuuguuuuccuggaaaacugaguacguguggagagacccugggaaauaugaaugguaaaguaguuugaugccacaauggagggucucauuccagcaugauuaacuguggagagcuauggaauugaggagagugacauaaucagaaauguguguucuggaagaaccuggaaaggguuuucgauaagcaucugaauacugaccucccuucugugagacuuuuucugguuccacgguauuaacacacacuaugcuacucuaccaaaggagguaaaacuugcuuuucucuuuucacugugugucucacuauuacuucaucauuuuaugcuuuacuaaacagaaucacuucucauagacuauggaagauuugcugguuuuagaugaagcaucuggauguacauccacauuacuuuuccaauaaaacagacauucuugggacaguagucaggggaggauuaccugucaaaugucauucaucucagagaggccuugccugacuuaagucugcaauagcuugccucuuacccucuugcuugcuuuucauagcacuuuugcuaccuggaauuacaugauuuaguuuuucuuucuccugggccagacugugaacucugaguauggcugcaucugauuccauuacuguauccuuagcaccuuagagcaguuacuggcacaaaauaggcacucaguauauuuugacuuagugaucacucuaguagugcugugagagcuugauaauaaaguuuuuuuuuuuuuuaagacagcaucucgcucuguuauccaggcuggagugcaguggcacgaucucggcucacugcagccuccguguccuggguucaagagauucuccugccucagccuccuaaguagcuggaacuaugggugcgcgccaucacgccuggcuaauuuuuguauuuuuaguagagaugggguuucaccauguuggccaggauggucuugaucuccugaccuugugauccguccaccucggccucccaauaaucagaaauuuuuuuuuaggaaauaauugcaauaguggagguggagauggaaaggcggguauacgugagggaugucccucauaguacugggcacauaacaaaaucaucagugguuauuggucaguauaaaacaauggauguuauuacuaagaaccacuuaggguuguucuuuuuuaaacaaauacucauuaaacuuuguuuauggcucuauucagcuaauucuuuucaaauuagguauuucaaaaggguucuuuuuuaaauuuuuauuuuuuggcaccccagcaggaaaugaagaaaucuuuuuuaagagaaaaaauacaaaaaugcaguugaauuuccccaaguguguuuuuuuuguuuguuuugguuuuguuuuuuugagacgcagucucacucugucacccaggcuggagugcauuggcaugaucucggcccacugcaaccuccgacuccuggguucaggccauccucccaccucaaccucccgaguagcuggggcuacaggugcacaccaccacaccuggguaauuuuuguauuuuuuguagaaaucaggucuuucauuguuguccaggcugaccucuaacuccugagcucgagccauccuccugccuuggcuucccaaagugcugggacugcaguugugagccacugugcccaccucauuuuguuuucuucuuuugguacuaucaccacaaucuagccacaggacacuuuucaucuuguaaaacugaaauucuguacccauuaaacaauaacacccuauucuccccuccucgcagccccuggcaaccacucuucuacucugugucucugaguuugacuauucuagguaucucuuuuuuuuuucuuuuuguuuucuuuguagagauggggucucgcuguguugcccaggcuggucucaaacuccuggccucaagccauccuccugcuucccagaguacugggaauauaggcguaagccacugcaucugccucuuuuauuuuuuuaguaaccaaauagaaauuuggguggcuaucuuuugcuucuucugucagcuauacucccacaaaucucugugauugucaagguucaguaaccauauacacuacaugguuuaauaguaggaaaaacugccgggcacgguggcucacgccuguaaucccagcacuuugggaggccaaggcaggcagaucaccggcggucgggaguuugagaccagccugaccaacauggagaaaccccaucucuccuaaaaauacaaaauuagccaggcgugguggcacaugccuguaauuccagcuacuugggaggcugaggcaggagaaucacuucaaccugggaggcggagguuguggugagcugagauugcgccauugcacuccagccugggcaacaagagcgaaacugucucaaaaaaacaaaaaaaaaaaaaaguaggaaaaacuguugucaagagacuuaaguaaugauccauugaggaugaucuggcuuagauuuaaucaggaagggugguuagcuagauaacaagguuuguaguaauaaaauagaguuuucauaaauacugggaugaauuuuggagagccugaauacauuacauuuauucauacagcaaaauuuuuugaguacuaugcagacaccaaggauauagugcuggacaaauugagucaagucuaugcccucauagagcuaacauucuacucaggguauauagaaagcacaguuccuuggccuuccuagagucaguaauugagggacaaugagcuguguguucuagaugagcuagggaaaggaucgcuuuuccaacuugcuaagucuugagagccaguaagcaacccucaccugcccaaggucucacugccugccuguuuguggcaggaguugauuugcugcuuuuguaauaugaaccuuuugauuauuuaauagggcugauucauagucauguuuguucuuuucacuccuucccucuagcuuugggggaagagugaguuacuccuguuguuaaaaguuuugauugugucuggucuucucuggaaauccuaugacuuuuuucugucauuuugcaucuucaguuuuucagacuuuacugguuuuuccccuuuagcauauaaacaugccuauguuucuuuaaaaaauaaaauuucuguagguaaugcuucacuuucuccuuccuaucauugauaaacagccuacaaaguacucuugacuccucuugaccuagucuucaucuucuacuacuuacuugccagguacuccucaacccugucccuacugcuccauugaaacugcuuucacugaugacuccugguugccuauacaacagaagaauuuuaguucuuuuuguuuuguuuuuuugagacagagucucgcacucucgcccaggcuggaguguaguagccggaucuuggcucaccgcaagcucuaccucccagguucaugccuuucuccugccucagccuccugaguagccggaacuacaggugcccgccaccacguccggcuaauuuuuuguauuuuuaguagagaugggguuucaccguguuagccaggauggucuugaucuccugaccuugugauccgccugccuuggccucccaaagugcugggauuacaggcgugagccaccgugccuggcacauuuuaguucuuaacuuaccuaacuucucuuuaguuuucugccuauagagcuucuuucuccucacccguguuccuccuugucuccccuuccuucuuucccccucuucuuucuuucccuuccccaaucccuguuccaucugaaguuuccauguaagcuucucuuuuucugcccauuccuaaauagugauauauguuaagaauugucuuacugggccggaugugguggcucacgccuguaauccuagcacuuugggaggccgaggcagguggaucacgaggccaggagaucgagaccauccuggcuaacauggugaaaccccgucucuacuaaaaauacaaaaaauuagccgggccugguggcaggugccuguagucccagcuacuggggaggcugaggcaggagaauggugugaacccgggaggcagagcuugcagugagccgagauugugccacugcacuccagccugggcgacagagugagacuccgucucaaaaaauaaaaauaaaaaaagaauugucuuaccagcugggcgcaguggaucacgaggucaggaguuugagaccagccuggccaacauggugaaaccugucucuacuaaaaauacaaaaauuagcugggcacgguggugcgugcuuguaaucccagcuacucgggaggcugaggcaggagaauugcuugaacucaggaggcggagguugcagugagccaagaucaugccauugcccuccagcucugggcgacagagcaagacuccgucuuggggagaaaagaaagaauugucuuacuucuuuucucacucugcauggucucucugcuagcuuauuuacaucaguaaccucaaaugcaaauggcuuacaucaaaucuauagcucacuccggaccccucucugcaguuacugccccugcuuggcaucucuacucagcucucucauagauacugaacucaccuuuugccuaauuuugcaaaccuggcucuuuuagguuuccaucuccauuaguggcuccacaguucacccagucuuuaaagccagaaacuucugaaguuauucuagacucuucuuccuuagcuuccacaccaauuacuggucacacaauccuaauugaucuuuccucagauaucuaaauaaauaacucagauccaucccccguuucuccuuucccacaggugcuuucuuaguucagaauuuugucgcuuuauaccugcguugcugcaacagccuucuacuuuccuugccucuaccaugaguaucucucauucugucuuucaaaaacacugaucugaaaauuucccuucuguguaaaauuaacgauucuuuguagcuggcagaauacaguuuuguaugguacgucguuagcauagccuucuaagcuguucaucuuggcccuaccugucuuucugaacauguguccugcaaauuucccaaaugugcuacugaacucuagcugcacugaacuauuucuuguucucugugguaacacuuaacagauccuuccaucugaaaugcccuucuuuaaugccucuuugaucuaaugccucuugagguuucaaaauuuaacaugucaucucucagaacacuucuaugccuuugcucccacucauggaccaccagugaaugcacucuguauaguacgucuguuagaacgcaucauguuguuuucagcugccucagacugcacugucuacuccuugagaacagggacuguaucuuucauguaugaaugccuagcacaucauauaccaccugaccuucucagcaagcuuucaguaaaccauugaaaguuuuccugcuaggagauugugugauucuuaaaauccaccugaacguaaaugucuuuccacuauccuuucuuugccuucucauccuuauggcuuauuagcuccuuguuauacauuguauacacuaggaaaaaugagauuaaaauugagcccauccuuuuuguugcuugggaacaccucuuguaaagauagcuuauagauuaguuuaaaaacgucagaugcugaaauuuucuugcuuguaaagauucuuacuaaauuucaucacacuggaauuacguugauuccuugauugaaggaauccccuuaugggauuccgaaagacagcaggagaugaaguucagguaaauuaguacuuacuaaauacauaccuuagucauucucacuguuagagaaggaaguccaaaaugaguaaagacaguuucuaucuggaguuaagggucuaaguagagauugauguaguguaauucaaguuuaauacuaagcagccugggugccguggcucacaccuguaaucccagcacuucgggaggccaaggugguuggauugauugaggucgggaguacaagaccagccugccuaacauaacgaaaccccaucucuacuaaaaauacaaaaaauuagcugagccugguggcacacgccuguaaucccagcuacucgggaggcugagacaggauaaucacuugaaccauggaggcagagguugcagugagcuaagauuguaccacugcacuccagccugggaggcagagugaaacucugucucccaaaaaaacaaacagacaaacaaaaaccuuaaaacuaagcaaacaacuaagugcuguguauaauagcaguugaacaaaaccuaugaaguauauauagacaagggguauagaacagugcauguuucugaucucuucgacaauguuacuauaauaaacaguuuuuggaauuuuuuuccacccuggcuucaaagcuaguggaaauuaaaauuaaaguaaacauuuuaauuuuucuuacuaaugguaaacaaaauaaaaaucaaauagcugcuguuaacauuuugauaaacagccugucagcugucucuguauauauaacucaugguuuuuacauaaauuaaaucauacuacccaccuuguuuuaugcccuuauuuuacucaauguguaauggauacuuuuucauaaauguaaguaguaguuaaaauuuuuaggccaggcaagguggugugagucaugucuguuaauuccagcacuuugggagacugaggugggaggacugguugaggccaggauuucgagaccagccuaggcaacauagugagaccacaaaaaauuaaaauaaaaacccaggcaugguggcucauguuuguaguuccagcuacucaggaggcugaggugggaggaucacuugagcccaggaguucauggcugcagugagcugcaaucagaccacuguaaugcagccugggugacagcaagaacuugucuuaaaaaaagauuuuuuuuuuuaacucagaaugcauuuuccuuugagcaguugcauuuuaaaacuuguuccuaaggaaauaauugaagguaugcacaaagauguagcuauaaugauguguuuugcaacauuguguuaccaguauuauacugucaaguagugaagaaauagauaucuauugacauuaaacaauaucacaguauaucauuaggugaagaaaucacuaagacaauauguacaguaugguuucaauuuuuaauuuguguguauauacacauaugcauacaaguagcaaaaaauagaacaaaacuacauaucugggagaggaaauuucagguaguuuuaaauuuuguucuuuuuugcuuucugcuuuucuguaaaacuuagguaaguuguaucauuaaaaaggguuuuggggggccaggugcaggggcucaugccuguaaucccagcacuuugggaggcugagguggguggaucacuugaggccaggaguuccagaccagcccaucucuacuaaaaauacaaaauauuagcuggaugugguggugcacacuuguaaucccagcuacccaggaggcugaggcaugagaaucacuugaacccaggcgacagagguugcagcaagccgagauugggccacugcacuccagccugggugacagaucaaggcucugucucaaaaaacaaaaaacaaaaaaauuuuuuuugggccaggugcaguggcucaugccuguaaucccagcacuuagggaggcagaugugagaggggggggucucuugaggcuagaaguuugagaccagccuggacaacaucacaagacccuguuccuuaaaaaaaaaaaaaaaagaaagaaaagguuuuuggagccaagacuaauguaagguauuguuuguaaauugauuuuaugaaugcacaagaaauuucuuuguaacucuuaaccacaggcuaacugaauacuucaggcaacaugucagugaaucauaguuucuuccuggauaguguuucuauugggcaguuguucaauaaauacaugguucauaguaccuuuccugcagacaugaauacauagauacugucuacaaacaacugaucuuuuaaguuuugauucuuugauucuuccagaugucauuaccagaggauaaccucuaguuuucggagagucuuggcugauagcagcucagucuuucauauaaggaugaagauauuuagucuuuucauaucuccaguggccuugcacauaucagauuccccaaaauauuucuuuuuaugaguauuuuugucagcuuaauaagauguuaauuagcaggcaaauccuuuuggaggggaugauauuaaauacugcauucugguuuauacugagaucccaauaaaauuaaaacaauuucuucaguguuuuagaaaauauaaucauuuguugaggcuagcaugguguguaucugaaauacaaugucaacuuuuguggguuuuguuuuuguuuuuuuaagagacaggauuucacuauguugcccaggcuggaauacaguggcuauucacaggcaggaucauagcacacuguaaccuugaacuccugggcucaagcaguuuaccugccucagccuccugaauagcugggcuggaaaugaaucucuuaaugagauggauuuucuuuucuugucuuuucuuuuuuaauguaaaaagagacaaucucugucacccaggcuugagugcaguggcgugaucauagcucaguguaaucuggaacuccuggguucaaguagucuuccugccuaagccucccaaguaguuggcauuacuggccugggccacucuccugacuacaguguuauaguuuuaauugagaagcuaaaauuuaaaauaaaauuuuagguggagguuggaagagacauacaacucaguggggcuauauacuucuuuuuuguuuuugagacggagucucgcugugucgcccaggcuggagugcaguggcacgaucucagcucacugcaaccuccgccucucagauucaagugauucuuaugccucagccucccaaguagcugggaccacaggcaugugccaccacgcccggccaauuuuuguauuuuuaguagagaaggguuuucaccauauuggccaggcuggucuugaacuccugaccucaugguccaccugccuuggccucccaaagugcugggauuacaggcgugacccaccgcgcccggcccuuggggcuauacacuuuuuuaaguuuaauuuauauuuguguaucuuauuccuaacaggucagucauuggcaccaugaacuggaauaaaggugguccuggcacuaagcgaggauuuggcuuuggagguuuugccaucagugcugggaaaaaggaggaacccaaacucccacagcagucccacagugccuuuggggcaaccagcucuucuucuggauuuggaaagucagcuccaccacagcuuccuucuuucuacaaaauuggaucuaagcgggccaacuuugaugaagaaaaugcguaagugguaauuccugguaguguagcaaaguuuggacuuugauauauucauucuaucagcagaaauugaggcaaagaaacuuuguuucucaaauaauaaugaauucuuaaauuaugugucucgcugaauuccauuguuccuaauaaguuaaauuaucagguuuacucauuuguaaggaauguaauaccugugguguuacuuauaccuuuacucauucaguguuacguccuacugggcuguugcucacugugggauuagaagccauugaaacaggcugggcgugguagcugggcgugguggcucacaccuguaaucccagcacucugggaggccgagacggauggaucaucugacgucaggaguuugagaacagccuggccaauauggugaaacccugucuacuaaaaauacaaaacauuagccaggcgugguggugcacgccuauaaucccaacuacucaggaggaggcugaggcaggagaaucgcuugaacccgggaggcacagguugcagugagccaagauggugccauugcacuccaaccugggcgacagagcaagacucccaucucagaaaaaaaccaaaaagccauugaaacauaaauauggcugaagaguuuuauauaauucaugugguuuuuuuuuuuuuuuuuggaggcagaguuuugcucgucacccaggcuggaguauaauggugcaaucucgguucaccgcaacuucaaccucucgaguucaagugauucuccagccucacccuccuguguaggugggauuacaggcaugcaccaccaugcugggcuaauuuuuguauuauuaguagagaugggguuucaccauguuggccaggcuggucucaaacuccugaccucaggugaacugcccgccuuggccucccaaagugcugggauuacaugcaugagcuacugcaccuggccugguggucuuuacugcagucuuuuacugacaccauauaaauuguuuaguaaacacaggccguugucagaacugauggaaauacaaguuugcuucaacaucugagucuuuuuuuuuuuuuuuuuugagauggagucucucucacccaggcuggaaugcaguagcgcgaucuuggcucacugcaaccuccgccucccagguucaagugauucuccugccucagccucccaaguaacuaggacuacaggcacgugccaccaugcccagcuaauuuuuuguauuuuuaguacagacgggguuucaccguguuagccacaauggucucaaucuccugaccucaugauccgcccgccucagccucccaaacugcuaggauuauacaggcgugagccacugggcccgggcuacaucuaagucuucaaaacuaguauguuggaacgucugauagugguagaaaaaucuacucacauuuuucccauaguucucauaauugguaaaugcuuuuuaccaauuaccguuuuuaacuugcugauauaauaaugugguuagaaaaggcugggauuuaagggguugaguucuaauuucuauacaaaauaucucucuuugcugaaucugaagaaaucucuuguugcuauuauuuccaagcugauugugacacugcuucacugcuugagguuuuuuuuguuuuguuuuguuuuuguuguuguuuugagauagggucucacucugucacccaggcuggaguggaguggugcgaucaaggcucacugcagucucgaccucccaggcuaaagcaguuaagcaguucucccaccucagccuccugaguagcuaggaccauaggcacaugccaccauacccugcuaauuuuuuauucuuuuuuuuuucuuuuuugagauggagucucacugucucacccaggcuagagugcaguggcgugaucuaggcucacagcaaccuccacuuccuggguucaagugauucucacgccucagccucccauguagcugggauuacaggugccugccaccacacccagcugauuuuuguauuuuuaguagaaacgcgguuucaccagguuggccaggcuggccucgaacuccugaccucaggugauccacccgccucagccucccaaaaugcuggaauuaaaggccugagccaccaugccuggccaauuuuuuauucuuuuguagagacagggucuugcuuuguugcccgggcuggucugaaacuccugggcucaagugauccucccgccuuggccucccaaagugcugggauuauaggcgugagcuacugcacccagcagauguuaauuggaaaaaaaagcuucuaaaagacuuuuuuguuuuuguuuuuguuuuuguuuuuuuuuuuuuuuuuuugagacagaguuucgcucuuguugcccaggcuggagugcaguggcgugaucuaggcucacagcaaccucugccuccuggguucaagcaauucuccugucucagccuccuuaguagcugggauuacagacaugugccaccacgccuggcuaauuuuguauuuuuaguagagacagggauucuccguguuggccaggcugguuucaaacucguaaccucaggugaucugccugccucggccucccaaagugcugggauuacaagcaugagccacugcaccuggccaaaauauuuugaaaguacacaguaauauuuuagaaagcugacauguuauuuaggagucaaauauacaaguaguguuuaaguuuuagcaaagucagagaucauuauucuaaacagcaguuaaccaguucaggcuacuuuuucauuaguuaaauagaacacacuauauacaggaggcagagguggaaagacugcuugagcccaggagucugagcugcagauagcuauguuugcaucacugcacaucagccuguaugucagagugagacucugucucuaaaaaaacaaacaaaaaacuaaaaaccuacuauaugaaugaauaugcaugaguaaauauguguauauauguaugcuauauauugcauauauauugcaucguauaguauauagcgugaguaugcuauugcuacauuaguauacauaacaguuacuauauaaaggaguuggcauaagcauauagacuauauauuuuaggccaggcacaaucgcucacgucuguaaucccagcacuuugggaggccgagguggguguaucacuugaggucagaaguuugagaccagccuggacaacauggugaaaccccgucucuacuaaaaauacaaaaauuggucugggcaugguggcucaaaccuguaaucccagcacuuuggaaggccgaggcgggcggaucgccugaagucaggaguuagagaccagccuggacaacguggcaaaaccccaucucuacuaaaaauacaaaaauuagcugggugugguggcggcgcauauaaucccagcuacuugggaggcugaggcaggagaaucacuggaaccugggaggcagaggcugcacugaguugagaucgugccacugcacuccagccugggcgacagagcaagacuccaucucaaaaacaaaaagaccacaaaaauuaacugggugcaguggcgugcaccuguaaugccagcuauuugggagacugaggcaggagaauugcuugaaccugggugguggagguugcagugagcacagagaucacgccgcugcacugcagccugggcgacagggcgaggcugucucaaaaacaaaaaagcauauauacuauauaguuuagccuauauuauuguuacauauagucaguguuacauuaguguguauauauauguaugcauguguguauauagcauaacaguuaaagcuuuuaaaauaauuccuaggaagacuugaaaugcuuuaacuuuuuaaacugcaguuauuuauuuaaauuaauauuugguuauauuacuauuugaguuugagauuaaagucuaaacagugguuuaguuuauaaagagcuguauugacauccuuuucugaaauguuuguuaaagagaaagugauaccuuauccagccuuugaagauguccuuucugaauacuuaaguaguaucuuaaauuauuuuggauugagcauuuauuuucuugcuuuuuuccucguuuuuugagagagucuugcucugucacccaggcuggagugcaguggcacaaucucaguucacugcaaccuccaccuccuggguucaagcaguucucuugccucagccucccgaguagcugggauuacgggcaugugcaaccaugccuggcuaauuuuguauuuuuaguagacacaggguuucaccauguuggcugggcuggucucaaacucuugacaucaagugaugcaccugucucggccucccaaagugcugggauuagaggugugagccaccacgccuggccugaacauuuauuuucaauuccggaaguuuucuguugguccccagaaaauagcccagaauuucugagguuuuuggucuuaaaagaauaucucaaguuuuuauuaaggguuauaaagaauaaacuggauuucuaauguuucaguaaguuuccuuuuggcugugcacaguggcucucgccuguaaucucaguacuuuggaggcugaggagggcagaucacguaagguaaggaguucgagaccagccuggccaacauggugaaaccccugucucuacuaaaaauacaaaaauuagccaggcaugguggcaggugccugugaucccagcuacuagggagggcaaggcaggagaauagcuugaacccagaaggcggggguugcagggagcccagauugugccacugcacuccagccugggcgaugaggaaaaccccgucucaaaaaaaaaaaaaaguuuucuuuuuucccauagcacagcucuuuaauauuugucauauuuaucuaacaauggucaguaaguuuguacugaaaacucuucccuuuuaacagaacugggagcaugauuugacuauacacuauugaaauggagaaucucuugugauuacuuuuuuguaauauugaaauuuugcauguauuaaguaguacuuaauaauuaggucauuagccaaagccuuggaggucucuaauuugaucugcauuacaucuccuaauaauaagauauaccauaauaaaaauguuguuaaaugaaagauuuacugaccccaaaguaagcauucacuuuaccaguuugcuuucuaauucucagcuauuuugaagaugaggaagaagauucuagcaacguugauuuaccuuacauuccugcugaaaacucaccaacucgccagcaauuccauuccaagccaguagauucugacagcgaugaugaucccuuggaggcauucauggcugaaguggaggcaaguaucaacauguuucauuaaaauauuuagcaguuagaaauagaucaaguuaacuuaguacuucaaaucuuauucaaaauuuguuuucuagucuuauuauuuuuuuuuuuuugagaauuuugcuccaguagucuauaguugcauauaucuacuuccacuugcccuguaguacuuuugcaaugauugguggcuagaaauuugaacuguaacccaugaacaugguagcucuagacguauauguguguauguauuuuauuuuaauaaucuuagcauauucuuaaauggaauuaauauucaaucuagcauuuguuaaguacauauuuauguaagguaauuaaacuuaaggaacuugccaaaauuauaaauucuguauucuguaguuuuaaauguuauuucuucaucaacauucaugaccucccuguagaaauuuaaccucaugaccaccuccuugaaacucuucucacuaggcuuuugugauuuuguguuauuuuccuuuuucaucuuucuguuuucuguuuguuuuuguuuucuugcuauuuuuauuguggaaaaauuuaaacacauacaaagauagaauaauaaaaugaaccuucauguaccuuuaaccaacuuuauuaguuaacaacuuuuggccacucuuguuuuauccaaucucucccaccucugauucuuucuuuuccuuucucuuuuuuuuuuucuuucuuucuuuuauuuuuuugagacaaagucuugcucugaugugggcuggcuagaguguaguaguaugaucauggcucacugcagccucaaacuccugggcucaaaugauccuccugccucagccuccugaauagcugagauugcaggugugcaccaccauacccagcuaauuuuuaaaguuuuuauagaggugaggucuugcuuuguuaaccaggcugguuuugaacuucuagccucaagugauccucuagccucagccucccaaagcgcuuggaccacaggcauaagccacugugcccaauccaauucuguuuuggauuauuuuaaaaucucagacauauaauuuuauccaucaguauuucucugagaacacucuuacaaauuacaaccaccauguuauugucgcacccaaaaaacaaaucauuaaauauccaucuguuauuugugauccuucuugccaucuuccuccaauuuuucacauacagagguccuuuuacagcucucuauauugauuauuauauagcagaucauuaagaauguucauuauuuaauuuaauccucaaaauaauggugggaaauaggcagaaaaauuuauauauauauauauauauauauaauuuuuuaacugauaacaaaaccgagacccaagauaauucaaaucacuugccccaaaucauauugguacuuaauguggcagaccuggaacucaaaucuaauuucgcuugcuuaguaguccugaaggucuagcuguuucccauacaucaugcugccuuuccucuucucauuggccaaaaucugucaaucuuuauaauagcccuugcauuuguucuuuccuuucuguugccauuguagccauccuacuuuacacucucguaaauucucucccugcuuuaggcucucugcugucuuauuagguaguauacagcuacagguuaauuagaccaaaauauguuucuuuucauguuauucuccauacuuaaaaacugucacuuuagauggcuggacaugguggcucauaccuauaaucccagcauuucgggaggcugaggcaggaggaucccucgagucuaggaguucaagaucagccuaggcagcauagcgagucccugucucuacaaaaaauaaaauuuagccaggcgugguggcaugcugcuguaguuccagcuacuugagaggcugagguuguagugagccaugaucaugccacuacucagccuggaugacaaagugagacccuuucucaacaaaaugaaaccaaaaacuaucacuuuagacuaugugccguagcucacaccuauaacccccaguauuuugcagggccaaggugggagaauugcuugagguugggcagcauagugagacccugucuauaaaaaaaaaaaaaaauuuggccgggcacaguggcucacggcucacauuuguaaucccagcacuuugggaggccgaggugggcugaucaacaguuugagaccagccuggccaacauggugaaacuccaucucuacuaaaaauacaaaaaaaauuagccaggcaugguggugcaugccuguaauuccugcuacucgggaggcugaggcaggagaaucgcuugaaccugggaggcagagguuauagugaaccgagauggcgccauugcacuccagccugggcaauagagugagacuccaucuuaaaaaaaaaaaaaaaaagaaaaauugucacuuaauuaguuaugaaauaaaauccuuucggauuccuuaguuacuugucuucagccagaauacaccucuccuccaaggaaguagggaaagaaauaauccaagauuaauguguuuuuguuuggccuagacauugcuuuuuuaaaaugugagccaacauuuuuaguaucaggggaucuugucuaauaguucagacuguugaaaaaaggaagaucuggcaauauacuaagucuguguuuuuguguggcagaaagaggcuauugcugagcaaauggcugccuacauuagacaaggcaugcuuuuccuugcucaccauaguuacaucaaucccuguuuucuucuuaaccuugaggccacuguuuauagcaccauuugucauuucucuugcacuguaauuuuuuucuuuugagacaggaucucucgcccaagccagagugcaguggcaccauuacagucacuguaaccucaaauuccuaggcucaagugauccuccugccucagccucccaaguagcuggaacuacaggugcacggcaccacaccaccacacuuggcuaauuuuuagaaaauauuuuuucccaggccggucucaaacucguagccucaggcagucucuccaccuuggccucucagagugcuggaauugcaggugugggucugugcccagccucuguauuguaauuuuucuuaggguggagaauuauuuuucugaacuuaguucucuaucagauaucagaaaacaaaagacucagggugauguaagaaaaauuagaguacauuucuguagaagaauaugccuacuuauuuccaguuuggucuuugaauuugccaucuuugauuuauaacaacuuaaguuacuuacugaagaauauacaccuaauagguggcagagccaaaauucaccuccaaaccccauauuccuuaugcaguaucauucuguaucugaguucuuauaguguuguguauuucugccacuuacaaacuauacaggauacuuaccaaacacccagacuauucaggguauacgugugucuugcagcauaguagguauuuaguuaauauguuaagugauuuacccuaggaguaaaggcaauaaaugaauugucaucuuugagaugucuuguaugcguuguuuucuucaucuucuugagauacgaacauuuccuaaugggcuauguuuccuagagaaucuggucucguuauuucuugagggaucccuagugaugaauuaaaagaaaaauuagcucugauuuucuggguuuaaauguagauuuaugguaguacaaacuggcauagcccuuucugagugacaguauccgagaauaggcuaaauucuuuugcuuggccuuuuuucuuuuuggagggaggaauggagcuucacccuuguugcccaggcuggaaugcaauggcucagucucagcucaccacaaccucugccucccgggucccggguucaagcgauucuccugccucagcuucccgaguagcugagauuacaggcaugugccaccaugcuuggcuaauuuuguauuuuuaguagagacaggguuucuccauauuggucaggcugcccucgaacuccugaccucaggugaucugcccgccuuggccucccaaggugcugggauuacgggcgugagccaccgcacccggcccagaugucaaauuuuauagaaaguauaaacuuuucuagugcuugaacuagaugaagauuuauuuuuagccaguguucugaaaaaggauuuauguaggcuuaaacaauauguucuaccacuuuuggugaccuguuucuuauguuacauugcuuaugucaucuucaguuuauagucuuaaauauaucuuauagcugguucaguccuccgaaaaguagguuguuuguaugcauugcuucucuuuaaaacaauuucucuucaucaggaacauuugguuugauagaacacccgaucaugccacaguauauauaguggcauuuuuaaaaaucugagauugccagaaaaacucacggugcuuuauagugagaaaaaguugugcagaauguguauaaagccuugggaaaaaucauuuaacucuucugaccuugauuuucaaauguauaaugcaaaugauuaauuuugaucagugaucaucaauuugcaguauauaaaaauugccuaggccgggcgcgguggaucaccugaggucacgagcucgagaccagccugaccaacauggagaaaccccgucucuacuaaaaauacaaaauuagcuggaugugguggcucauaccuguaaucccagcuuacucaggaggcugaggcaggagaaucgcuugaaccugggaggaggagguuguggugagccaagauggugccauugcacuccagccugggcaacgagagcgaaacuccaucucaaaaaaaaaaaaaaaaaagaauugccuaugaaaaauguaaaaacuacacacauuuaacucacuccagccccaaggauucugauuuaguagauguagaacagaauuuucagccuugagacuacugucauuuggcgcuggauaauuauuuguuguggggcuuuccuguguauuguagaauguuuaguagccauccuccgccucuagaaaccaguacuaucagcuguaccacccccaaaauuaaaaaugucuccagacauugccagauguugccuaggggcaaaauugucccagauugagagcaaccuuuccagagucagauguauguggucuuaagcuauacuuugaggaaggccuaucugccugaauugaaagcacuuuauaucuguaauuuuaucauuaacuuaaagcaacuuaagguuauguauuugugaagcaagcauuuuuguucauuuuuccauguguggcacauuauuacagauaaaauugugcaguccauauacagccaauuuauacagcauuuaguuauuucucuuugaaaaauaauugucaaaaugcaauuugauggcaucaaaaugcacuugucaaauacauagcuaaagcuauuauggcacuuguuccaaucuaaaaauuguuucuuucaguguuuuuaguugaugucauucuauacagccuuuuguuucauuaggaucaggcagcuagagacaugaagaggcuugaagaaaaggacaaggaaagaaaaaacguaaaguaaguuguuuucuucucccucacaaagguuacgugaaaacugcugaaguauugcaaagucuauucccccaaaguuuauagagaaaaaauauugacguacacuuguguacuuuacuugaaguuauuccuguaucuugaauacuuuaagaauagagauggcaacagucuuugcauuugcaauaauuaaaaagcauucaguuugguagaauaguauuuggucuuugacuauaaauaguuguuuaguaaacacaaggaaugaauuauaguagaguuuaggggagcauaauuauuaaaguuuaggcucauuguucugaguuugucgcauaauuaauauaaaauagguuuaugccuauaugguugauuaugagaaguaauggcaacuguaucaugaaaacuauguauaguugaaccuuugaacaacacagguuugaacugcgugaguccacucauggggauuuuuuucaaccaacacagguggaaaaauaauauucacaguauaaaaaccuguguauaaggagggcuguaauaauaccuaauuuuauuuagcuccagagugacauugugcuguagcagccauagucagaacuugaaguacuuuauuuucugggaaagagaagucucuuugccuugaugaauaaacuccuaaggcuuuuucugccagucaugauuggacuuuuuucucccugugcuuggcagucagugcuucaguccuuuaccaggguuucuguuccauauggagauuuagcugugguuuugguauucacuguaugucauauccccuuccaccugcccugcacuggugguguugcuugccgguugccuuaggaauagcaagcgcucuagguuaggcagaaagucugauuagaaacagaugguugugggaacuaagcaaccauauuuucucuauagcuccugagacauacagcaaguggugaugguccccuucuccaugugaacuguuuaagcguuuuauucccaaacucauaaaggaguuaauguaguuuucacucuguccccaucccuaagguaacugcuuuuggcugaaaaccauuuacccuagagcuagaaacuuuggggacaauaagaagguugugaccuuucuaguauaugccaaauacaagauuuuuuuuuucuuuuuaguaugaaauacuuuucacaaccgcauuguuuguuguauggauucacaaaacuaggaccauuugguaucugucuucagaaaguuuuuacgucugauauccuuguugguaaccgcuguuucuagggguaucauaucaucccauuuaaaagaaaugcaaacugcagauuauagagugcagcuacacauauauauaaugggguggauaguuuauagugugcucauugcugcuuuguuauuauuaguguugagaguuccugugcuguguggaauucaacacuaaucugcuguaaguauggagcuggguauguggaacauuugcagggaaguuuguuucuccgcuuguuuuuccagggguauucgagaugacauugaagaggaagaugaccaagugaguuccuaugcaguauuucuaucuuuuauuuuuauccacaaagucuauacuggggacaagcuagagcuugccuucacucaaaauggccauuccugacauucagcagggaaugucauuugauuugcuccuuuuguaccugugugaccaauugguaauacauagauucacauggcuuucccccauauugaagauggaauuuuugaucaacugugacauccaaagcaaauacgagcuuuauucagcuugcuucuuuuuaaauccaaaauuaauguuuauucugauaaaucaagugguagaguagugugggaucuauugauggccucugguaacaucuaaccucugucucuuaguaaguguccuguuugugguucuuguauuucaagcuggaacauuaauuacuguccauuagucucuuuucccccauuguucaguuguggagugaugagaaucagagugagugguagccguuuccagguuugugaccuuucuaauuagcguuaacuuccaaacuuggauuguuaaagccacagcauguguucuauggcucugggcaggguugauagacaccccacuccaggaaggcuguggaacagacagauuuguaagucuucuauuaaacaaguugcaacauuuaauaguacuaacuguuuaauucauuucuucugauuguucuucugaauauugcuauuauuaaaggaaucauugcuaguaaggaucuugccuuacuugguagguauguuaacugugcaauuaucugguacacuaugugcgcuaauuacaggagcagaaacauucucaauuguacuugggugugauuauguucuugugcuuuccugcaggaagcuuauuuucgauacauggcagaaaacccaacugcuggugugguucaggaggaagaggaagacaaucuagaauaugauagugacggaaauccaauugcaccuaccaaaaaaaucauugauccucuuccccccauugaucauucagagguaugguguuucuugcugaauuuuacucuuguuucaagcugaugcuuuacuucagcuuuaacauuuagauuuucucaguaguggaauacucuuacaucaugagcguaugcaucuugucaucucuacuaagugguugagccacaaauuccaugaggcuuuauagccuguuuuguucaaaaguauaaccaaaucacuuacauuugacuuuagaauuaaaacauuuuuuucaaguaauuguacuuguuuuccagaaccaauauuucuuucuuuucuuucuuucucuuucuuucuuuucuuuccuuccuuccuuucuuucuuuucuuuccuuccuuccuuucuuucuuuuucuuuucuucuuucuuucucccuuucucuuuccuuuuuuuccucucuuucuucuuucuuucuucucuucucuuucuucucuuuuauuuucuuucuucuuuuucucucucucucugucucucugucacccaggcuggagugcaguggcacagucuuggcucucugcaacgcugacuccuggguucaagcaauucugccugccucagccuccuggguaacugggauuacaggugcccacuaccaugccuggcuaauuuuuuuuaaauauuuuugguagagaugggguuuugccauguuggccaggcuggucuugagcuccugaccucaggugaucccccugccucggccucccaaagcgcugggauuacaggcgugagccaccgcacccagccuugacaucuuucuuucaaacugggaacguuuuggccuguguuuacuguuuuuguuguuguugcuauauugcccagacuggccccaaauccccuggcucaagugauccuuucacuucagccuccugaguagcugggacuacaggugcacaccacuguaccuggcaugccuuuauuuuuuuguuuauuuuuuuuccagacgaagucuugcucuauugcccaggcuggagugcaguggcgcaaucuuggcuuacugcagccucugcuucccagguucauuuuuaguagagaugggauuuuaccacguuggccaggcuggucucgaacuccugaccccaagugauccacccaccuuggucucccaaagugcugggauuacagaugugagccacugcauccggucacauuuguuuuuuuaauugcuauaaauuuuuacuguugguccuagaucuggggcagaugagaggcuguuucuucacaguggagccaguaauuacaggauccuuaaggaaugaggacaucgguauacccacuugaaaaaauaucaguguuucauccagguuaaauaucagccgagaucucacauacacuaaugauucuagaucuggagcagugguucucaguguggaccaagaaccccuuucagggagccuacagaguccaaacacuuuucauuauaccaagauuguuuuccuuuguuacugcaucaacauuuacauuguugguguaaaagcagugauaaguaaaacugcugaugccuuagcaugaaucaagccaguggcaccaaacuguucuaguaggcguauucucuguucucagaccauugcaguuaaaaagaaaaaaaaaggccaguuucacucaagaaugcccugaacaguaaaaauuauuaaagucgugacccuugagcuacaugucuuuuuauucugugugauaaaaugggaaguacgcauaaagcauuucuguugcauaccaaaauaugauagccauuucaaggaaaagcacuuauguguuugaguuguaaggugaacuagcuacuuuuuuucauagaacaccacuuucacuggacaaaaucaaugacauuucaaggaaaacaauugaaaguguuuauuacccaugauagacauucaagcuuucggccagacgcaauggcucacgccuguaauuucaacacuuugggaggcugaggcggguagaucgcuugagcucaggaauuugagauaagccugggcaacuuggugaaacuccaucuaaauuuuguuuuuuaauaacaaaauucaggcuggguaugguggcucaugccuguaaucccagcacuuugggaggccgaggcggguggaucaccugaggucagcaguuugagaccagccugaccaacauggagaaaccccaucucuacuaaaaauacagaauuagccaggcaugguggugcaugccuguaaucccagcuacucgggagagugaggcaggagagucacucaaauccaggaggcggagguugcagugagccgagaucaugccauugcacuccagccugggcaauaagaacaacacuccaucucaaaaaaaaaaaaaaauucaagcuuucaagcaaaaauuagaauuuggaaaacuuacaucuaccacaguaggcuugacagcuuuucaguacuuaaagaccauugugacaaaauugauggugauauuaguaacugauuuuuaauauaaugaaauguguuaacauuuggaugaucuguauauaaccucagugaaccaauauuuuccaaaugaucaauguaugacauuacaaagucaagcaugaauaaaagcucaacucaaaauacaugauaaauaaauggauuauaauguaacagagugugaaaacuucaguaauaugguuucagauuacacaaugaaaauaacuuuuaggaaaugaccacuugucaaguuuuaguguaaaauaaaaaguaucugaaaagggcugggugcgguggcucaugccuguaauuccagcacuuugggaggccaaggugggcagaucacuugagggcaggaguuugagaccagccuggccaacauggugaaacccccgucuuugggauugguggcaggcaucaguaaucccaguuacucaggaggcugaggcaggggaaucacuuaaaccuuggaggaggagguugcagugagcugagguugugccacugcacuccagccugggagacagagcaagacuccaucucaaaaaaaaaaaaaaaaaaagguaucugaaaaggcuacuaaaauacuguccucucuuuuucaacuacguauuuuuccuuugcuuuuuuuucuuuuuuugagauggaguccugcucugucgcccaggcuggagugcagugacgcaaccuuggcucacugcaaccuccuccuccucccggguucaagagauucuccugccucagccucccgaguagcugggacuacaggugugugccacuacgcccggcuaauuuuuguauuuuugguagagacgggcuuucaccauguuggccaggcuggucuugaacuccugaccucaagugauccaucggccucagccucccaaagugcugggauuacggguaugagccacugcuccaggccuggaggcaagaauuucuuauaggcuuaaauaaaaccaaccuauugcaauaauuugaauauaguaggagcuauuuaagucgacauuaauaaagagauuugugaaaauacaauagugucacucuucuuccaauuuuuuuuauguauccagaacuaugauuuuuuuuuuuaacuaccuauagaaugcuuauauuuuucuuaaaaaauaaguuuaagaaccaggcaugguggugcaugcuuggagucccagcuacuggagaggcugaggcaggagaaucacuugagcccaggaguuugagucuagccugggcaacauagcaagacccugucucugaaaaaaaaaauaguuuauaaaaaauaauuuagccaaauugauagguggugaugugcuuauguuuuguauaccuacuacacuaagcuaugaaaagaauaauagaagugacuacuacuuucuggaauuggaaauucuuggccauacauuuuuuaaaaguuauaaacaacuccauguuuuuaaacagaauagaacucccucuaaaagcagagcuaucuccaaaauaaauauuaggaguguuuuuaaaugcuuagagcuagguuaaacagcuuuauucaaaacauauuuaaauguuauauggugaaauaucuucucuguccucugaggucuuuggcauuauagagagauuccuuagucugcuucaauguuguucaaauucgagguuuccuuaagagucucuuuaggaaguagguugguguuaggcuaggcacaguggcucaugccuguaaucccagcuacuugggaggcugagguggcgugagaauuguuugaaccggggagguggaggcugcagugagccaggaucgcaccacugcacuacagccugggugacagagcgaaacugucucaaccaauaaaagaaguagguugguguuuauauugaaaauaggaacagaaaacaaacuagcuauacuuuuuaggaucuaagcugagaauaaauuaauuuuuuugcuuucucuagcuggaauggcuuuacuuguguaaaauuuggaaaagauuauuuugcaauaaaaucaaacuuacagaauugacucuugaauucuagacuaacuuugaauaauuggaccugcagauugacuauccaccauuugaaaaaaacuuuuacaaugagcaugaagagauaaccaaccucacuccacagcaguuaauagaucuccggcauaagcucaaucuucggguaagcaucauuaagcucaauauucuuaauauuaauguuaauuaguccagauuuaguauuauugguuaucuaaacuaauaaccuugaauuucuuuucuaauggucucugaacugucuuugccagaguaauuauuauaucccuucuguucaugucucuuaauuugauuguuuuagucuucuagaugcuguuuuaggauaggaucauuuucuuguuucauauuucagucaguuuuauauguucugugcuggaugggcuagugaugaagggugggaguccccaucuaaaggaagaggaaacaaaaggaauagauguuaacagaugauaucuuagaauauuuugaaaugaagauaaacuugucugucaaauuacauauaguaugcuuuauuuuaaaaauuagaauaaacuaauaccuuuuaaaaauaugcauguacuaauuucagaaugguuuaaacugccuaccagaaaguuuugggcugcacauuggcuacauugguuuaaggugcugauagaugguaaaugaaacacacagaaaaaauaugcuaugcuaucuacucuaauauagacaacuuucucgccugugugcaccuuaucaguugcuacacgauguuuaaacuccuguuuuccaggagggguguguauuuguguguguacacuugucuguuuuccaagagguuacucaucuccccagugacccaagaaaaauuuuaaguaaaaccccugaaauccugauuggaaauaucaacaucaccagagaagcauugaaagguuaccacuuugggggacaaaauggagauuauaagccccauucuucaccuaggugcaguuugaacagggcuugacaguggcuggaccaucacuaagugagacuuuaauucaucaagcauaacugaaaauggaggcaguagauuauaucuugguagccagcauguguagacuugucuuauuuggagcccacuuggaauuuucauuucaagaguaagauacauuaauuuuuuucuaccaucugguuaauacuuaaugcaaaauggcaaaagaacaguuauggcuucccaauucauugaacaauuuuuuuuccguuuuauuuguuaugagaaaauuaauuuugaguuaagaaauuuuuaaucauuuaaaauuguaugacaauuaucuugggaauauuuaucauggaguuuuuaauaugagguuuauauuuguuaccauuugagguuuuuccuuuucauuguaugauuuuggcuuacagacuuguauuuuuacuucauacuccagcuaaaaugcuagauccagguaaguauuguugaacuucaaaugcuguuaauguugaaguacaagucauucuggggaguugucucuaucucuaggucucuggugcugcaccuccuagaccaggaaguagcuuugcucauuuuggguuugacgaacaacuuaugcaccagauucggaaaucugaauacacacagcccacuccaauacagugccagguaaguaaaacauaaugaaagaaaaauaaaguaggguagucuuucaugacuauauuaauuuaaaaacaaaucacagcaguaaaacaguguuuaguguagaaccuuguugauaaggauagagguauuuaucacucuuaagaagucacuaaauggcugacaaauauucuuuuguaucugauacguauguugaaaauaugauaugaagaaaauaauuuauuaggccuaaaccuaaccaaaaagguucguauauagacaaauuuagcacugucaaugacuagaauuccuucguucgucacuugaaaauucucauucauuacugaaaguuuuagcuucuuuuucccauuuauauaugggauuuauuuauucuuaugcagaacauucucauuuucuguauaugaaugagauagucuguaccuucuuaaggggggaaaauuuuuaaaauuuuagcaacccuucauuauaaauugcaauuuuucuguuuuguuuuuguuuuuguuuuuuuuggggacagagucucacucuguuguccaagcuggagugcaguggcgcgaucuuggcucacugcaaucucugccucccagguucaagcaauucuccugccucggccucccaaguaggugggauuacaggcgcacgccagcacaccuggcuaauuuuuuguauuuuaguugagauaggguuucaccguguugcccaggcuggucucgagcuccugagcucagggaaccugcccaccucggccucccaaagugcugggauuacaggcgugagccacugcccggccuugauuuuucauuucuguauuuuaaacaaaauggaguuguuucuguucuguaagugguggcugauauccacguaaugagaaugaugucauuuccuauaaaucaagaaguuaaugagaauguuggauauugauauuucuauuucacaaccaguaugcauagcaccagguauguuuuguuccauugcaaauaaaaauguuaguagucauuuaucauuccccaggauuugcuucaguacaucuuuagaauugaaauuuuagagugguuauauuuuacuuuuucuccagggugugccuguggcauuaagugguagagacaugauugguauugccaaaacagguagugggaaaacugcagccuucauuuggcccauguugauucauauaauggaccagaaggaguuggaaccaggugauggaccaauugcagugauuguguguccuaccagggagcuuugccagcagguaugugcuuucuauagaaugccuccuuccauauguggacuagcaagggaccagccagucaagugagguagaaugaccaggaaacuuuuuuuuuuaauugugauaagauacacacaaaauugauuaucuuaaccauuuuuaauguacaguucaguggcauuaaguauauucacaguguugugcuaccaggaaacuuuuggaaaguauuauguguuaaauauuuucuauauaaccaaauacauauuuuccccuaaaaacuacuguuuuuauuuauuuuuauuuauuugcuuuuuuugagacagagucucacucuuuugcccaggcuggagugcaguggugugaucucagcucacugcaaccuccaccucccaguuucaagcaauucuccugccucagccgagaggcugggaucacgggcacacgccaccacaccuggcuaauuuuuuuauuuuuaguagagacgggguuucaccauguuggccaggcuggucucaaacuccugaccucaagugaucugcuugccuuggccucccacagugcugggauuacaggugugagccacugugcccggccagaacuacuuuuuuuaagaggaaaagccuauugugauauggggauuguuuguauuauaagcugacaguuuuucuguaggaugaguucauuuuaucuugguagaaaagcagugacaggaucaggaagagaaggggguaaaaugaauaaaagauuuuagauaaucuguugagaugcaauaaugguauuccauucauuuauaccuuuaugaauaaaaucgugguuuuaaaguauguucuagguuucgauuuuuuaugacaucacauucuguuuuucagaacuucguuuggguugugacagguauuuguuagugucacaguuuguuaauauauuauucacaacuuuguagauccaugcagaauguaagcgguuuggaaaagcauauaaucuucgaucaguggccguauauggaggagggaguaugugggagcaggccaaggcccuucaggagggggcagagauuguuguguguaccccaguaaguaugccuuguguuuaaauggcuucucagccucccucgguauggaaaacaugauuaguuuugcagagaauuuccccuaaagugugguaaaagcaggguugaaaauauacugaugaacggcaggcugugguuuuaauuuugauugguggcuaaauuagcaguucagugagagucucugugacauauaggcuaguagcuacaaauuccccucuaugucaaauaguuuuucuuauacucucccacaaaaugauugccaaguucaucaagaaucagaaagauacauauggucagaauagccuagaagaguguaguuuaaacauugaaaccugucauuaugcuuuaaaucaggucacuuuagaaugccucaaaaacugcuucuggccacuuucccacagaauuuaaaucacaguguaaaugaagaugccgauugaguuuucaaaauuucuguuccuuugagcuaaguagugcauaagguauguggcuguuggaccaguaucuauuacagucugagacuagagaauuagcacuuuugccaggagugcaacugcuuagaaagucccugugaaugccuuuaauuauacuuacuguucauuuuguugaucuuauagggucgacugauagaucaugugaaaaagaaagcuaccaaucuucaaagagucucuuaccuuguguuugaugaagcagaucgaauguuugacaugggauuugguaugccuugaauaccaguuucuucuguccccauccucaugauacuaguuuuuuuuccaugucuuucuagacuguuuuuucagcaugagagaagcuaaaaauacuccuggaugggguuagacuauagaaauauagcuaagaugaacauuuuuaggaguuuucucuggaaaaguauguuagguuuuauuggguugaggaaauuucaaagugccuuuguauauaaggggaauauuuucucugucuucauuuuuauccauaugccuuugaucauagagguuaaggucuguguucuuggguagaugaaugucagaucauucgaggcccuuugcuuuccuauccucguagcugucuuuacugauuggaacacugcuagaccuagcccaguuggauggagggaaaauuuuucacuuuuaugcugaaugauauguuuaggagcuucuuuuuucuugagacagaguuuugcuuuuguugcccaggcugcagugcagcggugcgaucucacugcaacuuccuccuuccaguuucaagcgauucuucugccucagccuccugaguaguuggggugauaggcaccuaccccacagccuggcuauuuuuuuuuuuuuuuuuuuuugguauuuuuaguagagauagcuguguugaccaggcugcgaacuccugaccucaagugauccgccugcuucggccuccgaaagugcuaggauuacaggcaugagccacugugccuggccugggguuucuaauuuucuuaauucuuacaacuucuuaugaagacuuuuacuaauauggcuuuuuccaggcuucccaaacuguauuucagguuauaauaauuuuauuguucuguuucuugcagaguaccaaguucgauccauagcaagucauguucguccugacaggcagaguauguaugaagcaccuuuguuaaaccaaauuuguacuaaaaagggcacuuauuuauuuuauaagcacucagaguuauggaaguaaaaaugaucuugugucuguuggugagaaccauaauaagggagguaaugaguuuaucugagcuggacaggaucuuagcacuagauauaacuuguuccuuuuuauagaugauaaaaccaaggaucagaaauuaaauaaacugcccuaaauuauacaguuuuaucaguggguagaagcaguguacaguacagaucugcugauuugaaaucaagagucuuuuucugaaccauacugacaacuugucuuaacuaaaaauguaauaaaaauagaauaagagcaaaucuuucccuagugaaucaguuucuaaacuaaauuuaaaguucaggugagcuuauguaaaaaaacugaauaauccugaaugccaaagaagcuuaauggguaugcauaaagauaucauauuguuucucuaacagaauuuaucuuaccuuuuagcucucuuauuuagugcaacuuuucggaagaagauugaaaaguuggccagagacauccugaucgacccuauucgaguggugcagggagauauuggagagguaacccuaagcagggcuggaugggaccuuaauggguuuauuucucauauuauggaacacagaauuaauuucucacuauugagauaaaaaaaaaagauguuauguuuauagaugcaacaugcuugagauuggguauuuugcaaguuguggggauagacguaacaagacuggcaaaauguugggaaucauugaagcuaggugauggguaugaguugauuuuguucauuuuguguuuuuuuuguuuuauugaaugucucaaaacuuacaauuguuuuaaaaaggcuucaaagagacaaaaagaugugccuggaagcaucagcguauuagguuggaacugacguuuuaauuauugugguaggggccuacgcaggagggaaagggugaccuggaaggccuggaaaaaaucagguuucauuucuuaccuguacauaugcgcuaugugaaaaauuacucugaauugggacuuggaauucaguuauggcugcuuagagaauccuucaguugcuugccaugguuauuguuaaggaaagcucuacaaaguaguggggcauacaaauuagguauguacaccagguggagagcaaggugauuggaaaggagaggugaguuuugagcugcacuugacuugcugaaggcccaaggagaacugggauuguucaaggucuucucgaugcagguagaaauauaaugccuaguccuuguucaggugcccuguggcuccaaugucacaaucaucuguuucauuucuuccuucucaggcaaaugaagaugugacacagauuguggagauucuccauucuggaccuaguaaauggaacuggcuuacccggcgucugguagaauuuaccucuucagggaguguccuccucuuuguuacuaaaaaagccaaugcugaagagcuagcgaauaaccuuaaacaggagggucauaaucuugggcugcuccauggggauauggaucagagugagagaaacaaggucauuucagacuuuaagaaaaaggacaucccaguccugguggccacagauguugcagguagaguaugaauuuuucaacaacauuaaguuccuaggcuauaaggguacucugucuuacuacauaagaccuauaauaucugagcaggcugauggaaagacuguuggccuggcuggccauccccucccaaacccccaaggaagcagcaguucagcacagggaucacagucuggagcucuagauaccacuuuucacuuaguauuucucucuaaucaaagaaucccugcagcuagaagucacucugggaaaaaaggcagugaaugcccuuauuguaugucugaauauaguagauaccuuacccuuacauugaucuacuauacacagcuuaguugggcaacuuaacucaggaugagaacaguuuuuggaauauaauuucuggauuuguucugucaaguuuuaauaacuacccuuaaacacugauauuuuuuccuagaaaggagagaacuucucagcuucaugacacauuuuaaauauauauucccagugcaagagaagagggcauggcagauuacugaugcaaaagauaaaagucccagucgggcacgguggcucacaccuguaaucccagcauuuugggagguggaggcgggcggaucaccugaggucaggagaucgagaccauccuggccaacauagugaaaccccgucucuacuaaaaauacaaaaauuagcugggugugguggcgcgugccuauaaucccagcuacuuggaaagcugaggcaggagaauugcuugaaccagggagucggagguugcagugagccgagaucauggcacugcacucccgucuggcaacagagcaagacuccgucucuaaaaaauaaaagucccuuacacuagaaggccuaacaucauagaaucugugguggugacuuaacaugccuguaucucagcucaccaaacccaugcgcuuugccuagauaaaggaaauguggcuuauuagcacuagcauuucugguuacuuugaucuucugacuacagaugaagaauaaaagaauuugguugcuuuuuauuucagcccguggucuggacauuccuucaauuaagacugucauuaacuaugauguggcacgagacauugauacccacacgcauaggauuggccgcacaggaagagcgggugagaaagguguggccuauacccuacucacucccaaggacagcaauuuugcuggugaccugguccggaacuuggaaggagccaaucaacacguuucuaaggaacuccuagaucuggcaaugcaggugaggggcugggcacacuuucaauugcuccugguuauaagaccaagacauuuuagcaguccuggaacagauaacauaaaaacuugacaagaaaguuggguggcuaggaggauguggggcuuaugagguacagauaggaauugugagauacuaaaauucaucuagucuuaucuggucuucuucuuucaacagcaucuguuuugaaaagcuauuccuuugugcuaaaaucugucgcuguaauuucuaccccauagcacacuuaggaguaaauuuaaucucaaagaugguuacuauucuccuuacugcucuucccccacaaaauuuuucuucugggaggcuaaaaaugugugaugccuuuaaaacaauauguguauaguauagugcccccccaccuuuuuuuuuugagacagaaucucacucuaucgcccaggcugcagugcaauggcacgaucucggcucacugcaaccucugccuccuggguucaagcaauucuccugccuuagccucccaagcaguugugauuacaggcgcccaccaccacgccuggccaauuuuuguaauuuuaguagagaugggguuuugccauguuggucgggcuggucucgaacuccugaccucaggugauccgcccgccucggccucaaccucccaaagugcuaggauuacaggcgugagccaccgugcccagccuguauggugccucuuaacuguuccuugcagagaucucagaccucugaccacacugauugcccucuuccaggugugcuccaaucuaaagcuaagugaggcauucuaacaaaucaaaccuggagucaucugaauccaugcuguccccaaauuacaaauggguucggaacacuuucugagagcagaaacuguuaagaguuugucaaaugccuaggccagcucacacaacugguacaacccagcugcaauguggcagugcccaaguuucugguccuaggaguaaaggaccugcacugcaggagagaagagaauaauguuuccuccccugcuccugagcacagagagcuaguccuaaauaaacuuuuaaaacaggacacauuuugacuuuggcauuuucuuccauuucuuuuuguaccucaggcuuucugugcucaggacuuuguccaagccugcugcccuaccucucaagcacuuuauuuugcugguaauaugugauugucagauaaaacuuuaaccuucccagagacauuugcuuuuuuuuuuuuuuuuuuuuuuucuuuuuucugagauggagucacacucuaucacccaggcuggagugcaguggcgcagucucagcucacugcaaccucugcgucuccgguucaaacaguucuccugccucagccucccaagcagcugggauuagaggcaugugccaccaugccuggcuaauuuuuguauuuuuaguagggacgggguuucaccauguuggucaggcuggucuugacuccuggccucaagugauccgcccaccucggccuccagagugcugggauucauaggcgugagccaccgcccugcauucuuaagagaaugugaguaaauauguugaguggcaauggucaaguucaaugaaaacuuuuacgcucugcggguaaauaaaauuuucaguuguguggcuaccauccuuucugggagucugucccuauagucaguucugauaagccucacuucacauagcauuuuuccuuugcuucugaacauaccaguuguuuaaguuccaaauguuuacguccaauaauacaugguuugagaaauaaaauauaagcucauuuuccucaaggaaguuagaaguagccaaaguuacuccucuggguuugaagcuuaccugaacaacuucccuuccaggagagccuugagggagggagcacuguaggaagccuuagauaaggaucucagccacuuuucaaauuugguggauuaugcuaccaaagagaaaccaaucugugguuccugugaaaauuccucccuuagcguagugcuggcugaaaauuaagcaaaaguucccccuucccacuuaauuuccucuuuguccucguucucuucuucuguucuuuucucccucccuugacuuaaccuugaauuuuguucaaugcagaaugccugguuucggaaaucucgauucaaaggagggaaaggaaaaaagcugaacauugguggaggaggccuaggcuacagggagcggccuggccugggcucugagaacauggugagucuagacuacuacaguagugccuuuauaguuggucucauguccugaaagucauuaggaauauucucaucuacccaggaaagccucagugaguuuaaagcccugucuagaagggaauuuguauuuaaucugauuugagucaaugcagugcucauucuuaugguaacuuucuauugaagaagcaucuuuguguacuugguugacuaggcuugcucaggaaauuauucuagauuagcagugaucucacacuguggucccuggaccagcagcacaugcaaacucauccccaaccccagaccuugugaaucagaaacucuggaguuggggcccagcagucugguuuuauaagcccuucaacacuggccuaaagccugcugcuagguaaauguugccaaagggucacuguaaagucuagccauaucuugucauuaaacucaggaacggaucaggaauuuccaagucgggagcuaguuuuucucacaaaccagguaacaaauguacccuuuugguggccuuucuuaacugccuguuuucugucaccuugauuccaagccagggaagaaagcugccaguauacuuuucuggagcauuaaacuuggcaucuuuguaauuacauacucuguucccacauuauaauaauaaugaugaugaugcauaauaauagguaauauuuauugagcacuuuauaugugccaggaccauuccaagcaaucagauguuuuggcucaguuaaucuucaaaauaacugaauggaaguuaguacagauaacaaugcugaggcaccuaagguuacagugacaaguguucaagccgaaauucagacccuucauggucuugauucagggccugagcagucacacaauaugcuauucagggccuuuucaucuuuaacguaauuuuuacuuaauuaauuggaaguguuuauguaaauacaugaucaacuuugggcauaaucugauugcauuucuguuuaauaggguuaauuuccagaaauagaauuucuggguugagggcauaagcauuuuuaaaugauugucacugugucuuuucucacaaagcaguagcagcuuucuaaaaguauccaguuccuuuguagcucccacuucaaggguuuucauaaugaggccuagucuauagcagugagcuuuccugcuuauuuuuucauucucauagauguguuuauuuuuuuaggaucgaggaaauaacaauguaaugagcaauuaugaggccuacaagccuuccacaggagcuaugggagaucgacuaacggcaaugaaagcagcuuuccaggucugaaauaagcauuucauuaaaagcacuuucagcaguaacucuugggcagugacagaggggcuuaguuuuccugguuguagcugggcgccuaggcuugaugcuagauuuagggucuucacgcugcuuggauuuugaauauaaaccuaacaguagcuuaguuggaaaugcaaguugaucuagagaaccccuugugcuggucuacuuugagucacacuuggggccugggauuguuguccugcagcaggguguguguucccucccuucccaacagccugaaguguugcccaccucccaggcacccaccuccaacucacuucugaagcaaaauuuacugauagucacacuaaggugaaucgauagaaugaguucaaggcagguuuugcugucaaacuuaaauugcaguaugaaaauuuuuuuuaaguuuucagaacuuuuugguuuugaaugcagauaaaugugcuaaauacauagaugcuuuauucuagccaaucaggcuauaaaaguacauuucagaacacuggggguccaucucuccacagagauccacaaguuuuccuuuauagcacaagaacaaaagggaccauacuguggggccaucaggacacuaaacucacagugccaggauagcacagaguuucuguaaaccucaucauuugccaaguuguauauucaaguuucuugaacuugcuaucuuaccuacuccugaugucucuuucucuuucagucacaguacaagagucacuuuguugcagccaguuuaaguaaucagaaggcuggaaguucugcugcuggggcaaguggguggacuagugcagggagcuugaauucuguuccaacuaacucagcacaacagggccauaacaguccugacagccccgucaccagugccgccaagggcaucccaggcuuuggcaauacuggcaacaucaguggugccccugugaccuacccgucugccggagcccaaggagucaacaacacagcuucagggaauaacagccgagaagggacugggggcagcaacgggaaaagagagagauauacugagaaccggggcagcagccgucacagucacggagagacuggcaaucggcauagcgauaguccacgucacggagaugguggucgccauggagauggauaccgccauccagaaagcagcagccgucauacugauggccaucggcacggggagaacagacauggaggaagcgcaggccggcauggggagaaccggggugcaaaugauggucggaauggggaaagcaggaaagaagcuuuuaaucgugagagcaagauggagcccaagauggaacccaaaguggacagcagcaagauggacaagguggacagcaagacagauaagacagcugacggcuuugcugucccagagccgccuaaacgcaagaaaagucgaugggacaguuagaggggaugugcuaaagcgugaaaucaguuguccuuaauuuuuagaaagauuuugguaacuaggugucucagggcuggguugggguccaaaguguaaggacccccugcccuuaguggagagcuggagcuuggagacauuaccccuucaucagaaggaauuuucggauguuuucuugggaagcuguuuugguccuuggaagcagugagagcugggaagcuucuuuuggcucuaggugaguugucauguggguaaguugagguuaucuugggauaaagggucuucuagggcacaaaacucacucuagguuuauauuguauguagcuuauauuuuuuacuaaggugucaccuuauaagcaucuauaaauugacuucuuuuucuuaguuguauggccaggcaguccccauuuuaggaguuggcuucugcaaauucaauccauugagcuaacuguuggggagcaauuugguaguuguagacauuugcagggaagggagaugucugauucuaaaugggaguugaugcucagguccccagccagguuugcauccagcccugagacauguaggaaacaccuuucagacccaggcucugaagauucccagaagccacaaggauugaagggaaaaggugauccugguaacuguuccaggauugcuccagguuugagaugguauugcuaaauuuaaaauuaaacaagaaacccaacaacagcuuuuaaagugucuucuaucucauuguauuuuuuuuaacuugccccaaugauagaaaagucuuuugcugaaaugauuuugaugauuuuuguuuaucguuuauaaaaaggaaaagaaauauacaaacuuugacuuuugugacuuugugaagguuucuuuaagaugugcauuccuuucugcuugcucucuaguaaauguuuuacuaccgggaccuguggaucguuugucauuucugucuaugaauugguacauauuaagaauagugccgcacacaguguagggacagauagggaagugcuuauuaaaacugucagaaaagacaacucuuccauuauccugguuuuauucaggaauaggauggggguggggagggcuuaaguggcccacacguccagguguagacugacuacauugaguaucgcuccaacaccgaacuucccuuuaacgguuuaaaaaaagggucaugagugucaacacaguucagcaguguuuucaugggagaccuucaggcaggcaggaggacauccuccucucugcucaggaccaccacgggaguucuaggcacuccaccucacuguucuucagacagcugugaugugagcaggggcuaggccgguaaucaagggggccagacugagccaugccacacccuuccuccuaguccccaugcucuccugggagccuggcagcucugcuuacuuccguuuguguuuuuucuuuuguuccuuacguugcugugcucuuugguccuucuucauccuugaguccaccaccuugaaaugaccucugacuccagcuggccggcgcacuuugcggcccacaccuuuuuuggcuacaacguaggugacauggcguuucuccuugccaagcccagccuucuuguagagacua

SEQ ID NO: 16900 - RNA, 7961 nt, Homo sapiens
gacaacucuuccauuauccugguuuuauucaggaauaggauggggguggggagggcuuaaguggcccacacguccagguguagacugacuacauugaguaucgcuccaacaccgaacuucccuuuaacgguuuaaaaaaagggucaugagugucaacacaguucagcaguguuuucaugggagaccuucaggcaggcaggaggacauccuccucucugcucaggaccaccacgggaguucuaggcacuccaccucacuguucuucagacagcugugaugugagcaggggcuaggccgguaaucaagggggccagacugagccaugccacacccuuccuccuaguccccaugcucuccugggagccuggcagcucugcuuacuuccguuuguguuuuuucuuuuguuccuuacguugcugugcucuuugguccuucuucauccuugaguccaccaccuugaaaugaccucugacuccagcuggccggcgcacuuugcggcccacaccuuuuuuggcuacaacguaggugacauggcguuucuccuugccaagcccagccuucuuguagagacuacaggggggaagagaagagguuagaggcuugcuuucugcugcacuuuuagcccuguguaccuuugugguguccucccauuaccuucgcagcugugccacuuucucucguucugagauguccacuguguucaccacggcuucugccuucuuccuggucugcuccagccucuucagcaucugcaaaggaaccugucaggugaccucuuccccauccccccacccccaccccacccaaucucuggaggccccaucacuuacccuccuuuucuuucuagccuuagccucagccaccuucuugaugggacgugcauugauuucccgccagcguuuccgguaaugcuccaccuccuucuuaccaacaggcaacugucguauccggugcugcuuuuccucuugcacaaaccacuccggaagcucccccucauccucauuaaauguguaccugaguggaaaggacaucugucuaauauccaacauuccaggcuuucuaaagaaauuaccagacugggcacgguggcucacgccuguaaucccugcacuuugggaggcugaggugggcagaucaccugaggucaggaguuugaccagccuggccaacauggugaaaccccaucucuacuaaaaauacaaaaauuagcugggcguggugguuggcaccuguaaucccagcuacucagaaggcugacucaagcgauucaaggagaaucaggcugcagugagccaagaucgugccauugcacuccagccugggcaacagagcgagacuccaucucaaaaacaaaaaauuacccauuuacccaccagacccugggucacucuugaugaguuuauggccccuuuaccgguugaaggaguuaucuaugaggucucucuuggccuuuuuggaagaggcaauaacagcaccuagagcaaggccuucgggguccaguauccgauguuucgcuagagagggaaggagaaaggucaaagcucaauucccaauacugagacuuccaguggucuuuucucauuccacugcauacagagcucucaccuggguccucaauaggcacuaucucaaacccgucaucaucugacuuaggcccacggcuucgcuucuuaccacggagggguucccagcugugaagaggggaggacucugagugauuccaccacucuguacuacucagaccgcacucccacggaauuugcaaaaauccugccaugcaggcuguaccccagaccaguuaaaucaggaucgucaguacaguauuuuuaacccuccccaugugcagccaagauuaagaacccccaauuuagagaaaugguucaagccaccgcuuccuuuccaucccuucucucagcugcaacuacucaccucucuucuuccucacugcuaguacugcuaucacugucugagaugccauccuuuucuuccccuucaaggccaguggcagcuucuguccccgaagaagccucuguucccuuaggggcuucaucuugguacaggggagacauuaucucagucuucaaacaggaagggggugucuguggcagcugcugcuucugcugcugcugccgucccuuccgccgguucucaaauaacagcugggccugacugaucuccagggccucaucggcaucguccucgaucccagcaaagcugcccugugauaggagaacaucagcugcccuucucccaaggaagacucaucuccccgcagucuugcccccggccucuccuuaccuuugagaaccacagguuggcuuguucuuccugcaguacugccuuuuccuccagugguaccagcaguggauucuccuccuccuccuccucuuuaucaucuugcacuucaguaagucgcauacuguagacccaaaggaaaguagggggcucagagacccagauugccuggagcccuugcugcccuacucaggcucugguaguacccacccuaacacuuccucagaguggcagcauucccuuuggugcacacgugccccuuaccgcuuuuggucccuuagacccugauguccccugacuccugccagcuccucuggauccaggucacuauccagagaugugucaucaccgucguccucaacaucugacacauagauaucaucccuuggcagaucggacagaaaugugucugcugcacucauauccccuuguguuacuuccucuaauaacugaaguguaacagaaacaaagguaaacuauuuaaaaggaaauauacuguuuuuuuuucugugucccucaccucagucuaugcucagcaacacuagaaagaacacuggcaaauccauuauccuuucacagaugggaaagcucagauccaggguagugaauggccuguuuacaacaucccguucuaggcuggguuacugaucuaucccacucagcugucuugucucagugguaucacaaauaggucuuaaggaagguaccuacagcccacauagcaccaaaucuuaacauauucuacaacacugguuuuccuuuaaaaauuauucucagacagcaucucaaucaucuccugagaauaccgucuacacaguuuguuuccacugaauaaaaggggcccagccaacauacauccaacaaaacuguuccacuuaaaccaauugucagaaccuuuuauuuuccucaugguaaagauacuaggcuggguaugguggcucacaccuguaaucucagcauuuugggaggcugaggcaggaggauugcuugaugccaggaguuugaggcugcagugagucaugauggcaccacugaacuccagccugggugacaaaacaagaucuugucucaaaggaaaaacuccaacuacuauuucuugaguguuuaucacauaugagggauuacaccuaucuuuuuuuauuccucaccaaaaacucuaguagguagguucuauuauuguuuuacagaugaggaaacugaggcagcaaggauaagugguagucagcucagucacuucacaaagcuccaggugguagagcugggaaggaaaccugagccugugucugcucuagggccaccaugcucuacugcccuccuguacaacaaagaugaccugauuaugacacucccacacauaagccacaaaaguucauuuuguuugugacccugauuuugucaggaaaaacauguucuucaguauucaguggaaguacccuaaugcgagugcucacuuggucucaaugaacuaaagaaugcugcuccccucugagggagauccucuauucaucugugcuugaaacucaaguaaccuggcagcaucuacuauaaccuaaguucuuuucugauguucuaguucuucaagaauaaaucuaucagccgggcgcgguggcucacgccuguaaucccagcacuuugggaggccgaggugggcagaucacgaggucaggaggucgagaccauccuggcuaacacggugaaaccccgucucuacuaaaaauacaaaaaauuagccaggcguggugguaggcgccuguugucccagcuacucgggaggcugaggcaggagaauggugugaaccuggaagguggagcuugcagugggccgagaucgugccacugcacuccagccugggcaacagagcaagacuccgucucaaaaaaaaaaaaaauaaaucuaucacacucaucuaucuaccuaacucauccuuuuugguuuauguuucuuuguggccuuauacucaccaaggcacccuguggugaagacagcaaccacagccuaucguucggcaaccuaaaaagacauucaacaccccccaccuccaaacacccaaacagauccuucugucuccuaaaccugcacccccaaugccgccucaccuggugaccccggauggugcucaaggagaacaugccagucucccccucgucugcaauggaaaccccaggcagauccaucuucagcuccacacgcucccgcugcuuucucugcucacgcaacagcuucuuuuucuuccugaggggguggauugagggaguaaaaccggcccagcuccaaaguuucuauccaugccuugcauuuucuucucccaucuucacacagucccugcguuggggaacuccaagcucuaccccagcuccuuucaccucuucaauuccgccaccuccugggccuucauuucugccaaggucugguucaguuguuccuccuccuccucuuccuccuccuccuuagagggcugcuuugugguuccagcuguugaguccuccucaucaccuucaucuuccucuccagagcugaggcuggcaaaacagucccaagaguuggguuauuuucccagacuuuuccccuggacacccaguccacaccugccucgcugcguucucuccucaccugauguccagugccuuugcuuguucuuucagcuucuuggccacauaucgccgaaguuuuguucuccaguuuaguagcgaccugccccagagauacuauuacugaucuugccaucucccucuuuguccccgcccccuucuguuuuaggcucacuacccaccuuucgggcuucggcuacauaaaucaaaaggcucaggcccccaucccaaaccuuuagcacagcaauauccucuucccagagguccaacaucauggccuuucccugccuccagggcuccuggcccccgugccuaccccacuccauaccugagcuccuugcgccccaacacucugauguccugacagcacacccguauguccucagugguagcuggaugcugugccaacucuucaucaucuaccaugaucuguuugggaggauggaaaggugucaggggagauccucaggccauguuucuggggcuaccucaugucccucaaggcuggagacucacuucgcuggccuuggagaggaagucaacaggguuggcagcucggaggaagucagugacugagguacggugauagagagugaggucacccucagcauagccuucagccuuaggaaggaaaagagagaagcuuggucaggcccuucuaagguaccuguaggacccaccaggcccaaccucccuagaguuccaggacccaagagugaccccauuccccaaaacacaccuuuggcuucuucuuaguaaccaauucaguaacggucuuagccugaacuucaaccuccuuaaaggcaaauuuggggucaaagaauuuacugucaaccuugucaggggccaggaauccuaaaaaugacaggauauauuaaaaagugugcuuugggaguugggagccuggaucaagagaaaggaaaugaugcccaccuuggcagacuacaaagaucucugcagauucauggcgagaggcuuggggcuugguggccuggacacggcggaacagcugcugaaagauccauagcagaggcugauagucacgagaacggaaaaccuuugugaugaagcugccaccacgggccaaaaagucacaagccaaacguagagccaucagugucaaaugggcuguaggauagagacaauuaguugacgcacucugcagcccaggagggcaugcgcccaccuccaccaucaccugaucuccaagcaccacacucccuguaccuugugaguaagcaucauggacccagcuagccccaacguugggggccccaucauugagcacaacaucaaccuuccaggucuucagcuccuuccucagggccuaaagagaagaaaaggaacuauggaaacagaaacacuggaauggcccugguucagccauuuguccaucuagucauuugcugagugcccaucaugggccaaaugcaguaccaggcacaggagauacaauaguaaacaaaaacaguaugucucuaccuucauggagauuacagucugacacugaauucacaggagaagacuucacuaaagaucucugcccuucucccaauuccaaacaccuuuaucccugacucuaaauaaagccuggaguggacacuacgaaugccauaggucuugucguacagaugucaggcaagaacgugcucaaagcacgguaaaaaggaaaaacuugccuuuagaggauuucagggauguagauguuuccguauaaagggggaaggaagagagagacuccuauuaccugccuacaacguucuguugugauguccugcuggagagucaccacauuggggagaggcuugauuggaaccagguccacuccuggaagaaaucaggucagaguauucuaaaagguugcuucaagcagggaggagagaaauacaggacaaaauaccuuauacacccaccccuuaaaacaccaaggagagcuguccguuacucacccacaauaaggcuggauacaggcauaaacuuggcagcuaccugcagccuauaaaaggaacagaaauuuaaaaaccuagagccauccuuuucccccucuuggcaacugaucucucaucccugguguuacguguacuggccaaagcauaucauaggcacguauuccaagcccuuucucugcaaucaagaaaggaaacggcccccaagaggaccgggauucggguuccccucccgcagugaaacuggaagccaucccagcucagaacccagaaagcggccaccaggagcaaccuguggcgaguguuacgaaccaucccccuggcgcagcacacagguccagcaaggcucgggcuuucugcaggaacugaaagcggcgauugagcuggaucagcuugaaagcagaucgggaacgguaaccuggacaaaacaaccaagugcgcaaacugcuucacuaguaggauuucuccggccucgcaaccgaccaccccuucugcaggagagguacauaauggucgcaaagagcaggcgaaccgggcagagaucgcucgcucgcucgcagacugagcgaauccggacucacccgucuccuucgccaagugauaaaacuugucucgucggcucuugccaacuuugcccuucuugcccaugguggaaagggggaguaucccucaaucuggggagaaaguagaaguugggaacgucucuuuccggagcaccagauuccacuuccaguuucccacuuccaguuucccacuucccgcagcaauuccaccccgcgccccucuccgcacacuaccuagacccagagccgcuuucuccacacuuggaaccgcacaaguaugcagcuaacuacuuccgcuuccgcuugcguccccugcgucccuggcucgagguuuuccgccauuuugaguguggcccuagauuguucucaauacucuguccuuggguuuuguaaguugaaaguugagacuaggaaggcauaucacaagaacuauaaacagaguuucaaugaggcaacacugaggaggaguucuacuccuuccucauccccuuccaaagccccugaacucgaguagccgccccucccaucaugguucccuuaguguggucucgccgcacaccccgcccau

SEQ ID NO: 16901 - RNA, 10888 nt, Homo sapiens
uaacucgacucgggcggccaaaccuccggaggccggggacggaaggcgggcccgcagcagauccuggauccggaaucucccgggcaggagcggaaucugucccgaaccgggucugugaggaacucgcgaacuuggauuaggaaaucccggagcccggaucgacaaaucccggaacccggaauuaagaucgccaagucccggaucgcggagcacagagcacggaguggacucgacgcggagcccggaguccggaucgcggcaccgcgggacgggacggagcgaugucgggccgaggcgcgggcggguucccgcugcccccgcuaagcccuggcggcggcgccguggcugcggcccugggagcgccgccuccccccgcgggacccggcaugcugcccggaccggcgcuccggggaccggguccggcaggaggcguggggggccccggggccgccgccuuccgccccaugggccccgcgggccccgcggcgcaguaccaggugagcaaggaggacgcgagcggacgggggcgagaggcgcugcgagggcgcccgggccggcggcugaaggggccucgagugagggcccuggggaaugcaugaggaacuccgggagacgguggagggcgggccgggacccucgggcugcggcgggucgcgguggagaagugggaaggggaagcagguucugcagcggagggcuggaagcagcugggaggccugggggcuuccgcggcacagggauuccgagugacugggagauggaggaguuuggggagccagugaauuguggcggguggguugagaagucuaggguaggagggcuggaaagugaugagaaaguuugggaaagggcccucgcugagaaaccgggguuacccugcaucggccuuggucccaguccaagucugcccuguuuuuucugauugggaacuggcggagcucuagcgugucugagauggcucccggcugcuaauaaggaggaaggagccuggcuucccacgggcacgggacgcugaggcuagggccaggggauuccagcuugugcacgggcggacuuuacuccugaggcagggccaggcgccuucgcugggaggacuccagcuuagaccagagacggugguggccuggccugaggggaggcccagcccagucacaggccggcucucuucugggcuuucugccuccugucaucguguccgggaguugauuagucuggacgugcagaguggagcccugcuggucuggggccggaggagucugcgagaguugcuucaaagagugcuguccugaccccuuugggguuuugagagcugcucagauugcagcuucaaaagcccuugcaaagcagcgacuucugcucagugugugaggaccucagccugacccugccagugcucuagucugcuguucagguugccccagagggcuuggaaacugugcccaucugccuugucacccucucugcauuuuuauuuggccuucagguucuaacuccaccacguccgaagccaugugcccaagcauuugacacuggcuucuugcucaucuacggguuugcugugggcuuccucuguuuucgacucaugucuccaggcagagguccuuagggauccucguggaguauacacagccuaccugccccacugggcccucacuucuaaggagauggcuuaacuagggacagugacuggauuuuuuuuuccuucuuacuccucauucuuccuccuuucucaagagaaaagagagucuggguaugggcagagacagaccuggucccagggauuccagcuggggcucaucucucccaccuugcuguccccguuggggauucaugggcccaggguguugcugagggcucccugcaucauucauuguagcccuugggccugcccacugagaccuggccugggcaccaucugugggccuuuggccuuggaaggaccuggaacagacaagccgcuccaguuuccuuggcaugcaagccauaggaaaugugcccuugggacagccccugagaggauggauuccacauguuuuggugggggguggccuugggccuguggcaaggccaagcuggcuggcugguuaggccugggcugcuagcugugcggaaguaggagauggcccugagucuggguuucccaucccacuagcuuuccuccuccuggcaggagagguagaugggaaggagaacccagccagcuaacuuuggcugaguuugaagaggauccuauuugccuucuuuccaaguccaguuguaugacugccaggagaagggacuugagaucugggaaacaaagggguuccugucuguuagggcucaugagaugcacuugaaaagugagaauuugaggcccaagcugagcaaauaguugaaagaagggaagugaugaccucccuuccuccagagggugguucuagcuguggaucacaguuaacagaggaaccuaaaaaaagaaaaagaaaagaaaaaaaccuccagggcaggauauggugggcucacaccuguaauccuagcacuuugggaggcccagacagaaggauuacuugagaccaggaguucaagaccagccuaagcaacauagugagaccaucaucucuuaaaaaaaaaaaaaaaaauuuagccaagcaugguggugugcgcuuauggucccagcuacucaggaugcuguggcaggaggauugcuugaguccaggaguucaaggcugcauugagcuaugauccugccacugcacuccagccugggcaacaaaauaacaaaaaccucagauugcuggguucacuccagagaguucaaaaaguucaaaaaaaaaauuuuuuuuuuucugauacggagucucacucugucgcccaggcuggagugcagugacaugaucucagcucacugcaaccuccgccucccagguucaaacaauccucugccucaagccuccugaguagcugggauuacaggcgcccaccaccacgcccggcuaauuuuuuuguauuuuuaguagagacgagguuucaccaucuuggccaggauggucucgaacuccugaccuugugauccacccgccucggccucccaaagugcugggauuauaggcgugagccacugcacccggccucaaaauccuuuuuacucaugggagagugggugguauguuccccaacugaggcccucaggcccagguuccaggagcaucagggccacauuuggggcagggcaaagcacgcucaccggagcccuggauuccucaucugggguucaggggauugauccaggccuaccugguccugcugcaggcagggaguuagggaggcucagagugcuggacugcuuuuuuuuuuuucuuuaacuccugaguuguuuuuuuuuguuuguuuuguuuuguuuuguuuuuugaagugggaggaguugcuagcgccuauaagcccuauggagcuuggcaaggcucagcugggacuugaacuauaagcagccuuccccuggggcccugagugagccaggggcucugggcccaggaaaccuggagcagaugucuggguggagccuauuccagacccugccuaugaggccuugucuugggacuuccuguuaccggagcaccugcccaggagggauggguggugcugcagguuuugugaacacugcagcagggagcuuccuggggaccacagggcccucgcucaccucugcaggacccacugcuucaguucuucccugucuuugucucaggcacuaggaaaaacuagucugggaugucugggccugggcuuacagcuguagccacacuuaguuuuuuucuauaaucucaggccagagaaagaacaaucuuuaaggcagagaaagaggcugucuuuugccuuucaacagcucugauuaaucucuuccugaugcagagagacuuuggcaggacucccaaagccccagagccccccacuuugaacuuuuuauucucccaaacacuuccgucccacccugcuccuccucuccccauccucacgucugugggucauguuucuuuccaucuccgcaucuggucaagaaucugacccucuguguugggaacauggguuuagugcgggaugaagagguuggggaagaaucucaucuccaugaugcuggggugggggaggguccuuugauuugguacaagucuccacccugccgggcuugguuggcugguugugcucguugcauaaucugggcccuggggccagcccugugaagcugccagggacagugugugcaaggcagagcugccaaacaggccuugcaggcagcagccauggggaggcggguggggguggaggugacucccagaugggcuccacagaaaugucagggagcaaggccucaggugggaaauccuucugcaggcaucuaaagaagcuauuucugucucccacuuuccugcugcucagccugggccucuauccuugccucccaggauaaucuuagcccccuucuccagcuugggauugccagggcuacacggagccagagccaguccuggcugccagguggugccuggaccacuggcagaguccaggugcuagcugcucucuuucccacaggccacccaggagccauagcuucccuucuggggucuucugucauagggguaguaguugggcaguagggagguaagaggaggguccaguucugggcugugggugggggcuaugugauaccagacuacaggguacagggucccuguacccugcccgaggccacccccaccagcugguacacguuccaagccauccuguugcagcccugcucaccuggggugcugcugccuaccagaccccuuucucccucggccacagaggauggggauuggggcucugcgccauuggccuacucauacuauaguacacuccucugccuggcagugacacugccccugugccucucagccaugcuucuucuucaugaugggagaaagagaaggagggcagggcuuggcaggacugucugagagaauagggaccagcuugcccagggaauagggcacagcaugcuggggcuggaagguagcaaugggcccugaaaagcuccccaaggcccuucccucugcaggcaggacccuccucccagcccagguucuggcaggccucauucgcuggcauggcugccagggcgguugcagggggcagggcaggugugguuuacacucugugcucaggcgcccacuccccuuuguuccuggggcuccagcagggcucuggugugcugcucaggcccuaccuggcugacgagagggauggagggcaugggcuaugggucccggagggccuugccccugaccuaugcacccccguuggcucacuucccccagcgaccuggcaugucaccagggaaccggaugcccauggcuggcuugcaggugggacccccugcuggcuccccauuuggugcagcagcuccgcuucgaccuggcaugccacccaccaugauggauccauuccgaaaacgccugcuugugccccaggcgcagccucccaugccugcccagcgccggggguaagagcauccugcuucucucacucugccuaacucagcucuggugguagcagaggguuuccuucuaucuuaagagcuuuggugacugaggaugacuccaggcucuccugggggagaggguccuggagacuggaggggcguuaugggagugaguguccuuuuuuggaccauugaccucuuaaguggguuucuguccuccccagguuaaagaggaggaagauggcagauaagguucuaccucagcgaguaaguguuaagaggacaccugggaggccugcccaguggccaccuugggguggguguccaucucucucaaagcugggcugcagcaggaagggaggaaagagccaggcuuuggcugaagcaagcugaugagcuucugcuaccuuccuucagauccgggagcuuguuccagagucucaggcguacauggaucucuuggcuuuugagcggaagcuggaccagaccauugcucgcaagcggauggagauccaggaggccaucaaaaagccucugacaguauguguggcccugaccaccucuagccuucccagguuuccuugccuuccacccccuuguuuuccaggggccaagcaaguugggcuagagccggguuuuucacaugcaggaugcagcccacuaguagaguacgaacucaguugaauguguuggggccaguauguuuuaaaugaauauaugacaguagaaaaucuuaaaauacuucacaguaguacuuaccauaguaguaaauggauucuuucaugacauuuuuguuucugauaaauagauaugcagaccuugggucauaauugaaaauguaaaucuuaugggugguggucaaaaguuugaaaaccacuagacuaggggauaaagguaguuccuuucuccuuccccuuccccauccauagagaaauuuucuuuuuuuuuuuuuuuuuuuuuucugagauggagucucgcucuuucaccuaagcuggagugcaguguugcgaucucggcucacugcaaccuucgcaucccagguucaaguaauucuucuugccucagccucccgaguaacuaggauuacagaugccugucaccacgcccggcuaauuuuuguauuuuuaguaucgccauguuacccaggcuggucucgaacuccugacugccucggccucccaaagugcugagauuacaggcgugagccacugcacccagccgagaagcuuuucuuaauaauaauguagaacagucccgaguggugaagccuuuccaggggacuaggauauuuuggagccgugauggguguuuggguuucauguaagaugugagccagagacuggcugcguguuacuccaucaugccguagcaccagucccacugugcuggcauuguuggugaugcaucucuuuccccauaaaauggugaguuccggccaggugcgguggcucacaccuguaaucucagcacuuuaggaggccgaagugggcagaucaccugaggucaggaguuugagaccagcauggccaacauguugaaauaccaucuuuacaaaaacacaaaaaauuagcugggcaugguggugcgcaccuguagucccagcuacaugggagacugaggcaagagaaucgcuugaaccugggagucagagguugcaagugagcugagaucgcgccacugcacuccagccugggugacagagugagaccaugucuaaaaaaaaaaaaggcugggacugggacuuacuacuucugauucccaguaccugacaaggugccuggcuggcucauggugcucaguacugauuguugaaugguucauaugagaagaugcgguagcacugugucccagcaucuugguccaccuccaguugugauugccuuucucucuuuagcaaaagcgaaagcuucggaucuacauuuccaauacguucagucccagcaaggcggaaggcgauagugcaggaacugcagggaccccugggggaaccccagcaggggacaagguggcuuccugggaacuccgaguggaaggaaaacugcuggaugaugugaguuggggagggagguucuggagggaaggaggccuguguggguuuaagacugagaccaaggaguuugauacuagccugagcagcagagccagaccccaucucuacaaaaaauuuaaaaauuagcugggugcgguggcaugcaccuguagucccagcuacucauaaggcugaugcaggaggauggcuugagcccaggaggucgagcuucagugaguuaugaucacaccacugcacuucagccugggugacagagugagauugugucucagaaaaaaaaagacugggccagacacuugggcgcucccagagaaguccugccauagggaggggggcgcugcuccaagcccguuggagguugauuugugugguuauuacaguguuccugcagauggcagucgagugucucgaggaagucccucgugggcugcaagagggcaccauuucccugccuccagucugcccagaguccugcuuccauccuucagggcccaggaaucuucaguauccggagcuccagggcugaaauggggcuucucuuucuugggauuuagcauagcuugagauuugagagcucagcagcaccaucucacaccccuuuccauccccagccuagcaaacagaagaggaaguuuucuucauucuuuaagagccucgucauugagcuggacaaggagcuguacgggccugacaaucaccugguggaggugagagugggccuggggcaaaagcaggcugaugugcagguuuggcagggaaauggccucagggcccuugggaggcccuguguucacgcccacccccuuggugauaagccaugcuucccucccugccaguggcaccggaugcccaccacccaggagacagauggcuuccaaguaaaacggccuggagaccucaacgucaagugcacccuccugcucaugcuggaucaucaggugacagagacccuggggucauuucugggcccacagggaccccucaggaggggagcugguuccuagaaacccuuccugucccugcccuauuuucccacuguucuacuauaagaacccguucugacuccccuccauccaacuccagccuccccaguacaaauuggacccccgauuggcaaggcugcugggagugcacacgcagacgagggccgccaucaugcaggcccuguggcuuuacaucaagcacaaccagcugcaggaugggcacgagcgggaguacaucaacugcaaccguuacuuccgccagguuagccagaugccagcccccguuuucucagcccuugcuuugccuugccugcugggcuacuccuuggccacagccugcagacugcugcccucacugguccuggaaugguccacuccacugugcccacaagccaacgcugagccuuucguauuuccuccagaucuucaguuguggccgacuccguuucuccgagauucccaugaagcuggcaggguugcugcagcauccagaccccauugucaucaaccaugucauuagguaaaugcaaggagggggacaggaaggcucuucuaagagcagauucacccuuggcuugaacuaaagccaaagaaagcaucagguuucuuuuucccugagugugugcagagaaugggccccagauuuggcccaggugggcaggaugaagucagcuaugugccuucccuccccaugugcugccugcagugucgacccuaacgaccagaagaagacagccuguuacgacaucgauguggagguggacgacccacugaaggcccaaaugagcaauuuucuggccucuaccaccaaucagcaggagaucgccucccuugaugucaaggugggcccucuggcuccacagcuuccucuggggcccaggauuggggugggcuggcucuguccagcauuuccauacauguagcaccuggaggacgggaugggaacucuggcucaguugcuugcauguaagcuuugggggcacagucugacacagguacccucuccagauccaugagaccauugaguccaucaaccagcugaagacccagagagauuucaugcucaguuuuagcaccgacccccaggacuucauccaggaauggcuccguucccagcgccgagaccucaagguguaguccucuuucccgaggggacuccuauguaaagcucugggugauuuuuacccacagcaguucccaggguggauuagcccagggguggggauuaugcuauggcuuuccuccuggcucuuugcagaucaucacugaugugauuggaaauccugaggaggagagacgagcugcuuucuaccaccagcccugggcccaggaagcaguaggcaggcacaucuuugccaaggugaggcucugcccuguuuucccuccuuuggccgugaguagcaaaggccugagccacuugguuucucccuucuccaggugcagcagcgaaggcaggaacuggaacaggugcugggaauucgccugaccuaacugcucagggaucuuucuucccagcccuggagccuggagggagaccacccucuggguccuugcuggggccgcagacacguaggcuggggugaggagugucugcugucacccucuacucuccagcuuuagucuuauaaauguagugauaggauuccuuguugcuugguccccaaagccuuauacuuuuugcauuggcuuuaauuggguucagcagaugccuccucugccccccugcaggcaggcccaaguaggacugcuggaggcugugcuuugacauuguaagacauuuccgaaccaaaggcugcuggguuugcauguuuacagacucccccuggggcgagggucagagcuggcucuggggagcugggcuaggaagaggaggugcagcccagacucuuccuagccuuucuaaaccaaaguucuuugccauuccuacaagcccagccuugcugcugguuuuuuccuuuccuuuggguauuugcacuauuuugggagcaaguuuucuaugugggagccacuuuuuuuguacagggguaaguuggggguuuucagggagccuguuaggugccuccuucuuuucuuuccucaaucuaugcaagcggcucuggccgccaucaucuccugggaugccagagggcugccucuccagcggcuugggccggggaggggacacuccaguucucuagcauggccugagguaugggguaugugcauguggaggccaggguaaggugaauggggaggcugggaggacugguguugcccuuuggagcuuggugaggagggugggccuagggcuuggcgagugccacaucuggcagguuuggaaauuuccaaauaaauccuuuugucuauugguggugccuggac

SEQ ID NO: 16902 - RNA, 3808 nt, Homo sapiens
cagaagacugagaggccccccagaggcauccacagaggaccccagcugugcugcccaagcugggcgaccgccaaaccuuagcggcccagcugacaaaagccugcccucccccaggguccccggagagcuggugccuccccugggucccaauuugcauggcaggaaggggccuggugaggaagaggcggggaggggacaggcugcagccggugcaguuacacguuuuccuccaaggagccucggacguugucacggguuuggggucggggacagagcggugaccauggccaggcuggcguugucuccugugcccagccacuggaugguggcguugcugcugcugcucucagguacagaacccacgacgaggccugugggguuugcucucaucuccagcugucugggcccugcggcucugccuccugcuugcuccacccuccuccucugucucucacucuuuaccgccugucucccucucauggcccuggggccugggucugugggugucagcugcacguggugaugggcucaggagccuguggccccaguuccucuccugccuggagagcaucaggcugagcugggcaugaggagcaaaccagaguuagcaaccaggaccguggaagaacuaggcucaggaggaagagaggcugagggcggugccugggggucgggaggggagaggcugucccaaccggacccuggaagaugcaagauccaaaugugguccccuccucugggaggugaaagauccuccgggcugugacuuucuuccugucucucuuuaaaaaaaaaaaaaaaaagagagacagggugucccuauguugcccaggcuggucucaaacuccuggacccaagcgauccuccugucuuggccucucaaaauacugagauuucccugucccuccugucucauucagaugccugcucaaagccaccaugagggucaaaggcagaaagggggcugggggcagggcuuccgguacccccaccccauaucugucucccaaguacugggggcagggaggaccgaggggucuugaagcugcugucauggaaggaggaaguagcuccgggaacauagagggcaugcagggguggggcagcccaggccagaggaggcccugacuggccccgcccacuuccucccacccagcagcugagccaguaccagcagccagaucggaggaccgguaccggaaucccaaaggucaguagccucgccugccgcuucugagggcaaguugugugcgacuauguccuguguccgacuauggucccuguccugggggcgguccgccuucccacccuugccugaucuccccauccaggauucccauccccaggccuccuuaggaucuccucugagccccacccccagcccacugucauccucaucagacacaugcccuccagccuuggccacugaagggcugggcuaaacucugggucauagcaagggagccuggggguuccucuaggacucaggcccgggccugucuagcugggaaucuggcugagucucgggugagcccuccagugcagggucacuaugugaggggcucagggauucccgggcagugcucacuaagaacaaggcagucgaagcuggaaagaggguucuggaacaagaaguggacccagucccugcaggagggaagagggggaugauagagggaagucaugcagggagggggucgacugaggaaggucucaguugacagacuaggaauuuggccuuuaucccuggaggaacgggggagacugaggauuucaagccugugcagggcagcccagugaaaggaggggccaggccugugggccuccagguccuggggguguggccugggucaggcuguuguaaugggcauaggaaggaauggcaaggucccagggcucuuccaaaggaaaaucgaaggggagguggggcagucgggaagagguggagucugagagcuuggccguggcuucucauguggcucagccucucacguggcucugcuucccaacuccaaccucagccuccugccugucccacacccugagaagcaaggacuaagcccagggagucugugccagccagggcaggggccugcugcuggggcuggcacucaggaagaugccaagcggaaugcugagccuggccuuggcacccacagguagugcuuguucgcggaucuggcagagcccacguuucauagccaggaaacggggcuucacggugaaaaugcacugcuacaugaacagcgccuccggcaaugugagcuggcucuggaagcaggagauggacgagaauccccagcagcugaagcuggaaaagggccgcauggaagagucccagaacgaaucucucgccacccucaccauccaaggcauccgguuugaggacaauggcaucuacuucugucagcagaagugcaacaacaccucggaggucuaccagggcugcggcacagagcugcgagucaugggugugugccagguggcugggacgcuccuguagcuguccgccccacccuagcccggccugccucuuguggugauggucauggcccuagagcacucaggagagccacugggaccugagggagcugcccuuguaggccuaaaagguggacuguggcccaggcucacaaccccaccccuguccccgcaggauucagcaccuuggcacagcugaagcagaggaacacgcugaaggaugguaucaucaugauccagacgcugcugaucauccucuucaucaucgugccuaucuuccugcugcuggacaaggugaucaggggacgggggaagccuugggggaccgcagaggaggccaccgcauaggccaggcauaugcagggucuccaucuccccagcucucguuguggccuucuugguccagccuguccccacuggcucaccaauucaaucauuccuuccuuccuuccuucauucagcuguucuugcagaaugcaccucacuccugaccccucaccccucucccuggcccuccccagccuggcccagcaggggauggggcugggggacacuaacacucugaucuccaucccucuccgcccccaggaugacagcaaggcuggcauggaggaagaucacaccuacgagguaaggagaggggcaggcccagcagcucugaguccucggggucaguggccacuaucugcuggugugguugggguguggucccggccugaguuccacuuaaugucuccagggccuggacauugaccagacagccaccuaugaggacauagugacgcugcggacaggggaagugaaguggucuguaggugagcacccaggccaggagugagagccaggucgccccaugaccugggugcaggcucccuggccucagugacugcuucggagcugccuggcucauggcccaaccccuuuccuggaccccccagcuggccucugaagcuggcccaccagagcugccauuugucuccagccccugguccccagcucuugccaaagggccuggaguagaaggacaacagggcagcaacuuggagggaguucucuggggauggacgggacccagccuucugggggugcuaugaggugauccguccccacacaugggaugggggaggcagagacugguccagagcccgcaaauggacucggagccgagggccucccagcagagcuugggaagggccauggacccaacugggccccagaagagccacaggaacaucauuccucucccgcaaccacucccaccccagggaggcccuggccuccagugccuucccccguggaauaaacgguguguccugagaaaccacac

SEQ ID NO: 16903 - RNA, 367 nt, Homo sapiens
aagaacgccaucgacgcuccccugucuuucagcgccugcagguuccgggaggucagguuguauuccuggcgggucgucuggcugggugggccccggaggucguggcucgggagcagggaggcguaggggggccggccugcugugaugacauuccaauuaaagcacguguuagacugcugacgcgggugaugcgaacuggagucugagccugcccgagcggagcugggagggggcuggcgggcgggcgcgcgcacacccgcugaucuaucacucucguucuuguagcucccagccgaggacgucggaugucaucguccuugcugcuuugccaccccauucccgucaauaaagugguuugaacccaacc

SEQ ID NO: 16904 - RNA, 367 nt, Homo sapiens
gguuggguucaaaccacuuuauugacgggaaugggguggcaaagcagcaaggacgaugacauccgacguccucggcugggagcuacaagaacgagagugauagaucagcgggugugcgcgcgcccgcccgccagcccccucccagcuccgcucgggcaggcucagacuccaguucgcaucacccgcgucagcagucuaacacgugcuuuaauuggaaugucaucacagcaggccggccccccuacgccucccugcucccgagccacgaccuccggggcccacccagccagacgacccgccaggaauacaaccugaccucccggaaccugcaggcgcugaaagacaggggagcgucgauggcguucuu

SEQ ID NO: 16905 - RNA, 548 nt, Homo sapiens
agcuugcuuuuuguguggggauuggggagcugucggggcggcugccauuugguagcuguugagggaguugagagggagcguauugugcggaugaaagcgggacgcuucgaggcagacgaaggaacaucuguuaggugcggcguuucgggagguguuuuugggguggccgggcauucugugggagcgaggggaccacuuccaaagcccuggugcuguugggguaggagggcggccggcaucagccauguggcugagucgcgaguacaaaaugccggccucggacauggcggcggcgccuuuguuaccccgcccggcggaggagcucaaaauggcagcgucgagaaaauguggcgcagagagaaaugcgagacaaagggggaagcgccgccccagcgggaacgccgcccggccgacuccgcccgggccgggacuccucccccgguagucgccggcuccuccuuuucuuuuuuccugcguuauauaauuuugauucguugauccggagcucuaccgcggcguucccccagcuggguuugcuagcagaagug

SEQ ID NO: 16906 - RNA, 2372 nt, Homo sapiens
ucugauuucaagucaagauuuauugcuuuacaaacaaacauuauacuuggucuuaauagaaaaaugacaccagauacauccaaaauacauuucacauugggauagcugccaguucagcacaaaacauacauuacuaggagcagggaggcaugaaaauaaacuauaucuuacuuuuugguacgucaggaacacuuuugccugaaguaagcccuuuaguacuauuuuuuauuuuauuuauuuuuuuaauccacccaucugcacacuggcccuuuaguacucuuuaaguauaaaacuuuaauacuuguccugggcuuugacccuuguguuugaucuaaaugacauuucaaacauaaaugucuuuugacuagugcgcuuacuguuauguacagaauuuaaaaugugaucguuugaauauaaaaucugguuugauacaugauauaaaaguuguauauuuaaauucaagaaaauguuuuuguggacuauuucuacuaaagaauauuaaauuaaaauaauuuaaaaacuuaugaagcaaugaucuguuaacuggacaggucaauuaucugagcuguguaaaucauugucuggcacuacaguugaaucaccuugacacugagcucaggagcagcccauuuaagaagcaucuuguaaauaacaaagugacaccuucgagauuacaguugcagcuaugcaagucauucacagaguagcugagggcucucuucugaaggaggacccauuacaugaagguagaccuuucaugucuuguugccgacguccaagucucuugcgguccagaaaugccaggaugguuguuucaaaugcauuggguaugaauugcaccuugaaucugcccuucccuuuuucgauuaaaccuuuucacauagcugcugcugcuccuuagcaguccauccccuggacggaggcggccucucaggaccuggagcagagcuguagggagcugccgucucuuaugguagauguggcccaucacaauauaccugcugccuggacaaaauaaccagaacauuaauucauagugucuuuuaaaugccaugaaacagaaaauguaaggccuuuaagaaacgccuaagcugcaaucuauuaucuugcugcacaaguugaaacugauauugagucuacaggcaucugguggaaacagccuagccaccuuuacaagauaaccaaccaggccggugugguggcucacgccuuuaaucccagcacuuugggaggccgaggugggcagcucacuugaggucaggaguuugagaccagccuggccaacauggugaaaccccgucucuacuaaaaauacaaaaauuggcagggcgugguggcgcaugccuguaaccccagcugcuugggaggcugaggcaggauaaucgcuugaacccggcagguggagggugcagugagccgagaucgaaccacugcacuccagccugggcgacagggcaagacucaaucucaaaaaaaaaaaaaaaaaaaaaaaaaaagcaguauguaaccggaccacauuacagaacaaagguccuuaucacaaucuaucaggauuucccagagcacaugucuagaaagaugugggaguggguauuccccgcuaccaaccccacauacacacccaaaaaagcagcuuuucuaaacucgguucuguacagucccuucuggcaaugguguuuggucguccaccccauuugucaacaucuauuuauugacagcccgcuuugugccaacccuugcuguucucacccuugagggugggggcugacagggcuuaaaucacagaguggccggaauaauaccugucgucuaaaucccauucaugucauuguuucccaucgcucccaaaaaaaggcugggcgaccuacagcccgggcuguggcacccacguuacaaacggugguauaaaguacauaugcagcgucauucaggucaguuucaauaccagguuuaaacucuggacacggcuuauugcagcuggaggaguccagggcuaacauguggacucggaagaagaagccgucgggggugagguacaggcgguucaucuuguacagcccgucccgauccaccagcagggucaccagccggaugcccgcgcccagcacguccacaucgugcacgaucccguucaccgcugcuuccgaaaaacaguuuggagaagagcauuaccccgaguuccucucccagucccccaggaggugguuuuuagcaaccgcgaaacggcccgcacgggucaggcgcccugggaucucgcgggcggauucuccggggcucggaaaggcucgcggggcggcggggcggcggcgcggcggccgggcucaccgaauucgcucucgcagaacgccucgcguucguccagaucggaccgg

SEQ ID NO: 16907 - RNA, 6116 nt, Homo sapiens
auuauuaaaaaggcauuuuauuauaaauacauuuuaguuguagcaguaaaauacauuuuguuaccaugaaucuuugaaaacaaaagaacuucacugagacaaugagcacacuguaggaacuguagaccccaaguugaaaacuuguucuauggaaccaaaguagcuaacguaauuccaaaacuaaguuagaaaagauaaagacaaagaaagaagaaaauaaaaacccuagagaguggcuuugggguuauuuuaugguacaaagucacuuuuacuuuuaaggauaaacucuuuagguauuagagccucuuagaugagguaucauuuacugcaaagaaaaaaaauuguuauaauuuugccauaaguuaugccuauuuagauggcuguauaacugguacuuugaagagaugaaccugaccaccucaguuuuguacagcuucccucaggaagacuucccaaaauaagacucaguaugaauuugcuaaguaacugaucuaugaaguuagcugaacaaguuuagauaagaacuauauguaugaagcauuaaaaaaaaauccugugucacuaauaacaggacccuuuaauaaaaugcaaaacucauuaucuuuauaauuuagaagagaaguauuuuaaucaccauauuuaccuaggauacaacuacuacauauagccaguaccuuuaugggguuuaaagaaucaggucagaugacuggcacagaaaucagauacaguacaaugucauauacauggauuuauaggaagcaggcauggucuggauuuaugaaaauccaggacccuuccucuguaaagggggaggcugagaaacauucucagcugcacugacacuuugggacuucaaccaggacaaagagcccucugaccuacugaaagauauaaagaggucuucgcauacaaguuaucgugcaaagcaaaguguaaauaaaccgaagcuccccucuaaguugggacugcauaaaggaacccaggcugaaaauauaaacaauccucuccaaaggugagcaagccuuuucaguaggaaggacugugucuuaagaaaacuccaaagcuguauauucuacgauggucuucacguguacuuuuacaccuaagucauucuguauucuauuaccauaaaaauagcuuuuuuuugucuuucuaguagcucaguaaauucaaaggcaaacuaaaaaccagaagcagagcccaguaccccccaagaugcaguccagauaaaacagcaacaacacacaaauuaaacaauacccaaagaccugacagguuuauuauauuauaggcaguuucuuucucaaaaauaacuugcucauacaugugcaccuaugacuuaugaauaauucaugcuguguaggugguagaucccccuaggcuguuuugcaaacacauauagauuuuuuuaaagguagcaaaguaaucagagacauuuauuuucugccauauguaacacuucaggcucucucuaacaccugcuggcauggcagagaaucuaaaauaacuuuguuaaccugagaaacacauaauuugaaaaacaaauccuuugcccucaccacccucccccacaaaaaaaaaaaauaauaauaaccauaaaaacuaaaacauuugccaggcgcaguggcucaugccuguaaucccaacacuuugggagcccgaggcgggcagaucaugaggucaagagauggagaccauccuggccaacacggugaaaccccgucucuacuaaaaaauacaaaaauuagcugggcgugguggcgcaugccuguagucccaacuacuugggaggcugaggcaggagaaucacuugaagccgggaggcggagguugcagugagccgagaucaugccacuguacuccagccagggcaacagagcgagacucugccccgaagaaaaaaaaacaaaacuauuauuuuauuauuuaaggauuaucugugguuuucgaugcuccaugucacugccaucuuaggacagggacuccugcacuuagugccucgauacaugcuaggugcacucucauggcauucugauggcuucuuuccaggauucucacuuccaugcauguggaucaagauugacccuaagcacaccaaacaaaugcacagcuuccagacugauguccaggcagcagcguacacaaaagcaaacucacccuaaaaccaaagagcuccuucacccuacugcggaagagcagugcagaccccagcaggggugagagugaggaggggugguggccaauccaaagggccugucgcuccauggagaccuuucuccacaaauguuccagucauggcaccagauuuauaaaaaugucuccagagaucaguuuuuuacacugaguaaauaaauacaugguugaaaagacguucagacucugaaggucucugagacuuucaaacugcgagaaucagacccagugauuuucaaagugugguuccuggacuggcagcaucagcaucgccuggaaacuuguuggaaaugcaaaucaucaggcuccagaccaaaaucagaaaugcuggggguggguccagcuaucugaauuuuaacaagaccucgaggcaauucugauacuggcugaaguuugagaaccauugcuccauccuguucacaauucucaaaucuuaaaacaggacagaucuguaaauaguacuaugugacuucuacucuguguugcaaccuauguaauuugccacccuuuccccuuuacuucucaaacauuaaaaaaguauuaaugaaaacacuucauaaaaucaaaaauuucuuaaaagguaauaucgauuuccccuccucuacauaguucuaaggcaggcaaucacaugcuaguaugcaaaguaaaauacagaagagaccucauauaugagguagaaacaguuaaaaagacuccccacgaacauaaugaaaauuucauaauauuguuuaaugaacucauagaauuauauaaaacuuacuaugcuuuaugcuuaauaucuguaucaaaauaaaaucucucuguugaacaaauugcaaauaaagucuggucuaauacucugauaacugaaacuauaugaaugucucuggguuuucuuaacacuccaguuuuagacgcuuuagacgaccacugcggaacuggguuugguauuuaaccacaguucacauuucuaagucuagauucuucuauuagguaccucccuccaaaaaauuuuuagaaacucuggugacuguuuccuuaaacuucacuccaaaguagacauucucaauugguucaaaaauuuuaaacguuacauuaaaauuguuuuuaaaucucuugaaucucauauucuaguuuaaaguaauaacaggauguguuuaguaagauucacuccuugcaacaauggucuugacauuacugauuaaaaagguaugaaaguagaaagugugaauuuagcagcuuuaaagucucagcuaauaaauguccauccucaagcagaugggaaaugugaggagcauaucauaaugagcauuuucaagacuaacaugccaguuacucuuucaagauggagauggugucuuuguaagugauuggcaccacuacgugauauuuugaacaagaaaucguagauagaacauuaccuauucuuucuaauuucuaggcgguuugaauguggaucagauggcaaagaguggagacaaaucagauccauuaagacauuuauaccuugagauucaggaagacauauagcgcggcaguagaaauuaaggauuuucauauguuaaggggauggugagcaagaaauaauguacgguaaaucauaaaagacaaauuacuaccauugaggagcuggagggaaaaaaaaaaacacaauggcuagcuuacaugacauuugaaagcaccaauuuguaucuuucaauacauuuaaaguuuuaaccuuguauuuuuauagauucuuucugggauucccuuuuuaaaaauaacuccacuauaaaacaaugcuauagaaggugucuguuuuuaaaugaguauuucaguaagucuaauuuucuuaauaacaaugguugaaauacuaaaauuuaucuugaaauuguucuucacacccugacucuuaacaaagguggcucgcucuagcuaagggggcuagagaaacaucuuuuacgucugcagcuuugcucuugacaugaaaaauauuaaacacauaaaaucaacuacacuagagcaacacaauacuauauauuaauuaucccaaaguugggaaauucauuagcuuucucagcagcuccaaugccuccauaaaaaaggagaguauuuucauaaauuggucuuagauguugcuauguuuaauuagguaaugcuuauucagugggaauucugcuuauuuuacuuauucugcaguucucugaacugaaaagaccaguugauguuuacauuaaaccuaaacuuauucuaaaaucugaugauuuaaaaaaaaaaaaaaucuacacaaagcaguuuguuauuucacguguaaaaaaugaccuggauagaaagcacaucugugugaggaaaggaaaauuaaggucauguuaguuuaaauggucaauaauuaacuacugauuaaucaaaaacaaaguucugcuauaacaauuuggcaaagcauaugcccaaaugacaaccaaaacccccuuuaaagacacacaagaaaauauccauguuacacggaaugagguucuucaaaucguaacaaaagaccauuuuuagaucaugaaaagaauuuuuucagcaugaaggcucacuuuacaaacucuaucauccaaaauaucgucuuucagguuaaaaaaaaagaaaaucucaaguagcacugaaauuaaaaagugaaacaaauauucuggcaagaaaaagaaaacuucagagugauacaaaggacaaagauguaaaaagacauuaugugaacaauuaaccucacuuagaaaaaaaucugcucugaagaaauggaagcugguaauacuugguauuaucugagagcuaucaucaaguuuucuggaaaaaaauuuuauauacauauacuauacauauauaugcauauauaaggguugaaccuagcauauaaguuauguuucauaaaucugauuuauggguacuugcuacuacuacucaaguaauacccaaagaacaucagcuguacucagaagacacgccucauuuugauggaaacuugcaaugauucuuacacaagacguguucaaaauguuauaagauacuaugcguaaagagcagguucuuuaaagcaugguuggaaagauggcauuauguaaugcugaggaagaguaagcuuguuguaagucaaaauaagcauuugaugcagaaucuaagaagaguaucagauggaagcagcguuagaauccuugacuggcuauggaaauaaggaaugagaaguacucauauacucacagcagagcggugggccaauaaguagcuauuauuuuuaguuuuuagaaauaacugcuuagaacaaggaugucaugacaacuuaauagcuuccuuauccaaagcuuccaucaucaacauauuuauauaaggugauggggugcauacacgaccccaugacccuuaacuaaauauaaauauaaauaauuuaaaaacugauauuuuuuaaagauucaaguauagaaaacagaaaauuaggcaauaaccucaugacaaggggucaacugaaagcccugacuugacaauucugucuucauauuaucagauugcuuuugaacauuuaucuagcuugcguuguaguccuguauaugggggcugggggguggauaaucacugaugggaaaauuauuuuccauaacauccucacaucagagagaucuaauuuucauucggauaugucuugaguuuugucacagacuuaaaagcacauagcuacguggcaaaacuuuuucuucuuuucuuccuacuaaagaauguugaguaaaauuugacauugcuaaauguggugaucugacaucauacagagaaagaguggugcuguaacuugccggcucaguuuuccagcugugauuuaugcuaaccauuaacacgucugcaguuuacaagucuaugucugccaccuuacacagagacccacagccuggaacgcaaagccacacacaaaugaaccgcacucuuagcagaaagguagagcu

SEQ ID NO: 16908 - RNA, 2295 nt, Homo sapiens
caaccccagccuccucccgcccccucgccagccuccaccucccccgggggugccggcgcggccccuggggaucgcucgggucccgggcuacgcgcgcgugcuugaguuucgguguguuucauugugucugugggcgagggggugugcgcguggagaguuugugggaucggugugcuggggagguccccagccgagagggaccagagcugauguacagcuggccgcgaagggacccgcccgccagcuccggcuccuuugugucucgcgcggagccagcgccgcgcccacccucuccccggcccgcgcgccgggcagugugugcgcgugugugugugugcgcgcgcgcgcgcgcgcguguguauauguguguguguguguguguguguguggggcggcgaggggucggggcuggccguaccuucgaugcagcacacccgccacagaccagagugggugaggucgccgcgggcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccuccgcgcgccgcuccgggggcgccgggguuggggggccgagggccggggggcggcgccgcgcugcgcgcuccgaccccgcgccccgggcgugccugcgcuccggcagcgcuggggcucaaacuccgaggcgcggcgacgagugcgggcugcgcggccgccgggcgggcuggcggcggcggccgggggcuccucccucuccgcucgcccuccccccucggcccgcgccuccgcccugcgcccuccgcgccucccccgccgccgccgcgcuccggguccgcgccccguuucucucggcgccgccccucgagccucggcccccgcccggcugugcgcuccucugagcuccccucucuccccagccaggauuuucucccccucgccucccuuccccucgccuccccuccccucccuuccccuccccuccccgcgcccgcgcgcgcucucucucucucccagaguucauucacauuauuggagugaaggaagccgagggaaguguuccccaggaggaccgaagggaaagcgcgucuccagccaccucucuuacccgcccaggacauccagccuccccuccgacggcccugcggauucuuuaauuuguggaggagggcgugggugggugugucccuccuuuccccucugugccuguucaccuggugaugaaggugagugugggagugcguguucaggucagaauuccugaaaccccagaugugggacacagcugccagacccugcaagccacgccaggcccgggccaggccccaccccaacccaggugguuccugcuccuccagauccccuugcagggccuggaaggacccugacuugggguugagggagaagggcgaugacagcgagaaguccuuuggggagaacacagggucucugcuuucuagagugguggcaaggcugagauugaagauggggcguuccucugugcucacauuucugagggucuauuacugcuagaguccagggacacuccaguuguguuagauuccaacacuccacccgccagccuuuucccuuucucucccaaccuuucgcaaugccuuuauuucguuuugccuuuugcucugcucgagcuuaaccggcuuucccuccccuggccuuuauugucagccucugaccccaaccccugcuggcuucacuuaauugccuuugcugcuggccgugaucccaaccuggacacacucccuucuccagggagccgguccggacuccuccuuccagacccagcuccaaaccccucccuccaggagguucucagagcccagcaucaggaggugcagcacccuuugacauguccaggugguccuguuguuggcaucccuggcugcacuggaccccaggauauggaaaaagguauagggagugcugcuauucuugcaagacgaagcuuaacuuucuuuguggcaccuucccugguccccacuccccguguugaaaucacuguucucugucccacaagauugugagccuuuccugugacuggcauacaugguaagggcuuagcaaauguuugcugagugagaguuguuucuugccacuuggaaaauuauagucugauugggaggaauagaucauaua

SEQ ID NO: 16909 - RNA, 15704 nt, Homo sapiens
uacuaccauuuguacauuaaaaaggaagggguggaaauagcauuaucucuuucuagguuguuuguucuuuaauuuucuuuuagguacaaacaaggauuuuuuuuuuuuuuuugagacagagucuugcucuguugcccaggcugaagugcaguggcacaaucucagcucacugcagucucugccucucggguucaagagauucuccugccucagccucucaaguagcugggaucacaggcaugugccaccaugccuggcugauuuuucuauuuuuaguagagacggggcuuucaccauguuagccaggaugguaucaaucuccugaccucgugaucugcccgccucagccucccaaagugcaggaauugcaggugugagcgacugcgcccagcacaaacaaggauuuuuuuuuuaacccaccaaaaguauugaucuguucucuuuugccaagaucuguaugcaauuaucucucacuuuucugguguuuacuuaugucacccacagcugucuggaauauagguaaaaacuaaaaaugcaauccaaaaaggcucuuaaacaauacagauauauucaauuaagaaaaaacaaauuuaaaacaauacuuauugacuauuggaguaugggcuagauauuauccuggguccuagggauauaaaaaugagaaacagcuucuaccuuaagaaacccccagcucaaaaguauggucauugacacauugauguuuaccucagaggggagucccuuauuuucccacccagauaauuucauucuaauaauuuuagaagcaauaaauuagaucaaggugcuugugcuagcacacugaccagugucaagaaauggcagcuaagaacuugucagaggugaagauucaauaauuaaugauaaaaagcaguuacaaaaagacaaaauuggcaauucagguacuacuuucugaaaagguagacagacuaagggaauuacuguauuguggcacauugugauuuuggguguucacaauaaccuugaguuauucaaucugaggaaguaauaauaauguuucacauauacugaucauuuauuauguuccuaauauuguucuaaggucuuuacaucaaguaauuuauuaacuuaucacaauucuuugauauacucauuguuaucccaguuuuucagaggagccaacugaggcacagaauguuauguaguuugugaaggaacagggacacaaauccaugccaucugauuaugagcuuggacucguaaucaucguauaauuuuagagauagauuuuucucaaaaauuguuaauuuuuugaagcuucccauuuaaaggcguaaaucucaacugugcuuuuauguggcaguucugagucccagaaaaaaaaaaucaacaguaaauagaggggaaacuacugguacaugguacauuggaggcacagugccaauuugcaaaauacuuauugacuugucagcaacucugauagcaauuccuuguugguuucccauguaacauaucauuuuagaguaccagugaagcaggcuguauaacauaucauuuuagaguaccagugaagcaggcuguguaacauaucauuuuagaguaccagugaagcaggcuguggcuugaggagaaacgugccuccucaguagagcaguguaaccuaguucaaacccuccugggaauugguuuuagcuguaucucugagagagagaucacacuuagagacacguaauagaagcacaguuacagccccugugguuuuugucaagcagcaaacugaaugguguucugaauaucaagcaccaagucugagugguguacgguguucaagaaugaguaggagaacagaaccaaaauggagucugugggaaagcauuguagaggaaaggaaugagagcauuacacagaagauucagaggaaggaguuucuccugaaaauguguuacuccggaagaaaauguuuaaaaauucaccaguagcauacaagaagauaugauaucuaugaaggaggaacagacaccauaaggaaagaaagggaugaagugaaaauugucauaaggaaaucguaaggaaaccaaaaguacaauagcagacuuacgaucacauaguugcugguuggguuaggucagauuuuguaaagaauuaaaucagcgauaugaaggcaaggcauaaugaccuuucagacugcaaaagaaagggacaaagaaucaaaaauuuugaggaaggugauauuaaggcagaaaauagaaaaccaguauauaacaacugauauuucugaaggaaggcucagaauaaaauaacacaaaaauaacuaaagauaugagaaaacuuuucagaaggucuguguauguaauuuuaaagauuucacucuuuaucagcuaaaacucaauacaagauuaaaaaauguuugaauuacaguacaaagagaaugauuuuuauaaauguccagaccccagggggaggggaaagcaaaguuuagaugacuuuagucuucuuauuugcaaaccuaaaugucauaaaacaauagagaaacuuaacgugugcuguguuuuaggccaaaguguugugaccuaagaaucuuauaccuacaauuuccuucauguguaaaggcaacagaaugacauuuuugaaugugcaaagccucagaagauauaucacuaggauauucuuuuugaaaaauaaaauuacuggaugauggacuuuaaucagccuaaggauaagcaaaagaucaaaucaaacaaaaaaaauacucaagaacgaaaaaguacuggugaaugccaaaauuaaaauagagaugaauuuaaauauuuauuguguacacaauauaaacaauggaaaugucagaagagaaucuugaaaaagaagguaugugaaguuaaaacaauuuaaaaccacuaucugccucagcaucucaagauuauauaaaagaaaaccaaaaugacuaggagagggagaaguaaacauaugccaagcuauuauuuuaacagggcagagguauuaauuuuuaacuugcuaaauauuagagggauguagguuaaaaauaauugugaaauauuuauggcaucauuaguguaauuaaaaucuguuuccaaagacgauguccuugacaaaauaccagcaaaccaaauucaacagcacauuaagugaucaggcaccaugaccaaguggguuuauuguugggaugcaaggauugcucaagauagguaaaucaauaaaugugggaaaugauggcugacuagaugcagcuagaaagaauaucugccaccaaggggguaggacauugggaagacuggcacauuccaagucgaucuucagaggaaaguuacugagaguggacagagggaggacagagacacugggcugaaaggggaggaagcugggaauccugcauggggcugccacacacugggucuucuuccuggcuccuaaugucuccuggggaaugggugaguugagcaggcaaggagugagcugcucuugcuuuggaccucuggaauccuggcagcagaagaccccaugacccccacacuugagcuggcagagagaguugcuuagagagaugguuggggcaggacuccagccuguacagagcccagagaguuuugaugagggaauguuugcaggggggcauggccggggaugcccauucccucaggcuggccauguuccucuaggagacuuuagccuuaaaagaauuguugaaccugaacagagcagauggggccagucuuaccugaacucucccaucggcuggccucuccugggaccauagccuggcuuugccugcuuacagugcagacucagaugcucaaccaggaugccucccuagggcccucaucauagcuccugugcuggcagacugugccagauugccagagagcuccagcagaguggcccccacugacaugcacuggcccacucacacucucccucuacugcagccucccccaugcugcuuuaccagcaagcacucacccaaggccauccuccuauugccauauuggcacaugugugcaugggugaaccuugcccuuccaugcuggugcagugaugugcgugcaucccacugcgccauugcugccagcgugaguguacccgucccccacuugcugcuguguugcagugcugccauuucuggugugaaagcacucaggaaggccaguggcccugccucccaccacgauugccaccagugugaacaugcacaaggaguuugccagccccaccccagccagaaauccacugcuaugccaacacugcccaccagugugaaugcacacacagaugccagugaccccuccccuccauggugccacugcugccacugugaaugcgcauacagaggcuggcaguugcuggucugccagcgccccaccccagcuaacaagggugaacccugguguacuaccacugcugcuggcacaugcaaacaagcauuaaucacauugccacugccugaugaagcgcuuuggcuggcaccacucguuggaguguuguggccaucggaccaggaacacuuuggcccauuuaacacagcaggucccaacuuugagggaccagagaacaaagccagugacccgauaccagccccuuagaguuagaguauacagugugggaguguugagcugagccuuggcuccucaaaaucuacuagaaaugaagccagucgauggaccccaccuuaugccacaaacccccaaggacaucaauggagauaaaagcaaaaaacaaaacaaaacaaaaaccccaccauccaaaggacagcaacuucaaagguugaagggacaugagcccacacagaugagaaagaaccagagcaagaacucuggcaacucaaaaagccagagugucuucuuaccuacagacacccacacuaguucuccagcaaugguucuuaaccaggcugaaaugguagaaguagaauuuagacuaugaauaggaacgaagaugauugagauucaggggaauguugaaacccaauccaaggauuauaaggaauaaaauaaaauaauauaggauaugaaauaugaaaaugccauuuuaacgaagaaccaaacuuaccugauagagcuggacaacucacuucacgaauuucagaauacaaucacaaguguuaacaguagaaucaaccaggcugaggaaagaauaucagaacuugaagaacagcuaucugaaauaacucagucagacaaaaauaaagaaaaaaaaaaguaaaaugaaaacaacuucagagaaauacgggauuaugugaagagaccaaaucuaugacuuauuggugucccugaaagggaaagaaagcaaguagcuuggaaaauauccuuuggguuaucauucauaaaaauuuccccaaccuugcuagagagaccaacauuuaaauucaggaaaugcagagaaccuuugcaaaguacuccacaagaagaccauccccaagacacauaguuaucagauucuccaaggucgaaauaaaaaaaauauuaaagacagcuagagagaaggggcacgucaccuacaaagugaagcccaucaggguaacagcagaccucucagaagaaaccguacaaaucagaagacauugggggccuauauucagcauucuuaaggaaaagaauuuucagccaagaguuuuaugucccagcaaacuaagcuuuauaagcaaaggagaaauaagauccuuuucagacaagcaaaugcuaagcgauuucauuaccaccagaccuaccuuauaagagguucugaagagaguccuaaacaugggaaggauagaccguuaacagccacuacaaaaacacacuuaaguacacaggccaaugacacaauaaagcaaccacacaaacaagucugcauaauaaccagcuaacaacaugaugacaggaucaaauaagcacauaucaauacuaaccuugaauguaaaugggcaaaaugcccuaauuaaaaggcacagaguuggauaaaggcaaguuggauaaagaggcaagacccaaugguaugcugucuuugagagacacaucucagaggcagugacacccauaggcucaaaguaaagagauggagagaaauauaccaagcaaauggaaaacagaaaaaagcagggguugcuauucuaauuucagacaaaacagccuuuaaaucaacaaauaucaaaaaagacaaagaaggacauugcauaaugguaaacugcucaauucagcaagaaaaccuaauuauccuaaauauauaugcacccaauacaggagcacccagacucauaaagcaaauucuuagagaccuaugaaaagacuuagacaaccacagaauaaugaugagagacuucaauaccccacugacaguauuagucaaaugucagaucaucaagggagaaaacuaacaaagauauucagaacucaaauuugacacuugaccaaaugcauguauaacaucuacauaacacucuacccaaaacaacagaauauauauucuucucaucugcacauggcacauacucuaaaaccaagcacacaauuggacacaaaacaauccucagcaaauaaaaaaagcaaaauuauaccagcuacacucuuggaccacagugcauuaaaaauagaaauuaauacuaagaaaaucgcugacagccauauaauuacauggaaauuaaacaaccugauccugaaugacuuuuggguaaauaaugcaauuuaggcagaaaucaagaaauucuuuaaugagauuaaagauaaaauguaccagaaucucugggauauagcaaaggcaguguuaagagugaaguucauaaugcuuagcacucauaucagaaaguuagaaagaucucaaguuaaccaccuaauaguacaacuagagcaaccagagaaaugagcaaaccaacuccaaagcuagcagaagacaagaaauaaccaaaaguagaacggaacugaaggaaauugagaugcgaaaaaccauacaagaauacuucccaauacugaaccaggaaguaacugaaucccugaacaaaccaauaaugaguuacauaauuaaaucaguaauaaaaagccuaccaaccaaaaaaaccccaggaccagagggauccacagccuaauucuagcagauguguaaagaagagcugcuacuauuccuacugaagcuguuccaaaaaauugaggaggagggacuccuccuuaacucauccugugagguuagcaucauacugauaccaaaaccuuacagagacacgacaaaaaaaguaagcuucaggccaauauccuugauaaacauugauacaaaaaucuucaacaaaauacuaggaaaccaaauucagcagcacaucaaaaagcuaauucaccacaaucaaguauacuuuaucccugggaugcaagguugacucaacauaugcaaaucaauaaaugcaauucaucacauaaacagaacuaaagacaaaacccacaggaucaucucaauagcugcagaaaaggcuuuugauaaaauccaacaucucuucauguuaaaaacccucaacaaacuaggcauuaaaggaacauacuucaaaauaauaagagccaucuaugagaaacccacagccaacguaauacugagugggcaaaagcuggagacauaccuuugaaaaccucagcaaggcaaggaugcccucuuucaccacuccuauuuaacauaguaguggaaaaccuggccagaccaaucaggcaggagaaagaaagaaaagguauccaaauaggaagagaggaagucaaauaucccuguuugcggaugauaugauucuaugccuagaaaaccccaaacuccuugaucugauaaacaacuucaucugauaaaaaagcuauauuuuuucaggauacaaaaucaauguacaaaaaucacuagcauucuuauacaccagcaacacccaagcugagaaccaaaucaagaaugcaguuccauucacauuagccacaaaaagaauaaaauaccuaggaauacaccuaaccagagaggugcaagauuucuacaaugggauaaaaaacauugcucaaugaaaucagagaugacacaaauaaaucaaaaaacacuucauccucauggauaggaagaaucaauauuguuaaaauguccauacuccccuaaaaaauuuacaaauucaauacuauuccuaucaaaccacuaaugacauucuucacagaauuagaaaaaacuguuuuacaauucauauagaaccaaaaaagagauugaauauccaagacaaucguaagcaaaaagaacaagcuggaagcaucacauugccugacuucaaacuauauuauaagccuacuguaagcaaaacagcaugguacugguacaaaacagacacauagauuaauggaacagaauagagaacccagaaauaaggcugcguaccuucaacugugugaucuucagcaaagucaacacaaaaaagcaauggggaaaugacucccuauucaaugaauggugcugggauaacuggcuagccauauacaaaagauugaaacuggacccuuucccuauaccauaagcaaacauaaagucaauauggauuaaagacuuaaauguaaaacugaaaacuguagaaauccugaaaguuuaccuggaaaauaccauucuggauauacaaaguggcaaagauuuacagucaacagagugaagaggcaaacuacagaaugggagaaaauauuugcaaaccauuuaucugauaagggacuaauauccuaaauauauaaggaacuaaaacaauuuuauagcaaaaacacaaauaaccugauguuuaaaaaaugggccaaggacuugaauagacacuuuuccaaagaagauauacaaauaacagguauaugaaacauucucgacaucacuaaucaucagggaaaggcaaaucaaaacuaaaaugaaauaucaccuuacacuuguuagaauggcuuuugcuaacacacacacacacacacacacacacacacacacacacacacaaagggauaacaaguguaggccaggauguggaagaaagagagcgucuauacucuguuggugggaaugucauuauggcaaacaguauggaaguaucucaaaaaauuaaaaauagcacuaccguaucauucagcaauuuccacuucuggguuuauauccaaaggaaaugaaaucaguauguuuaagagauaucuacacuccuauguucauugcagcacuauucacaagagccaaaauauggaaucaagcuauguauuuaucuguggaugaaugggauugaccuaaguguucaucuauggauggaagaaacugugguauguauauauacaguggaauacuaugcagccuuaaaaaagaaaauccugucauuugcaauaacauggaagguccuggaggacaaguacugcauuaucucccuuauacaugaaaucugaaaaagcaaucaaacuccuagaaucagauaauagaauggugguuaccaggggcuggguggggagggaugucagggaauggguagaugcugguuaaaggguacaaaguuuuaguuuaggcuggucagaauggcucaugacuaaaaucccagcacuuuuggaugccgagggagguucacuugagggcaggcauuuuauaccagacugggcaacauagugagacccugauucuaaaaaaauaugauccaggugugguggugcaugccuguaguccuagcuaccuggggggcugauacggggggaucacuugaguucaggaguuugagguuacagugagcuaccauugugccacuguacuucagccuggguggcagugagacccugucucaaaaauaaaaguuuuagacaggaggaauaaguaucuggagauauaauauggugauuauuauuaauaauaaucuguaguauacuugaaaauugcuaagagaacaaacuuuaaauguucucaucacaaaaauaaguauauguaugauaugaauaugugacuuagcuugauuuaauauuucuacaauguauacauauaucaaaacuucacacauauguauauacgauuugucauuuuucaauuaaaauaaauuuuaaaaacaccauguuguauaccucaaagauguauaauuuuauuugccaauuauauggcaauaaagcuggaaaagucauuuucugucucuaugugucaaucugucagaacauggaggaguugaggacaguaacaaaaaugccauguauaaaaaguaacauaaaaaauuaggaaacaggaaaaaacggcauaaauaguauuuuagugcuagcaauaaaucuaagaaaaaaauguaugauuugggccaaauucaacuugcgagagaacuugacuaagaaagaacgauuaaagcaaaaggagaggugaauauguauaaguaaacaccaguguaagauaacaucucacauauuaguuucucccuuuaacuuucuucugaauuguccuucccccacccuuucacuugaauacauugacuuuucucuguguguuuuuccuaaauuggugggugauuuuucacuuaagauuuuauuuuuuacugauguaaaaacauguuuccaggaucuuuguauuaggucauaucugaauuucauuuugagguuuuagucuuugacucucuacauuaaaaagacuagauuugcguugaaauggugcuuuuguugcuuuaguaauguuuguacucuaguauaguaugcuuacuaugugccaaacacuguaauacauauuagggauccaaaauaauaauuaaacacuugaacaugguaaaaacuugaacagcagacuucuuuuuccugcauguaagauaaaauaaauguaguggcaaaaauuugcaaggcaaguuguucuuucucuuucucauaagacaaauagucuuuaugagauacuuuaaauuuaccauuuaaaauaugggggaggguggcuacagguuccuaauucucuugcuuuuucuucucugccucucaguguauucuuacuuuugagauuaucaucauagcagcccauagaagcuuuucgauauuaucuuggaaaauguccugucuacccucacuuucuuucaguuuauaagcaaacauugauuuuauuaauuuauuuauuuacuaaaacacugagagcagaaauccaaaagaauuuuuaaaagaagagguuaaagauaggguuugaguuaaauaggucuccauuuaaacugauauaaauagcuaacuacagguauuuuuggcuagcccugauucaguguuugauaugguuugucauaguguauuuauguuuuguuguuguucuugucguuucucucuuaaaccuguuggccacucguuucacuuucagccuuaccuugcuuaccagcaggucuguagcggguuuucccaccccaccaaguaacuugagcuuucccaccucccaccugggcucugcauccucaguugccauguauguagagccauggcugcuguuugauuccuuccuuuucauccagcuguaccaaaguuucccuuuuacauuuuaagauccguaaaauguccacauuggcuauguuuaucugcauaugcauaugaagagcuuuuugugaagacauuuuuuuuuuuuugagauggagucucacucuguugcccaggcuggagugcaggggugcgaucuuggcucacugcaaccuccaccuccuggguucaagcgauucuccugccucagccuccugaguagcugggcuuacaggcgugcgcuaccaugcccggcuaauuuuuguauuuuuaguacagacaggguuucaucauguuggucaggcuggucucaaacucuugaccuugugauccgccugccucggccucccaaagugcugggauuauagaugugagccaucgugcccagccgaagacaaauuuucauuucacccuuguuauugaugcugccaucucauuuacucaaaugauccacauuuaggaaagagguaggcauggugcggggaguggggagggguggcaguuuccuuccaaacucaguaaauaguuauacaaauuauucccagcaguggaagagaagaccauuucaucauaaccauuauguguucagggaauauagacacauuguuuauuguauucucuugaaucuuguaagauuucuuuucuuugauuaaaauauaauuuaaaaaaucugaaguauuccauuuuuuauuuucuuuuaaguuaugaauuuauuuuaaaagaauucaccugccgguagacucaagaaauucauuuugaacagaaaauagguauuugaguauaguauugaaaucauucuaugguagaccaaguuucuaucuugaaauaucuaaaucuaauuuuauauuaaaaauggauuugugaucacuguuucauuguuuguaugucucuuugaaguaaacuuuacucgucuuccaauaaauuuuccauguucuugucauggcaggcucaugacuugcagagugaacuugauaaaggaaaagaagauacucaaaagaaaauucauaaauuugaggaagcuuugaagugaguaaaauuguaaugcauuugauuuaaaacuacccuuuauuaaacugugagccaaauuaaguaacugggaccuaaacacuauauuuuuauaagagcuuugcuauggauucguuugcaucaguuucccaucacaaaucucuaucuucaagauuuuauuacuagccaguaauuuuuuuuaaaagaaaaaucaguucagcuguuuuuaagugauaggaauguaaaaaaauagaacuuagugguuucagaugcucucucccucuuaagcgaaaacauauuuuuuaaaaaaugagauuuaggucuuaggacauuuagaaauuccuccguagauuuuguugagcaguuugggaaaugaaauguuccaguuguuauauuugaaaauggauuacuauacaggcauuauuuaggaaagaguuugucuuaugauauacucaguauuuuaauguuuuacuguacuuaggcauacauuaaaauauuagauuuuauuugucuucuccauucauuuacuaaauugauugggcucuccuauuacuagguuugaccuugcaguuuuuagcugaaaaaacauugauucauuuagauaacuuaaaacauaaauuauugugaggucugaacucaauaaauauugaguucccaucaugugucagccaauguucaguacauucccauagaaccauauagucuaguuggagaaauauucaagacauuuggcaauuugguacagaaugauaagaguuuaauuggaggaaggucaauacggugacugacccaagaaagugauuuaagaggagaagcuuucuugagcucaauauaccuagcuaacucccagagaaucaguaauuuuauuuuacuugcuucccuaaaccugcaaauaagaaugacuuaaagaaaggccaaaaagaauacccaagaucaaacacauuuaguaucgaauucugccugggaagauugcauaaccauuccuucugucucacuuugcuuguuaauaaaauauauuggcucaguuccugaauagaacguuuuaaugcgauuuauaaacuauggcaucacaagacauccauauuuuuaucuacagagggacuuauuuguuuaccuugucaauaugaauuagaugaaaucaggagagaacaauaauauucauuagauauuaagucaaauaaauauugaacaaaacuagggcagucuugcuuucuuuuuuugagauggggucucacucugucacccaggcuggagugcaguggugcgaucucggcucacugcacccuccgccucuuggguucaagugauucuccugccucagccuccugaguaguugggauuacaggcacacgccaccacgcccagcuaaucuuuggauuuauuuauuuuuuuuaguagagacuggguuucacuauguuggucaggcuggucucgaacuccugaccucgugauccgcccgccucggccucccaaagugcugguauuacaggugugagccaccacaccuggcccagucuugcuuuuuuuaaugaauaggaugcucucuauucuucauuaguucauuuuuucucuuuaaaauaauuaacuacuuucuucaugaagauuucuccaugaacuuuaugaaauuuaccauauuuuuucucucuuguuccacuuugccuuuguucuuuuuaaauuucuuuauccuuucuucauuucuucauugguuuauugauuuauaaaucuaaggaagggguaauuucuuucaaucagugguccucaaacuuuuuggcaccagggaccgguuucauggaagacaguuuuuccauggauaggggguggguggggaaugguuuugggaugaaacuguuccaccucagaucaucaggcauuagauucucauaaggagugugcaagcuaaaucucuugcuggcacaguucacaauaggguucacgcuccugugagaaucuaaucugacagaagguggagcucagguggcaaugcuggcuugcccggggcucaccucuugcuguggccugguuccuaacaggccauggaccuguauggugcccagggguuugggaccuuugcuuuaaauagcaguaagacaacaaauauuuguuuaguaccuacaauguuuacacauuguaauaucauacuaaaggaaauaaaagguuuagaagacagcucaagauguaaugauguucuuaaugauuuuccaguccagguuaggcauuugaaguacuuagaauaacuagguauuaacuuguugaccauaacagcaauuaaaguucagacugaucguuucagugugauauuaggaguuuauguauauaacaauauaguaucuuuuaguggugcugguagauagucaaagagcccugaaguuucugcaguuuucuauauauaacauaaucauuuucugagccaaguaacccucuuuagguacuucaaaagucuuugccaaaauacugaauuuugcuuggaguuaaaagaagauauuuuagcauguuaaauaaaauucuucuguagauuauuuauccaucuuccauauaguuaauaccuucauuuuggcuaaaugucuggaugaucuuaacaguacaguacccagcauaguaguaauaauguagucugaaaguaaaagaguaaauuauugugaggucuaacuucaaaguaaacagcacaaguuggcuguuuucccaaaggagaauauugugacugcugcugcuuuugaaucuaagaauagcguuagaucugguuggcccagagacaguuccauuuugcugcaagacagcuuugugauguagaaauuugccuugacuauuaacaaaauuuuuucuuuaaaaauaugcaaagaaggaaaaucucaguuuuagaauguaguguuauuuauccauguaguuauuauuucuuucauucauugaauaaggguuuauuucuucugugcauguugaauauauaguagagaggcuaucagagaaaacugggauauauaaauaugaauuuauauacauauaaaaacaugauacaugcuguauaaagcaaaauacuuuaaaaacauaauaagguaauaaucaguaagauggacugguaaugggaggcaucuuagagaaggaaaagucuuuaacugaguugugaaggaaaaguggagaauaaauuauccugggauuuuggucccaucuucuccugucucuguagagaugcuggucucuacuaguuuugucucuuucuuuucuauuuccaagcugucuuucuucaccuuguuacaugaccagauauacuccuuccauagaauaccuuuccuuuucuccuaaugacuucua

SEQ ID NO: 16910 - RNA, 973 nt, Homo sapiens
aaucugaagacacauucaucagucaugucccaggugacuaacaccacacaagaaggcaucuacuucauccucacggacaucccuggauuugaggccucccacaucuggaucuccauccccgucugcugucucuacaccaucuccaucaugggcaauaccaccauccucacugucauucgcacagagccaucuguccaccagcgcauguaucuguuucucuccaugcuggcccugacggaccugggucucacccucaccacccuacccacagucaugcagcuucucugguucaacguucguagaaucagcucugaggccuguuuugcucaguuuuucuuccuucauggauucuccuuuauggagucuucuguccuccuggcuauguccguugacugcuauguggccaucugcuguccccuccauuaugccuccauccucaccaaugaagucauugguagaacuggguuagccaucauuugcugcuguguucuggcgguucuucccucccuuuucuuacucaagcgacugccuuucugccacucccaccuucucucucgcuccuauugccuccaccaggauaugauccgccuggucugugcugacaucaggcucaacagcugguauggauuugcucuugccuugcucauuauuaucguggauccucugcucauugugaucuccuauacacuuauucugaaaaauaucuugggcacagccaccugggcugagcgacuccgugcccucaauaacugccugucccacauucuagcuguccugguccucuacauucccaugguugguguaucuaugacucaucgcuuugccaagcaugccucuccacugguccauguuaucauggccaauaucuaccugcuggcacccccggugaugaaccccaucauuuacaguguaaagaacaagcagauccaauggggaauguuaaauuuccuuucccucaaaaauaugcauucaa

SEQ ID NO: 16911 - RNA, 3331 nt, Homo sapiens
caggcuguggcggcucuccaacuccagcuucagcuuuuccagccucgagaucagcucagcugcaaagguggcggguuccacgggggucaucuccuugggcaggcgguggguucucuacaggacguggaaaggaaagggaggaggcacguucagcaggcuaggugggcgguggcuuggccggagcuucccgcaccaggcgcugugcaccgcaaacccauguucggguguagaguggauggcaaggcggccugggcugcucgggacuuuuaugcgcuagcgccauggccucauggagagccaugguccccaccagcguuugccuugggcaggagcaguuggucgcacuccgagaggcccugcuuguucuuucuguaguacaaccagcccaucaguaguuacuuugaaguagaaaaucuucaaagacuguugucaaccaucaaaaaaaaaaaaaaaaaaaaaaaaaaaaaaaaaaaaaaggcagcccucugagguggggaggggagagaccaacucaaggaauagaaaguagaaucuaaacagaaagagaguugaaaauuuaaaaaaauaagauuggaaaggaggugggaggaaagaaagugggggaaaagggagucaaacggccuggaucagagaagaagugguaauuuauuuccuggccgcacacugcgcaccuuugaggugguggugucucaacacuguccucgaucucccucguuuuucuccuucccuccucccucucucuuuguacagaaaaugaagaaagcugcugcaggcuaguagcagaacacugcugagcuuggcugccugaagcugaucuaucaagggaaaagggaacaucuccaaaucaagugcagaauauaaaaaggcaccgaguacgccugccaaaagcagcaaacagagagaaccccugcugcccagcuuucuguccuuuuccugucaucucgcuccccccacccaaccccccaccucuccaguuguucuaccuccuucuuccuaaucucccucuugcuuagcuccuuucuuugggcugggguggggguagcagaaagcuaacuugcaaaggcuagcaucucccccagcugaaaagaugggccuugccacggcaaccacuuagcugcagaaacuggggaagaagagaaaggcuccuguguagguggccauucucacacaggcuggcuccuugcagccccugaucaaagcgcugccugauggagaaagucgauuugcacaccccaggacaaaaucaucuaauuuacaagcuugggcgauagaacuuuucuuuguuaacucacauaucccccagucaaaaaaacaaugauaguaugucaucaauacuuguuaucuguagagggaggggaugcuagagguccucagaaaagcaauuuuaauaugcuaauuuuaaaacaagguaagucugcccuugucugugugaggagcuuucagagaagagcuauaguuugugcacuaaugcaacauggguuuagcaauucaauguguuaauuuuuuaaacacaacauaaccagaccaauuagauucucugaagcuggcaggaaggauucauaaacaccugcugugagcugggugcuuucuuccccuccccuccuugcaaccuggaucugaggcuguuguaaacagcacagcccuaaaaugggaauguagauggggaaguucucuugaguacagccaugugcuggcugcuuuagcaagcauggaaauaaaagcagaggucccagaagagcccuucauccaccaucucagucacaggaagaagcugcucaggagauccucacuucuaaacacuucguucauuccgcauuugauaggcacagacucaccagcagguaccaagccaaguucuggaguuggaaaggaacagcuacccuccagggcuucaggagccaggaggagaaauggucaaugaauacauaaauaaaugacuaaaaucacugacuaaaaugacuuggaguccugugguugacacaagaaguagaaugucccagugaagagagcaggaggaugucccaagggggggcagagguuccuuauucauucacucaaauguuuauugagcaccuauuaugugucagguacuguucuagucucugugcauacagagguuaacagaauagauaaaacucccucccaucagagggcuuccauucuaguggaaauacagugagcucaccaagcuguagagaagcauggaucaucuagcauuucuuaguuucugggaaauaagugcuucaguuucuuucugauagggaauuuuuuuuuugaauucagaaaaugcaaagguucaaaaauaggucaucaaaccucucacauaguugggaugcuuguccccuccaaaucucauguugaaauaugauccccaaugguggaagugcaccuagugggagguguuucgugcccucccugcaguaaugagcaaguuuucccuguaguucauaugagaucugguuguuugaaagaacauggcauugcccaccacccccccaaccucagcuugcuguuucucccgcuauguuacaaacuggcucuccuuccccuugcgcaucaugauugaaagcucccugagaccuucaccagaagcagauguuggcgccaugguucuugaauagccugcagauccaugaaccaaauaaaccucuuuucuuuguuuuuucuuuugagaaggagucucgcucugucgcccaggcuggagugcacuggcguuagcucacuacaaccuccaccucccagguucaagugauuccccugccucaggcucccaaguagcugggacuacaggcgcacgucaccacgcuaggcuaauuuuuguauuuuuaguagugguggggcuucaccauguuggccaggcugggucucgaacuccugaccucaggugaucugcccaccuccgacucccaaagugcugagauuacaggcaugagccacugugcccagccguaaaccucuucuuuuuauaaauuacucaaccucagguauuccuuuauagcaaaacugacugauaccucauaaucacaucacugugcucaccaucacaacccaaaaaaccauguaaugccuauuguccaguucuuuucucucccuuugcccuaggggaccuuagguacugcucuuuucuaccuucccuauaccucuccccauuccaccacccauuucuuuucuuuaggacucaacauggcagaaaacagcugucuccucacuccagacuguacucaccgggaaaugagguagagacacuuggccauuggccuucacacugcgaugcauuucucucuggagcuguuucuuacugcccacacgauaaggaggaauuccaucucua

SEQ ID NO: 16912 - RNA, 606 nt, Homo sapiens
aguguaacauauuucucagaucauccugaggaccuggacaggggagggagagggcugagagcaagggaugaguauggaaguugguggaguccagguuucaaauuggaacaucauggccacagccauuuaaaugugauccugguggccugcucagccuucugcaucuggaagcaggaugucaggcuggauggaaagugcugcuuuuacauccuguuccaagggcuuccuggaaagacagaagaaagaaaaagaaagcacaggcacuugagucccagcccgcuucucucccugcagcagugagucacccugggaaagagucaguagaacccacuagagcauccugaaacuugacuuguuuguuuugaccauggcaugagacuggaauauguccugggggcuggccugugggaaugggcacaauagcucuaccagucuccuugacacccuucgagaucgcaagcacuccacggacuccuggugccuuaguugagcaggauuuagugacucaaugcccagcacuggaagccugugggguguuaggcccugagcugggagcuggggauuugagcaugcugaggaucacuuucuuggggcgggggggcucag

SEQ ID NO: 16913 - RNA, 47491 nt, Homo sapiens
uauugaauuguuuacaaauguuuauuaaaugucaguaauuuuuacaaagcaaauauuaauagcaagaggcaaauguuuugcaaaauauguacaaaaguaaaaagcuguaaugaacuagcaacucauuuuauaaaaucaaaccauucuuuccacuuuuagaccuccuuuagaaauaauuuauugcccauccugaacuaaagcacugacaaaaaaauuuacaacaauuaucagauaaugugcuuaguuccuggaaaguuauaaaaagauauauguaaaaaaaaaauccuaagccacaaauauuuuauagagcuaauacgagucauguuuuguuagguacaguaucuacgggguuauuacaaaauauacuuuuuuauaaggcuucuugugguaaaugagcucucaccagaguagaguaguuuagaaaagccauuucaaacguuuugcgauucugccuucaaguaagagguaaaagguaaauggcauaguuuguugcacuguugcuuauacugugcaagaauuaaucucuaccccuuucuuuccuaguaccaucaaacaggcaugauuaaggacaauuucucacuuacuauggcaaaaaauauuauauacaagcuuucuuaacacaaaccaaagucacauaccaaguaguauaugacguucagugauauucacugacugaaauuuuaugcacacugaguuccagcauacucugauccaccuguaaacuuucaucaucaacagcagauuuguauaugucacaaaacucuccuuaucaagacauaaaauauugccauaucauucaugcuuucaaaacaauguucauauaagcucucgcauuugaaaccagaugguaagaccugaaugcuacaagagugaacauaacuuaaaugcuaacuacacguucaaguacagacauaagaaugcuagugguacaaacacuguacuccaaaugauguuguuaaucaccuaccagccuaagacuaguaucuacuugauggaacuugaaaaagccauaaaguccaacuuguuuaaaauguucagacuuagacuuacacuucaagaucuaguauacauuuauuaauaagcccuaaccucguaccauaaaaaaaugggcaugugcuguauuugggacaugcggacacacccacacccacccacaaucucuccccuccucauguuuacuagacugaaaagccacccuguauccuaucauuaaaaaacaaaacaaaacaaaacaaaacagugcuuuuagucaagcagcacaacacaaggacagaucaucugugauuaacagaagcgaacgccuuaaaaugaugggagagagacaaauuaacuagguacuaagucagauuuccaagugaaaaagacaugagcaaaacuucuggucuuaauuucucaaauaaaacuaaaauaaaugaaaugguaacagagugacuuucucuaaauuuauuagggaguuuguuacaaauguuugggcuuuacaggcaugauuucacggauucaaacaagaaauuaacacugauauuuagccuucucaugacauacacagaaauaacauugcuacaaacugcaauggagagaaucuuguuucaaauggcuuaguuugggguuuugucuaaauguaucauuauauaaugaaagcaccaauuugaggguuucucaaauagugauuugaauuuuaggacauaacaguguaacaugguaacuuuauucuucauauauaaauaaggcauaaucggauguguauuaaugcugaaaauacauuuuaucaaaagcauaaauacaaguauuuggguacacauugaaaguuaggacuuaaccaauuucuucuuacaaaaaaugauaaggacauaugguauuuguugaaucuaaaucagcacuucuaaucauuucugguauuaaggcgaucuuauuuccuucuacuuuaaaccaaccacugccaccaacugaauaaggauuucccuaaacagccucaauuugagagacuaaccagaggaccuucucuaugcaaauuacaugccaauacaccuuaaaagaaaauaagacaaaagugaaugaguuuuuucauuccauauugcuuucuuugguugcagagcaauccagugcccuuuccagauaauaaaauugaaaugaagauuucaauuuaauauuuggcagacagcaacaaugcagguuauuaaaaauauuaaaggggcagaggcaugcuuugaauuacucagauuuucagaaaacauuugacaaaacccuuucucuauaaaaguuauggucuaaauuuauguuguuuuauaaggcaacuguauauacauuucuucaaggucaaugaagacacuugugugauauuuccucagaauuaaaugagaaggcauucagauuuaagaacagaauguaacacaggauuaggcacauuuuauuccaaaucauaaccauaaagauuuagaaaaucaaauacaucaaagaacuuuaaaucuaaauuacuuuuuuagagacugggguaaguuugcauagugaaauuaugagcaccuuuucaauucuguucacuaaauuucaucucucucuucauauagugguauuucaaaaggauucaguuuucaugauacagguguaagacuccuuucaaacguuuuuaaaauacaacguauaaaaaaauguggacugaagccuuuagauugaacuuaaaguucuacugaaugucaaaacaagccuaaguugaauauaaguaauucauugccucaaaauauagucuagauuuuaaaagaauguugauucugagacauuacaugcagcagggaagaaaacugcaaaugcccaaaauaacaugauaucuauuugguguuucaacacuucuuggugguaauucaaaagggggaaacuuggugauuucugcuuugucaggcaauaucuaugguucguaucacagaucuuaacuaugacuuaaguaagaugaaguguccucuuucuauagggaucuaacuugagcccucacuggagucaaauguuuuggccauucaauuugcuaaauguauggguaaacucuccaaugaauaguccaaauguuacugugcacauauuccgauauucauuagcacugcaauuaugcuaauuuugugaauuuaaacaauguauucuuuuuggcaagaagcacuagauguagaacuauucaaacacgcaugaaugauaccaugauaccacgaacaugcacgauaccaugaacuugcaucacggugccgggcuacguauguguagcucauggauuaccauggcaugaaaaugcuagaaguuauauggauacaaugauaguggaaguucaaaugugagaaaagucagguaugucaagaacaaucccugguuaguucacugaaaagccccacucucguaucagacagcaagacagaacaacagccacugacuuggaaaggcugggugauccauaacgaccaaucuuucaaggaccaauaaaauaccugaguacacagucagcuauacaguaaaaugacagauaucacagucuuaaaauuuucaggaaaaguagaaaagcugucagacuuuucaagcugucgccagccuuggacuucuguuucucuaauuguagcacuacauacagccuagaagauaguauuucaguacugcaaaccagccauucugaugaguucacuaugaauguaucugcgaucacaaagcuacuucguggacacauuuuaauuugguaagcagucgggggaggucaauguaaucaucuuuaggugcgaacuaaaaaaauuacuacugauccuuagaagcauccuuaaaacauuuaaaauauaccucaaaaaagcuggacuuucaacaacaacaauuauacaaauguauacauacuguaucuguuagagacacaccaagaaugaacaggaaucucaaauaaugccuucuugaauagucuugacagaaaaauacugcccuuagcaaacuccaaauaaacaaaacgaugccacaaauggcacaguguggaguugaugggacuggacaggacagcaaaagauagauguuugugaugauacaacaaugauuuccuacaguaaggauuggucuuuacugaccaacugagauagggcuuaaaagucaaauacaugacauucuggaacagguuaaguuuauuuagaaaguucuguuaccaaguugcuugcaguuuuuaguugcugcuauggccagaauguuucacauaugguacauuaaacuacaugauaauuaaauaugagaaaggcaaauucuauuucacucguuacguuugaccaaaacacgguaaacagcauuagcuugccuuuugcucucccauaccaccugugaacucuucaucagcaucagaccaaagauccuuauguaaacuugaaaacaggaagaacauuaccuucagaaacacagaaaucuaaaagcaaaacagcuguuguguauacaagcaauuaaaauaugaaggcuaaaccuucuauaaaccuacagaaugccauuucuuagauagaacuucuaacagcccuuacaaaauaggaggucaccauaaaguuaggcaacaagugucacugcuauauguaaggcggacagaagauaucuuguuuuggaacugaauauuccuaaccucaucccuacaaguauuuaaggacaccuuugauacuuggcacugcaggagaauucaguuuggaaaguagaauaauuuaaagccugaaauaugccuagucugaggucagcugggagguuuuaacuggacuugaauagaagccauggugaaacagaucaaagccugcauuacagcaaaucuuggcgaugagucacucaacagcuuucagccacaaaccaaaggccgcagaaaaaguacuaagauuuucaagaaguuaaacguagaauuaagauuguucuaauucugguuguaaacugcuauuuuaaaaaacaaaacaaacagaaaacaucaaaaacacaaaaagauauuaaaacagcaagucuuuuguacaucacuguagcauaagcugcuugagguugucaugcagaauaguauccuucacgucacggaaaacaaggcggauguucuccguguugauagcaguggugaaguggugguauaagggcuucuguugcuggucccggcguuuguuccggaaacauuccaccaggaauuuuuggacgucucuuaagcaguggggauccccuucaaauucuaggaaauagucuuugaugcucacaauuugcaccuucuccucaagcaagucugucuuguuuaagaacagaauuauggagacauugcugaaaacccgguuauugacgauuguuucaaaaauguucagagacucuguaaggcgauuggucagucgaucuuccauaagcaccuggucaaauucacuugaggaaacaaggaaaaguauugaugucacacugucgaaacauucaaaccaacguuuccuuucugaucucugaccaccuacaucaaccauuuugaaaggaacauuuuuuauuucaaagucguauucauggaugccuuuggugggucuucuggcaagcagaauaucuuguugugauggaauauaauccuggaaaagaaaaaacuuguuuuauaccuauuaaucccgaaguaaugcgaauuuuuaauggacuacuaacuggacuagugaauagauaugcaaacaaaaugaucuuuuaagugacauuuucagauagauuaugcuuauuauaaaaugccaagacuggucagacauggugggucaugccuauaaucccagcacuuugggaggcugaggcaggaggaucgcuugcgaagccaggaguuugagaauauccugggcaauauagcaagacccacuugugcuccccacaacaaaagccaagauacauuaaaauguuagcaggacggguucaaaauuuacuacaaauggccagaaucuacuuguuuucaucccugcaauacuacucaaaauuuaagcugaagucuuaucaauuguucuuacccacccucacugcuauauauccaccugcaaucuuacuccccacuaucagccacucuugguucuagccagagugaucuuccugucugcguaucuaccuucuccacacugcuccuugcuccucuauuaaaagcaaugggggcugggcgcgauggcucacgcuuguaauuccagcacuuugggaggccgagacgggcagaucacgaggucaggagauugagaccauccuggcuaacacagugaaaccccaucucuacuaaaaauacaaaaaaauuagccaggugugguggcgggcgccuguagucccagcuacuugggaggcugaggcaggagaguggugugaacccaggagguggagcuugcagugagcugagaucaugccacugcacuccagccugggugacagagcaagacuuugucuuaaaaaaaaaaaaaaaaaaaaaaaaggcaaugggaucugauuccagugccaauucacaaggaucacuucccaguuccaaguucugcccaccucucucuaaccuauucuaaaaguucuuuuacugugcaaccccacucaugacuuaaaacuucuauguuuucauugcugcuauauuacaugugugaaaaauccuuucucuacuauaauuaauuucuuacuuauugacccaagaacucaaacuagucacuuacucugagugucagcaccucugucugugaaauggaggugaucacacuuggucuauauaccugggagggaggguuguugcaaggaucaaaugagcucuucucugcacucuuggucagugaacucuaagacccugaacaaacagaagcugcuggucacacaagucucuggcuacucugugauggcacacuuccuuaugcaauguaacugguucuuccuugucagucuagcauuuuuccaaaacuacaacacaacuuucugguaauacaugaacgggacagcuaauauuuaucaucaaggucaaaauauuuuaaaaaucaaggcaggauuuaaaacaaugcuguuauucacaaugcugcacuuuaugccuuucugaauagugucauaugauuuugaaauuucauuacaagaauacucauugucucaaaauggugcaauggaauuaagaauauauauauauacauauuuuuuugagauggagucuugcucuguugcccagauuggagugcaguggcggaaucucggcucacugcaaccugcgccucccagguucaagcgauucugcuccucagccucccgaauagcugggauuacaggugugcaccaccacggccggcuacuucuuuguauuucuaguaaagacgggguuucaccauuuuggccaggcuggucucgaacuccugaccucaagugauccucccgccucagccucccaaugugcucggauuauaggcgugagccacugcacccggccagaauucagaguuuuuuaaaaguagguggguucuuaguuacuggcaaccaacagccauucauuaaauaacucuaggacucaaguguuagcuuuuccauguuuucuucuagcuuuguucagauacacgccugcuuuauuuauaaucagcauaugcacacagcguucagccuaccucugcauuuuugcuuaauauuuugugaacuguuccauaugcugauacaaucauaccucauuuuaaaagacaagaaaauacaccaaaugcauuaacgugcuguacuuuacauuaacauuccccuacuaguggucauuaagguuguuuccaauuuuuagccauaauuaacagaaauacugcaauuaaaauucucaugcacauuuuuuuuuuccuuuggacuauuuccuaagauuaaaauaaucagggguacgauuaugacguuaaagguuacaaacauuuuaaugacucuggauacuuaacacccgacugcuuucuagaaggcaauaccaauuuacaacauacaccuaugccagcuccuucagaaacacgccgggcccugagcuuuuaaaaaauguaauuccauaaaaauaaaaaguucucuauuauugucuuugucucuauuaaagcuaauaaucuaguuagcaaucuaaaggcugcuucacaugaagcacagaacuucaugcaaucgagugcuaaauagucuggcagagcagaguauguugaugaggacacacacauacuagcugugugaagaagaagaaaccugccuuaugaggaggcaaaugaagcugugcuacauuuagagaguaacagaugacucuaaggcaauggcuuucaaaauuuuccuaagcagcagaaaccuuucucccacugaacucuucuguguacgcccaauacagaggucaaacaagcgagaugcucugccugcagugggccccgcuggccacagcgccagcuuagagcugcuggcuccgaggaauaccuacaggaaaaugauagacucucuuuucaagggcgacucccccuaccucguggagucucuucagccuuuuaaaucuagcccuccuacuccgugacucgacacaaagggggcaugaauucgaaaaugucauuugucaaaagauuuggaaaucagucaacccacuguguucuauuucuguuuacaaacaaaaaccucuaaagauacuaaaguauaacagauaaugcacaauaucaucuucaaacacaaacuucuuucucuaaacaguuuuacuuccaagaaauagcagacaaagcauuccucaagaaaaugguagagaccuggacaguuagagggagaaaaaagaagugucgugauuaaacaauaaaaauacuuucauuuugaaaaaauaaaaaucauucaauauucugagcuaccaaucacucuaaauaaagcagagaagaaucagaacgccaccacuaaaaaaaaaaaaaaaaaaaaaaaaaaaaaaaaaaaaaaaaaaaaaaagagagaaagaagcaaauagcuuaauacauaauuuuucuaaauuuccuaacaucgauauccugacuucugcuuucaaauggcacuaaacauaaacauuugguuuaaacacuuacugguucuccaaguuuauccaaguuauccaggaaauauuuuacagauucacccuaaaaacaagaagaaaacaaauaguuauuagggcuuagaaauggaagaucuuguuacaacaguuuacaucauacugucugguuguacacuuaacccaaacagacuuuguuuagucaccaauuucagacagcuaaccuuccuaaaaacauauaaaacgucugcucugucacagacugcuaaaucugcaaaggcaggcugauuucacaaaugcuuaauagaaucaauaucccaagugaucaucugcuuggacaggauuacacgcaugcuuuuugcuauaacuacguauccacagugaagacauauaauuagaagaugaaaacugcuuuugagauaaaacauaaaucuacauauaaaauuuaagugacagucuuuuugucuacauuuucuagcuuaauagugacgauaguuaucuucagagacaaaccaaaccagagaugagguaagaauacuguacaaaaucccccaaccacaggcauggacaggcgugccuugcucaggaaggcccuggauagugcugccagcuucacaucuccaacaggucuuuucccgaguggccuauccuuucugagcccaguuuucucgacgaaacuuccaagcaauuucaaacaucuaaacuguacgagaauacauuccuaacaugaaaacgcuugaccagagcacacagagaagaggggaacuauuuugggaaagaaggggucuguguccgagucuccuaguccucacccccugcguuucacuuucccgcgggauucuacagcugcagcauugucccugccugaagcuacuuccaaguguuccugaagcagcaccucauuuaguaugccugggcaucaugugaagaucuccucacacugcaggcuccgguuuaguaggucugggugggaccccaguuucugcaauucaaggagugccugggaccacacuuugagucacaaagcuugaaaguagcaguucuauaauuuuuuggucucaagaucacacaauaugauccagcaauggcacugcuagguauauacccaaaagaaaggaaaugaguauauggaggagagagauaucugcacccccacguuuacugcugcacucuucacaaaagccaagauuuggaagcagccuaaguguccaucaacagaugaauggguaaagaaaaugugauacacauacagaaugguguccuauuuagcuauaaaaaagaaugagauucagucauuugcaacaacauauauggaaguguaggucacuauguuaagugaaguaagacagacacaaaaagacaaacauugcaugcuaucacuuauugguaggagcuaaaaaucaaagcaauugaacccauggagauagaaagaaggaugguuaccaaaggcugggaagggcagcaaggguugggguggcaggagguggggacggcuaauagguacaaaagauaguuaaagugaaugaauauggaccaguauuugauagcacaacagggugacuauagucacuaauaauuuaaguguacauuuagaaauaaccaaaagaguauaauuggauuguuuguaacauaaaggauaaaugccugaagggagagauacccuaucuuccaugagugauuauuacgcauugcaugccucuaucaaaacagcucauguacgccagaaauauaugaaucuauuaugugcccacaaaaauuaaaaacagaaaaauuaaaaaaauaaaaacggaagacauggaaacaaaugaugaugucucuggacucaauaagcucaacagcuucugaucacuucuuuuuguguuuaguguccucauucaaauuuuauacaaagcucaguacgaggcaacugguauccucuccuccuaccuuccuaaagugucuggcagauaaaauaugaauuacugggaggaaguuacccuucaauauuuuuuucuuaacaauuucagaagugaucaaagucuucuuguuuucuaauauuaauguuaaggaacagaugugaauuucaguccuuucucuaacaaggagugaucuggccaagucucuaaacuccuccaggucuccauuucccccagaguuacaugaagaaguucagugguucaauggauaaccaaccgcuuaaguucugcccugugcaacaauuucaguuaguuccacugauuucaaguuaaguucuccuuuccucauaggccauguguuuguuaauccuaaaucugcuuuuguugugacucauucaagcgguguugcuuccacguucuuugcuaauaaauaaaggauuuaauguauugugcaagaauauuauggguuuaagacucacuuuuugcugguuguaacuugaggcucucauauuuuucccaguucauuuuauguuacugaagggaauuuuuuuuuuuuuugagacagggucucaaucuguugcccaggcuggggugcaauggcgcgaucuuggcucaauacaaccuccaccucccggguucaagccauucuccugccucagccucugggguagcugggauuacaggugugugccuccgcgccuggcuaauuuuuguauuuuuaguagagacaggguuuccccauguuggccaggcuggucuugaacuccugaccucaggugauccacccgucucggccucccaaagugcugggauuauaggugugagccaccaugaccggccuggaaauuuuaaaaauaaaauuucaaagaaauuucauuucacaguuaacacuuuaaaaacuuaagauuauuuuauucggcccuuagcucuuuuuucucuguucagaacacuacagguaaguuucuagguuacuguaguaaggcugaagaguaaaaguagcauggcacucugaaaaguguuccaauauuucuuuagccuuguggauauuucaguuccauuuaaauggcauagcagccaguguaccuggguuccagccccaagauagacuuuauuacugacaaagucaacaaacaauauuaggugagcuucagugacccuuugaguauuagaagucuaugagguuccacgaaccauauuucuuacgaguuuuacaaaauggugucuaagcugggaauggcuucaauguugcccccacuucacaacaauaauuuguuauaaacauccuuugcuuguaaagacaaaaugggucuggaguccuaagcuugaagguaacagaaaagcuaagaacaaaaguuagaaaauaauuucuauuaaauucauagucauacagagagaggcuuagcagcuuaucgacccaguuacugaacaagugacauuuguauucaaugcucucuucugcacagcuaaaauauuaaaaggaaaggauuuagaaugcacuucuuuaaaaggauauggaauuuaagcuggauagccaaagaacacacaagaagaacugaucugcuguuuuagaacauacucaaaaacaccaguggcuuuaugucaauaagaaaagggcaacucugcuuauagaaaauagguaaagaguagaguuuuuuaauucaaagucugauucaugccuuaagaauauaacauaagguuuauagagauggguaucaaauauagauuuucuaauaaaaagcaagguaaacauauucuagaaagcaauuuggcaauauguauuaagaucuuucaaaugauccucaacacaguaccacugaaaaaguauauacaacuacaacagugcuagugaauuacuauuauggcagaaggaagagcugguugagagcaaauggauugcuccuuauauuuaacuagauucuggaccaggggucuguccacaaacuauauagccugaaggccaaauccaacccaaugccuguuuuuguacggcucauuuuuaaaugguuggggaaaaaacuuaaaagacuauuucaugauauguaaaaaugauaugaaauucgaacuucaacauccauaaauaaaaaugcacuggaacacagccacgcucaccuguugguguaucgucuaugggaacuuccaggcuacaacagcagaggugaggaguggagacugaggcaguguguugcacucucaugacucugcaccacugcuuggugcaccacaaacugcagugacacaguuauaacuugaaaauauuccaagugucaccaguauugccacaccaugacauuaaaaaaaaaaaaaagggaguaaauacacauccauccaaauaaaaagaaggcccugaauaccacacuuuuaaggcacaguaggauguaaauaauuuugcuaucaaauuccaugguaaagcauuauuuauuaugcaaugacacuauagcuaugcuagaagaauacaauguaugccaacauuuacagacuaagcuuucuucaauccucccaacccacagaaaagcaacggucauaaaacaaaaacaaaacacaugcaaaauuuuaaaauggaauagcuuaucacugcagaauuucuucaccaaaacaaaaaaugaaaugagacugcaaccaaaguauuuucaaguuuucaaaguuuuuguuagacaagcaaggaaugccauuuaccaagugagugaguaacucauguuugauuguaacagcugaagaaauauggccagagaaaguaaccuuguuuaagacuauuagccuuucagugagagcagcugcucagaguugaggacacucggaacaaccaucaacugucaauuaagaaacauggcaaauuauuucagugguuuucccuggcucuugcugaguuuauuaccacaaugcucaguuguuguuuacuuagggaaucaaugccaaguuugaagugacugaagaaccagccuguaugaacaguccauguggaagagcuacgugugagaguauuuucagagaagcugagaaaacacuaaaugaguacagccuaaacuggaauaugcuaggcuguguuacaacugauggugguaaaaaugcguggaacagaaagggggucaaacaugcaaaaccuguguaaggguuacucacugcauuacucaugagcauguaccuugugggaaacacaugaaucuauugugcucaugaacgaguaaugucagugaugaauuuaacacgcuccugugaaccugaccaucagcaggucaugaguuucugucagaaacaaaaagugaaaauucugacacaguucgaugucuuagcagcgcuaaaguuuuacugacuuuuuucugagcacagggauggaacugauuucuuuuccugaacaagaacuacccuuaaccacuauuguugaacgcugaaugguuucggaaauuagccuuagggcagacuugauuugauuucugaaugaauucaaccuaaaauuacaaggcaaaacggcacuguuggugaaacuuacacucugguaaagucauuucgacagcuagcauaguuuuaaucaaaacaaugucaaacugcuuuauauacuuucuuugcugucaaaaguuaaaacaaaaagugagacuuccauucccauacaaauuuccaguggacauaauauuucuaaacucuaacuacaguuccaacagcaucuuucagaccccuauguaagugcaaaggaaauuuccauauuucaaaauccauuuaacuacgcaaaugaagagcuucuaccuaaccuucaagugguuaaucugcaauguaaugacaugcuaagaggcaaacacugagaagaaucuaacaggauucuguaaguaucucucaagcacugacuaugcucaauaaaaaucauaugcuauggcuggcacgguggcucacacuguaaucccagcacuuugggaggacgccaaagcgggaggauugcuugagcccaggaguuuaaaacccaccuaggcaacauacugagacucaucucuacaaaaaguuaaaaaauuagcugggugugguggcaugugccuguagucccaacuacuagggagggugagguaggaucaucaccugagcccggggguugaggcugcaaugagcugugaucauggcacugcacuccagccugggcgacagagcaagaccuucuccaaaaaauaaaaaaucauaugcucauuugguaguaucugugugaaaauauauuuucaaggaugaaauguguaaaaucucauuacagaucagaauggaggaauauuugcaacugacucugacaaaaaaaugcuaaaacauugaaucccaauaaacaaaauguuauuccaaaagaauccaauuuuuuucacauucguagccacaaaaacuugcacacaaguuuauauuuuuaaucucaucaauaaaacuuuuuauauaaauaccuacauaaugcccuugauuucuucccuuggcacgcagugccuaaaauauuauacuaucugacccuuuacacauuucuagaccaaugauacuuaauccugguaaucuaucagaauuaccuaaugugcuuauuaaaaauacagauucccaggucuccaaacaaauccacccaaucaaaaucuuagcaaguuccgagagaagugauucugauguagccagcccucgcauuacuucaaaucuggauauauauuuuacucaaaacuagauuucguauuaauuucaucuuuuaggaucaauuacacaaaaucuguuuuuaaagucuaaaaaugccaagauaagaaauuuaguuuaguuuuaucuuacuguacaagugggcuuguuuuuuguuuucuugagauagggucucaacucugguuauccaggcuggaguacaguggcacaauguagccacugucgaggcucacuguagccuugaccacccgggcucaggugauucucccacuucagccuccagcguaggugggauuacaggcacuugcuaccaugccuggcuaauuguuuguauuuuuaguagagaugggguuucacuauguugcccaggguggucucgaacuccuggacucaagcaacccacccacuucggccuccgggagugcugggauuacaagcaugagccacuacacccagcuguaaaaguggauuucaagcaguauuugcauucuucauaauucaccacgucucacaagaaacuaucaggccuucuuuugggauaucugaaucauaaacaauaaaauuaagucuauauauagcuuccucuuuuaaaaaaacuuauuugacaauucugacaagcuuuauuuccuacuguacuacaguucuagcugccuacuugucuauaccccuagagccuauuuucaaauguucaccauaguccacagcuuucaagcuaacucagauuuugugguuaaaaauuaauggaccugauacuccagauguaacauuacugaacgugcugagaagcgcggaugggaaaaguuaucguuaagugcuacuuauauuuuagcaauaggacucuaaggaacuugaaaccucaauuaaacuuacaaaauuaauuugcuucuauaauagacaccuaaacauugcaugauagguaaauaagcaauuaaaaaugcuuaauaggcagcacucccuggccagguucaguggcucaaugccuguaaucccagcacuuugggaggcuaaagagcaaggaucgccugagcccaggaguucgagacccagccuagaacacauagagagaucccaucucuacaaaaaaaaaaaaaaaaaaauuagccgggugugguggugcacgccuguggucccagcuauuugggaggcugaggugggaggaucacuugagccuaggaguucaagacugcagugagccacgacuaagcagcagcacucuccaucguuuuacgugguaaacagguaaaaaaacugcacuaugaugaaaacagcagauaagacacaacaaaaaaaauuauaaguaauguauaagguuuuaauuuucagaguuaaaaugagaggccuacucugccaaacauuacuaugauuuuauauauuaguuaaucaucacuaaaaacccaaaaacuauacaauuuucuauauuuuauacucccaaaauaagaccaaaucacuacucuccaccaaaauaaaaaaaaaaaaccauaagacaacacaaaaaucacauccaacccuuaaacaaaccucaaauccuucaaaucaagacuacacuaucccucugagucaggucagagucccaauaccaacauaauugacaaauacaauuuaucacuuuaucaucugauccccaaagggaaugaugaucuauaguuauaucaggaagccaugacuagaaaauacucuauggcuuagauguaagacuuuccauuaaaaacaaaaacaaaacaguacucauuuucacaaaucauaagccaaguuuauauaggcuguaaaauaaagccguuuccaaaguaaguauaauuaaagaaauaauuuuuugccaaaugaaucuuacacuaaagaaucacaaauucaucaaaaaauaugaagcagaggggguucauuaaaauacagaacuucuagaucauucaagaucuaauauaguaugaacccccuuuuaagaaaauugcauagaaaaugagauuacaaggaaacucaucaaaauguaacagugguuauaaagacauauacaugaaccuuuuccaagcacauucaauuuuuuguuuguuuguuuguuuguuuugagacggaguuucgcucuuguugcccaggcuggggugcaauggcaggauccuggcucaccacaaccuccgccucccagguucaagcgauucuucugccucagccuuccaaguagcugggauuacaagcaugagccaccaugaccaguuaauuuuguauuuuuaguggagacaggguuucucuauguuggucaggcuggucucgaacucccggccucaggugauccgcccaccuuggccucccaaaaugcugggauuacaggcgugagccaccgcgcccggccucuuuucccagcauauucuuaaggcucacuacuuucugaagcagaaggaaagaaaccauuuuaugaaaaucuaguuuacugacuuccuaauaauuuuucuacaauucugaucuuaacacuagcacuuuuguguccuuucucuugccucagaaauccaaagugcaccugucuuucucaaaucauccagauuuauuuauauaguaaagccaaauucccaccucacaccccucccccgccuuuuuuuuuuuuuuaaagagauagguuuucacuauguuucccaggcuggucucaaauuccuaggcucaagcaguccuccugccucagccuuccaaguagcugggauuacaggcguaccaccacaagcagccacugggggcccuuuaaaaaucuaagaaaaccuuuugcuuaaauuuccauagugguuuuaucagcaccuccuauggcaugagucauuuucuaccucauaugcaaucaucuguguacuuguuuuauuuccuuuucuacaauguauuguuccuggggacaguuuuugccuucuuagucacuguaucccucuaaauauuugcauauaguguuaaauaauauauauguuugaaaaaagugaguaucacagaauuggacucucuuugaaacuaggaacacugacaugcuaauuucuccuuuacaacaaaaggcuuuccuaagaaugaugggagaggccaaaacaaaaccaaauauucaaaacuucuaucaguuaagaaaacaaggcugggcgugguggcucaugccuguaaucccagcacuuugagaggucaaggugggcagauuacuugaggccaggaguuuaagaccagucuggccaacauggugaaaucccaucuacuaaaaguacaaacauuaggcugggcacgguggcucacgccuguaaucccaguacucugggaggccgaggugggcggaucacgaggucaggagaucgagcucacggugaaaccccgucucuacuaaaaauacaaaaaaucagccgggcgcgguggcgggugccuguagucccagcuacucgggaggcugaagcaggagaauggcgugaacccgggaggcggagcuugcagugagcugagaucgcgucacugcacuccagccugggugacagagcgagacuccgucucaaaaaacaaaacaaaacaaaaguacaaacauuaggcgggcauagugaugggcuccuguagucucagcuacuugggagggagguugaggcaggagaacugcuugaauccgggaggcagagguugcagugaguugagaucacgccacugcacuccaaccugagcgacagagugaggcugucuccaaaaaaaaaaaaaaaaaaaauaccaccuaccauauaaggaagaaaguggaaaaaaaaaacccacuucacaggugauucuuaagguugcucaucaucuacuugcaagaaccacuguaauuauaauuuuccuaaaugguagcaguugccucuuguaauuagcucacugguacuuagggcauuucaugaaauacuugagccuaagaagacuguuucaugugucaugagagguaugacugcagaucacuugucuuggccucaacacuaggaugauagcgccacaaccuuaagcaacuuucaggucaccaagaaagaugaaagucaaggaauacagaucaaacuaucucuaauuccugccucccuacuuuacucuucagcuccacaccaccuucuucuuccaaucugcagccuccacuucccccaccuacacaccuuccagagagcuacagccucuacaugcagucucuagaaucuagccuuccccaaguaggugacaguuuccuuaaagaggaauacuauggauuuuguuucuuaaaaaggagguagaaacaaaaagaaaaagaaaaagaaaaaaaaaggaggcagaguuacugauauaauacugagaaguucaccugaaugagaaacauaaggauguugggaaaaacuuggugaacacugaaggaucaaggauacuguucaguugugcugcugagucaaaaaguauuuaccaagaacuaccuaaaacaggagaaauauaauaguaucugauaaaaugcugaauuagcuaugcaguuagcaugucucguguuugaagucuccagcuagucccaacugacuaucuccaacauuaucuccuacuuuucccuaugaaacaagcuccaugcucaucuccccaugcuucuggaaaauucugugcauauuccuaccuccucugccuaacaccauuucccccacacgccucugcuuccaccucuccuucugggguucuuacuauuauacagggagcaaagauaaauuuuaaguuggaagacagcuuggagaacaaguaaccuuaugcuccauuuuacagaugagaagccuaagggucagggaaguuagguggcuuagccaacaaaacuguuucaguggcagaaccaagaauuuaauguauccugauucuuauuuuuccccuaccuccacugcaacuucccaacucucgguaaucauacucuucacucaauaucuuuugcacuuacgguuuauaccacucauggcacuucuuuauuuuuauauguaguccuacaugucaaauuuagacucaaaaucucuuugcuacaccucccuguauccuaggauagcaauuuuacccuguacagagcaauagcuacauaaacaucuguugaauuuuuuguauuauaacuuccccuuuaugacauccuguuuccaucuuauuauuucuacaaaugucagaguugucacaagcauaauacauugaacgggaagguuuuuuuuuuuaaaggcaacuuucugccacuaaauuccacuuguuuauaaauguaaaugcuaaagacagaaaagagaucaacucaaauguacauggcaaagaucuucaguggcauaaagugcgugacucuuuucaguaagucugaaugcuuugaagagcacuguaggcagugguacgggaagaugcuaagacaaaaugggaagcuccuacuccauguaaguaaccacucaguguuaacaucaaucaaaaagacaucccauaaaagugauaaaguauccugguaguucgaagagaauaauauaaagauagaauuuggaaggagcaaagaugaugacaaaucuuccuaacugcuuuuucucugagcagauuuagaaacuuucagaauauuuauaauccugaaguuucagcagauccaaauucaaaguaaugaccaagcagggcuauuaacuacuccaagacuagaucuccagaugcuggugaagaaucacagaucaugcagaauuugaaagguuuguuuuugucauagauaguauauguucuaaugauuaauaccggaaaucugacaaaggucaaauucugauaaugagaauguuagguaauaauaugcaucacacauguaauuaacuucauuuuacuggauuuuauagacuauaaugaaggucagaagacuaucacacucaaguaggcuauucaaaaguuuguuugcuacuaaaauaaaacaucacugcuuaaucuuguaaaauguccagaauuuaauugcaggccaauuaagaauguacguaaauggcagaaauuucacuuugaaaaaaacaagccaacuauaaaggacaaaauaaagugaauuaaaaaguuuccaauuuugguugggcauggcugcucaugcuuguaaucucagcacuuugggaggccaagaucagaggacuuuuugagcccaggaguucaagaccagccugggcaacauagcaagaccccaucucaauuuuuuaaaaaaguacccaauuuuuauguguugagaucucuuuaguuaugaggcuaacaucaccugcaagugucuuuuaaaaguaaacaacucaaaaaauauugaaaguaaaagaaaaucuauauuaccaagauaauuaaguagaguuucuucugaaaccuaaguauacaugugauuccaaaaaugaaaguauaauucaaaguuaauauccaguuuuucuuuauagagaaccaaccaagugcuauaaagagcagaacaucuuaauuacuagcauacacagccuacuacauaccucggcuauauggcauggccuauugcuucuaggcuacaaagcuguacagcacguuacuguacugaauaggguaggcagcuguaauacaaugguaaguauucguguaucuaaacauaggaaagguacaguaaagauauacuacaaaagauuuuaaaaaugcuacaccuguauagggcagcucccuuaucaucuuacagggccgccauuuuauaugcagucaguccuugaccaaaacaucuuccuggcacacgacuguaaaugucuguguucuaaaauagcuaagcccaaugguuuaaaugguuuacacacuucccaugcauauauaaguccuuuguugugcaaguuuggaacauuucaaagaggaaaaagaaucaagugauaucagagaaaacuggaaaucuaaguuuauucauacuuaaucacaacugugaguuacuuuuauuaucguaagguuuuuauauaccuauaauauacuuuuaauuuccaucaguguuauaaucccaaaacaaauccaggucaaaauguuuucuaaauauuuauuaggcaggacucauuaagcauaugcuuggggaaagcuauucaauagcaaacuuauuaacuugcuuuuaaaagagaccuaagaguugggcaugguggugcaugccucuaauuccagcuacucaggaggcugaggugagguaggggguacuauugagcccaggaguucuacaccaacccggacaacauagagagagagagagagagagagagagagaaagagagagagagagagagagagagaguguguguguguguguguguguguguguguguguguauaaaagagaccuagauauaggcuuuuaucaauaauucgcauauguauacacuaauaauuucaguccuggaaacaucuugauaaagucauauauaaauaaggagcuguucauuguaacaguaggcuuauaaugaagucuauucagaagccauuccaucuagcauguacuuacauaaaguuuucagcaacaauuaaaugccaaacauaaauagauacaaaauggaaaacucugggguuaaggcugguuaaucaaccaagacuuuucgauucaacccgaggauauggcuaguaaaaagacagaagguaauauuuauuaguacuuacacucaauuucccacccuaucuguccuuucucucucgucucuccacauauuaacauaaaaauaugaaauauaccaugagauuguucugcccacacuaucugaaaucuauuacaugcaauuccuuaaagacaguaaauacaaaaccaggccugauuacauuuuaaguuuauucacagcuuugaaaaugauuuuaaaguuaaaaaaucuuggaaccauccuauuucaaacauuugaaauauacuaccucuuauccuaggucuuucucccuuuaauuuuuauuucaaauuaagugugauaaagaaugacuugagaaggucuucccaguccaaaggcuggcuuuacauacagcauacaaaacucuccuccugguucucagagcuuaccauggaccaguuucacuucuuuuauuuaaugccuuuccaacauuuucauuuugcuugguugucacacgggaccuauucuauuggucuuuaucuuugauauugccuuuucugccccauggcuuucucuaugacuucauuuuucucuggaaaaaaaacacaguauuaggcugggugcggcggcucaugucuguaaucccagcacuuugggaggcugagauggguggaucaccugaggucaggaguucuacacuagcccggccaacuuggugaaaccccgucucuacucaaaaugcaaaaauuagccgggcgugguggcuggcaccuguaaucccagcuacucaggaggcugaggcaggagaauugcuugaaaccaggaggcagagguugcagugagccaagaucgugccacuguacucuagccugggcaacagagcgagacuccauuuaaaaaaaaaaaaaaaucacaguacuugaugugauguauaggauauguuuucaaugaggguaauacugucauuguuaucauuagagcauaguuaggcuggacacacuggcugacaccuguaaucccaaugcuuugggaggccaaggugggaggaucguuugagcccaggaguucgagaccagccugggcaacaaagcaagaccccaucucuaaaaaaaaaagaagaaaucagcugggugugggugugugguagaccuguaguccagcuacuaggaggcugaagcagaaggauugccugagcccagaugugcaaggccauagugagcuaugauugcaccacugcacuccagccugggugacaaaaugagacccugccuuuaaaaaaaauaauuaaaaaaaaaaaauuaaaaaaauuacagcauacucaaaguaccaccagucaugccuuucuguuuaguucaggaggaguaaaauguucaguucaugaggaacaaaacuuauagccgacaagccauuuuccuuugcuguguagauacauaaaaauuaagcagacuccaagugaauacacaguuccaaauuucuugccagcaauuucuauguacaucaguuaaaauuuucaaaagaggccgggcuugguggcucacaccugugaucccaacacuuugggaggccgaggugggcggaucacaaggucaggaguuugagaccagccuggccaauauggugaaacccugucucuacuaaaaauacaaaaauuagcugggugugguagugggcgccuguagucccagcuacucgagaggcugaggcaggagaaucacuugaacucaggaggcggagguugcagugagccaagaucacccugcuacacuccagccugggcaacagagcaggacuccgucucaaaaaaaaaaaaaaaaaaaaaaaaaauccaaaagaaccaaaauuagucaguuacaucauaaaccauuucaauauuugaaaauuucuuuuucaaacuaaguaucuuuccagaccaauguaagacagucuauaauagcauaaguagaauacuaccuuuaucucacuuagauaaguuauuucaauguuuucuagcauauaagcuacaaaaauaaacuacugcacaugaaauaagagcuuuuuuggaaagaacuuauuacauuauucuagaaauugccuuuuucuuguugcugcucacaaauuaauaaauuccucuuuauaucaaguuuuuguguuggccuuaucaccaaaauaauuuaaggcuaauaauuuuuuuuuuuuuuugagaugaagucuuuuccugccucagccucccgaguagcugggacuacagacacccgccaccacgcccagcuaauuuuuuguauuuuuaguagagacgggguuucacccuguuagccaggauggucucgaucuccugaccuugugauccaccugccucggccucccaaagugcugggauuaaaggugugagccaccgugccuggcccaaggcuaauaaucuuaaugauccaaguguucuaggaguauuuccguaguccuaucaaauguuaacacaaaauguacaacgcaguuuaguaauucuccuacuacagaagucacaaaaaaaggaccuuacuaaaaugcuucaucguggagaaacagagaaaaaaguuuuagccauauguuuaguauuuauuuuauuuuauuuuuuugagauggaguuuugcucuuguugcccaggcuggagugcaauggcacgaucucagcucacugaaaccuccgccucccugguucaagcgauucuccugccucagccuccugagcaccugggauuacaggcauguaacaccacgccuggcuaauuuuguauuuuuaguagagauggaguuucuccauguuugucaggcuggucuugaacgcccgaccucaggugauccacccgccuuggccucccaaaguguugggauuacaggcaugagccacgguacuuaacaaaauuaaguacaaauuuuaaaugugagaaaggaguuuaauacugcagagaugggucagcucugacaucauauauauugcugaucagguagcaacaugguaauauuuaccccauauuuguuccauguuaccauuuagcaccacuaucuucuguuggcuaaaaaaauacauauauagcgggaagaauuuuccauuuaaauaaaaaauacacaucuauuucuaaaaaaugccuugcugcuccucugagaaaaucaccuccuccaggaaaugcucaugaugcaacauuaaaugaacaggauauaaaguuguacagaaaguacaaacaagcuuaucucaacauccaauaucguauucaaauacuggaaggaaauacaccaaaaugucagcagagauguccugaggugguaggauaguggcuaacuggaugauauuuuacaaugaaccauguauguuuuaaaauuuuaaacuuaaaaaaaacaagcuaauuaagguucuggagccuguaagucaugaacagacaaaccacuuuccuacucuucaguuuucacauaaugauaacaacagaaagcuuaagaauucugagccuugaaaaaucccucaagguuaaaauacuuuuuugaaaagggccaaucauauauaaucccaucagcauaucaagaaauauuuagcuuugucagaacuagaacccuucguuguuaauuuuuuuuuuuuuuggauucccaaaaagcaacgacuucaauuguuaaaaagaaaaaaaguauaugcuguuuuccaacgcaggacauacuucccaaauacaguuucaauuccuccacuaucuaaagagaggcgccuauuagagcgcuucauaauaccccgaaguccucgugaacgcacuccagguggaaaauucugcugugaugaugugcuaaaaaauacccuauaacucaaauauuacacaauaaucaacacuaauuaauaagguaauucuacgccuaugaucacaaaacaggugaaaggaaaacccagaugacuuuauucccaguuuagagcucaaucauuaucccaaccaaacucucuccagaagaaaauuuccacacagccuauaaggagcacuaaauacuuucccauccuucacagucaggcagcaaagcaagccaaccuguaaauauuuucaaaagcugaugaaugugaaaauuagcucaaaauguaugcuggcacaucagcuccuguuuccaagucccgauuuggucaauuuuguuacuaaggaagcaauaaagcaaggcagcugaguaucagccucgggcuuuggaauccuacaacccggagucugaaucuuggcucuaucacuaaaacuagcugggccaggcacgguggcucacgccuguaaucccagcacuuugggagaccaaggugggugaauugcuugaggccaggaguuugagaucagccuggccaacauggcaaaacccugucucuauuaaaacuacaaaaauuagguggguguuguggugcgugccuguagucccagcuacucaggaaggugaggcauaagaaucgcuugaaucugcaagacagagguuggagugagccuacaucgugccacugcacuccagccugggugaaagagugagacuaugucccaaauaaauaaauauauaaauaaauaaaacuagcugugaccuuagccucuauguguccuucaccucuguggccauaugcuuuacuuacaaaaugaccagaacucgacuacaugcucucucaggucauuucuagguuaauaaagagugauucugcacacucuuggcagaacagcugcuagugcaguaaaugaucgcacugaucauuucauuugcuccccacuagauugggagcccccauuaaggcagccagacaggcaguucacuuggguugcuagggccuagucugggccaagaacauacuaggggcagguauucaguacauguuugcugaagaaugaaugagugcaauguauauaacugaucagguuauuaccccaacuaaauuggaaaugaucauaaguaaaauaaucaagaauaaagugaaaaacucuucuguauuugccugacccagcagauuaacaaucuuaugaacuaauauuuaauacuucugagacugaaauucaaauaaauugguuaauauaaauaaaauguccucucaaacuuuaaaaaggucagaaaaaccacaacuuacuaagccagaggguugaaaguacuguaaaagggaaaagagaacagugagcuugacuucaacugaaucuucuccacuuccucgccucucucuccucuuaagcccuucuaggcuggccucucccucaccagggcaccugcugccauagucagcauauccaacuuuccugugccaacaucgauucuuccuagaauucuuccuagaccucucaauggcacaggacaccacugaccacuuuuuucuucuugaaacacuuuccuggcuuccaugacgugacaugugccuacauuucuccuaccuuucuggccacuucugcuaggaucuccuccucugaacauucucaaaagauguagagauuucucaagacucuacugucagacugagcacaguggcucacaccugcaaucccaacacauugggaggccgagagaggcagacugcuugagcccaggaguucgagaccagccuaggcaacauggagagagacccagccucuacaaaaauggaaaaaaaaaaaaaaaaaaaaaagacaaaaagacucuaccgugagccuucaucucuucuuuuuacacccuuuccccgaguaaucauaucagaaaaauuauacucaguaauuauuucacagacauuaaauaucuccuagauacaaacaccuccucaauuucuaucucuagccccaaacuguucuggauucaagacucauguaucaagcugucaaccugguaucuccacccauacaucucacagagaucucaaccuaguacuuaagcucguugacuuccaacaggguuaugccucaacaaacccaucacuuaagaugaaaauaucguuaagucaaaaacacauuuauggccgggugcaguggcucaugccuguaaucccagcacuuugggaggccgaggcagacagaucacaaggucaggaguucgagaccagccuggccaauaugaugaaacccugucucuacuaaaaauacaaaaauucaccgggccugguggcacgugccuguaaucucagcuacuugggaagcugagguaggagaaucgcuugaagcucggaggcggagguugcagugagccaagauugcaccacugcacucuagccugggcaacagagcaagacaccaucucaaaaaaaaaaaaaaaccauuuauuuuuagagacagggucuugcuuugucacucaggcuugaguacaguggcauaaucacggcucacugcagccucaaccuccugggcucaagggaugcucccaccucagcucugaguagcugggaccacaggcauacaccaucguacccaacuauuuuucuguauuuuuaguagagacgggguugcgggggggcguuucucaccauguuggcgaggcuggucucgagcucuugaguucaagcaauccgcccaccuuggccucccaauguguugggauuacaggcgugagccaccgugccccgcccaaaaauacauuuaauacaucuaacccaccaagcaucacagcuuagccuagccucccuuaaacaugcuuggaacacuuacaucaguugauaguugggcaaaaucaucuagcacaaagcuuauuuuauaauaaaguguugaauaucucacaacguuuacugaauaccauacugaaagugaaaaacauaacggcuauauggguaccugaaguacaguuucuacuaaauguguauugcauuuacaccaccauaaaguaaaaaaaucguuaagucaaaccacaguaaaccagggacugucuguaugcccaaacuaaacucuuaaucaucccccucaaauaucauucucccaugauccugugauuugaguaaauagcaccaauauccaccuaguugauaaagccagaaacuugagucacucuuaauauaugccuuucuucccuaccccacauccaaucuagcagaucccaaugauuuucccuacaaaguauauccugaauccauuuucuucucuuaucucuacagccaccaacugacgacaagcugcuugcucugcaauagucuccaaacucuggaacugguuaggacgaagaacaguaucuggugcaaaggcucucccucacuccccucuaacuuccacacagcagccugagugaucuugcuuaaaauccuuugguggcuucccaaggcagucagagaaaccccaaacuucucaacaugggcuacaaggccuggcagucacaggcugcugccugccucuuccaccucaguucucccucacucacuccuccacccuggccuggaucacguuuucugaccagcaguaaguuuuuuuccaacuuugcacauggugcucauucugccuggagcauucuucccccuccuuuccuggaggacuuucucauccaugggaucugaaccuaaauguugccuccucagaccauccucuuggucucucauuguuucucuuccuucgcagcauuuaccacauguguaauuacauauuuguuugcauauuucauguagauuacucugacuagcaucuaacgucaacgcagagauuacuuucacuugguucacuagcaaacaccuaacccacaaaaagguaacugacucauuaauagguguucaguaacacgugacugcauggcugcugaaagcuaccagugaacuguuaccagaccuguuucagaauaacacauuuccuguaauccacuaccuagggcuuucuugucuccucaucacuuuuugcauucgcuaguuacuuuucauauagaauaaaauauaauuacauauacaaauaucacaugaacauauucuuaccagaaaaaguauuucuauagaaugaagcuuuuuaauaaaauacuuuuucaaaaaaaaaagacacaguaaggccaacugugcaaaauacuguacaacaaggggaaccuugguucucuuacuaaacuauuaaacaaaacaccaacuuuaaaauugguugcaacauuuaaucauaacauaccauaauuggaaaaguccagaaaaaauggaagcaaguauaauucuccuuguucuagucuagaguugaaauguauauuaucuuuauggcaacaguuuaaagucccuaccauguuugaagcuguggcaaauaguuuaacaguaaauguggcaagcugguaacaguuaaaaauagcaaaucauuuguauuauaauauuuuuaacugaauuggauaaaucacauuuucuuuuuaaaauuugcaauuaggauaaaugguauuugcaacuuugugaacauacaguauuauuuagguuuuguuuuuuuugagacggagucuugcucugucaccaggcuggagugccguggcaugaccuuggcucaccgcaaccuccaacucccugguucaagccucagccucccaaguagcugggauuacaggugcccgccaccacgcccagcuaauuuuuguauuuuuaguagagacggguuucaccaucuucgccaggauggucucgcuuuccugaccuugugaucugccugccuuggacucccaaagugcugggauuacagccaugagccacucugcccagccaauaauuuagguuuuuaaaaacccguuaguugaauagcaacuuuaucugucuaaaguauacccccguacauucucucauguguuaggcuuacuguagcaguuggccaggcaauaacuugugagcaacucucuagcaacauggaaauucugggacagcugcucauugcuaguagcuuccauaaauguuucuuuuauuuaauaucaaugaaaagauacaaccacauuucacaucaugaugcuuaaauaaaaaucacaugaugauauaucugauuuucuauauaacuucugagccaauucauccuauuuagcagaaaaauaauuuuuuaaaaagagacuaagaaaacaguaaccaagauguugaaaaggaaagugaaagucucuugccccaauuauucauuauuccagcucuuuuucuuuaaccuuuccaaaagaguuuaaagagaaaagaaauggccuauuuacaagcuaaauauagcugccuuggcucaaagaacccaaugacauuguuuuauguuuuuuggggagagugaggugguauagaagaguuuuguuuuuaaaugcuaaaaucaauacuuucuucuuugaggggagcaaauuugaaauuugcuaauuuugcuccaugagaaaaaguagauauucucuagacuuuuuaguugguuuuuauacaaaauagucagaaguuuuaagaucucacaaaaaacauggaaucuaaaaaaaaaaauauauauguauuuugugaacauaugaauuuuuuuaccuuggaaaugaagcucuaacacccucuuuaacuaaguacucucaacgccucugcuaagucacagggcagagaaaugacagaaagggaaagaguacgucugugugugcacguggaagggguguggggagcaccucagagacaaaggugaaggaagaggggaugaaagcagcacauucagugggaguggugagcacucugcaccugagccagagguuaucuccccaugccuccagcaggaagauaaaugacuugucucacucugguacaucugaggcauuucaggaacacauucuccaaacaaucaaauaauucuggcuacaaaugucaucgugaugagaaggaucaauacugguuaguuucaccaaccaucuauauaacacucuauuauuuucaaaugacauuugauucuuuagaguuguaaguuuuuacauuuacaaagacacacaaggacuagccauaaaaauauagacccauuguuuguaaaauguuuucacuuguuuaaaaagguacugugaaaaaaugaagaaccagccagccgcgguggcucacaccuguaauccccgcacuuagggaggucaaggcaggugggucaccugaggucaggaguucaaggccagccugaccaaaauggagaaaccuugucucuacuaaaaauacaaaauuagccaggugugguggcacaugcauguaaucccagcuacucgggagccugaggcaggagaauugcuugaacccgggaggcagagguugccaugagcugagaucagccauugcacuccagccuggguaacaagagugaaacuccgucucaaaaaaaaaaaaaaaaagaagaaccacaucauaaguuuuugaucuaaaaaucaagcaaagcgguaucacuaggcaacaagaacgaauguaacacgguggcugggcacgguggcucaagccuauaaucccaacacuuugggaggcugaggugggcagaucaauugaggucagaaguuucagaccagcauggccaacacggugaaaccccaucucuaccaaaaauacaaaaauuagccgggcaugguggugcgggccuguagucccagcuacuugggaggccaaggaaggagaaucacuugaacccgggagagggaggcugcagugagccaagaccgcgccacugcacuccagccugggcaacagagcgagacuccaucucaaaaaaaaagaacuaauguaacaaggaaaacuucaaaucucucuucaacaugugguccuagagacaacauacagucuaauaagaaaacacaaguaauauauucuacauuauucagaauuuuuuauguugguaaugagguuuagagaguaaaucaaaucaaaguuuauacugcuuuauuuuucuaugcagcuacuuaggugcauaaagcccauuaggaauauuaauaacuaauauuaauaauaugguuaauacaagucagguacuguggggcuuuacauggguuaucucauguccucgucacaauaguaacaguaggucccuaauaauagaucauucucauuuuacaguugcagaacuagaaauucagaggccgaaggacuugccugagcucacacagcgaguggcagccggaagacgaacucuggcugcugccuuacuccacuuuaucccacagcauggcacaaaaccaaauccaaucuuaaggccaucacaugaaaccaaauguaaaaauguuuugcaauauauacaaucauuaaguuugaacauguuuauuaauuuuuuuuuuuuuugagacaaggucuugcucugucucccaggcuggagugcaguggugcaaucucaggucacugcaacucugccucccagggucaagcaguccucuuguuucagacccccgaguagcugggaccacaggugugcgccaccaugcucaacuaauuuuugcguauucuguagaggcaggcuuuuagcauguugcccaggcuggucucaaacuccuggacucaagcaaucugcucaccucagccuuccaaagugcugagguuacaggugugagccacugcgcuuggacugaaugugguuuauuuuaauuuguauggaagauaaaagcuuuuaaaaagucacagauagcacaaccaagcacacagauuuuacuauuuagauuaaaaaacaaaaauaucuguaggccaggacugauaaaaaaugaaaacaagaacaaaaaaaacaaacaucaacgaagaguuccacuaaaguauucuggaucuacugcagaguagauggggaugaaaaaguuuacccaccgcauggauuuaaaaauccuuucgaggcugggcacaguggucacgccugaaaucccagcacugcaggaggccaagaugggagaaucauuugaggccaagaguucaaggccacccuggucaacacagugagaccucauuucugaaaauaacaaaaaaacuagccgggugugguaguaugagccaguaaucucagcuacucgggagauugaggugggaagguugcuugagcuggggaggucaaggcuacauacaguaagccaugacugugccacugcacauuggccucgggaacagagcaagacccugucucaaaaaguaaaaaaaagaaaaaauacuuucaguucauuuugccaaaggaagagugauuauauuuggaagauuaagauaaauagcuaccaucaacgcaacagauugguacuuuggccaagugcacuaaaguucaguucucaaaacaaaacuauuuucuugauucauaucagcucauucuaauacugcucugcuaauguggcuauaacaaguucuuuugaauaaaaggcaucuuguaaacaagauagguucacaauauagacaaaggugaauaguauauagcuagggaaaaacgaaauacuuucaagcagggaaauaaaaaucacuucucauuuccagaaauacacacuuaaaaaaaauuaggucacuuuuaacuggaaaaaaauuugugacaagccaggcacggugguggcucacgccuguagucccagcacuuugggaggccaaggugggagaauuaaucgaacccaggaauucaagaccagccugggcaacccagcaaaaaccccaucucuuaaaaaaaaggaaaaaaaaaaaagaaaaaacuuugugagaaauugcaaucucgagugcucacaggcaguaugaaaacugugacaugauuacaugagaagcauuucaaaggaguucauaaaaaguuaacaauaggccgggcucacgccuguaaucccaacauuuugggaggcuaaggcggacagaucacuugaggucaagaguucaagacgagcccggccaacauggugaaacccugucucuacuaaaaauacaaaaauuagccaggcaugguggcccauaccuguaaucccagguacucgggaggcugaggcaggagaacuggcugagccugggagguggagguuucagugagccaagaucacgccacugcacucuagcgugggcaacaaagugagacuccaucucaaaaaaaaaaaaaaaaagaaaagaaaagaaaaaguguucugguguccccuucucuaaaacaaaagcaaaucugaccaauuacauagaagacaggcacuaaagauggcacuguccuagaaaaauguuggcaaucucuuucagcuaacugguugccauuaaacuucuauuuuucagaauacauuaaaaacuguguucagccaggcauggcggcucacaccugucaucccagcacuuugggaggcuaagacaugcagauuaccugaggucaggaguucgagaccagccuggccaacauggugaaaccccaucucuacuaaaaauacaaaaauuagcuggguauggcggugcacgcuuguagucccaauaacuugggaggcugggucagggcuugaaccugggaaguggaagaugcaaugagcugggaucaggcacuccagccugggcaacagaucaagacucugucucaaaaaaaaaaaaaaaaaaaaaccaaacuguuuccacugaugaaacaucaguugagaaucacuauuacaguuaguuuucaaggagguaaagauucaaacugaaccuuuaccaagcugaauagugauuaggauaaaauguaccauucacaguuaguaaauuuacuauuaaacauugcuuaagaucacuuauaucguuacuauaauaaagaaagaagaaaugguacaaggauauuaggaaaguucaggauauaaaaauaacuacgugacuaucaguguaacaccaaacauucuuaaauaaaaccuuacaugcacuuaaaauaaugugcuaaaacuuaauaggggaguguuaauuauuuguauguaugggugguggucagaagaaguugggaaugaaagacaagaagaaugcuccacagaugccauguuugagugcuaguaaaaugguuugguggccagagcuguggacuaggagucagcagauugggacugcggugucuauucuauuauuauuuacuaggucugugaacugaagcaucucaagggaucuuucugagucuccauuuuuuaaucugugaaaugcggauaacaguauaucuuguuuugcuuuuuuguggaccugacacuucaggauucuuucuccuuuuuaaauauagcacuauaugaucaugaaugugauagggauuugaaaagugcaaagcaaauguuguuauaaaacguaagauauuaaacaauuauuauaauuaaauuaaacaauuauuauaauuaucaauacuaugaauuaauuuuauuuuuauuuauuuuugagacaggaucucacucuguuggccaggcuggagugcaauggugcuaucauagcucacugcaaccucaaacuccugggcucaagcaaucuccuucucucaaccucccaaguaggugggacuacaggcacgugccacugcgcuuggcuaauuuuuaaaauuauuuguagagacaggaucuugcuauguuggccaggccguucuggaauucuuggccucaagcauuccucagccugaauuaauuuucugaagaaagaaacuggcaccuguuuugggcuaauaggacuggauaccccaacuugguuggcugcgcauaucugugaaagauaagcagggaacauucaauccaaggaguccuuuggccauuaugcuuuucuuuaaaguaagcucacaaaccuuuuuccuggguuagguccacgcucuagguaaagaguucugaaacuaaagucuacuuuucauaacaaaacuauuuacuuguuccaucucuuaguuguuuaauaaacauuuucagagaaucauaaauuauugugccccuagcuuuguuuagcaauaaaagguaauauagaaagcagcacaguauuuuccaauuccggaagcuuuagcaccaagaacccagacauccuacagccagucaaguuuucacccaaaaaaaugcgaacaugaaaauuucaacauaauagaauacaagugauaccaccuaugugugcaugcacacacacuucacaaaguuguauuaaaacuauaaguguaaacuuaaaggaacugacggaaauuuuaaaaaagaaauuaauuaaaaagaaaaaaacuucauuuuuaacguaaauaaacauaaagcucuggguuuacaagauuuggauaaaauguaaccacucugacaucugaucaauuucaucaaaaggaaauuaaacucaacuuuaaaaucucuacuaucucuggcugggugagguggcucacuacuguaaucccagcacuuuaggaggcugaagcaggaggaucacuugagcccaggagucccaagguuacagugaacuaugaucacaccacugcacuccagccuguguaacagagugagacucugucucuaaaaaauauuaauaaaguaagauaaaaaccucuacuaucucuaauguuauauauaaucuuuauuuuagaugggaugaaauauuuaacacuaauccuagaaucaaaagauaaccaauagguuuuuagcaacucaaaguccuugcuugacuauacuuauagagaaaauggaccaaucauccaaaagaaacauaguauuuuacaacugaaaguagcaauucuuuaauauuuaaagcaaauccaaauuagcauuaauuaauaaaugacucugauucuuuuuuuuuuuuaagagggagggggcuguccucacuauguugcccacauuggacuugaacucuugaggucaagcaauccuccugucuccccagaagcugggacuacaggagcuucaaaugacucuugauuguauuauauuuccaauacaugcugcagugcaaauaaauaaauaaaaaaaauuagcugaaacugaaguuucuagaauacuuaguuggaccuccccuuuuuacaggccaaucauggagcuaaaugguuacuuuguuacacagauugagggaguaaaucucuguguuaaugaauacacuaucuuaucggcuucaagaagaguaaccucaagcacaaaaagaaaagaauuaagucuaacugaagguaccaugauuagcaaaaacacuuugguuucaggaauugcaaagacagacuggccauuacaggaaguuguauuaaugcugacaauguuaaacuguuuacagaaaguaggaagcugugggauguuccucccacugucacacacacuguccuguccuacguaacaaguguugccuuauuucucaauaagugaauauaaauuaaacaaaaaaaaauaguuggaaaugacuccuagccauuuugucaguuuucauccauaucuccaauuguaucauccagccaaccccugacucccaucucuuuauucaucugaguuaccaaauuaucuagcuauugucacauaagaagguuuucuaaagacaggguaacucaaaagugcaguggcaggcuauguugaauguacagccagaguagaguauuucaaauauuuaauucaguacuaaaacaggccacuucuuacaaucuauuauccucaguaugcuaauuuauaauaacuagaaagguaccuuaaguuauaacgagaaugugaaucuuguauuuuucuuuuccacaguaagcuauuuagcugacccaugauggaacuaaccaaaaaaggaaauguuuaccuuugggaacuuagaaagaaaaacauucauguuuacacccaaaguuauuacuaacaaaugaguagucugcuaaaaaccuaagcuguguuaucaacacccuaucccuugucccgaaaauugauuaaagggcaguuguucaucuuaggcaaaauguuaagucauguagggccuuaaaaccugucaguuuuuaaugugcauuaauaaguuuaauaaucaaaucauuaguugaaacgaaaagguuaauuuuaauuuuaguuauuuuaucugcuaaccucuauuucuucugauguuuaccuuuccuauccaaaauucaaaaauaugcugcuaaacauaacaaaacacauuucaacccccccaaauaaaaauuauaauuacacaagaacuguccacuuccuagaaaauuaggaaacuauuauagaaauaauccauauuucccagaaggaacuuaauguagaauuaaauuauauuacauauuuuuuaauuuuuauuuuuuugagacagggucucacucugacguucaagcuggagugcaguggcaugaucuccacucacugcaaccuccaccuccugaguucaagcgauucucgugccucagucuccugaguagccaggacuacagguacaugucaccaugccuggcuaauuuuugguuuugguuuugguuuuugguagagaugggguuucaccaugucagccaggcugguuuccaacuccugaccucaagugaucugccugccucagccucccaaagagcugggauuacagguauuuuauuuuuuuagaacaucuuuguaauuaagaaugucugaaaaacgaggaaauaaaagugucaggcacuaugcuaguaggagagaaaaagacaaacuaggcauaccaaaggacuucuacaugacugacagccacacaugaaagcugugacucuaacacacauaauggguacugugaggagugacaggaguaagcaugcuagggaaagcaaaggacacggagaucuccauucuagccaagaagacuggagaugcuucaaauaaagagacacagccccuaaggcacuguuccuggggaaagggagggggcauggagcaaauucauccaaaccaccuauggcuauuugcugaaaacacagaucacugggucccaucccagaauccagaaucagauccucagguauaaagucugagcaucugcuuguuuguuuuaacaagcauuccaguccaugggguccaugggccacauuuagugugauuaucacuacauuaagugaaggguaagaccuaguaacagauaggguaaagaauaauucuggcagagggacuacgcaugaugagagcuauagaagcaaaaaauuaggguaugugggaaucaagagauuacagaguauguccaguggccuaaugaaauauauugcuggaaucacagguaagcuagcuagagucuuuacucccacaaaaaagcugagcucuguucugaagacaauggugagccaccaaagcuuucugagcaaaccaaugcuguguuugaacaagacugccuuggaguccaagcaagagguagcagaacacaaaauagaggaaaggagggaaugaaugcaagagacguuacagagguagaaaaaucagaacuuggggagcugcugcauguagaugaguagauggaauugaugaugacuuugaggaaaauuuuaaguaagccaagugccuucucagugccugacacuaugccaagcaccacagcacauccaagaguuuaagagucauuaagucaacauaauaauggagcaucucuaugugucaggugcuauuaacaaugcugaagccacgcacagugguucaugccuauaaucccaacauuuugggaagccaaggcaggaggacugcuugaggucaggaguccaagaccagcacuggcaacauagcaagacuccgucucuacaaaaauuuuuuuuuaaauuagcugggugugacggcacacaccuguaguccuagcuacuugagagacugaagcuggagaaucacuugagcccaggaguugagucuacagugagcuaugaucacaacagggcacuccagccugggcaacagugagaccuucucuuaaaaaacaaaaacaaaaaaacaaaaaacaaugcugagcguagacucaggaaaaaagaaucucuguccuccagaaguuuaaaauuaggucuugcucuguuccucuuuucuugucucuacuuuucaucauggaaaaaaguauuucuggaacuuaucucuccucaucuuugaggacuucuuugcuccuuaaggaucaacuggcucaagucaacaacaagcagguccucauccugagugguuuuaccuauucguucuuaaucacaaagauauacuuagggaugcuuucucaacaaugaggacaugacaguccugaugugagacaguuagacgucagcuuccaaauuaaaaaacuguccaugaaacacaacuuuaauuaaauggacuuagggcaaauacggaacuuccccacagagaacuuucagguaugcaguucuuuauuuauucauuuaauccauaugcacuguaugcuuauuacagaugaauguuucuucucugaccuggaaggaugaauagagccugacaaaauugaguugaaagugugugguuuguugagaaaaugaacuaagaagaaaggagaauaagcagcacuuaaaaacaggagguagauggccaggcacaguggcucaugccuguaaucccagcacuuugggagggcaaggcaggcagaucaccugaggucaggaguuagagaccagcuugaccaacauggagaaacacugucucuacuaaaaauacaaaauuagccaggugugguggcgcaugccuguaaucucagcuacuugggaggcugaggcaggagaaucgccugaacccaggaggcggaggugagccaagaucgcgccacugcacuccagccugggcaacaagaacaaaacucucaaaaaaaugcaaaaaaacaaaaaacaggagguagagugaugggcgauggaaagggguauauggaagaacucaugcaagcaaaucuaccaaaaauaaaguaauaaacauugaucaagggacaaaacuaaccagaaaucugggaauuggauggaggucauuugucaaguuaaauucaucauuuucaacaugcaauacuggcagcuacguaauuuuaacaauaaugugagacagucccugccuuucagaaauaaacacauuacuugaaaagacaagauacaaacaugauagaagagaacuauacaagacgguaaauaaucaaaugcuaguugaaugacagauauaaaagccauaauucagauauagucaaaauuaaggugucaguuuuauaaaaagcuaucgugaacacuuuccuggaacuuuuaaaaggcaagacugcuucuaaguauaaauaauaacagcaaggacugcugguuguacaucgcuuugcagccacacccauuaauguggauuaauguuggugacaucaucaaacaacuuccuaagcagcuuauuuauuuuuuuuuuggagauggaguucugcucuuguugcccaggcuggagugcaguggcacgaacucggcuuaccgcagccuccgcuuccagaguucaagcgagucuccugccucagccuccugaguagcugggauuacaggugccugccaccacaccuggcuaauuuuuguauuuuuagaagagacgguguuucaccguguuggccaggcugguuucaaacuucugacaucaggugauccacccgccucagacucccaaagugcugggauuacaggcaugagccaccgugcccagccagcaguuuuacuuuuaacugucacuucauuuuaaucauauuagaguaaaacacuucagaucugaacuaccuccaaauugcacacagucuagauuucuaucacugcuggaaucuuucugaucuuuggcaaauaaaacccaaucacagcauucacaguuaaauuacaaaacacuugauuaaaaauuuguuucaacuguauucuguaucuuuaaccuggauuggauacuuuuauuccaaaccugucuucaaugcuguguaacagcuacaaagcauuuuauggguagucucguuaaagaaaaaaggggaaaaaugccuggcacaaugccagcaauuugggaggucaaagugggcacauuaccugaggucaggaguucaagaucagccuggccaacauggcgaaacugccucuacuaaaaagacaaaaauuagcuaggugugguggcacgcgccuauagacccagcuacacaggaggcugaggcaggagaguugcuugaacccugggggcagagguugcagugggccaagaucacaccacugcacuccagccugggcaacagagacuccgucucaaaacaaaccccccaaaaacaaaaaaacaaauuucugaggcuauaauuuuggauagauacauuaaauuauggaagucagugaaaaaagugugcuaaaaucagauacagguugagugucccuuauccgaaugccugggaccagaaguguuuuggauuuugaauuuuuucagauuuuugaaauaucugcauacauaugagauaugcugggaaugggacucaagucuaaacuagaaauucauuuauguuucauauauaccuuaagauauguagccuaaagguaauuuuauacacuauuuuuacacguagucauuagagacuaggacacauuaggucugugccuuagccuuucagucuguuccuccaucucaaauacuuuuagauuugggaacauuucgaauuuucgcauuagggaugugcaaccuguauuacuaaacaucauuaaaauaaaaccacacguuuuaaaagagcaaaucucuuaccaguugaaauucucgacgccggucauaggcauucuguaugccgcugucugcccauaaugcucuuauagcaggaagauauuguaagaaaacccuuguuuccaccauuccuugggcugccaugggggcccggguaucaaacgacaucaucuuaucuccauguuguugguuugaguugucuccccagggaauaugaagcuucucucgagcaucaaccagcacccucauaccuuuguuuaaaaagaagaaaaaaaauguauggagaggagucauuacauauuaucauaaguuuuuauuccaguauuauuuccuuauacuucugaauuaaccuagacaaaccuucuucaaaaaugaagaccaacaucgaaaacaaauguaacuucucagagguuaaaaaaaauaacaguugcucacugucuuaaaauuagagccuugaaaagcaaauacuauuagcacaauuccucucucugaaggauuuuuaacauguuccaauuuauaaaauaacuucuaggauagaagguagucaaaaaacaaucuaacucaagaaagaaaaagaaguuaugcugcacagaccaacaauguccaagcucagaagaaaacagacacaaccaagguuuuaugagccuaaaagauguucauuuaugaaacacuaagaaccaacuacuauagcuccauguucuguuuguugcuucggcacccuaacccaacauugagucuucuagcaacacauucaaaauuuaaaaacuucuuccagcccaaguuucaauccaguuuaaguuacaggauggccuucaauuucccuaaaagggaggaagaucaacugcaaaauaauacaaagucggacuccaacucacagagguuaguugaaacucauuuuuccuaucacugaucuauuacuuuuauuaaguuugaucaaucugaacagucacuuggcuauuaggaagucaucugaauaacugaaaaacgggugggguuuuuuuguuuuuguuuuuuaauagagacgaggucuggcuauguagcccagcuggucuggaacuccugggcucaagccauccucccacuuuggccucccaaagugcugggauugcaggagugagccaccacgcccagccugagaaacuguucuacugucaaauuucaugucaacuugaaaaaacuagauuccugaugacuuacaucaucucauaaucaaugcucaacguagaucacacuuacaacucaguguacauuaagaacgagguguuuaccaggcucacagucaguuaacauguugaugcuauucauuaacauaauuccuuaaguucagcugcaucagguuacaaagguaccuucaauuaaggacugucaaggcagagucugcagccuugaaagagaccuuaauuaguuuugagcuaaacauuacagcaggauaaauacaacuguucuuuauaguuuaacugcagagguacuagggcuagagcuggcuguggucuagugauucucucuaauucauuacuccauaaugccuggcucuucaggcaguuuuccuuuacccaaacgcuggaagcucgggaggcgguuggcggggagggggcgggggggugacaugcagaagucccuuauguacuuccugaacaaaaaucccacuuaaaaagaccugcaaucuguagcaaacuccuaaacugcuccccagauaaaauaaaauccagaugcaccugaguuaccaggcgcugcaccuaaauuuugccaaaaugccuuuucuauagaacauacuugacacgcagaaacgaguguuaauuaucuuucaaaugacaaaauaaaaaccaucuuuucgauuucuuugaaugcccagaaauaaacaacuuguuuauuuuucacuuaagaacaaaguuuaauuuuaaaacuacugucaauaaagagccgagccaauuaucuaacucaacacucauucauugucuccaucuguacaggauccacaugacuuuuaggccagucuucuuacuacuacauuucaucuaaauagaagcagugguacucccuuccugccagcccccaguuacuuagcgaaaaggagaguggaacguguugcacagaaaucacacgcaaacauccuaccugaccgugacacuggggcgaaaaagcacagaugcuacauuuucaugcuaacuguauggguccacucucuccugauuccaguacagucaaccugacacuccucaaguuucauauucucgcccaaaaggaggcugucacccuacgcccuugacaagaagucucgggcaaaaaguucccuuauugcgacgguuccagaacucgcuugcuuaggagacggccaaggaagcagggaguugggagcgcaugcgaccccaugugacucgggucacccagccaggguagcgagguucggcccacaucgcccgagcaggggaugggggugaagcggcuagggcugcuauugguguuccugccucauccgcagcggggaggacaggagaggucugcccacaccccgaggcagcacccagcucgccccacuucccucucgcagggggagagaccaggacgcgguggggggugggggaauggccgugacgcccaccggggagacaagcgggagagcagggcgaccccgagcauccucucgcccuggggcgcgagggcaccccgggcgggcagggccaguugccggggcgcgcccccuucccgccagcccgcccgccgggcccguuccuucgccagcgacacagcggaccagggcggugccccgccccgcacccgccgccgccccagccccccugcccuuaacccccggcccccauucccggcccggcaccuuugaucacguugcuguagaugguggggcggaacuccucgcgcgcgcgcuggucgaaguccugcccguggaugauccgcaucugcuucaggaagguggacuugccgcucucgcccgcgcccagcagcaggaucuucaccagccgcuucacauaggucuuuucccgagacaggcauuugucgaucuccuuggacuugcguugcugcucggccucgccacucgucagcaggcagccggggaagcacacggacagcacggaccgcgacggcaggaaguccgccaucuugccgccgccgccgccgccucggcgggccccuccggcucccuccaccuccuccuccggcggcgggcggcuccggcaccgaggcucgagggcggggagcgcggcggcggcccgagcgcgcccagggagggagggaaccagcgaacugacucgcagggcgggccgggcagggcgggccaggaca

SEQ ID NO: 16914 - RNA, 942 nt, Homo sapiens
uuggucgccgcguccuuggcuggcgucagaaaaauggcuacaaacuuccuagcacaugagaagaucugguuugacaaguucaaauaugacgacgcagaaaggagauucuaucagcagaugaacaggccuguggcaggugccucccgccaggagaacggcgccagcgugauccuccaugacauugugagagccagagagaacauccagaaaucccuggcuggaagcucaggccccggggccuccaguggccccagcggagaccacagcgagcucguuguccggaucgccagucuggaaguggagaaccagagccugcguggcgugguacaggagcugcagcaggccaucuccaagcuggaggcccagcugaacgugcuggagaagagcucgccuggccaccgggccacggccccgcagacccagcacgugucuccuaugcgccaaguggaguccccggccaagaagccagccucaccagcagaggaugacgaggaugaugacaucgaccuguuuggcagcgacaaugaggaggaggacaaggaggcggcacagcugcgggaggagcggcuacggcaguacgcggagaaggccaagaagccugcauuaguggccaaguccuccauccugcuggaugucaagccuugggacgaugagacggacauggcccagcuggaggccugugugcgcucuaucgagcuggacgggcuggucugggggaccuccaagcugaugcccgugggcuacgguauccggaagcuacagauucagugugugguggaggacgacaagguggggacuuacuugcuggaggaggagaucacuaaauuugaggagcacgugcagagugucgauaucgcagcuuucaacaagaucugaagccugaguguguguaugugugcgcgugcguaaggcccugccacgauuaaagacugagaccggcaa

SEQ ID NO: 16915 - RNA, 510 nt, Homo sapiens
aaugggccacaaacaaaguaacuaaccaaaaucacagcuggcaagugauggauucaaacccaggucucuccaauuccaaagucccugcucuaaucauagccucucuuccaugccuggcuguacccagaagggcagacuucaacccagaaacaacugugaauugugauggagagaugggcucuaguaucugaacaacgaaauuauacuuauaggcuacuuucuuuucacagaacaaaugagcuuucuuggcuuuuaacaaaauuaucauugaaaacuacaaaauuaagaucacccauaaucccagcauucagaggguuaaucuuuuguuuaaaauccuuccaaaagucuuaaauguguuuauaugccuuuuggaaaaaaaauuuauuuuauaaucauuuuggauuuacagaaaauugacaaagauaguacaaagaguuccuucacucagcuuugccuaaugugaacauuuuacauaaccacaggacaucugucaaaacuaagcaauuaaca

SEQ ID NO: 16916 - RNA, 5800 nt, Homo sapiens
ugaacuuuauuggcuucacgguaaguccauuucugcgggcaguguguuguggcaaauguccaucuacacuaugcauacucgaauuugcuacuuguguauguaaacacaggaacguagguaaugccuauacagagaauaaauaggaauauacaaguauacauauaaaaacacaagauuacauauugaguuuucaauacacaaacacacagauacuuauuuuuuucuauuuuuguuguuucuaaagaucauauccaggcaugaucccucuucuccagacuuugaauugucuaccugcauuucaguguucgcuuuaagggggagguaaucaauuuagcacauuaucauucaaucagacaagcugacucaaacaccguucucugaauuggacucaugcugagcaauccucuauucuagaagccaggugugaggggugggaggcaggaagccaguguggguagggagcccauugccaguagacagagcauggcuugguucuuucccaccccccaagcaguucagauacugguuuggaggucuccauugaggaggguccucugggucuccguggucucauucagccgggauuuguccugcuuacugucacuccgcuccccaucaucugugccgcucaccuugaccaagcagaggacauucuggaagcucuucuugaaguugucagacaagaaggcauauaggauaggguuggcacagcuguuagcauaggugaggaccaccacaaagucaaacaugccuuuaagggcugggguggggcugauggccauggagacggaagaaacguugaauauguagaagggaagccagcagaagaugaagacagccaccacgauggacaccauucgggugaccuucuucucagacuucuuccucuuagaggagcccacucggauuccagaggacuucaccuugaugauaaugaacagguagcaaagacagaugauggugagggguaccaggaaccccagaaugaaaguguagaugaugaacccuguguaccaagccccagauucaccuggccaguugauggugcagcugcuucucccccacugguugcuccggagcccagcauauaucaugaugggcaagaugaccagcagagagacuccccacacagccauggugaucaucuuggccguccggggucuccuccacuuggccgacuugaugggguggaccacagccagguaucggucgaugcucaugacugucaggcagaagaugcuggugaacugauugaugccauccacagucaugaccacccggcaaauggccuugccaaagggccaguggaccagagccaccugcauagccaagaaaggcagacccagcaugaagagcucaucugcgauggccagguugaggauguaaauguuggugauggucuucaucuuggcauagcggaggaugacauaaaugacaaguguguugccacacaacccaaugaugcagaccacaaaauagaugaaugugaggacugcauugcuugucaggucauaguacggcucugucugguuugagguguugguugacaccacagagccauugaggucaaauggaauggauagccauguguggcuuccauugaguggcucauccgccauguccauggcugcuuuucagucuuaggcuaguuccagccagcccagagaucuuauucucaccuuaauggacccuggaggccaaggauccagugugacaucuggaaggaaaagaggaagauuggcccgucggucacaggcuguuuaaagucucaccaaauuuacacauuucugguuuagccucucagacauacucuuaaauugaaaaauguauuaucuuuccacaucaacauuaagcucuagaguuccucaucagugugcagacuuuuugaguuguuuuuccaauaguagggaaggguuuggguucagccaucaucugcugacgcacaugucggggagggcuguggcuucaaaaagcacauacuuugaccccuaagaaguugacugaucuaaacugcagaaaggcagagcuuggagaaguucagcgccugaccucagaagggucugacacugacauuccuggccucuucccuaccaggaaaucuaugcugacuugcugacugccuuggagucuuuccauucugaaaaugccauaguggaaaaaacccagacucuagaggcagaacaaaccggguuccacugcugagcccgugugaccacaugccugguccuuaaugguucugacucuuauuucuucacaugggggcgucaugaagguuaaaugauggaauauaugugaaaaugccuagccuugcguugggcucauaaugggaaccucguaaguuguuuccccccauguuuuccucuaccaucucauuaucucugauuuauugaaaucuaccuacguggugaaacaauuuauagucuucaguauuaaaaauaaaagucugguuugcuuucauuuuugaaauguaggcuucaguuuauuuuuuguuuuucuucuauuuuuguuuuccaauaccuaaugcuugacuuccucaagagcucuuucccaaagucccuaaggggaugcugcucccaagugcuguaacacuccagagaauuugccugccauuuucuaauuacggacaaaaacgggaagcaggugugggacacaagcucuuucacagaaguaagcagaaggcuuccaguacugauauaauucauucacacucacgagucccuugaucuccccaacuguccuaggugguagggauaauuacccccauuuuagagauguggaaacugaggcuuaagagaguuuaaggagcucaccccauucucuugcacauaauugguggagcugggaugugaacacaggccaccuggccccaagucuuuugcacgucucaaggcauccccucugcuccucaguggccuagagaccgaacggcugauaacugggcuuugguuugaagcaacugacuccuguguuacuuccuugcugagaaaauaauuggagcacuauuggcuuggcuuaagaucuaaaacaauaguucaucccauaauuaaaugauugauauacagccauucaaaaaauaucacggggguugggggccuggagaggaggcuucuuugugcugacagcagggauguagaaaugaacaaacuuggccagugcccucuaggaggugauaauuuaaaaggggagauaggaaaggaagccagcucauauagggugggcauugcacgagagauaaaugaaggacuuaagaaugccuuccuuuccugggggacucagaggaggcuuccaaagagaaguguuugagcugggucuuggguauaugaagagugaagcaggaggacagcaaagaggccaaucuaggaagaggcgagauguucaaagggugguguguucagcagagugggacuaauucacuuggcugacacauuuccccugagcuagguccuuuuccuggugccuggguguagauggaagauuacuucuuaauccuuggaaagacugcagaucaguuaaaggagacuuggccagcaacaaguacuugaggauccuugcucaccuuugcuucugauugauucugaacugccaggugcauugcucguuccuucugugcucauuucccuaccacacaacugucugugaagugagaucugggcuuuguggcugaccauuuugugaaguauuugaggcaccuggaauuucaugucugcauugcguaaaaaagcauagacuggcagcaauuaaaacagaagcuguacagaaacugugguuaguaucccuggauuaacuuggguaguuucguuaucacuucuaaccaucuggucaguugguuuaauucuacagagccagaauccuauucaagcugccugcaaucagaguguaccuuaucauggggauuuccaggggcccaucuauauaacaugaauggucacacuccaaugucugaguaacacggaaucccccuggguuggcagagccccugucuaagagcuuuugggcuaggaacgaugauggugcagggaguaugagagaggguugaguguugcuuuccagcccuaacucggucauuuuaacuggaguuugagucaacaggacagaauugcuuaaugguagcaacagacaggguucagagucuuggugaaggugguggaggugggaggcuggggagccggcugagagugggaaggcuccucuaagcaagaaaugagcuuaaaucauggggagucuuauuuaacaaagaagucagccgcuuaaggucuuccagagacuucuguuucauuuuuguuucagagaaagaauauuccaaugccaggcagacaauucuagaugaauugugguuaaauuaaauguacaaggaaguuucguuuucugcauucuuuguuuuuccagcccaagaauuguuagaugcuggaaauggcuagugguugguuuccucugaaccauguccaggcucuguagagaggagggugagaauggucucacgcaccugccccccccgccccccuuuuacauaggggcugugauuaccagcccaagaaaugaguguugggauggcgacccgacaucaggggagguccuaaauccuacucagcuucaguuucuccucuccccaucauguuucccgcauucacuucccaccccccgccucccucagggccugcagaacccggcuuggucucugugcggcuagagcgagagcccccacuggcagggugacaaaagccccugagggccaccgcggcgcgugagcgccugggaaaagccggggcggugcuggccuacgggguugagaaauggaggggcgagugucaggaccgcggagccgguugcucccggcuggcacagaaaguccuccuccuggccauccaacucgcugauccucagagcaaggguuucccaaagaacucugugccauuuccaggaagacgaggcaagagcggagauuguggcgccagcacgcccaguaucgaaacgcacagcaggggugccggguguggggggggggcgcugaggacagagacaucggggcgcagaagacagucgcuugggggacuuggccagcggcuuuugggcacggccuaugcagugguuuuuucucuccaaaccuagacaaacuguccuuucugucccgaggugggggacggggacggauccuagaucguucagcgucuagggagagaagccccucuuucuccgcucugcgcccgccgccugccucuggcaggcucggaucuccgggugcgcucccgcaggagccccagcuggcaucucacggccucgcuccccucgcgccaggucucuuuuguagggggcugggagagaaguugucacccgucgcagcuaccugaaaucucgggcuaaagggcacacgccacgcacacgggcaugaggcugcgaggacacguccguuccagcacacucuacccacagcccccuuacucaggcaaggguacccguugucguucauuccuacuacaaucaccccaaaaggcacaagagcggagaaucacgcaccgggaccuaagcucaggcacucggaugggcacaccaccaucagcgcagaugcacacaggugcccaagugcgcuucucgcucccuccaucucucuuaucacacacacacacacacacacacacacacacacacacacaccccucaccuuugcuuuuccgcugcaauccgcuagcuccggucuccgacacccagcggcuguccccgagccagcugggcgccggggcgcgcagcagcuuggcuagcgccuggcgccggacguuugggguuccuggcuccucgacccucuugu

SEQ ID NO: 16917 - RNA, 1071 nt, Homo sapiens
caugcaggcagucccagaugguggagaacccacauccacugccuggccgggcuggaacaggauggggcgcagacaggcagguucucggcagacaggcucugugaagaaggucucaugcuucccccaucccaccccaagggaguggcgagggaagggaagccugugaccucaucaucugggccaaggccaaugacaucaccaggagggcaaggagccaggcccagcaaguuauuuauggaaacggcuggcggccaggcacagcuccugagcuguuucagauguggcugggauaaagccuccagcuggcccacuggggcugcugaggccaggcaggcgggugaggaugaaggagggcuggaggagggcugggggagucagcccgcugauggggcagggcucuucgaaggcucacugggguccccagcggggaucacuggggcaccaugcuucuccuuggcgucugcccaucuguguccucccuugcucaggguggaccuguggucucugcagccugccaucagggucugagucuggaugagcuuagaaagagcagcauggagauuucaaucacaagccacagcucaugugugcaucuauauucgugugccugaggggauguacugugugcauggcuguuguaugugcgucccugucaauggauagauauacucucuggucccuuguauauugcuccccugaguggucauagggguaguuaaguuugugaguucauggauaugggcaucucugcaugaguguguguguguguguguguguauguguuuguaggagauggggagaagagagagacagagugcacaagaccuagcaaauaggaagagaggagucacgaggggagagaaaucacuguaggaaguugggaaauauaauuucaguggaggauacagaggcacuuauggaagcuucagcaaaaguagacaaaccuuucaauccauuuaucaaaaaugccugcagcucugccgccugaguaggugcaacaagaauaaaauauugagcagaaccagugauugugggacuggaggaggccaauaaauaagaaauuacugagau

SEQ ID NO: 16918 - RNA, 6389 nt, Homo sapiens
uuacuuggcagugguuuuuucucacccuuccuuuuuaacaauaaaaucccauuugggucuugaugguuguguuggaaauuugaccuugucuggaaugugggguggccaugacuaagauucaaccaacucccgcucccccuaguccccaucuaccccuggcucgcuauauagcaccaaccuacaaauaccugggggagagggguuuuucucuagauccugaggccucuccccaugguggggcuagcaagauccguuaugucccuaucccacuggccuucacaccugcccaggcacccucccaggagaggucagggaccugaggcggcccagaugccagaaagucucacaacccagaugaggcgguugccccucgaggucagggcucagaaacugcccagcuaagccccucagccucaaagugaggaaacuccugcaaggggaauggggugcucccugacucccccgcaaggggaauggggcgcucccugucucccaggcagguggguugcugugaccauguggaugcuuuuaccugcccuaguucugugucuggguggggggaaagcucaacaaaggggagugaaaccccuaaacccccuggcuugugggacccucccuggguuguuuuuacccagaaacugagugguucaaucaucccuuuaccacucugagcaucgguuuauucaggaccaagaacguuccuucaagucagcugugaaaucagcucuugaaaccaggcaucuugucuaccacgccucaccuggacuccaccccagcccuaggguggccggcgccuggccauccaggggaccaggcuuguugccaccuccaggcucgccuugcccuucccagacccacagggaccaccuaggccaggccuuuauucccagaccccgaggcuacuuggggguccggauaagggugugguauacgggcuugacgaugaggugcaggugcagggcguucucaaccagguacucggaguugcgccgcugcaggucggcgugcgccaggaagucgccggccuccucgcugcucugguggaagcuguaggcguggcggaccagcaggcggcccugcuggcgcgcccccaccagcaccgucuucuggaagcucacgcccgccgcgucgccgccgcugcuggccggcgucaccaccagccgcggucggccguccuccgggcgcgcggcgggcagagcagugcccgcggcguccgcguaaacgggccgcaggcugacgggcagccagcgcggcgagaagagcacguuccaggugacccggcggcccgcgucguggccacucgggcccagcugcgucuggaagcuggugcugcggucgucgcgggccggguuguugaugacccacggggcgccccaggcgggcgcgagguaguugcggggcaggaaggcgcugccguugacgucgaagaacuuggcguagugcagcggcgacgcggcguggaacugguaggccugcagcaggaggucggccaccgcggggccguggcgcgccagggcugccgagcgcgccugcagcuggaacagcugugccggugggaucaugggguagcguauggcgcgcagcgcccgcucggccacggcagggggcggccgcgcgcgacccagccaggccuccagcgcguggaacagcuccaguucauccugcagcaccagguccgagcguugcaggagcugccagagcagcucggggcucacggcgccccacucggugcuggccgccacggccgacagguuccaggccaggaacugcaggcagcucucgcgcagggccucguccccggugcccaccgcguagugguaccagcccaccgccgggcccgcgccucccgccaggugcgcgcgcauguagucggccacgccgcgcugcagggaggacacgccguacuugguggccagucugugcagggggauggccugggucagcagcacggucagcuccccgcaguacagguaccugcgggagagaccgagagguggggcggggucagggcgguacccaccucccaggauagauuuuuuagaguccacaggggacccggccuggaguuggagcuucacuguccgggugcaaacacaguggaagccccacccugaggcuucccauguuuuccuuucaaggacccuuccaggccauucuuacuucacaggcucuucuuuccguuuccgcggugauguagaaauugccugcauugacugugccucuacuaggcgugcagcccuaggcuggaacaaaacagacguggcuccugccuuugggguuuccagucugguugggauccauggccugccuucuccuugccaugagucugggcaagucacuuaacuucagugaaccuuaggcuaaucaaucaccuaggaaagggggaguggcacacaccccucaggguuacugugacaaccagaggagaauaaagaaucuugcuacaggccaggugggugcuaguggcucacaccuggaaucucagcacuuuggaaggccaagaugggaggauugcuugaggccaggaguucaagaccagcuugggcaacauagcaagacccuaucucuacaaaaaauaaaaaauguuaaaacauuagucaugugugguggugcacgcuuguagucccagcugccugggagucugaggugggaagauagcuucagccuaggaguucaaggcugcagugagcuaugaucaucaugccacgacacuccagcuuuuuuuuuuuuuuuuuuuuuuuuugagauggggucuuucuguauugcucagguuggucucaaacuccuggacuugagcaguccucccaccuuggccucucaaagugcugggauuacaggugugagcccccauuucuuuuuugcagccucaccuuucuuuuuccucuccuacuguuggugaucacuucugcugaguaucucuucgucuuacuucugccacugucccauggcucaccuuuccugccaguccccaccggcacacggcaccgcacuugccucuauaggaguguggcagccacugccagccaucuuccccaacguccauuucuccccuuuccccugcgugauugccucugggaauaaaagaccacauuucccaggcucccucauucuggccuuggccaugugacuaacugcuggucaaugggcgcaguuugggauuugcaggaaggcugauuaaaugcaacugauuccggguuaacaggaagacccuuuuugcccuucugucuuauccccuuuccuguugccuggaacuuggaagcaauguauggaauucugcaggcaucucgucugagccguuagaacagaguuacuuucuuagacacuagugugaauggcacccccugagcagcaucacggcaggaggcaggagguggagagagccgucuaacuuuuucagcucccuagcccugugguuccaaaccuggccaaacaccaaaaccacagcgaugcuuucaaauaaaaaauauucgucuauaauggaauauuuaggaaaauaaaaaguaaauaaauaaaauaaaauaaaaaaugauugcuggcccuaacccuagaccugaaacugacaauccagguugggauccgugaaacuguaguuuuuuuguuuguuuguuugguugguugguugguugguugguugauuuuuuucagacagaauccugcucugucacccaggcuggaaucuaguggcacaaucucagcucacugcaaacccaaacucugccucccagguucaagccauucuccugccuuagccucccaaauagcugggauuacagucgugugccaccacacccagcuaauuuucuauauuuuuaguagagacaggguuucaccauguuggccaggcuggucuugaacuccugaccucaagugauccaccugccucagccucccaaauugcugggauuacaggcaugagccaccgugcccggccccaaaacuguaguuuuuaaaagcugucuauggccagguuuggaaacagcucugaggggguuacuaggaaccgaaagugacaucaaacugcacagaugacacgggcaaagacagggagcuguacaguggaagaagggaugcaggggucacugucaucccagugauguccggggaaauggacauaacaaccucuaagggccugggcuucccugacccuguagguggaggagccgggggcugaggaagggaugaagccauccccuagucuuccgcguccccaccugaugaacuugucgaagacagcggcgcaguccuguggcuccugcagcaccgccucgcucugguuacuuagcagcuccaggaacagcucacugugcagucccagcagcaggcggugggcguggaauacccggaccucaucggugcccgcagccugcacccgcagaaccacaucgcuggcguugcccugccgcagcagcuccugcaagcgcuggagcaccgccugggagugguugauggaggugccagcugccuccccgccaacaucggcucucugugcugcagcaggaaggaacacagcauagccugagaaggugcccgggcccagaaccucagucagggguggagagggaccagcuggagacauaugcaugggugugagcagagggcaaggugggccuaggcggguuguaugugcauaccuguuugugcccacgaggcgcguggaugcaucggugcacauacaaacgcacccugggugggaaggucaugccaaugcaaaccccaagaggaugcucuuggaagggggugcauucaggcagggggagguugugcucagguuuaggacaacaugcccagaacucaucuccaugcugccagccccccaggcaaggguugaggaaacucguggucccacccuucucacuuccuaaagaauuauccaucuaaccccuuggagcaguagucagaaguggugcauucacuaacaaauauuuauugagcacuuacuauaugcuagacauucuccuaagagcuugggauguggcaguggacaaagcaagccaaguucuuaugcucauaaaagcacgaauugacauaucaaacggguaagacacacacaaauaagcacuccaguuuuaaaggagccagccagggaaccagugucaaggcaggcuccagccccgcaaaggcccuugaacggaaugggccugggguacugggagcagagagagcauuagggaggccacagcaguagcaggagagaggggcgggugugagacgaggcugcggguguggaagggaagcuguuuuccaggcccagcccugcccucuuggguccugaucucugagacagaagccgauuuucugggguggccagcaggggacaggagaaagugcgaagggccagcuggugcuggaauagaacuuccuggguaacugagcauugaggcuggccaggccggcccuuugcuuaugcuccaggaugccccgacagucagauggggauaugcacucaguuauagaaacugucagcagcuuucccaagccgagaacagcgaggggagccucgcagagggaggcgggcgggggccugauugcagcagaugggccgcagccacaugugcacgcacagcacaugcaggcccguggugcacacaggagagaaggcucacacaggagcagagcaucugugcaugagagagggaggccgagggacaaagggagggugaaagagaagcggguaguauguuucccagcacggccuuccccagcugucacuuugaaggaccugaaugcugauggcguccccauucagccucugcccaggacaaugggcaauggaggguccucuuguccuuaagagcccugcccaccugccugccaggccccuccuuccuucagacagaugaguccguggagcuguccgguccaccccgugcucuccccagcagcuggacaccgcccccuccuggccggccgcgugcagccagggcugggacgaccugccgcuccacccugccccgcaccuggcccacugcccgcucaccugcaugggugaccaggcccaccaaggucagcauggcccagaagcugccccaggacccaggcuuggaguagccucuccuaggcaucuuuaugcucagcccccaaguccacuggagggacggugaagcccagaccacucugcucacaucccucuuccuuauauaggauccggcacaaggggacggcaccccccuuccugcuuggccucccucccccacucagccuccuccauggauugguggaaacuggccccagcuguugcccaggcaaccacuuaagccagagagcggcagccccgggggcuauugugcugccugugggcccccaaggggaacagauccggaacccuccucccccaaucuccuuaccacccagcagggcuagccgugccucucccuggaaaguuucaggcu

SEQ ID NO: 16919 - RNA, 10602 nt, Homo sapiens
guggagccgcaaggcuccgcuuucccggagcgcagggggcgggguuuggggcggggccucgcuugugggcgggcccgggcaggagcgggcuugcccugcggagcaguagcuaggaacagauccacuugcagguugcuguucccagccauggcuucgcgcugcuggcgcugguggggcuggucggcguggccucggacccggcugccucccgccgggagcaccccgaguaggagcagggcgccuuuggggcuggaugggagcgcggggaggccugcgagcgcugaguaggggucggagcagagcuggggcagggcuggagaagggugagacugaaggggugucuuccugcuggcgagaucccggugguguacgggggugggcggagaucugugcgugagaugugaggcuucuaggguuagagacggaggucaacaaaggugaaaaggagagacuuugagaucuacaggugugagacggggugaauggaggaugauacggaggucuguggggcgagaggaaagucugagucgaaacagggaucuguaggaauaagacgggucuauaugggcaauauagcguuuuguggagagagagagggguuagaggagggacaccguggggagacccacgggggcgagauugggaugauauggaggccguuggaaggaugugggauucuagccgauuggauagggaaugaaguguuguugggcaggccauuggcagugguguaguagguucaugggugagaugugggcucuggaugaacccacagccuuuggggguucagaugaaguaagagacccugcaaaugccaaagccuugaggaacaagagaaggaggaugcaggugagggugaagcuugggaaguuccagcuucuguuggauauucagguugguuugggacuggggagagaaguuaauuuugaccuuuucccucuccucugccuggccccaggcuucugccaccauuucuccacacaggagaagaccccccagaucuguguggugggcaguggcccagcuggcuucuacacggcccaacaccugcuaaagguaagccacuuacucauaguccaucauucaccugcugcuccaguccuaagggcaagccucacccgcuuuggguuuuaagagcacuccugguugccuuauggggaaggggcucccagccaucuggccuggacacuucccacuugcuuccucaccuacaccugaggcuccccuccccucccguccucagugugacagggguguaaaacgcacauugguggugaguggucaguggcagguggucagcuuugccucccuggccaagcacuccagggggcuuauguagaccugcaaaaugacuuuguccuccuucaucuucccuccucucucgucuaucuucacucuaucccaaacauccuacaucucgaggcuacccaccuccuccgcuuucuguaacuuuaccugccuugccaugcccuccucacccauagcuccaguccuccgugccauucuguucuuucagccugcccucugccccucccccuuccccugugaaggccaggaucucaaggcuuucagugucugccucggcaggaagggccccaagccaaggcuacagguucuacuugagacuccacaucagacuuugggacagaguagagaggggauacccagguuaacugagacgugagacaguugccuagcuuuggagaggcuuggaguguccguggagagacaagagaaaggaugaauaucuuaauuauacacacacacacagaugcuugaaauguagggugaccaacuggccuggacugcccaggacaaggggcuucagcgcuaagcuggaaguucuugggaaacugggaugaguugaucacucugcugaaaagugacccgugcaugcuucccaggcaacacgggugaaagagcuaauuacaauaaugugggcagcgugagccgaggcagguggggucaaucagaaacuguuuccugggccggaagcccagguggcucaugucuguaaucccagcacuuugggaggccaaggcagguggaucacuugaagucaggaguuugagaccagccuggccaacguggugaaaccccaucucuacuaaaaauagaaaaaucagccaugugugguggcacaggucuguagucccagguacuugggaggcugagucgggaggaucgcuugaacccaggagguggagguagcacugagccaagaucaaaucacuguacuccagccugggcgacagagugagacccugucucaaaaaaaaaaaaaaaaaaaaaaaagagagacagugcauuugagcugccuugaagcagaccaagggcuuuggugagggccucccacauguggggagucauccuggaaugcaaggccuugggcacgcugccaugugggagggaggacagccugggcucugggauggagaucagggagcacauggggguuggagaggcccugaagggcuuuguauaagggacgguuuuuuuuagcugagccugacauuuuggaagggaggagaguaagccuuccaggcaguguucuuuuuuuuuuuuuuuuuuuuuuuugagauggagucuggcucugucgcccaggcuggagugcaguggcacagucucagcucacuucaaccuccaucucccaaguucaagcgauucuccugccucagccuccugaguaacugggauuacaggcgcacuccaccacaugcagcuaauuuuuguauuuuugguugagacaggguuucaccauguugaucaggcugguuuugaacuccugaccucaagugaucugcccaccucggccucccaaaguccugggauuacaggcgugagcccccgcgcccggccaggcaguguucuuagcacgacuguauucagcuggcagacacgugcacaugcuuuccuuguggaaugggauggggaggggcucaggccagguacaauccuuguucugauccuugggcugaucuuugcccacagggagcuccaagcuacuggcugugcuccuaagacaggaccacaugcagcacguuugggacaguggcccuuagcuugagucaggcacugagcacagcaucucguagcauccucaugacaaccugcaaagcaggugucgugccucuugcuucacagguaaggaugcuagggccaagugagguuguccaagcuuccaccguggagcagggauggcacugggaucugagcgaaggcagcuccaugugaggccauccauguuaauccauucaguaaucauuuacuggacguaacauguucugggcgcaggcuuuacugggaacaugggggugaacaggacagacguggucccugugcucgaggaccugacauucgaauguggaggggacagguggauaauuuacaagguauuuuagggcucugacggcuauaagcacagagacuggggugcggggaggggguccaugccuagucuggagggagagaugucccaauugcagucugaaggacaguagaugucagguugggggacaauagcaggagugucccaggcacagagaacugcgugaacaaagaggaagagaauggcucucuggggaaagggcaaguucuggaaggugccugugugcaguaaggcgugaggaggugagagccgaggcugagagguagguaggacccagauccuggggggcuuggaagccauugaccaggcucuggaggcagguuucgcugggagguguccacagcugccuccucuuccccgaucagagucucccggggcaucuuaucaaaaugcacauuccugggccuaacuuggaccuaaucaaacucuguggcugggcccaagagucagcaauguuaaacaccccgaaggauucuugugcccacagcuguagaugguuggcuucacuggagaguuuucgggcugcuguuuuccuucaggaugcccccucugccugcagcguagguccaggcagggcugguggccagauggcaguggggagcugcugggguuguagugaggaagaggacugggaggaugggggauugaugggaucaggucgggggucagggaggagccccagguuccagcuugggcucugaguggauggggucgagggaacaggagcagaaguggggagcgguuuggggcaaggggacuuggcuugaaacuggguggauuugagaugucuggggugggacauccaagggucucagguuuggagcuuggggagaugucugggcaggagagagagaguagaaagucaucagcaaguucaggggaauuuggggucgcaggagggaguggguuaaauccucagggaggagggaggggggccaaucggaagaaccucagagaauguccuuguuagcggggagcagcuagagggacaggagggagggaaggaaggaaggaggaaaccuggaagaugaggucagccacgagagauaagggguaagaauauccggcagacuuagcguuccggagguggcccuggagaggacaucgugacccagagugaaggaucugucgcaggaaagaauggaagauaaggacagagagguugguugggugagguguugaccucuaggccgagcaguuugaacuuuaugcuguggcacugggccccagcgaagauuuuugagcaaggcagugacauacaacaacagaauaguaaugauagcucucuucuugauugaacacucagaguagguugcaccccgggcugccugauuacucauuuaaccuugagcaggacaccacagggcucuucuuuuggacagagaagaaacuuuccccagugcacagagccagcuagugcuggagcugggacuggcauccaaggcuaccuguuugacuccaagcccagagcgcuuuguggguacaacaucguggggcuugagggaggugguuuggguagcccccuguggcuggccugggauggagagaggcaggaggugggggaggguggacuugggugcaggcaggggaguggaggggaaggggggauuugggcaaaggcgaagaggugggugggagccuuuguuggggguagggagacugaugggcaggggcuucuuugccuugagucccagugaagcuggaggugucauagcggggaccuaagauaggauggggggcugggugugucagcugugggaccccugacugcuuuacugcuaaccggccuguggcccagagucucaccauccugaccuccuggugcuuuccagcagccaugagagggagcugucauccauccuagugugcagagggggagacugagacuuggggaggcccugggacuugcugggaucauguggcugguugguggcagagccauaccagacuugccugcuggacccccgacccugugccuuucacacggccucucaaggugcccugggaaggcggucaugcagaaccagugccugagacugucuuucuaagagugggagcaggcccauuuccaccucucuuucccgugaauucccagccgugcccccucccuguccugcugcuccccuuuccccagagcaugguccugggcacuagagcuaaggcaccugugaauucagaggguggcccucagguccucagacuggcugggaccugagggucccaagugucgaaggguuggaggccagggcuguggguugugcuugaccugagaagauaaagaagccgcccugauauaauuccagucgggggaagccacggccuugucagcuggccacauuucuccccaucuccgagggccggccgucgucgucuuuuuuuuuuuuuuuuuuuuuuuuuuuugagacagagucuugcucugucacccaggcuggagugcaauggcgcgaucuucgcucacugcaaccucugccuccuggguucaagcgguucuccugccucagccucccaaguagcugggauugcaggugccuaccaccacgcucagcuaauuuuuguauuuuuaguagagacaggguuucaccauguuggucaggcuggucucgaacuccugaccucagguuauccaccugccucagccucccaaagugcugggcugacaggcgcgagccacccaaggagugagugcucuuuuuccuugcagaggguggaagccuuguguucucagcccaggguccugaacucuccugcucugucuggggaaggggaggaccugggggcgucccagccucucucucucgaccccaccagcugccacccuguuccccagcagcacccccaggcccacguggacaucuacgagaaacagccugugcccuuuggccuggugcgcuuugguguggcgccugaucaccccgaggugaaggugggugucucugggccuggaggcugggguuuggagacuuuggucaagaugaggagggcagggaggcucccuggcuggaugacaggacuucaugccaucugugcccaugccacccagcuucccuccuggggacacagaguggugaggguggugcagacuuggucccuggagcugccuuacccucuaaccccucccauucccgggggaccuggcagaaugucaucaacacauuuacccagacggcccauucuggccgcugugccuucuggggcaacguggaggugggcagggacgugacggugccggagcugcgggaggccuaccacgcuguggugcuggugagugcagcuaggcccuggcuuggggaggcaggggcugcagaaggaggccgguggcucgggguggaaggcagcaggggugaggccaggaugcaagcugcugagaagcuggaaggaggccgcugggagccuggggggcugcccggccuaucagugcuggugcugaaggcugugggucucgggccugccaucuuucaucagagcuacggggcagaggaccaucgggcccuggaaauuccuggugaggagcugccaggugugugcuccgcccgggccuucgugggcugguacaacgggcuuccugagaaccaggaggugaguauggggagcacgcccgcugccucuuccuccccgccccucagcccuuggaugccagaccugggggaagagggagcugccauccaguggcgagaugugacauugugcugacugaggcgggaggccagcuguggagggccucgggggagagcuggguccaggugggggaggagggaccagaguuguggacuuucccgguguggggaagccccagggcacaguggggaccaggcaugaggcaccugcagacugagaugagcugaguggagcgaggccgggggacccuaucaagaccuuuccccuccagcuggagccagaccugagcugugacacagccgugauucuggggcaggggaacguggcucuggacguggcccgcauccuacugaccccaccugagcaccuggaggugagugguaggucagggcuggcgggguuggagguggggucacccugaggagagagugcccuugucugcaggguucaggccuuaccucuccaagcugggcucagugccucuguuuccccguggugcccaggcagaggcucucugaagggcagugccaugagcuuccucuucuaccauuuucccuucacuuucugcacuccagcuaaguggcguuuuucucuuacucuucaguaagccacauccccugcuuggaucauccccacucaccucccaccaguuaacaguuaaaguucaucuuugagaucuuggcucgguugucccuuccuccaggacuucccugaauugguccacucccccaucgugccuccucccauagaccugucuacuucuguuucaccgcauaucaucgccacggcaauuuuacacacauugaugaguauuugaugaguauuucucuccccagcagaucacaagcucugagagggccugcuccuugucucuuuuccucaccauugaccaccccgccccuccaagcucuuugcaugggggugagcacaugguagaggcccacuacauacuuguugaaugaaagugugggccuggugugcuauuaguuggagccauuugcagaguuggcagcaaugcuccaucuggccaccaggggggagcaguggcgcaauuuugagccgccagccuucuccaggcccacgguggggacaugaccaaauggagaguccccuuuccucggucagugucugaugacuccaaggcccuccuuuugugccagagaacggacaucacgaaggcagcccuggguguacugaggcagagucgagugaagacaguguggcuagugggccggcguggaccccugcaaguggccuucaccauuaaggugcuggggccagagugggaggagccaggguuccagguggagggggccucuccuuaagggguugggguggggcagagccccugggaguagcugcugccugggauggaagaaggggagcagucagggccccgggggcccugugccuuuggggaggaggcgggugguggucucuccugccugggcuggacccuggggugggcucagguggacuguguucugggccugaccuccucccccauucccugcucccaccuucaaggagcuucgggagaugauucaguuaccgggagcccggcccauuuuggauccuguggauuucuugggucuccaggacaagaucaagggugaggggcccuggccuggccccccaacuacuagggagaggguggccuaggucagagagggauuggggaagggcaugcagggagagggccggggcccagggacagccuggagacauucuacguugcugacagaggucccccgcccgaggaagcggcugacggaacugcugcuucgaacggccacagagaagccagggccggcggaagcugcccgccaggcaucggccucccgugccuggggccuccgcuuuuuccgaagcccccagcaggugcugcccucaccagaugggcggcgggcagcagguguccgccuagcagucacuagacuggaggugagucucauguuucucaaagacacccccuucccaggccucugccacccgccugguguugcccacacucuccccaacagggugucgaugaggccacccgugcagugcccacgggagacauggaagaccucccuugugggcuggugcucagcagcauuggguauaagagccgcccugucgacccaagcgugcccuuugacuccaagcuuggggucauccccaauguggagggccggguuauggaugugccaggugagagggugugaggaggcugggugcugaauuauggugagaggccgagaagcugguaucuccuggggccaugcguucauucaucuagcaacauguacugagaagcuucugcagggcaggcccucucuaggacccagugccgcccuccucuuggcccugagagaaguuccagucuggcuaggacauaugugacauacgucgggucauuaagucauucaacaaacguuuacugaggucuuuucuggguuaggcccugugcuuagugcugggauuggagauuaauaaggcagccuguguccucagggagcguccaguuuuacuaagugcccacauaccuaucuagugauuaauucacuugguaaacauuuaccaagggccuacugaaacugcaggggagcaagccucagcuccuaagcuuagggauccccucaucuacagggaaacugagguguaagggggucggccugguaaaaacagggagagaagaauccagggcaguggaccagcggccacagcaggcucagccgacagucugccaagaggcguggggugucugugugcgugcacguggguguagauugugggcacaggauggccagggugguauccagccaccucccucccuuccccuuuuguuacccccucucaggccucuacugcagcggcugggugaagagaggaccuacaggugucauagccacaaccaugacugacagcuuccucaccggccagaugcugcugcaggaccugaaggcuggguugcuccccucuggccccaggccuggcuacgcagccauccaggcccugcucagcagccgaggucugggccccgaugcugagguccugggagguggggugggugguccuucucugggccucacucuuugggagggggcuguucugggaggggugaaggaggagguguugacaaucuccccuuugcuucagggguccggccagucucuuucucagacugggagaagcuggaugccgaggagguggcccggggccagggcacggggaagcccagggagaagcugguggauccucaggagaugcugcgccuccugggccacugagcccagccccagccccggcccccagcagggaagggaugaguguugggaggggaagggcuggguccgucugagugggacuuugcaccucugcugaucccggccggcccuggcuuggaggcuuggcugcucuuccagcgucucuccucccuccuggggaaggucgcccuugcgcgcaagguuuuagcuuucagcaacugagguaaccuuagggacagguggaggugugggccgaucuaaccccuuacccaucucucuacugcuggacuguggagggucaccagguugggaacaugcuggaaauaaaacagcugcaaccaagagcca

SEQ ID NO: 16920 - RNA, 14194 nt, Homo sapiens
aauccauuaaacaaauaggguuuaugcggcaggagagagcuguugaacccugccuggcagccaaugaaugagcucauuaggagacagguguguggggagaggagcuggccuccuagcucggagcucugagcucugaggauguccagagccacacuuggaccaggugcucuucucgcagcagggggcagaccucugaguccuggcuggagaggggugccccucgccaagcuccccagacucggucauguaggucugacccucccacagaguagccgugagggggccccugccagccuccuggggugcacccuuggcuugcggaucguggugggaaggcagggggcaggcaugugcccaggccuggccgugggcaucagaagcucaguguccaggccccugcuguuggccucuggcucuaggcagugcccuccccuucagugaggcucuggggagcaggaggccuugagagccucaggcuggucucggcaccucagaaugaggcaucugcucagagacucugggcuaccaucuuccccaccuuggcacuucgagguucugccgggggugggcagccucaggcccccagguagaccuccaccaggccucccacagagugcaugcgguagaagacccccagaggcaggccgaaguugacgauggcgaaccauaucugguagccguagaaauccuuuucuagcccguucucaaacuccggguguaugccaaaugcaggcaucauccacagcuggggaagaggaugugcugaguuagggaagggcucuccugugccccaaggcacucaguucaggggaggcagcccccaaaccugcagccccuccagugccacccccaccucccgcucagucuucuucuaacccuugggcuuucagcgugagcucuucuuucccccagaucuuucucgcccuacugcagaaggccuuagcuauccccagccaucucugugagcuugccuguggccagccugaacuucagaugggucaggagaccccaggcugccgccacguguggggagaagcaggaauucccagcgcgccaccugcucugucaagcugggcacccccacccuguacccugagcucgggcuucacuccucggcuagcuacuuuuuauuuuuauuauuuauuuauuuuuuugagacaggucucacucugucacucaggcuggagugcaguggcaggaucacagcucacugcagccucaaccucccgggcucaagugauccucccaccucagccucccaaguagcugggacuacaggcaugcaccaucaugccuggcuaauuuuuauuuuuauuauuacuauuuuuuaagauacagagucucacucugucacccaggcuggagugcaguggcacgaucucagcucacugaaaccucugccuccuggguuugagcaauucucgugccucagccucccgaguagcuggaauuacaggugugcaccaccaugccuggcuaauuuuuguauuuuuaguagagaugggguuuaccauguugcccaggcuggucuccaacuccuggccucaaaugauccacucaccucagucucccgaagugcugggcuuacaggcgugagccaccgugcccagacuaauuuaaaauuuuuuuuguagagacagggucucccuguguugcccagguuggucuuaaacuccugggcucaagggauccuccucccucggccucccaaagugcugggauuacaggugugagccacugugcccugucauuucugcuaguuaugacccccugcccccuccuaccuuccuguccaaauucuaccccuuccucaaggcucagaucaaaacuucaugaagccuuccuuggcuaugcaggcccacaguuccuuugcugagcuccuaaugcacuuuagagccaauuuauucucugccuggaccagagguuucauuucucagguauguuuucagugcauugauugcuuggagucaaacacaacccugaguugucccagcccugccacuuacaggcuguggguacuugggcagguacaauaaccuaagccuuaguuuccuccucugugaaaagggacagcaauagugucuguugcauggaguuacugucaugauucaaugaagcguagagacauugcauggaaagguguaccugggacuuccgccagaagcugggcagccauuaucaacaucuuccucuaggagugucuuagaaaaucagguacuuccugaucucuuccuuugacugaacccagggaugaugaauucaguggugucuucccaacuagacaggaaguuucuggaggguggaugucuuacauauuuguuugugaagagcacuuagccaagugcuuggcacauucauuugugccaggcacccuguagggaacuggggggacacucucaagcagcaucaagcuaguuggaaaaagauguguccuugauccaucccuuccugagugaggcuuucugggucugccuggccaccucuacccuccaggccccuuagcccagccacuuacugugauauugcagaggaugaggaagagugagaucuccuugagugcccuccgcuuccaguugagguggcuguaggaguggauguaggccagugaggcccgcugcaggcccuggcccagcuccagcaaggagccucugcggggaggcucagccuccugcuuuccugccaggcccucgggaacugucucccagagugggcgccggugcaggcccucgaugaugaagagguucugagcgaugugcugcaggaugagcagcagcgaguaggccaggaugaggcgguugagcagcucaugcgggcgcuuggccacaauggccacgauggagaaauaggcgaugcccaucuggcccagugcagcacccauuagcagcaccacauccaggcugcggguaggguucuugaccguguccagcucucucuccuccagcccguguauggcugugcccgccaggcacgccagacucauggugggcagcacagccacauagaaggcauaguagagggugaaguacuggcaagcaauggcagggccacuggccucgauuuggaagagcacaaagacgcacacaccugccagcagcaccagcaggcccagcagcggcccgaagauggccccgugcagguggaagggugcgguggcagggugggcacccauguggggugccacguggcggcccacguucuuccacaugacaaacagcacagcacagcagaugaggcaguacucagugcugaagggguagagcaucaggaagccucuccggaaagcuucacacgcgguggcauugaggcacagacagguguuggucucauugccugggagggaggcagggugggagggacagacauucaggcaggcucugcucugaggaaacuggcuacacagauaccucccauucccuggaauacacuagagcugaaagcgacccagccgcucauuuuaccaauguggaaacugaggcccaggcaaagagaucacaaaucccacagaauggucauucuuuuucaaaggaauugaagacuucagaugccaaacuuacguaaagcauuaaaaacaugaugccagccaggcgcaguggcucaugccuguaaucccagcacuuugagaggccaaggcaggaagacugcuugagcucaggaguucaagaucgacuuggguaacauggugagaccucgucucuacuaaaaauaaaaaacauggccaggugcggugguucaugccuguaaucccaacacuuugggaggcugaggcagguggaucaccugaggucaggaguucaagaccagcuugggcaacauggugaaaccccgucucuacuaaaaauacaaaaauuagcugggcaugguggcacgugccuguaaucccagcuacucgggaggcugaggcagaagaauggcuugagaccgggaggcagagguugcagugagccaagauugugccauugcacuccagccugggcgacagagcaaaacuccaucucaaaaaaaaaaaccacaaaaaacaaaaaacaaaaacuaacaaaaaacauuagccggauggcacacaucuguagucccagcuauuugggaggcugaggugggaggaucacuugagccuggaagguugaggcugcagugagccguguucccaugacuguauuccacuuugggugacagagugagagugugucucaaauaaaccaaaaaccgaaaccccaagaacccucacaugaugucucuggugucaaaugucaccuccacagauuacuuccugggcucaagggaaaacccguggcugugacagcggaacccagccaucggccuuagcagcacucagggucaggucaucagucauuaguaccuugccaucccugucccucagagcacacagcaucaccuggaagaagcuggggccgaaaauaucuaaccugaaucuaaucaagauuuugucuauacuucccguuccaaggaaaaguaggggagagggaugugaguuaaacacugccaggaggaagcaaccugacaagucucaaggucagugggaaaacaccaauuuagacuuaaccaaaugcauugcauguuugaacaaaccgucuguaaaagacauuucuggggcuaacuggagaaagugggauauagauugauuuagaggacagaaugaagcuaaaggauuuuguuaacaauuguaauagcauuguggucaugugggggaauacaucucuuucuaaagagauguacacuggguccggcaugguggcucaugccuauaaucccagcacuuugggaagcugaggagggaggaucacuugaacccaguaguuugagaugagucugggcucagaaauuuuuuugugagacuccaucuuuacaaaaauuuuaaaaauuagcugggugugcuggcaugugccuguagucccagcuacucaggaggcugaggugggaggaucgcuugagcccacaaguuugaaacuguagugagcuaugauuucaccacugcacuccagccugggugacagagcgacacccugucucaaaaagaaaaaaaaagaaagaaagaagaaaaaaagaugcaugcugaaauauuuugagauauaaugucaugauuucuguaauuuaaguacuucagcaaaaauuaaaaauaaauaaauauggccaaauauuaauaauuauuaugccuagaugauggguaugucuuguucuucuacucauuuguaaugcuugaaucuuauuuuauuuuguuuuaugacaguuucacucuugucacacaggcuggagugcaauggugcgaucucggcuuaccgcaaccuccgccucccggguucaagcgauucucaugccucagccuccugaguagcugggauuacaggcacccacaaccaugccuggguaauuuuuguauuuuuaguagagacgggguuucgccauguucgcuaggcugguuucaaacuccugaccucaggugaucugccugccucggccucccaaagcgcugggauuauaggcgugagccacugugcccagcccugaauuauuuuauaauuucaaaauccaugaugucacuuggcaaaaauucucucuuugcacagcuuuucugagaaaugcaagcagaguauauagaaugcucacaguacacaggcgugucgugacugaugcagcggguaugugaauguguggaugugcugggagggcugggcugcagggcgugauggugaugccacccggggcgggguggggcauguacauacagguguggcucaaucccacagagcaguguucccauguaggguaugggaugcagccucuaggauaggaggugaggcauaugggacaaucuugggaguuuuuuucuguccagauaucuuccgucccaccugauugaugaggccaggcaccuaaaauuguguuaggaagauauuccuuucagccgggaggcuguugaguugcuugcaaguaaaaugcaaaugccacgggcggggugcauaccugaaggacuuaguggcucucucagccaggaucaguggcuggcuugcugauggcuagcuggacaccuggaguugggugcagggcgucagcaccugauggggugggauggggaccacuggcaaacuucaguuuucuguugauuccuaaucuggccucuagaguuugcucccaacucuauagaccuacugagccucaccuguuuuagagaguguagcguuuauguguguguguguguguguguguguguguguguguuucagggcaaggaagaccuggucuccuuuccauaccuguggauuuuuccaugaggaugccaagcucagcuucgaucucucggugcauggagucauugguaacggccagaacccacagcagcagguuuguggccagggucagcaucaggccacaccugggggaaaugccacacucuucucacacacccuggccggcuccccaggugccaaacccucaccauccacuguuguuggggcaaccacucacucccaaccacucacucccuagugucacacuggcacuaggacacaagaggcagcccuggggccaccuaggacacaucccagacuaaccuauagccccgcggccacccugaccagggaagugguggggaggacagagaggccagaggguuugggagggagagaagucuuaccuagugaaguuggucuggacccgaacacagucuuugcaguguuuccagagcacccaggucugaaagagacagggccuugagcccaggggcugguggagguggugggaccacagugugaguuccuggggcgcaugcguguauuuacagugaaagacacagggagaaagacugggucggaaucuuggcucuacugcuucuugcugugugguauugaaucaguggcaaaccaucucugagccuuaguugccucagcugggaaaagggaccaaaaagcccacccuuuggggaagugcuuucuuguugggggaaauaagacugcgggaacgaagcacccaacacaaugccuggugacaagagaaaccuaagaggaagcuggagauuguauucuuuucuuuuuuguuuuuuggagucucgcucugucgcccaggcuggagugcaguggcgcaaucucggcucacugcaagaucugccuuucggguucacaccauucuccugccucagccuccugaguagcugggacuacaggcgccugccaccacgcccagcuaauuuuguuuuuguauuuuugguagagacaggguuucacuguguuagccaggauggucucagcuagucucgauccccugaccuugugauccacccaccucggccucccaaagugcugggauuacaggugugagccaccgcgccuggccgauuguauucuuuuuuuuugagacagagucucacucugucgcccaggcuggagcucaguggcaugaucuuggcucacugcaaccucugccuccuggguucaagcgauucuugugccucagccucccgaguagcugggacuacaggcgugcgccaccacacccggcuaauuuuuguauuuucaguagagacaggguuuuaccauguuggccaggcugguuucaaacuccugaccucaggugaucugccugccucggccucccaaagugcugggauuacaggcgugagccacugcgcccugccgagauuguauucuuaagagaagguuuauacauguagggaguguauauccagggauaugccuacauacgcauagacagcuggacuucuaagugucuacauucggugacacgguguguguguugaugcaggaacccguggguauguguggacguggacacuugugugagggguguggugugugugcaaagacccugggacauuagguauuugccuguguggcuguuccuaggcauagguagugggaggugugugcauggcauggguagauaggguauguccucggugauguggggacgugagaagccugucaccuggacgccgaugaagaccaucucgaugacagagaagacaagguccagcugugacuugcagcggauguggcucacaucguagcccacucggaagauguugaggcagaaggugcagcugccgaagagcacuagggaaccuggccggacaugugggcgggcguuggcaccugcgcggaaccggcucucccuccccaccccugcccagccccccagcaaccugacacucaccccgcacccagaggggccccgcguggggaucuugguagagcacggcguguggucggcggguggugcuugccacauaguagagaagccaaagcagggagaggaccuucagcguggccagcaggauccacacgucacccagagugacggccaccuuguugaagaucaugcugcagaugaaggcgccacccaggaacaccacauucagggccaggagccccgagaagaguuguccagccuucugggccugccggucccgccgcagcagcagagagaaaugccucaccagccaggacuucugccggggccggguggcggccgcucucuccucggcccccacauccacucgguucuccuucuccggggcugcuucagucuccugugcuucugaagaaggcauggguguagccucagcaggggcuggagauggagaaaggguccuggguuaacugccaggcuguccuggguucaaguccacgcugccccuaaccgcugugugacccagggucagcuaugcggccucucugguugggugguugggacauuggaacuaauagcagcugccccaucuaucuuacaggaccugaggagguucaaacagaccaggagacccuacggaaaccucucgugcugcacauaaacauggggaauuaguuugacuggcgugaggaucauguccucccucucaaccccacuuccugacuugugccugauccuaaagucagcgucugccuagugccuggucaguuucuagggcugugacuuuuugccaugaaaaggcagcgguguccuuccgccuucugguaggacuuucacuucugacaccagggagggcaaauugguggccuuucuuauucugacccugauugguugggaaaugauugccuaaaaugucuuguagagaagcauccugaggcugugucugggcuugguagggaagaauggugugaucugaaacaauacuguauuaugggaacauacaagcaccuauaugauuacuuuuaaaaggucuagaccagcaguccccuccccaacuuuuuuggcaccagggagcaguuucguggaagacaauuuuuccauggauggaggguggagggaugguuucgggaugaaacuguuccacuucagaucauuggguauuagauucucaugaggagugggcaaccccuagaucccucacaugugcaguucacgauagggcuugugcuccuaugagaaucuguugccacugcugaucugacaggaggcagagcucaggcugucaugcucccuccccaucacuuaccuccugcuaugcggccugguuccuaacaggccauggacugguacugguccgcagccuggggacuggggacugcuggucuagauuauacccaucaguuucacaauaggaguuucuucugggaugagaguacugggauugggaguagcagacuuuuuagcuuuacuguucuaguuuuuuaaaaaaaaauuagcacaguacuuauguaauuaagaguaauuuuaggcugagcaugguggcugaugccuguaaucucagcacuuugggagccucaggugggaggauugcuugagcccaggcauucaagaccagccuggcuaacauaggaagacaccaucucuucaaaaaaaaaaaaaaacaaaaaagccgaaaaaaaccccauauauguauauauguauguguguguguguguguguguguguguguguguguguguguguguauaauauauauauuagccagguaugaugguuuaaugccuauagucccaacuacucaggaggcugaggcaggaggauggcuugagcccaggaaaucaagguugcagugagcuaugauuggaccacugcacuccaagcugagugacagagcaagacccugaguuuaaacauaaauacauaaauaaaauaauuuuaaaguacauuaaagguuuagggaaaaguuucugggguugauucacaaugucuucugagagcaugggacaggccuggaucagcaucgcugccacgcccuugacuuugaagguugacuuugaaggaacuggcuucuauuucugugccccuccccccacucccggaagucccacgagugccuggcauaacguaggaaacacgaucguuacccuccucuuuuccugaaugucuccugccauuuccucaccucucccaagcauucacacaggccaaccacuuugucaccacuugcuaagaccagauuuugggccauccaaugccugcagcucugaguccagcaugcucuccccaccggacacuccuucuuccuggugggacugaggugcuguugagaguggggaugguucugcugcuucugggugcucuccugguggggaggcugagcugacccagaaggcucccuagagacccccuguuccacccaggcucuuccuugguccugcugcugcccuugugcucugagcucaggguucuaggugcucauugcucccauucucuugcuuccuaaugucacaaucucagagugacaucuccaucuccccaccuccuagcagagaacuggguguccuuuuugccucuccccucaucccuugcauucucuuaggccccaggcuuguucauuccagcucacaaguugcucuuagauuuuuauuugucuauuuuuagagcuagggucucgcucugucacccagccuggagugcaguggcaccaucauagcucacugcaaucuugaacuccugggcucaagugauccucccgauucagccucaugaguaguugggacuacaggcaugugccaccacccuuggcuaauuuuaauuuuuuuuuuuuuugcagagacagggucacguuauguugccuaagcuggucuugaacuccucgccucgagugauccuccugucucagguucccaaagugcugggauuacagguguaagccaccaugccuggcccugauuuuucuugaccucaaccacuaccuagucugggcccccuuccuugcucucuuggacuggucuucuugcccagagugccucuccccuacuuaaaguccugcaaaggcaacuaauugcccucaguauaaaguccaaauuacugacacagccugcauggccucucaaaaugagagguguaugauuaguaugggccuggacaagguuccagguucucugcccaaggcagaguagcugcugcugcuuccuggucuggcuucaacuuaccccucuagcauugucuuugacccuacuccccucuccuugggcuauaccaucuugcugcacuuccuggaacgcccccagucuuugcccacacccuauucuuugccuuuaaugccuaccccuuuugccccuuggguaacucuagcuuguccuucaggacucggcagagacccugccuccucucugcggccuucccucgucagcauucccaccucaccccacgcugaccacccaucguccucugcuuccauuagcugugcuuugcucugucucucccuugagaccccaggcuucaggagcuucagacgugcccucuaugcaacaccagaagacucucaccauaucuggcuugaaaaugcaaccucuccgggcucccauucuccccuugucauauucucccauucuccaccugcuccauauuuauaccuucugcuguucucuucuggggcagauggagcacuaaaacuuaagccucuuuucaagauucuauaaaugauuuucuccccuuucccacuccacucugucauccuugccuaaguucugucuccucccugucccaccaccccugccguacucaaggcaccugccucccacaccaacccaggcccagguagaaaguucugcguuucucccauggucuccugccuccugccaucccuccuggacacugcucuucuuucugccucccccaccacucgcccauccuccccacccaccuggaaagccuuccucucugccuaagccuucuggugcuacuuugcuggggccacuccccucuauugagaggugugcccuguuuggugugcuguggguguggcuggcucccauuaaguccugaaacuccuccaggacagagaccggguccugcuuaacuuggaccccccaaaccuagugcagaugugacauucacccagugauugcccacugacucuggcaucuuuugggaaauuuucagcaccagagcuguggacagagacccuucccauuaaacucuuuccgggcuggcuggggaggagacucccgaugaucuuuaucuuucccuccuaagcucccccacccaaauugagcaaggcuggggcucaccgggaugucucccugcuccauauaucccaacuguaacugcucuacuucaccuuccccaaaaccugcacccucuccuccagcccccaagcaggguagauuaaugaucaagugcucagauuccagcacuuauuaccucugucaucuuagacuacugagacuacuacagagagcuacuuagacucugugccugaguguugucaucugcaaaacugauauacaacuauggaauaguagcuggugcauaguagaugcucaauaaagacuuccggaacgaggcuggcugcaguggcucacgccuguaauuccagcacuuugggaggcugaggugagcggaucccuugagcccaggaguuggagaccagccuggggaacauggcaaaacccugucucuacaaaaaauaccaaacaauuagccagguguaguggcaugcaccuguagucccagcuacucgggaggcugaugugggaggauugcuucagccugggaggcugaggcugcagugagcugugaucgccacagugaacuccagccugagggacagaguuagacccugucucaaaaaaaaaaaaaaaaaaagggugggggggugaugaaugccgaauaggggcuuugucagaaugacaugauuuaauacaugcacgaagcacgggcagagaguaaugccggcaaugccuggcaccuggaaaacucaguguuggcuaucucugcauuuccuuccaguucuuuugagguccuggagagcugggaagggucgggauuacuggugaaauuucaagggugaauuuuauucagacuggaggccuggaggggacacugggggacaagguuccagguucccuuccucuggggucuuugcccugacaguaucccccgucucccacccugaaguccagcccuccaaaggccgcuggcgugagccuucaaaggagcgaauuuggucccgggcugggcagggggcaggagugggcauuuaggggucucgggcagaaggcuggggcaagggcaccuggaacugacaagcaguacucugccgcccccuggcacgccccugggcgcgacgccaguccaagggagggccgggacacuggacugguuugugggucucggcuggauuggcgaugaaagccgcggagccgucgggcccggcgcccggcccagcagcgcagggccggcuccgaggaggcugcugagugcgggcgcccucgggauuuccuuccgagccauuuuagggacugcggggccggggcagccgcuuccugcgugccccagaccgggcguccagacagccccaaccaaccucacaccccaggccuccgcgcuuucugcuguguggacccggccgggaggagucgcgcccugaggcccucugugcuccccggguccacggaaaggaguaggggcgcggagcgcggguugcggggcggguggaggggccggccucagauuaaagggaguucaccucuccacagucaccccgcuuucccguuccaaucccugcagccccuacuugugaaccccccuuuuggggggguggguaguaugugccagugucuggggugcgcaagcugggaaaguuccgccggcgcuccgggcuuaccugaggccgggagaggcaucgccgugggcuaaccaccgacugcgggcgcugagcggaucguccguccaggugagaccgaugcccgcgacgcccucccccagcgggacugcgcagccgccgcucgggcuccgcggcccaucgauu

SEQ ID NO: 16921 - RNA, 6220 nt, Homo sapiens
cugagacggggcggggccugcaugggguccugagaggagugagugccgucaccgagggccgcgccagacugcgacggauacagggagggcaaggguuuccuuuuggcgcuccccuuuggaccccggagugaaaaacucuaacguccagaucaguggagagaaacgcagauuuaggacccugaggagucuuuuucacccguuucccgucacucgcucaggcgcgccgagggcaguccuugugggguccucguggccagccaagauggcugcccccgcagugaagguugcccgaggauggucgggccuggcguugggcgugcggcgggcugucuugcagcuuccagggugagaggguggcgagcagcggcgggggggcgcugcgaggaaggaagggggccacaggcaggccgcgugggccccuagagagagcauugcccugggggccggaguaucuggauucaagcuucuaaguuagcugcgugacccugcgccaauccgaagguuuagugacuaccucucgccuaaggagucuggcugaucuaggguucuaacgcggagcugaaagugcgguucagcuaaagagcucagaucugggaucgccugugaauugggauggguguguaggcgccaagcccauccuuaccguuagcacuugaccaggaggagacuuuacccgccugcuuggggaauguccuccuacuugggacaagggccugaauuguuguggcucagguuuagcucgcggucuccgcgccgcucccccucgucggcgcguuggcagucaugccuauuguuaagucaaaccuacucgcuuguggagucagcuuuugccugccuccuccuuucccccccucccaggcuaacucaggugagauggagccgcuauaguccugaauucaaggaucccuugauugacaaggaauauuaucgcaagccaguggaggagcuaacugaggaggagaaauauguucgggagcucaagaagacucagcucaucaaagcugcuccagcagggaaaacaaguucuguguuugaagacccagucaucagguuagauggaaacaaacacuuguuacauggacugggacuaucccagggaggguuucuggugaggauucugugauacagccuuggagagcuaaacguguugcuuuucucuuugaaguaaauucaccaacaugaugaugauaggaggaaacaaaguacuggccagaucccucaugauucagguaaacagcacuucccuccucagucaucuuucuugccccccuaccccguagccuuguacuugguacuuucaguguagcuuaagagcaaauggauucauguaucuauuauucagauuaacuucccugcauguguacgggcuuuaaugaagcccuguaagagucagcaacugccauuccuugguguuucggaaguaaacacacaauuaaaaaaaaaggaacaaauaaaaaauaaaacaacugccauuccccaccucaccccccacccccuccaugccacaaaucucaauccacucuuucuguccuagucuagcaaagggggaggcacuuaaaaacuuuguuuuggaugugcugugagaggagcugcauugccagcgcagaaccagaggaugggaguaaagggcaagguacuagcuuggcuggguaaacccuuuagggagccuggggcagccucuuccaccauauucuuuugcagacucuggaagcugugaaaaggaagcaguuugagaaguaccaugccgcuucugcagaggaacaggcaaccaucgaacgcaaccccuacaccaucuuccaucaagcacugaaaaacugugagccuaugauugggcugguacccauccucaagggaggccguuucuaccaggugaaugaauggccagggcaagaaagcagggcccuccacaugugaaacaagauagguggugcuugggaguugggucaagauugauagcuuucuagcuggugcagugggauugcaccuguaaucucagcacuuugggagccuaaugcaggauagcuugagcucaggaguuaagagacagcagggcaacauagggagaucccgucucuacaaaaaaaacaaaaaaauuagccaggugugguggugugcaucugugcucccaacuacucaggaggcugagguaggaggaucacuugaguccaggaggucaaggcugcagugaguuaugauuacgccccugcauuccagccugggcaagagagagaaaccuugucucagaaaaaaaaaaaaaaaaaacggcugggcacgguggcucacaccuguaaucccagcacuuugggaggccgagguggauggauuaccugagguggggaguucgagaucaacaaggagaaacccuguuucuacuaacaauacaaaauuagccaggugugguggcacauaccaguagucccagcuacuugggaggcugaagcaggagaaucgcuugaacccaggaugcagagguugcagugagccgagagcacaccaccgcacuccagccuggcaacagagcaagacgccaucucaaaaaaaaaaaaaaaaaaagaauugagacuguuacgguccacucaucugaguccuguagcguaaaaauuauaggcagaagguggaagagagugaagaaguaucuaagugacaucugggagcccaccucccuucgccuucuucugucaagcauccuguguguccuaaccuguaaaauucucauggcgagggacuauucauauccugucuuuguaugccaguguuuggcauagugcuugaccgauaacugaugcuucaucaguguuugcugaacaguacuagguaucucuuucauagcauuuaauuauauuuuauuguccugaguuuucuuguguucuccuuuuucaauaucaacuccaugggguagggacuucauuauugucugcacucucgugucuggcaugguacugacgcauagugagggccugacaaaugauuuuuggacacggggucuuguuuuugguuuucuuuaacuguuuguauagggucuuuuuguuuuuaacuuuuuuuuuuuuuuuugagauggaguuucgcuuuuguugcccagacuggagugcagugcuguaaucucagcucucggcucacugcagccuccgccucccggguucaagagauucuccugucucagucccugcccaccccaaguagcugggauuacagguggccgccaccaugcccagcuaauuuuuuuguauuuuuaguagagacaggguuuugcugugucugaagacugaaggggucuuguuuuuagguaccuauggucugagguggauuagucaccccagcuaauggggcuuuuccuauuugguucuuauaacaacuugguaggacuaccauuuaggagggaaaauggccagugcuuuucuucuuuuucuuuuucuuuuuuuuugagacgaagucucgcucuguugcccaggcuggagugcaguggugcauucuuggcucacugcaaccuccgucuccuggguucaagcauuucuaccucagccucccaaguagcugggauuacaggcgccugccaccacgcccagcuaauuuuugcauuuuaguagagacgagguuucaccacauuggccaggcuggugucgaaauccugaccucagguaauccaccugccucagccucccaaagugcuggaauuacaggcgugaaccaucgugccuggccuucuuuuuuuuuuaauauauggagacagggucuuguuauauugacgaggcuggucuugaacuccugggcucaagcgauccuccugccucagccucccaaagugcugggauuacaggugugaaccacagugccgggagaggccagugcuuaauuaguauuugcugaaugaacgccucuuaugucugcuacacuggggucaccugaaggugagggaagcucgaagaaaagacaggcccuucuccccaggccugaccagggcugguccagagggaacauguggcuacuccuuagaauucagggaggcaggaggccccaaacccuggcagacucuuggaccaacuugccuauguccugucucacccaggucccuguaccccuacccgaccggcgucgccgcuuccuagccaugaaguggaugaucacugagugccgggauaaaaagcaccagcggacacugaugccggagaagcugucacacaagcugcuggaggcuuuccauaaccagggccccgugaucaagaggaagcaugacuugcacaagauggcagaggccaaccgugcccuggcccacuaccgcuggugguagagucuccaggaggagcccagggcccucugccgcaagaaacagugugagcuacugccacgcugaaaacuaccuguggguuaaggauguaguuccuuuguaagggugggcaggccucguaagaaagauguagcagcauauucacuauccguuaauccuucuuucuuugaggcuggaacuugcucucucugccccuauuuccuuguaaagagggagcacauugacuugggaauuuccuccaggaaacucagggcuguuuucucuucccuuagguuggggcggaccuuuggauauauaaaggaagcaguuuuaguaucagaaaagauuuauuagaaaauucucacgcugaacugguguagcauguggugcagcauucagugaaacuggcuggaggaaauaggcuuguuuccagaguuguccuuauacaaaauguauaaaaagcaguuucuggugugacuugugcucugccuccaccccuugacaucccaaaauaucccaccaguggcuaugcuuacccauuuuacagauggguaaacugaggcaccaagguaguaguugcacuaaugguuacacagugcaguggcucuugggaguugcccuucucugccuggccgugguggguugugguggggaaaggggcucagggcaggaccacggcauaagugggaaacaucucaccaggagaugggaaagucuagaagggaagacacucaaagucuggaagggaaaagucuuugggugaggcagagacuccacugccagcuuuagagguggguagaagaaaggccagugcuggugaggaagcccugaucuggaggccuagucggagacuucgcuguaguaauacuugugggcagcuggcguugucuuccagccggccgcccggaacucaaugaucuccagcagcagcagcugggccagggagcugaggccaguugggagcaggaagccaucccggaucagcacaaagagcucauccaugcgcugcccauucauuuucuccagcugcuccccaacccggugcagcugcagcaccaaacaguccaccugcaggcgacaguguggguaacacaagugaacuggggcagugccagccucucacacagcauuugccaagugccaggugcugugcuuugccuuuacacucauucccuugcucccuccuuaccauccaguggguacuuccacaucuuacacagaaagaaaugaguuccgggacuugccugaggucccucaucuggccaggcuccacucaagccugucuccaaaccacuucuucaucccacucuccugccucccacacacugccugacccugguuuggcuuuggggccgucuguacccacagcuagccauggcuugcacagcugccaucauacguuggcuuucugacugagaaggaagcuacugagccaguagguuuuggcugcucucuauuggauaaacuccagaccuggcagcuuguccuauaacugacaggccuuaaacacccccacaguccugccccagaagugacacaguccucagagaccuccgugagcagugggcugacacacggcugagcuggacuguccauccugcagccuucugugcuugugccagggcuggggccacccaccuccuccuccuugcucaaacugucuggcugggccagccggaagaggcagucauagacaggguucaccagggccaucaugggcauguuguucaccugugaggaagaggaggggucagagcaccaggcuuaguggccaaggggagcaguccaaccugggccucaggaaacaggccaugucugccucccaggguggcugccggggccucacccucagguagucaaagauguugcagauaaaggugacauagcagacccagcccugcagggagcgugcucgcagcugcucccgagccugguacuccugcugcagccgguugagga

SEQ ID NO: 16922 - RNA, 6220 nt, Homo sapiens
uccucaaccggcugcagcaggaguaccaggcucgggagcagcugcgagcacgcucccugcagggcugggucugcuaugucaccuuuaucugcaacaucuuugacuaccugagggugaggccccggcagccacccugggaggcagacauggccuguuuccugaggcccagguuggacugcuccccuuggccacuaagccuggugcucugaccccuccucuuccucacaggugaacaacaugcccaugauggcccuggugaacccugucuaugacugccucuuccggcuggcccagccagacaguuugagcaaggaggaggagguggguggccccagcccuggcacaagcacagaaggcugcaggauggacaguccagcucagccgugugucagcccacugcucacggaggucucugaggacugugucacuucuggggcaggacuguggggguguuuaaggccugucaguuauaggacaagcugccaggucuggaguuuauccaauagagagcagccaaaaccuacuggcucaguagcuuccuucucagucagaaagccaacguaugauggcagcugugcaagccauggcuagcuguggguacagacggccccaaagccaaaccagggucaggcagugugugggaggcaggagagugggaugaagaagugguuuggagacaggcuugaguggagccuggccagaugagggaccucaggcaagucccggaacucauuucuuucuguguaagauguggaaguacccacuggaugguaaggagggagcaagggaaugaguguaaaggcaaagcacagcaccuggcacuuggcaaaugcugugugagaggcuggcacugccccaguucacuuguguuacccacacugucgccugcagguggacuguuuggugcugcagcugcaccggguuggggagcagcuggagaaaaugaaugggcagcgcauggaugagcucuuugugcugauccgggauggcuuccugcucccaacuggccucagcucccuggcccagcugcugcugcuggagaucauugaguuccgggcggccggcuggaagacaacgccagcugcccacaaguauuacuacagcgaagucuccgacuaggccuccagaucagggcuuccucaccagcacuggccuuucuucuacccaccucuaaagcuggcaguggagucucugccucacccaaagacuuuucccuuccagacuuugagugucuucccuucuagacuuucccaucuccuggugagauguuucccacuuaugccgugguccugcccugagccccuuuccccaccacaacccaccacggccaggcagagaagggcaacucccaagagccacugcacuguguaaccauuagugcaacuacuaccuuggugccucaguuuacccaucuguaaaauggguaagcauagccacuggugggauauuuugggaugucaagggguggaggcagagcacaagucacaccagaaacugcuuuuuauacauuuuguauaaggacaacucuggaaacaagccuauuuccuccagccaguuucacugaaugcugcaccacaugcuacaccaguucagcgugagaauuuucuaauaaaucuuuucugauacuaaaacugcuuccuuuauauauccaaagguccgccccaaccuaagggaagagaaaacagcccugaguuuccuggaggaaauucccaagucaaugugcucccucuuuacaaggaaauaggggcagagagagcaaguuccagccucaaagaaagaaggauuaacggauagugaauaugcugcuacaucuuucuuacgaggccugcccacccuuacaaaggaacuacauccuuaacccacagguaguuuucagcguggcaguagcucacacuguuucuugcggcagagggcccugggcuccuccuggagacucuaccaccagcgguagugggccagggcacgguuggccucugccaucuugugcaagucaugcuuccucuugaucacggggcccugguuauggaaagccuccagcagcuugugugacagcuucuccggcaucaguguccgcuggugcuuuuuaucccggcacucagugaucauccacuucauggcuaggaagcggcgacgccggucggguagggguacagggaccugggugagacaggacauaggcaaguugguccaagagucugccaggguuuggggccuccugccucccugaauucuaaggaguagccacauguucccucuggaccagcccuggucaggccuggggagaagggccugucuuuucuucgagcuucccucaccuucaggugaccccaguguagcagacauaagaggcguucauucagcaaauacuaauuaagcacuggccucucccggcacugugguucacaccuguaaucccagcacuuugggaggcugaggcaggaggaucgcuugagcccaggaguucaagaccagccucgucaauauaacaagacccugucuccauauauuaaaaaaaaaagaaggccaggcacgaugguucacgccuguaauuccagcacuuugggaggcugaggcagguggauuaccugaggucaggauuucgacaccagccuggccaauguggugaaaccucgucucuacuaaaaugcaaaaauuagcugggcgugguggcaggcgccuguaaucccagcuacuugggaggcugagguagaaaugcuugaacccaggagacggagguugcagugagccaagaaugcaccacugcacuccagccugggcaacagagcgagacuucgucucaaaaaaaaagaaaaagaaaaagaagaaaagcacuggccauuuucccuccuaaaugguaguccuaccaaguuguuauaagaaccaaauaggaaaagccccauuagcuggggugacuaauccaccucagaccauagguaccuaaaaacaagaccccuucagucuucagacacagcaaaacccugucucuacuaaaaauacaaaaaaauuagcugggcaugguggcggccaccuguaaucccagcuacuuggggugggcagggacugagacaggagaaucucuugaacccgggaggcggaggcugcagugagccgagagcugagauuacagcacugcacuccagucugggcaacaaaagcgaaacuccaucucaaaaaaaaaaaaaaaaguuaaaaacaaaaagacccuauacaaacaguuaaagaaaaccaaaaacaagaccccguguccaaaaaucauuugucaggcccucacuaugcgucaguaccaugccagacacgagagugcagacaauaaugaagucccuaccccauggaguugauauugaaaaaggagaacacaagaaaacucaggacaauaaaauauaauuaaaugcuaugaaagagauaccuaguacuguucagcaaacacugaugaagcaucaguuaucggucaagcacuaugccaaacacuggcauacaaagacaggauaugaauagucccucgccaugagaauuuuacagguuaggacacacaggaugcuugacagaagaaggcgaagggaggugggcucccagaugucacuuagauacuucuucacucucuuccaccuucugccuauaauuuuuacgcuacaggacucagaugaguggaccguaacagucucaauucuuuuuuuuuuuuuuuuuuugagauggcgucuugcucuguugccaggcuggagugcgguggugugcucucggcucacugcaaccucugcauccuggguucaagcgauucuccugcuucagccucccaaguagcugggacuacugguaugugccaccacaccuggcuaauuuuguauuguuaguagaaacaggguuucuccuuguugaucucgaacuccccaccucagguaauccauccaccucggccucccaaagugcugggauuacaggugugagccaccgugcccagccguuuuuuuuuuuuuuuuuucugagacaagguuucucucucuugcccaggcuggaaugcaggggcguaaucauaacucacugcagccuugaccuccuggacucaagugauccuccuaccucagccuccugaguaguugggagcacagaugcacaccaccacaccuggcuaauuuuuuuguuuuuuuuguagagacgggaucucccuauguugcccugcugucucuuaacuccugagcucaagcuauccugcauuaggcucccaaagugcugagauuacaggugcaaucccacugcaccagcuagaaagcuaucaaucuugacccaacucccaagcaccaccuaucuuguuucacauguggagggcccugcuuucuugcccuggccauucauucaccugguagaaacggccucccuugaggauggguaccagcccaaucauaggcucacaguuuuucagugcuugauggaagaugguguagggguugcguucgaugguugccuguuccucugcagaagcggcaugguacuucucaaacugcuuccuuuucacagcuuccagagucugcaaaagaauaugguggaagaggcugccccaggcucccuaaaggguuuacccagccaagcuaguaccuugcccuuuacucccauccucugguucugcgcuggcaaugcagcuccucucacagcacauccaaaacaaaguuuuuaagugccucccccuuugcuagacuaggacagaaagaguggauugagauuuguggcauggaggggguggggggugagguggggaauggcaguuguuuuauuuuuuauuuguuccuuuuuuuuuaauuguguguuuacuuccgaaacaccaaggaauggcaguugcugacucuuacagggcuucauuaaagcccguacacaugcagggaaguuaaucugaauaauagauacaugaauccauuugcucuuaagcuacacugaaaguaccaaguacaaggcuacgggguaggggggcaagaaagaugacugaggagggaagugcuguuuaccugaaucaugagggaucuggccaguacuuuguuuccuccuaucaucaucauguuggugaauuuacuucaaagagaaaagcaacacguuuagcucuccaaggcuguaucacagaauccucaccagaaacccucccugggauagucccaguccauguaacaaguguuuguuuccaucuaaccugaugacugggucuucaaacacagaacuuguuuucccugcuggagcagcuuugaugagcugagucuucuugagcucccgaacauauuucuccuccucaguuagcuccuccacuggcuugcgauaauauuccuugucaaucaagggauccuugaauucaggacuauagcggcuccaucucaccugaguuagccugggagggggggaaaggaggaggcaggcaaaagcugacuccacaagcgaguagguuugacuuaacaauaggcaugacugccaacgcgccgacgagggggagcggcgcggagaccgcgagcuaaaccugagccacaacaauucaggcccuugucccaaguaggaggacauuccccaagcaggcggguaaagucuccuccuggucaagugcuaacgguaaggaugggcuuggcgccuacacacccaucccaauucacaggcgaucccagaucugagcucuuuagcugaaccgcacuuucagcuccgcguuagaacccuagaucagccagacuccuuaggcgagagguagucacuaaaccuucggauuggcgcagggucacgcagcuaacuuagaagcuugaauccagauacuccggcccccagggcaaugcucucucuaggggcccacgcggccugccuguggcccccuuccuuccucgcagcgcccccccgccgcugcucgccacccucucacccuggaagcugcaagacagcccgccgcacgcccaacgccaggcccgaccauccucgggcaaccuucacugcgggggcagccaucuuggcuggccacgaggaccccacaaggacugcccucggcgcgccugagcgagugacgggaaacgggugaaaaagacuccucaggguccuaaaucugcguuucucuccacugaucuggacguuagaguuuuucacuccgggguccaaaggggagcgccaaaaggaaacccuugcccucccuguauccgucgcagucuggcgcggcccucggugacggcacucacuccucucaggaccccaugcaggccccgccccgucucag

SEQ ID NO: 16923 - RNA, 1304 nt, Homo sapiens
ugaguccuuauucuucaccuaaguggcacuugguucauauuuuuugcuugcugcugauaguaauggcaguuguuuauugaguaccuacuauaugucaaauauuauacuagacccccugcauauacuauuuuucauaauucuauagcuccucugugaaauagauauugucauuuccauucuaugaacaaagacacugaggcucagagggacaaauaauuugccaaggucauuggcguuugagacauacuggagcuaggauuugaacccggggauauuuggcuuugaauccugugcuuuuuuucacaaugggcuaggagcagaacuggcccuuuaaagacccugcuacggguuucagaucagacaguuaagaauggcugucucccagaaucccauguauggaaugaugggaaaacagagacucuuagaaaaauguccuguuccuggcugcccucucuguacugcugugguuccagcuggccacagagugauuuugccuuugcagcguuggcagaaggaguuaacaggcacaguccccaucuggcuccugguguuuuucccuguguggcaacgaucucauccagccccugcugggauggggugucauggggaccuugagcugcagucguaagcaggacuggggcagccugagucagacaguggccuuggggaggaguggauuuggucccucaggaucccauuucaguuggcgaccaaagacugaaugucacugcauugcaaggccacuuccagcgucacugucuguaucugagccuucgaggcuggcucagcuuugaaaggcagggguggaagagacgugguugcucagccuagggcaccagcaugggugccaccuugagaggaauugggcgggguuuuggaguggaguugguggcagaaccugggccuucugguuggguccuccggacacagcuuuuauuauuucuugacagcuuuuuucugggucaguucuggguuucugccuggcaccccuugacaaggcuugcuccuggcccccaaaagagcugucuuagucaguagguuagugcuuucuccaagaggagucgcuuggcaucaaaccagauugcucagugucacucuuuacucaaacacacccuggucugagaucauuagagugacggcugccaggacgggagggugagggcuggugaggguagguggggagguagggcaaaccucauuuuccagguaaccagcccgcuuuugucggaccuguugucagauugggcugcccaucguguguucaucugcucaggugccuguugagcacugcacucaaccacgug

SEQ ID NO: 16924 - RNA, 7539 nt, Homo sapiens
ggagagagggagcuugucuugucccugagcagcgcucucagggcagaggugaggcaccgggacaugaaguuggaggacaaguucccaagcagggcuuccucgggcucccccucgcgacgguaauuugacacuuggaucuccaggacgaccaacaacaaaaaagccaggcagagacagcagcuggcugucagcagaggagcugggcugaggcgcccaggggagcagcggcgcccacgaaggaaguacgaggacagcacguggaggcuccgcgcuggggcacugcugcucagcccccaacaccugagcucccaggugaguggcaauggccacagaagaaggggggacagggagggagcagcaaggguccccugcccccagggugaagggccacagucuaccauaaacacggagaggucuucggggacaugcugggucgcuucccugcagggaagucagccagccuccugcacacaccugcacucucccugcugcugggacccugcacuaggggagggcugggggcucugcucagagcgccuccugcuccgccugcugugcagcagaggggccccgagggccugcuuauucugcaaguucauuucagcucuuuuauucagggggcuuaaaagagggauuuggcuguccagcuugggagagaauggcugccggccugcugagccucccuuuuucccaggauuagggcagagcccugucgaggucagcgcagggucugcccagccagcaugcggcgcccccaggaugcagcaggacucugcccaucuguguccuuucaggggcuuggcccacucacugcugguguucucagcucacggcucagccuggguccuccucccugggcccaucuagaaccccauaaacuccuagaucucccucuggugaugagccuugaacaccaaaccaggaaccuggaggacugacuuucaacucaggcucaggugggcagaaggucacagaagugaggcugggagggaccacgcuggcaaccgggaccucugcugugccaccgugaugcacaggcugacaugacaccaccccuaaggaagcaggacccggcuguuugguucuuuggggaacacugagagcagcccuccugggcagggcccgugagccgaggcugccuacuccuccugccgcccuguccucaagccagcguuaaagccaccaccccccauauguuuuccucaaagcaaacaagcuggcaucuagugagaaacaaaaacaaugacccagggaaauguggaaaccaaggacuagcccaaguguucucagcucagcagaggcugggggcuucggcuggggcuggugucuggggagacaagcuccugcgguguugggaggcgcacaguagggaagagucaggccaggucggggucggggcacagcggugagccuggagaccccaguggcugucacucacaagacgccccaggcaggcagguggggaucccuguccugcauccacaggacacgaguggacagggucucuccaacacagucccugaaccaggacggagggugaaugaacagccagcuucuguagcugcagaaagagcgccuacuguuucuaacaccagcagcagaaagcgcuuccucccgcccuggguggcuacaggagcagggccugccagggguucaagcaccacuuucuacuuccaguuggagccagggcaaaaaggggagucacccaaaggcucagugccacaaauaggggcaucccccccggcugcucaggcacaggacccugcaaaucucccacaagugucaguuaugccuccuucuagguggaccucaaacgagauaaugcccaacagggcaagggugacuaaaacccaccaugacgaaacaacagggcagagcaagcagcccucuggggccccgcgcugccaacacaccucgcuuaucagucucaaacacgccgccugcugccagcccuuccucgugaggcgccugggguuggaguaucagcucugcgaggaggaaacagggaagcuucgggaccaaguggcagcugucuggccugcgggaugccugccuguugcaaggcuccgugugccaggagaugccacauaaaggaaugcuucccaucccuccggcucugccagccuucucugcccugaguguuuccccugugcugaccgcuacugcagccagggcacacccucugaaggcuccaagcagggcuggcugggcagccugggcagcaggagggccugguggcagcugggcuacacucccucuuaaggccagagggagccaccacuugcucuggcagccacucaggaaccccugaggacccugagaagccuccaaccaaggcacuacugagcgugggguugggagggacucugguugcccugguucgcaggugggcacuaccaagcgugggguugggagggacugguugcccugguucgcaggugggaagugugguuuuggaaggaguugggugaaccugagauagaaagacgggaaaaauaugggaucaucaguagcccuccugggcuucccugccuuccuccugccaaaccuaggaagggaaaggggaggagagguggccagccucagagcucccauguuccccucgccacagcugggaacacuaagguucccuuaggagcagcggcuggggcacaugccacacagucaccugacggcugcugguuauauugggcaccaagugucaggcacuccuuggccuggcuuuaaauagcccgcugggaagaccaccuggggaccggcuggaaugcgccuccuccucuuuagagaacaggaccccucagcucccccaccugcgccaugaagguucagucgcggguuuacgcuccaaaugacaagauaucaacugcaaaacaaagggggucccgggguuccucuccagcucucugggggcagaacagccacguccaacgguccuacuucugcucacugugugacaggauaccgugaguaccccugggucagacccuggggcugggugaggcuggccaugccuggcuggcaaauucagcuuccagucagcccccuagggaagcccugggcgcaaagcuaugacacuguccacagccgcagccugcugcugcugggaacugacacuuuuccccgcuggaggccgggguccacccggcaugagucugcagcucucccacuuugcagccccuggaggaggcuggccagagcuucucagcaacaaaccccacuuuuccugcaccaguaaauucagccucaguccaaccuuccuccucccuguucuggugagcacagccccaggucucucgcucacaaggaaaagugcccccugcaaucucucccugggucucuggguguggcacaagcgaaaaagcucucccugcccgcucccucuuugaaggagugucucugcugggcuacauuaggccgugugggcacagugccagucaggcugaaaacgccagaccaaguguagacagagagggaggggagaaaggcagcccagcuccugaaccacgcgcaaacugucccguaagggacacugucggcauugucgucccucuaagaaugagggaaccuggaaagcuggggcgugaggauggcacggaggucccggaaccaagaggggaccacuguccuugugcaagccugcuccaccuggccagagagaaugucccauucagucugaccagaggguucaguccuacacucaggcuggcuagacucacaagaccuguaccuguggugacaaggacuccagguagucucaaagagccugguguggccccggccugguggugauaugcugauaaaagcagcuucagauccacaaaugugggcuggggcuggccgagcacagccagcuggcuuccagggggcucucgggcccuggcuccuguacugagcccacugcacgggcaguacccucagcggggcugcuccuggcuaucuugcuggucuaagcuggagacaggccuccauggagagacagcguggggcaccagugggggugcuggcuggggcccuguccugcuguguaaccucagagaaguugcuugcucucucgggucucagcuuccccacguauagaaggaaggaggcgggagcggaugaucuauagcauucuaggacccuaugccucucaguacauuugaaaacugagauccucaccuccacagaaacgcacucacuccaggugaggugugagaagcuggguggaucuaacucagggaacccacggcuuuugacaagaacucaucuaauuuuccacggagccaucuucugccugcuacccucaucaucacuuaaaaaaacagcuccccaggccgggcgcaguggcucacaccuguaaucccaacacuuugggaggccgagggcggaucaccugaugucaggaguucgagaccagucuggcuaacauggugaaauccuguuucuacuaaaaauacaaaaauuagccgggcaugguggcgcacacucgugaucccagcuacucgggaggcugaggcaggagaaucacuugaaucugggaggcagagguugcagugagcugagaucaugccauugcacucuagcuugggcaacaagagagaaacuccaucucaaagaaaaccaaaaccaacaacaaaaacauagcuccccaccuccagcuugccuaccuuccuucagggcacacaccgcagacacccuaggacagacacccaaaagguguugggggugcuagugacggugcacgggggugacagcccccaaagccagugagacccgucccgggggggcauucucgugugccgggcaccccccuauggcugucuacaaugugcugcuagauggucaguccucccaauagccucaaaacacgggcaucucauuccauaucagagacaugaagcaaccuguucaugucacaaaaggaagaaguggagguggcauucaaggaggagcagcugaaaacacuagagcaggccccuggcagagaaggaaauccagaagguacaugccggcugccaucuugcuccugaagggcuacgaggcagaagagggggcaaggucuaagugaccacaagugggacuaacugggggccagcagggaguccgaccuucugcagugggugggcugccucagcaggcggagguuccucaccauccugggugcucaugcaaagaccacauggccucaaggauggccgcaggccaauugcaggguggagggccccguucgaugaccuucacggugguucuaaaccagcucugccaaggcagcggcaccgggagugacuggccucacugacguagccaucucagcgagaaccggcugagaccugggacaaggcaacgauaauuacagccaaaggucuggcaccagccccuggccaccuguccccaccaccaccccuggauuagagcaacugccuuggugaacuggaucaggcuggguugggacaagguugucucuggcuccucucuaaagaggcaccagcucccucaugcccacaggagaggcagaaggggaaagccuucuggaguggcaccuugggccucuugggcacccugagacaggaagaggcucuccuggggcaggggugggaguggagaggacuuuccuggucaggcuagagaaacagaugacgccagcaggggaggggcuggcuugagcaaccugggccuccugacccccucccaacagacaggacagaaacccuggcaaaaccuggagggacacggugcggccucccccucuggcagaacaggcaugaguguagaaacugggcuggugggagagguuggggggccugggggacaggggggcaguuuucaccucugacugacccuggccagaagccccaugaaccugcucucgggagaaccugcuccuucuguccccacauugauggaaggcaagaguaccagcuuggcauccuaucccagucuccccaccccgagggagcugugccagucccaagcacccaggcaaaacccaguagugguaccucaagacaagggaauggaacagcgaagccagaaaccaccaccagccgccgccuuggccggcagcccccgaagcaagcccuuggucucacuguccucaccggcuuccuccacccugagcugugucagcuggguggggacugagggccaccacuagguggaagucaccaggggugcaaugugugagaccugacaaacuuguucugcgggcugcggaugggugcgaggguggaaucucggugcugcgacgaguguggggccagccguggaggcuccagguguucucucugccccagcagagcccggcaggagccccaacaggaagccagcgcggcauggcugccaccgacuucgugcaggagaugcgcgccgugggcgagaggcugcugcucaagcugcagagacugccccaggcugagcccguggagaucguggccuucucagucaucauccuuuucacagguuaguuggggcacucagcaccccauggcucucccuggcaucugggagagaccacaccauggugccagccagagggcuggcagagguggcgggugucugccggaucaaggaggaaaaccaguugucccuugggggaagccaagggacuucccucauccucugauaugcugcuugggugaugggcggugcuggggacugggcccagcaguaccccgggaucccaaacgcggggaugacgggagccaggcuugggcagugaaagagaagacacaacauggaggagguuggcccuggcggcuggcauggggaccguccgcaccucucaccagccucucggaucuuucugaccuccaccaaaccugugggggaaagacccuggcaggcaguggguuucucugggaggagggugggcauccuuucucucccccaaccugagucccgugcucucucccggcccuccagcuacuguucugcuguugcugcugauagccugcagcugcugcugcacucacugcugcugcccugagcggagaggcaggaagguccaggugcagccgacaccaccaugacggacgggcgauggcugaggagaagcuggagaggagauggccaaugccaugacacaggccaucagccuggcccugcagcccuuaccccucaagaccaggcuccccuggccccagcucuggcccagcccagguaccuggacacugacaacuugagcccuaccaaggaaacaagggcugguauaggugcaaaccucucaucugccaguggacacugggugcuggggagucagcuguuucaaagacugggucaacugccugggcuucuucgccuaccugcacuuuuuaacaaaacaaggaaguagggguccccauaccuugauggagaacaguccccaccugugggcaauuggcccuuggggcucugcugauacaugccaaagaggagcaaggcaaucagaggggcuuugugcaauagcuucugcauccgagcucccgccagagcgugagcaugucaguauucuaguccaguauuugccaguuuccaaguaaaagcuuuuguguuacguguuucugcggugccggacucccugag

SEQ ID NO: 16925 - RNA, 7722 nt, Homo sapiens
cacgugggcuuuguaaauuuagccagauuuuucaaauagagaaacuguuucccuuccuccucccuaccuugucuucagucuacaaggccaauucuauagccggcuuaauaagucuuggcaaacuccuguuucacccauuccuauagaaaccuucugugguuggggccgggcgcaguggcucacgccuguaaucucagcacuuugggaggcugaggcaggcagaucacgaggucaggagaucgagaccauccuggcuaacgaggugaaaccccgucucuacuaaaaauacaaaaauuagccaggcgugguggcgggcgccuauagucccagcuacucuggagguugaggaaggagaauggcgugaacccuggaggcggagcuugcagugagccgagauugcgccacugcacuccagccugggcaacagagcgggacuccaucucaggaaaaagaaaaaaaaaaagaaagaaaaaaagaaaccuucugugguugggagcagagccuucccaucagcaaguggucuaagcaaaggcaaccccagcgugucccagagggccccaccaacuuccgcccauuuuucugauaaauugaguguuuccauucccaggcaggcagugugcccacggcaguggcucaguccuggccgacaggauacaacuaaaggaaaugugcuagcaaugggcuuucuccagggcucuccaguggggguggcuggcaucuggccucuggggugggauguucccaugcagcauuggguuuggaggcuuugcugagcuguugacagcucucacuccuagcccccaaccaugucucugucaaaccaacaucauuuuauucuggaacuuggagguauuuuauaaagguaauccagcauuguugcuuucuuggcaaccugaagugacucacauugaucucagaaaaccuuguuuugacuauuacuuugaugccuccacaagaggguuucuggaggauggcauagcaguuguucugaagcagcuguauugccugaugguuaagagcacaguuucaugggacuguugugaaaaaugagauucuuaauugaagagcuuagcauaauaccuaaacuuauuccccuagauugaguuuucauauuuuauccucaaugcuuggcccauugcuugguguauaaaucaugcucaauaaauuaucuguggaaaaaauaaaugaauuaacuauacaguaauuauuuuugucuuaggauuuaggagcauuaggcccaguguucggaaagaggaugcagggccagaugugguggcucacaccuguaaucccagcauuuugggaggcuguggcaggaggauugcuugagccuacgaguucaagagcagccugggcaacauagugagaccccaucucuacaaaaaauuuaaaaauuagccagccaugguggugcaugccuguaaucccagcuacuugggaggcugaggcaagagaauugcuugagcccaggaggucaaggcugcaaugagcuaugauugcgccaguguacuccagccugugugacagagugagacccugucucaggaaaaaaaaaaaaaaaaagaugaugcagaaagaugaacaaagaauuggguuugaaauuuuuuuguaauucagcguugguguccccuccccaccuucuccugccccuuggcagacuuuuauugcaagccuagcccuuuuguuagcugcucuucugcugccuguccgucugacauuucuagugaaucuacacaugaaacucacuguggaguugaccaggcugggagucugaaguuaaaacauaacagcugaagguagguguggaaccuaaacuugacagaagacaaacugacaguguuuggggugugugugugugugugugugugugugugugugugugugagagagacagagagaggucagugcuugagcaccuucuguggaccaggcugacuauuagacuuggugauuuuugugaguacacagaguagaguaguuugucuucaucggccaggugagcaugaggguagaggaaggcuucccugggcugggcugaggccuacacggggcuuucuaggcaggaguggggagaaggugauuucagggagcaggcauugcaaagauccugggugcagaaaggggaggaagaggcugaaaugggcagcagggaauccucaaggcucgugggccacagugaggaucuguuuuuaaggagcuauugugcucgugaagugagaucucaucaggccaugggcugucccaggucugagagaauaaagguuugaaaggagucauuuuacuaaucugccucccuagcugccacguacuuguaagaugcaagauuacauugcccaacaggaaacccccagucuguagcauucuugccuguggccucggggcuggcugcccugugccccuguucagagugcuuucucugugcccgcuacucccgaagcuggaaagaaaacaugacguuuagauuuggugggaucuagaugcuggcggcugccuuuguggaacucaaguuugacacuggagcuuuguggggccgguuccaggaaggauugaggaagcauuguuggcuguaaauaaaccuccauucucuuacucaggacuugguacuucucugcugaguaaauccucccagcucaaauggcagcuuguccaguuucgugggucuauauuguuguuacuuccuuccugcgcuccagucagcuucaucaauggcuggacuuuuguauucucugcaggaggaaccauauuccagguucuguaauucuugagaaccaggccccugccacugaccuacaguugcaucuuccaagucucagucacaguugguuaagaaaccaaauuggcagguugagaucacuauucuucuccagggacagcgcccagugugccgcagccgccuccugcucugguuguugggccuuuagucucagguggggucuggguggaugaggggugcaggcagaggaggagaccucggcucagauugguguccuccaccagcucagcguuuaaaccauacuuccucuuuccuccuuucuguuuucuaacuuggcuuuuguuuuugucuuuucguuuuuccuuguaucuuuuuuuuuuuuuuuuggagacaaucuugcucuuucaggcuggagugcaguggcgcaaucucggcucacugcaaccuccaccucucaaguagcugggauuacaggcaugcaccaccaugcccggcuaauuuuuguauuuuuaguggagaggagguuuuaccauguuguccaggcuggucccaaacuccuggccucaagugaucugcgcaccucagccucccaacucccccagccuguuuuuccuugugucuugauuggaauugaaugagggggcugaagaggugggccuagucuuuucucccaggagcagccuuccuuuccuaggugaggugcuuuguuuucaccuuccuuaggaacugggugaaaagcccucagccuguucuggcuguguguuguugcucaugucucugggcugcggguuccaugcccucuggcugauguagacagaugccuggugacuagacauccaggaugagcucauuacuuuaaccaacugagaauuucuaccugaaggccaguggguggauucauacgagucaagacagguguuuccugugcauuucaaaacgcugcuggcggggaagagaugaacagugcuuucuuguugcuuuuugcuuguauccucacagcccuucuuuccgcuuccugccucuuuaagggcauagugagaaucucccccagagcaggugguuuaacaccagugccuugaacgacuggcaguuuaauaaucgagccuuucuuccgucuccuuaauucugucauuuaaaauauuucagugggcgagaggugacuucuaucaauuaaaagauuucaaugggagggaggugaggaaugaaaaauuaccuaccggguacaguguucacuuucugggugauggguacacugggagcccaaaccuuacuuaucauuacacaauaauauauccauguaacagaccugcacauauaccaccaaaucuaaaauaaaauacuuuuuuuuaaauuauaaaauaaaucguucaucacauguuuuuucugacacauggcuggcuuccaugauaacugucaugggugcuugguccauuuuucauacuaaauaccuccuaucugagacaugacugguaagagggcaucucuuuaggccuguccucccugugguggaggucguuauagaggcauaucauuacuguuugaauagaggucacuuuuauuggaugaaacuugauucaguggaugguuguguguaaaugguacuaaaaagcagcucugggguauuucagggucucccugugucacccaggcuggagugcaguggcaugaucauagcucacugcagcuuugaccucccagacucaggugaucucuccucagccucccaaguagcuaggacuacaggcuggucucaaacuccuggacucaagcagucaggcccaccucagccucucaaagugcugggauuacaggcgugagccacugcgccugaccaagcgagcacuuuaggauccagagaacuuagguuguugucuuucuucuuuaggagaagcucggcacagugacagaggcacccagggcucagcaagcucauggcccagcuuguuggacucagagggcagaagaaucacauucuaaacaugauaagguauagccagcaggaggcagauucccagauugauucuccagagccuuguaggucccaagggugccuaugacaccaaugggaaucugaaccaacacagacagcacagucuucuuaggagacccuagugcagcagcgcuggccuccuccugagcgugcacgcuuauauggcuucugagcuggccaggcuacuucaugcauuugguuuaauggguccucguaaggcaggagaaucuucuugaacuuggaguugggucugugguccauuggucaguacuuuguucagaggcacugagggugggaaggcucauggagcuggauucugcugcugggaagcugggugggccuuguuugugggccucagguucaggacugaaugagaguccucuuguugcgaguugaggguguacucugggcaugccaugcccuuuuuuuguacuaagaggguagaaaagcaaagaccagacuaguuggcaaauuggaacccaacuacccaguuuauuuauuucuuaggcguagaaggaauaauuuagggggaacugaagagccaaccuaaaggaaaaaaauaaaauaaagggauaaaauacuuccugugauuuugccccaucaucucuuuucuuccagagacgugacucaacaaccucagcugagccuggcagcacacacaccccacacuccuuuccaucuccagguucacaaaagccacaagaagccacggggaggcuccuggccucuuacuuuaccuaaggaggcccugaaguggcaaguguguuuccccuugaagagccauugcauguuuggugacuaacuuccuguggcuuugggguagacaugguagacuccuuguguggggauugggccucugcaguugaguccaugagaaggggugggugugguauggugcggagccuuggggaagggugagugggggcuggagggagaguuaacgaauggucagucccuguaugaucagccagcuggcgggugagggaggagcugauguuuuccuacaaucagcacccagaaagcuguucucuagagggaaaaugugagggcauuuuacagucccauguauuguuacuaacacucuugaacacugguuuccugagagucacugcuacaaagggauuguugguccccugagagacuggcagucucuauagggcugcugauuuaugacugcggcagucucuauagagccgcugauuuaugacugcaaccugaaguugguguggcaguccuccaggcgcgccucccugccugcucccagccuccucuuugcccaccugauuggcagggggcaguggcucgaagagauggguugcuaagcagccuggccuggacguggugcccugccagguugaaugaauagcugcaguguucugaggaauggggaauuuggccugucccagcaucaggagggacuuucuggaaagggggcuaagacugagucuagguucaguguggggaacuggguggccuuccuggcaccuuccuuuuggagccguggcguggugugccaugucuguguaaguggagccugcggagcucugcaccuguccucgaaaaggucuuguugcagggucuuccugucucaucuccucccucacucaucagcaggaaaagacauggcguccagcaacuuucugugaacucugccucugcuguuuugaugaugagcacguguggcccuugagauuguugaucuaacuggcuuugaggggcugggugucagcaacccagaaaugggggaaacagguguguucuugccauuuuacacuugagacaauggaggcaagggaagacuugugacggagggcuuggaccguggcuuucucagcauugauuuugguuuagaugaaacauuuacuacagaacagugaaauccagaaaacgucuaagaagccuuugcucucagguuucugcaggacauguggauguagcugucaugggacacuguuugcauuagggauuggaggaagcuuuucuuuggagggaguauaaagccaguguaaagggagcugagagccagagagaggcuuccuugagccuggggccucucugggauccccauucugccacuuauuaaagguuugcugcaugcuugcucugagguuccaugagcugccccuuuauccucaugaugaagccucccuucuuugaacuaaaaauaagaagaguaucuugggagcagcuagucugcauuuucaucucgggagucugcuguuacaaagcagucaccucuugcuuccuugguaccagcgguagagguggugaugucugggcuggccgggcccuugagcucugcacuccauucaggcaagcuuccucagacccaggggagagcaacaggcaggguauacguugcccaguuggcugcagcaggcuugcuggcuuguguucuccucagcgaugguggguuuggucacugaaaaggcauggaggagagaccggcguggggcucgggagcauccggcugcugcgaugcgggaagaagaggguucggaggcucgggggugccagaggccccugaagcaucagcuuacccuuaguguuccuggcagugcuuuuacuuuuucuccuuccuuaaaaauccugaguggucucaguagagaguagcugguucaggagccccagucuuaccuccucguauuuguuugucuuuugcaggauaauacagaagcagaaaagcgagacccccaggaacucgugggugaguauugggggauccugggggcacguuucucagccuugcuccuagcagccuggcuuccagccaugccaggccugccgccccacagggcuucugucugcugugagcacuguugucccuuuggcucccucucagggcuuuggcauuuccuaggaugcccgggugagacguccagggaacaguucuucuuuggaaaucauauuugugguguguuuuaaugggcuuuggucgguugccagcgcugucaagagggaauucagggcacucagcugggagcgugucuuggucucugcuuccccuagugcccugggc

SEQ ID NO: 16926 - RNA, 9672 nt, Homo sapiens
gguccaguuauuucauuuuuacuauuucacauuuucagcaaacaaaucgaggugcaaacaggguuuauuucacauuaauauauuaacuggauuuuuugucaaauaaauagggaauucucuuuaaauaaccaucuccucacuucauggccaguccagggacaaacaagagugaauguuagcgcauccaggggcacaaagcuuaaggggaagaagcaggcuggggggcugguggcaggucccggccagcacacagggucaggggcccuuguucccggccccacccagcagccaccaaguggacagacaugcauucucugguuccagucaggaagcuccuucuagaaggaagugagaggugagggaaagcaaauuccagaaacaccagcaaaaggcagaagggcuuccucccagccucggcggcccugccccgacgccacccaagcccuggaagcucauuuuacagcuucaaaagucacacaggguggcaacaacaugacccaggacagggaagggaaggaaggguggcgggggcugcagcuggacccuggcugaguggaaugcgggcgcgguggccuucugagaccagcacagaccagcagagggaaugugagcagggucuggcagggcccgggaagacaccuggcuggucugaaguggcucaugaggcugaguguagcagugggugccagacugagggagcuggacugcgguggaggagguggccagagagucccuucgaggggagaagcugagagugaaacaggaacaggggaugcuccgugcucccagaagagccccagacggugagggagguacgcugggcagcacugugggcuccgggcuggcaugggaagcugggcggcaccucucccgaggccgggggcccuaaugucccacaaugcuaguuccugguaauuguuuaugaucagaccuggagggagaacaaggcgcccccuccccuccccaagccccagcacagccccgaugggagggguaggguagagagaugagggugggaggcagggaggcaggagggccuacugggucuucuuaucuuccgguggguaguagggagguggcggcggcuggcucuaaagaagggagaaaggagagacuugcauuagaagguuuaaaacauggugcggucaucccccugcggcucccagcaucugcggcuguggggcugcaccggcacugccaagcccucucaccgugggcauguagacguugugaggauugccuggguuguaauaggcgcuggcggcugcuucugcggccuuggcuucggcugugagagcaaacacaccuggugucggugacaaguucuccucccccugagcucagcuaagagaccccgggcccccauggcucggggcagcuggugcuggggguccaguuccaccaaugagagcagcaggugagguuuccugagcacaugccacgcgcuggcacgguccuuuccaggcccaucgcaugucucaccucaucuaauccuugagccaaugccccaggugccacugugaccgaccagcugaguguagaugagaggaucgagaggcacacagggugaccuuccccgcccagggcacauggauagcuaagggauggggguggggccagaaucuagcuccgcuccaccaggccacagcccugcugggccccugggguaguccaggggucauccaucaucugcggcucucagcagucucuggccauucugaggcucucugugcgacaucggggaggagagggcuggucccgaagggcugccagcacccaagggcccucaccugcaggaguggaggggacaucggggccgcugaccggagguuccaugggcccaggguagggcgguggugggggcugcacguaucccauggccccguccaucaugggggguccuggauagaacucugcucggugagagaguaacaaggacauggugagcacccggcugcggcccccucccgggugaggggggccucuccagcuccuucguugguccugaagcagcucaaggaauaaagucucccuggccuggggggagccuggguaggugggcucaugaggggagugggggcagcaaaggacacacucaccaggugggggcgguggauagggguagccaggagggcagggguacauuccauuggcgacuggcgggggauagacauaggccccgcugggcauguaagaguagccauaggcuccacuggggacuucaccucuggaggcuacgaguacaaggggaaagagaaaugagcguggccugccuuggggcggggagagggcagccccgcugccugcagaugggagcuacugggucucaggaaugugccccgcagacauccucuguccaucccacuccacccuccacccauacucggggggccaccuuggucagggaugagagaggacgggagaggucagagccaggggaaggcaagggaggucaagggcaaggcuggaggguggacagaggccgggagggaggcucagggcugggguaggagugagcuggcggaggaugucugcuggcccaucccucggucauuuucaauggcugcggaaccgcagucgaaugguugguuuaguguuuguuuuaugaggccauaguaaaguguccuugaguccaaacagcuuugucaaaacgucauccaccugccccaggcagggaaacgcagucucugagguacaggacagagcugaugccaaugacagcuuuccuucccaacuccuaggccuggucagccuggugcccaaacacuuaccucuugaguucuugaaaaagcaaaacgaaaaggaagcaaacucauaccaaaccccuacauguuuagugugucuuuagccccuaaucuucggagccuggauaccuugagaugccaccuggagcauccgcuguccgaacucaauggcgcccccugccgugaaagucaacuuguaggaagcagagccuucccagccaccugaaaggggaaggacagugaauaaacagcacaggaaaagaaaacuuaugcccaaagagauggcuguuuuccucuccaggacuucauccaacgcccgggaggccugcgggggcugggccugcacugugauggggacuuccuggugccaugguuuccagccugcugccugcauaggagccagcacugcagccuggccuggcccugcuguacucgcuucccccuuuggaacaauggccucuccuuccuggaacaagccuguccucccacccuuggcccaauauguacacgggugccaaggccacaucaagguuucucuccgcccccagucaagcacucggcagcuucacaggaacaagcccacucagcaacagccgaccuuaaaauucagagcagaccucucguccuaagggggcccaaggacagacuccggccccucuagccuggcuucugcccaaagggggaccaagagugucucaauagcaagggcgggccuggcugggugucaaggggaaggcaaguucaaugcagaggucucuggggccugccaaaaagccagccccaaagcagggugacucuggcuucccagaggcagcugccucuuccuggcucucaugaaaaggccccucucaagaaccugaugcagcuccuuccugagucuaaaauuuguaugcgcucgccaaguugcacuaagcaucuugacucaguccgcaggcuucugcagacuucacgcucugaaaagcugaucugagcugcugucuuucaugccagcauuuuccccaccucuuggcaaucaaaccccaccagcuggcagcccagagcugggaagaggucauggcuagggcgauaagggucugaaggggacgcccccacggcggcagucagagguucccaggacaccucccugcaggccccaugcgugucccugaguucccaucaccuaccucccgcuuccgccuucacuguucccuugauguaguuugcaccaaauacgggcugcuugaucucacagucuuucaugagauaaaauggcaucaugaaggacugcauggcauccuugcccuuggacagaaagaugaccugcagggagagagggugaggccaucaguacuagaagcacagcccacgcugccaugcuucccgccugcuuccugggagugacgaauccucucccagugccaggguccagcagccccauggcucucucugugccagacacuccuggagagagcuuuggaaagggaaagggcucaccgcagccuggagaggccaagcucacgcacacgggagaaaaacgugcuggucacagauaguaucuaugagcagggcagacugcuuugucacugacgugguggggugguggcaguguugccuaagugaaggggccuacgaagcuagggaaggacaggcagaggcaaggcagggauggguuccugaaagaggggggucuccagccugaacucuccagaacugagaaugauggugcaguaggucgcuagcucccauugaggggggcuauaaacagcaacaagagcucuccuggagccugugccuggagaaacccuuggguuuuauuuuuucuuuucuuuucuuuuuuuuuuuuugagauggagucuuacucuguugccugggcuggagugcaguggcgcgaucuuggcucgcugcaagcuccgccucccggguucacgccauucuccugccucagccuccugaguagcugggacuacaggugcccgccaccaugcccggcuaauuuuuuguaguuuuaggagagaugggguuucaccguguuagccaggauggucucgaucuccugaccucaugauccgcccgccucggccucccaaagugcugggauuacaggcaugagccaccgcacccggccccagccaggguuuuaaacccacgacuuuuaucugugacugaaggugccaaguugagccuccagagaugggguuuugagacucuccugucuuugugaagucauggagauuaaaacuugaaaaugugcuccucuucuuccagcugucuuugagucuaagucuuuuuuuuuuaggcagggucucacucuguugcccaggcuagaauccaguggcaugaucccagcucacugcagccucaaccucuccaggcuccaguuauucuccaccuuaccucucggguagcugagacuagaggcaugugccaccacacccagcuaauuuuuguauuuuuuguagagaugggguuuugccauguugcccaggcuggucucgaacuccugaguucaaguggccugccuaccuuggccucccagagugcugggauuacaggcaugagccuccgcaccagccugucuuugagucuaaaucuugaguagccacaggcagcaauccuuuuccaagaacauccauuuguauuucucaaccucucagaguccacguggguaacucucaggcagggcccauucugcagccuggcauuugucauucugcggggugguaccgggcucucugcccaguccggaggccgugccaugcaacuguacccuguuuacuggauuucucacucuggauacacacagggcuucaugggcuacucucacagaaaacaaaauauuaauaauaauagucuggccuccaggcccaagucaugccagcggcugcauccaacucuauagagauuuugcagcagcggcucuggaauugacauggguucacugcccaguggucaggucaguuacacaaagagccuggugauucuggaauccaggagcaugugacagagaaacaggcagagugaagcacuaacacucaccaggauucagaggccaccugacucaugaggcugaggcagaccugagacuaagacucacgucaccuccaacagcaacaagccucucaaccaacugcccugcugugcaacucacccgguaagggguaagguagacagugccuuucuuggucccuuugaaggcuucuggcacguucuucaugucauugaaugugaguuccacgugaucauaggacauuaggaugcugugaugagaaaagaggaaaagccucaaugagacaguauggagacgcgacgucacccagacacugggccuuucucccaagcagcugcccggcacgucagcucucauaaccucucaauagugcggcauuaaaacuauucauagggcugggcgcgguggcucacgcccguaaucccagcacuuugggaggccgaggcgagcggaugaccccuggucaggaguuugagaccagccuggccaacauggugaaaccccaucucuacuaaaaauacaaaaaaauuagccaggcaccguggcgggcaccuguaaucccagcuagucaggaggcugaggcgggagaaucgcuugaacccaggaggcagagguugcagugagcugagauggcgccacugaacuccagccugggcaacaagagagaagcucugucucaaaaacaaauaaauaaauaaagccauucauagggccaggcgcaguggcccacaccuguaaucccagcacuuugggaggcugaggcgggugaaucgcuugagccuaggaguuugagaccagccugggcaacauggugagaccucaucucuacaaaaaaacuaaaaaccaacaaaaaaacccauuaauauagccauggaagaaaugagcagguuggggguucuguaaaauuucccaaaccccgcuuauaaagcccccaaaugaucaacaugguagcagagcuacagggcucugaagaggccaucaucccucaagcaaguuagauaaucuggcuuaacucuucuauuuucuuuauuuuuuuuuuuuuuuuuugagacggagucucacucugucacccaggcuggcgugcaguggcgugaucucggcucacugcaagcuccgccuccuggguucaugccauucuccugccucagucucccaaguagcugggacuacaggcgcccgccaccacgacuggcuaauuuuuuguauuuuuaguagagacgggguuucaccguguuagccaggauggucucgaucuccugacuucgugauccaccugccucggccucccaaagugcagggauuacaggcgugagccacugcgcccggccaacucuucuauuuucuuuuaaguccuugugauagauguucuguuuuugcugguuuguuuuucaagccuaaaauauaaacaugucuaagagaugacuguacagaucacaauaggacguccuucgggguucuuuuaaaccuggguucuuaagcgggguuugcaggaaaguccaugaagcccuugagaugaucacguaugucauaugugcauuuuucugggaggagaguccacagcuuucaucauugucaaaggaguucacgacuugaagaguaacguucacuauuuuaauuauaauuuuuuauuuuuuugagacggaguuucacucuuguugcccaggcugcagugcaacauagcgugaucucagcucacugcaaccuccaccuccugcguucaagcgauucuccugucucagccuuccaaguagcugggauuacaggcaugcgccaccacgccuggcuaauuuuuuguguuuaguagagacgagguuuuaccauguuggucaggcggguuucaaacuccugaccucaagugauccacccaccucagccucccaaagugcugggauuacaggcgugagccaccaugcccagccuaauuaucaaauuuuggacacuggacuuaacacuucaauuguuauagauacaacuuuuucagacagcaggcugaagcacuuucuaaaacagcaggcugaaggcacaccuuacuuagcaggacugagcccuaagccagguagaaggccgagcaggauagauacauucuugucucagaaaguuccacagagacagaaagaaaaacaguccccagagauguugccaaauggcacgaaaagcuggccaggccugggaacugacucacacacagagaugcaacaaaacagugugaggugucucugauuacaugauaaaaagguucacacgguucuguuugucuucugccuccccccauauaucacaacuuucucugacuggggaaggguaagugggaaacaacugguauaagcaaaggaaaauggcugggcgcgguggcucacuccuguaaucccaauacuuugggaggccgaggaggguggaucacgaggucaggaguucgagaccagccugcccaacauggugaaacccuaugucuacuaaaaauacaaaaaauuagcuggguguaguggcgggugccuguaaugccaacuacuggggaggcugaggcaggauaaucgcuugaacccaggaggcggagguugcagugagcugagaucgugccacugcacuccagccugggcgacagagcaagccuccaucuaaaaaaaaaaaaaaaaaaaaaaaaaaaagagaagagaaguacugcucagagaaaagaaggaauuaccagcaacaggcugggcccaugaaacucugagcggguaagauagagggaaagugagcaugcugggucacucuaggcauuuuccucugacucaucaaacauucccaagucacagggcagcuggaugcuggccuuagcuggguacagggcucugacuccacgaugucuccuuuggggacucaggugccuccuaagcuccuucugccuucaagaggcaauucagggucggcauaguucaacccagggcuggcuggucugauuuucaauacccaaggaacaaaaggagacagaggccauuuaaggcuucucuuggcagagacuggaggagagacaggaugcaaugagcaagggguggggaggauggaguggaaagaaccuugaauuaggagagcucugccuuccgaggugacccaaaccaacaggcauucaagagagaggcaagggaaugacuacggacccacacagugccaggaacuguuagacaccugacaaacgucaucuguuuaauuucaccucugggaccucaguuuuuuaccgggaaccugaacaguucuggaacauacuggaagccuguaugcuggugguuaauccuauuaacuuuggagucaagacuccuuuccuggaauuaccaccucuguuacuuacacaguugcgaucucgggcaaguuacuuaaccuuucugcccuccacuuucccuaccugugaaauguggacaguaguagauuauacugcacagaauuuauuaaauaagguagaaaaggcgcagagccugacacguaguaacguuguagacauccaauaagugacaauuauuuuuguuuggggcuccucccagcuacugaaaucacaagucugggaagggguucaagaaucaccccuaggccccaccgggggccccauaccagguccccaugcagacgucccacccccgccucccagcugaucacaaccucccgggcucucccccacggcccacccaccuuccuccaaccccgcccccagccguuccccaccaaccucacuccaucagugcucccucuucaggggcuuauuccccaccacccaccacccaccgcccacuuccucgacacccgaacuuugguccuccaggauccuuccgcaguguuuucaccucucgguguuauugacgaucacuccgccgcccuccgagugauucuuguugagcgccauagucucuccaacaggggucccgagacucaaaacgcaaugagcuugcgccccucuucgccccgccccuagug

SEQ ID NO: 16927 - RNA, 1160 nt, Homo sapiens
ugcagaauggccucgccccugggggagcugcagggcaugcacccgggcugcucccaggcucguccacgcucugcccaaaugaccaaguccacuucuccgggugggaggcgugugggguucucuggcuccccaccgcgguccuuuggggacugagccgccggcucuccugcagaagcaggucugcgcaggccaguacgggccgggcauggcggagcuggagcaacagaucgccgagcacaacauccugcagaaggagaucgacgccuaugggcagcagcugcggagccucguggggccgguaggugagccuggaggaugucacauccggggccagccccagcccguuucuccagucagagccggagcuagaucggcugggcccuggggauaggggugggugggguauggcuggcccagaucuuagggggccgucucccugcaccccaccucucacgggcuuguuucuccccuuggucgaggcaggaugcagccaccauccggagccaauaccgagaccuacuggugagcaggagggagggucgggcagggaggcugcgggugggccuggguggccgcccggacccugcccggggccaguguuccugagcgcggcccaauggcgccuuuugccccccacuuucugucuccccacccugcugcuggcggcggguccugagcacagaaggcggcgucguggcgcgggcagagccugggcagccuguacacgcaccuccagggcugcacgcggcagcugagcgcccuggcugagcagcagcgccgcauccugcagcaggacuggagcgaccucauggccgacccugcgggcgugcggcgggaguacgaggucggcuggcagaggucggggccaggugggggcggccagggccauccggguccucaccgccgcuccccacccgacucgcccccagcacuucaagcagcacgagcugcugagccaggagcagagcgugaaccagcuggaggacgacggcgagcgcaugguggagcugcggcaccccgcgguggggcccauccaggugcgcuggggcagggcgagagugagaagggacguggugggcggggaaggggggagguggggcggacguggggggggcgugguccgagggcuccaugcugccguacccaggcccaccaggagg

SEQ ID NO: 16928 - RNA, 3243 nt, Homo sapiens
ccccuccugagaggaagcccagcccacccucuccucaccuccugggcucugcuucuagacuuugucuuguccugccccaagcucauuaugaggcagagcucagcccuacaagacucugccccacuugucuuuccaaugauggccacaaugggggaggaggagcaggcaggccccggaccccugguguggacagcguaagaggggugagugagauggggccugcccuggagcuccugaggccuggaggucauccaucuggggugacagagugugaucuacucuggggcuuggccccugaauccccauccucucgcgggggcugcaggggagggacucacagacaaggacaccccaaccucaugcccagcucuguccuccaggaaugccuugucuucccugcaaagucaauuccacagccuucgcucucucccaacccuaaggaaacagucugacugaaccacacccacccacaugguccuucucaccuguccuugcagaggggcaguguccaaaauguguauguugcuggguauaguggcauaugccuguagucccagcuacucaggaggcugaggcgggaggaucacuugagguuaaagugagcuaugauggcaccacugcacucccgccugggcaacagagugagacccugucggaaggaaggaaggaaagacggaaggaaggaaggaaggaaggagggagggagggagggagggagggagggagaaggcccauaaaaugcacacauuuacacacauaugacuggaagcauggcccugacagcacacuggacacaugccacauucccaggaugcggccccucucacacuuacaaaggugcauuugcauuuuuuuuuuuuuuuuuuuuugagauggacucucgcucugucgcccaggcuggagugcaguggcgcaaucucggcucacugcaagcuccgcuucccggguucacgccauucuccugccucagccucccgaguagcuggaacuacaggcgcccgccaccacgcccggcuaauuuuuuguauuuuuaguagagacgggguuucaccguguuagccaggauggucucgaucuccugaccuugugauccacccgccucggccucccaaagugcuaggauuacaggcgugagccaccacacccggccuaggugcauuugccucgauggccgagaacacccauuucccagaacccucaggaccacaaugagcccagacaaugggaaggggaggguaagcagacccugagaacagaauggaagagguagcagaggccgcgccuuccaaacugcgagccccagcccuugcugcaguggugcagccccuggccgauggccuuucugggucucucccuuccugacuucguccuccuguauauagacuugcccugacucugugaagaucaaagccuccaagucgcuguggcuccagaaacucuuucugcccaaccucacucucuuccuggacuccagacacuucaaccagagugagugggaccgccuggaacacuuugcaccacccuuuggcuucauggagcucaacuacuccugugaguccuuaacccaggggaaggugugggugcgcaguaggccggggcagagggcagagggcagcuggcuuucuggucugccucuucccugggguuugccagaccugggaggaaugaugggucggacuccugucccucccagggcucugaauggagcacccccacucuuguuccaguggugcagaaggucgugacacgcuucccuccagugccccagcagcagcugcuccuggccagccuccccgcugggagccuccggugcaucaccugugccguggugggcaacgggggcauccugaacaacucccacaugggccaggagauagacagucacgacuacguguuccgguaagcuguccccacccaagcucccucuccagccccucuccugcccccuccagccccccuccagccccucucuugccccucuucugcagacauggacucuucugagagacccauaggauguuccacgccugcaucuggaagguggaauuccugggcucucgagagaauuuccgcacauaacugcugccucccccauuucuccuuccuuuccccauccaccuacacaaaucucccuccucugcucaccugucccgucugauugugucuuucugcacagauugagcggagcucucauuaaaggcuacgaacaggauguggggacucggacauccuucuacggcuuuaccgccuucucccugacccagucacuccuuauauugggcaaucgggguuucaagaacgugccucuugggaaggugagcaaagaggaaggagccuggccacacccagacucuggaugagggagcacaggaggugagaagggagaggagaggcuuucauccggauggagucugugguugguacaggcuccccuccuauaagggcaggaguggggaggacagucagaccaguccagagcagagcaagugggcagucggagucagagcugggccacccucgguggugguccugaaggcaguacuuuuggaccacucccuguccuugguccucaggacguccgcuacuugcacuuccuggaaggcacccgggacuaugaguggcuggaagcacugcuuaugaaucagacggugaugucaaaaaaccuuuucugguucagguacccacuguccuccugccauccccuuaucccaggcugagccaugucaugaguggcucuaaaggguuggacagguggggacagccuuagcuaucaccuggagaugggauaccagucaugcucaugacccugacuuggcccaccccagaccagguaagggagcugagucugaaugaccccuuccuaaccacaggcacagaccccaggaagcuuuucgggaagcccugcacauggacagguaccuguugcugcacccagacuuucuccgauacaugaagaacagguuagagcagaaagcacgugacacguagcccaggucccuguuauccuugcagccuccugacaguuggggguuuggggcauuucacagguuucugaggucuaagacccuggauggugcccacuggaggauauaccgccccaccacuggggcccuccugcugcucacugcccuucagcucugugaccagguaaggcuccacugcagcugcagaaauaccuggagaaacagcuccugggcuauuccugggccuguucagcauaggacagugcaugggcugggugcc

SEQ ID NO: 16929 - RNA, 35070 nt, Homo sapiens
cgggcucccucggggucccagcuggcccgcacucggcggccgcggcgcgauggaggcgccggccgagcuacuggccgcgcugccugcgcuggccaccgcgcuggcccuucugcucgccuggcuacuggugcggcguggggcggccgcgagcccggagccugcccgcgcgcccccggaacccgcgcccccggccgaggccaccggggccccggcgccgucccgccccugcgcccccgagccggcggccucgcccgcggggccggaggagccuggagagcccgcggggcugggggagcucggggagccugcgggaccgggggagcccgaagggccaggggaucccgcggcggcgccagcggaggcggaggagcaggcgguggaggcgaggcagguacgcaccggggcccucgcggcccccuccccacccccggggcuccggcugccgcugccguuccccgccgagccagggagcggggccgcggccuccagcccaggcugcccccaggaagcgcagaacccgcggcccgcaggaaaugcaggucccgccaugcuaagccgcagccccgcaaacucgccgcccucccccagaaaguguggcgaggggcgagcccgaaggaguuuguuuggagguguuuugcucuccccuccccucggccucucccagcccagggcgugcuccgcagcugcuggcucccaggccucgggaccagggcuuggaauuuugcuccucacccacuucugaccccucccgcccaccgguucccaaauccacgugccuguggcuuauuuccaggccugccaugagaguuaucuugauguuuaaaaaguaggacuuucggggggcgagggaggaaagcuggcuuuucuuuuucagccaauuugaaguccagauuucagagucagugcuguggcguuuugugaagcccgugggcugggacugaaagaaaaggcacccgaucccagcaguccuuuuuauugucguuuucaagcuacacaucuaacacccuccuacccccacucccccggguuguagguaagcugggccuggauggagugaagaugcaggauaaagcccuccuggagcaccagugagcaccccaaagcggcccucccugccucugccccaggccucccgccaugcuguccaucagcucggccuuggccaccuuguccugccuguggauaucugagaggagucggauuucccucauccacucaucccagccccuacacugugugcccauguucccuggaguucaccacgcuuggccgguccaggccaccgccagggucuccgagucggauuguaaucccuuguucuuaccccugagcuccuuuucuuggaagggaggagagccgggaugcgcauugucagcgugccugcgugucugcgugcccacucuguccugugcuggacacaaugguuuacccuggagagaagcccuucgggggaggaggaggcagccaggcugugcucagaggcauuucucuuugcugaguaagugcgccagacccccucugagcaggcgcuuugcuugacaagugggugacuaauugugucauuagagaggauucuaaccagccacauuuaaugggguggagcaggggcaggcccugccguucuugcuuggggugggcuuccagaccucacgcggugaugguggagggggcgcgguuuggacaugugcugaucuguuguguuugcucccauauuugggauuccugccuccaucgaggucucgcgggagcaggagaggccuuuagacaguucuggagccgucaugcacacucagucaguccuggccuuacagggcuggcccuuuaucacccacaccaggcucuggacugaagugcaaaauguccuuuagcggcgcccugucuuagcucaauccuguggggcacagcgcuuaaagaacuuucuacaaggcuuucggcucucagcacaugguaccuacaggaauagguucagugguguuuaaauagggccacucgcauaauuugccacugucugggugaaugcacguccucugaagcugaaugggugcucugaaggacaaggcaguauggggguucgcgugccaggcagcccccaugacauaggugccagugaggaugacuugaggcuugugucuguccucccgcuaaggcacccuccagagagaacccaccccacaggagaauucaauugaagucagugcccuuccccuuuggguucaaguccccaggccuuccugagcuggccaaagcucccccaaaacuccugccugcaaacauuaagccaggugcuguggggacacagauauugugucaucccacccacucccagugguggcauuaaccuaagaagcugcuuagaaauugucuugaugagcuucgagucagugacaagaaaaaaaagaaaggaaaacaaauuguccugaaguggacuccagcguuuccaagagcuuccagugcuuucuucugaugaucacacugcuggggcuuggaggacagauagggagaaaggcccccuggggaagauaacucaaaucaggguugggaaguggggcuaugcccucugccagccuccuucucccuccgucccuaagcgaaccccaccaacagcgagggaggagggcaacuccaccugcuguuagcucggaagucacugcccuggggagcagcguguaacucaccucuccccucccucuucauuuuccauuaacugccuccuuucuaauccaguccucucccuucccagggaggccugggcgggcuggggcagcugcugccucugacuacaaagcugauuauugagaaggaucucucgccccgggaagcagccuucagcugcuauuggggaucgcucaggagcguccccuagugcacggugcccucuuuggccaaggacaaaguaguggggaggggcuacuauaggccgagacccuggaaauggaccaaagaaauggggaugagaucagugcagcucuugcuuccccagggcagcacaggccagggcagggaggcugaggagaagcggaaugauacugcuagaaccucuuuucucuccuaaggauuagcacagggugggcugugaggaagcauuauaggcaaggccuguucacgcaaagaaucaugagccaacgaagucaagaacaggagccggccucuuuucaggccaggacucagggcuuucuuggugcuccuguguagguugggguuuuaggauugccaggccucuuaccuaauggacuuguggauuggagcaaggcuggauggucggauucccaaacauugguaauuggcaaagcgucaagggucauuugaauagcacuagaguuaaauuucuugucugugccaggacucaaguaucucgguacuuggggccuagcucugcucauagacagacuagagcccgggcgcgauggcucacaccuguaaucccagcacuuugggaggccgaggcaggaggaucaccugaggucaggaguucgagaccaaccuggccaacauggcgaaaccccgucucuacuaaaaauacagaaauuagccaggcaugguggcgugcacgucaucccaucuacucaggaaacugaggcaggagaaucacuugaacccaggaggcugagguugcaguugagccaagaucgugccacugcacuucagccugggcaacagaacgagacuccaucucaaaaaaaaaaaaaaaaaaaaaaaaaaaaaaagaguagggacuuccugcaaggcagugggccggugucaugaagcacacagagacucuucuagauuuaauugggauuuaggagauuaaagcaauaugacaaauaaauacaaucuugauccuugauuggauucuccaucagagaagggagcuauaaaggacauacuggagauaauugagacauuuuuuaaaugaauggcuguguuagguaagcuuauugaaucaacgcugaauuuuuuguguacgauaccggcagauggcuguguaaacaauguccuuauccuuaggaagaugcaggcugaaacauuuugggaugacaugucaugauucaaauaguuacaugcacacacacacacaguguguguguguauagagagagaaugcaaagauggcaaaauguuaaccauuggugaaucuaggugaaggguguaugguauucauuguauuauuauuucaacuuuucuguagguuuggaauuuuucaaaagagaauguuggaacaaagaagccaacauucuucuuugggaaauuucuugggaaagggguugguuuuucagacacucuggaggugguggucugaguggguagcacagccuucaucugucugucuuaaccaugugacuuggcccugguuccccugaagucacccugcugucagguccaccuguguccucugcccucaccaaccuguucaccauaggugugggcucuggaagcuacagagaccccagccuucccagaaugacccaggagcaggugaacuuccccaucaucucuccugccuuugugauggcagugugguccuuuuugauggcagugugguccuuuuugauggcagugugguccuuuuugauggcagugugguccuuugugauggcagugugggccucugugacggcagcgugggccucugugacggcagcgugggccucugugauggcagagugggccucugugauggcagcgugguccuuugugauggcagcgugggccucugugacggcagcgugggccucugugacggcagcgugggccucugugauggcagagugggccucugugacggcagagugggccuuugugauggcagcgugggccucugugauggcagcgugggccucugugacggcagcgugggccucugugacggcagugugguccuuugugauggcagcgugggccuuugugauggcagcgugggccuuugugauggcagugugguccucugugauggcagugugguccuuugugauagcagagugggccuucgugauggcagugugguccucugugauggcagugugggccuuugugauggcagugugguccuacuuucuguucucuuagcaaaaucucagaagccaaguaguggagggccaaguagauauuugccaguuguuuauaucacuuuagguccuugucuuuaagcagcuuaggcugauauaucaaaauaccacagacuggguugcuuaaacaacaggcauuauuuccuacacuuuuggaggcugggaaguccaagauggagguguuggcagauucugguuuuggugagggcucucuuuuuggccugcagacagccaccuucuugcuguacuuucacaugccagagagagagggaugucucuuccucuucuuaucagggcccucauagcauuguagggacuccaccaucgugaccucgucuaaaucucaccucccaaagacccccaccuccagauaccaucacacuggggguuaagacuucaacagauagauuugcaggggacacaaauauuuaguccagaacaggcccagugacuuacuggggaaaaaacuagaaauaauccaaauguucauuaauuagcacauuggauucauuagcaaauuaguaugaaauaaguaaaaagguagaacauaaaauauuguauucacaauaacuauaacgauauagagcaacugaauagaagaugccuuggagggcuguaaguagaguucccuguucaguaguuccaguggguauuuuuuuguaaaguuguuugagugccuaacuuaauuuuuuuccauauaugaaagaaguccaggggcuuuccuaauagauaaacuuuguucuuucagagagaaagagccuugguuacagacuaaugucagcuagaauuuucugcuuagcaagaaggaguauguuuuuaaagaauaugucuugagaaaaaaagccaccuagcuuuggagagcuagaaaugaaauggugagcaugcagacaguuuccuuuuuguagccccgcucuuucccacucggcucaaaccacacugugggaggagggagaccagcuugggccucugguaaaccgucuuccagagaaaugccagaucccugaugguuaggaguauuucuggaacaaccugcguuuggccacacugggcuugccacuguuaaggacagauguauggaacaggaugaggaggucagguucagaagccccuucucuaaggggaccucaugcagaacuguuuccagcauucuuuuuuuuuuuuuuuuuuuugagacggaguuuugcucuugucgcccaggagugcaguggcgcaaucucagcucacugcaaccuccaccuccuggguucaagcaguauuccugccucagccucccaaauagcugggauuacagucaugcaccacuaugcuuggcuaauuuuuguauuuuuaguagaggcgggguuucgccauguuggccaggguggucuugaacuccuggccucaaaugaucagccugccucggccucccaaagugcugggauuacaggcaugaaaaaaaaaaaagcuggccgggcgcgguggcucacgacuguaaaccuagcacuuugggaggccgaggcgggcggaucacgaggucaggagaucgagaccauccuggcuaacacagugaaaccccaucucuacuaaaaauacaaaaaauuagccgggcgugguggcgggcaccuguagucccagcuacucgagaggcugaggcaggaggauggcgugaacccgggagguggagcuugcagugagcugagaucgcaccacugcacuccagccugggcgacagagugagacuccgucucaaaaaaaaaaaaaaaaaaaaaaaucugaaggaagcuggagggugcugcagcagucauucuagucauucuauucccugcugcggggugguagaagcaaugcuaucuucuuuuucucuuuuuuuggagacagucucccucugucgcccaggcuggagcgcaguggcacaaucuuagcucaccgcaaccuccgccucccggguucaagugauucuucugcuugccucagccuccugaguagcugggauuacagguggccaccaccacgcccggcuaugaugcuguuuucuggacacaggguuacauuggcuaaaacaaugucugcaugagauuugauggcccagagaaaacccauugcaggacucacggaaguuguuuaucuucaaauguugccucugaauugccauagaacuuacagaagugauuguccacuuuccaggcaucagcuccaguuuuuuguuuuuuucaauguauucuuuuuuuuuugagcuaggaccucagcugguccaaugguguuggguuaucagaacuuguuaacauuagugucacuaaacuugauauacaacccccuacugcuaaaguuaacuggcuuuaaaaaacaaaaaacaaaacagagucucacuuugucgcccaggcuggagugcaguggcacaaucucaguucacugcaaccucugccugcuaggcucaagccauccuccuaccucagccgcccgaguagcugggaccacaggcacgcaccacuaugccuggauaaguuuuguauuuuuuguagagauggaguuucgccauguugcagguuggucucaaacugcugagcucaagcagucugccagccgcugccucccaaaaugcugggauuacaggugcgagccacugugcccaacccuucagcuccaguuuuguggccuguguauguguguauuuaauguuuucaagugagaacuccuugcgcacauuuauaacccgcugaccaaccugaccucugggugagacaacccuggcagauucucagcaagggccuucuugugugauguccuugguauucaucguuuuucuccuggccugauucuuauuugcugaggacucagagucugagauaaaucuugcuguuuugagacaaggucugguucugucacccaagcugcagugcaguggugcaaucucagcucacugcaaccuccaccuccugggcucaagccauccucccacuucaagagaagaaaaugcccccagcccagugguguucugcuggagaucagcaggaaacccuacuccauagucaagucagccguuagccuuucaggaaguucuuccuauggugaggccuccucaagauauauauauauauauacguauauauauauauuuauuuuaagagguagucucgcucugucacccuggcuggagugcaguggcgcgaucuuggcucacugcaaccuaccccucccagguuccagcgauucucuugccucaggcucccaaauaguugggauuacaggcaccuaccaccacacccagcuaauuuuuguauuuuuaguagagaugaaguuucgcguguuacaggccaggcuggccucaaacuccugcccucaagcaaugcauucgccuuggccucccaaaguacugggauuacaggcauaagccacugcgcccggcccucaagagauuuuaaaaacugaccacuugucuucuucuucuucuucuucuuuuauuuauuuauuuacuuauuuauuuagagaaccaggcuggggugcauuggcacaaucauagcucacugcagccuugaccucuugggcucaagggauccucaugccucggccuccuaaguagcugggacuacaggugcacaccaccacagccagcuaauuguuaaacuuuuuguagagauggugucuugcuauguugccuaggccuggucucgaacuccuggccucaauccaaccuccugccucugccuccugaggcugugugauuacagaugugaauugcugugcccagcccuuaucuucuauuacuauauuucaagcuggucauggucaaaauuguucaaccugguuuucccccauaaaauuaagucacuuucuucaacccucuuccaucagauuuuauucaucucuuaguuuucuucucuguccuauauuuucucuaucucaaaauguagcaccuagaauucgaccugauauucccugauagggguugcggagaguacagauugcugcccaagaguguuuuguuguuauuguuguuuuccuuuuuuguuuuuuaaaugaagcuuuugguguccucuaaauccucuuuguaggaacuugccagaaacuguuaaaucugauaggauugaaucuggcaugcuccagucaucugagcaagaguuuguuuagggcuugugaaugugcccuugaucgggaugugagguuggaaugcaggacgaugcuuuuggucuggacauuggaacgcagcagucggcccugggcagggguuggggcccggauggggucggcuccucgcaggaacagugauccugucucuccccagacaccccccacccacaacauacucccuccuugucugcggcuuacccagcacacucccucugcucuuugcccugcuggaagagcucaugcccauaauaucaacugcaggacuccuggaccaggccugccuugcugccuuccagaacacaccugccgcccccaucccccugaucaauagcugauggugcccacaucuauacgcccagcucucgccuccccugagcucccuggccuguggguugucuacgugcaccucagcccaacacgcugacaagugccucauuucugcugccccuccacccggcauuccucaucucaucccggauccacccccccgacgcucagcugcucagaccaaaagcccagacauguccuuguuguccccgccucccucacgcccugaagaccugcugucugcaauucuggucaccucucuccagaguguguuccgagagcagcccucccuccucucaucuuucuggcuccugcuucgguggcuguucagugaccuccucacuggucucccuguuucccguccuccccaccccugccaggcucuuccagcaaccagcaugaccuuccuagcgcagagagcacaccccccggccccugcucacagcccuccgcgugcaauuccaaacuucccacagccccagguccaggagcacccugccuacucggcaucugcucccagccccccacagccacagacuccuuucuggugcuuagaccugccagcccugcgcccacaucaggacccugcccagcacaccccucccugccugagccuccgcgcagucgguccucaccucucuccucucuauguccuugcccccgugagcagauguaaagucccccgccugccgcccgcccacucucucucucucuccaguguaucaucacguuuggcuuucuucauagcacuucauccggucugaggucaucuuuuauuucaguguggcuugucugccgcaguggaacgccuguuccggagagcagggcccuugcccgccacaucccagcuccugcaacaggcccgcacgcaguaggcaccuguugaauaaauacgccacaaugccacaaaaagaaagaacagaaaucgcugugggcuccugccuagaggcagguccugucucuuugucucccaccuggggcagcaggaagguaucuuguuucugucccugcccaggccuguagcccagcgcccugcacagccgccugcaguucuugcccucgugcuguuauguuaugccccagagaggaagacugcucuguaagguagugaguuuccugugccagaagcguucagacagagacgggauaccagcaguucauccaaguuuccaucagcgacuguuuuuccuuaggcggaagccacacuagaucagugguuuucuaacauuuucuaaaacacuggauccuggcuguguccgguggcucacgccuguaaucccagcacuuugggaggcugaggcgagcagaucaccugaggucaggaguucgagaccagccuggccaacguggcaaaacccagucuguacuaaaaauacaaaaagccaggugugguggcgcaugccuguaaucccuacuugggacuaaucagcuacuugggaggcugaggcaggagaaucgcuugaacccaggagguggagguugcagugagccgagauugugccacugcacuccaaccugggugacagagugagacccagucucaaaaguaaauaaauaaaaaaugauaauaauaaaacacuggaucccuucuugccucuucagugucuuauggaagcccaggacauaaagcaaaaacagagcugcucuggguggcagucuaggccccuuuuacucuguccccuccuccuugcagcagucucugcaaaccuaggguagaauuaaagggccuccaaaucagguccuaugacccugggggaccccugcccagacagaggaaggagaggggugugugcagaggugaauguggaaggacagaucacauuccugaggccauggugcaaagagcaccccaagucccagcccaccaccccuacccaguggcacccucgguucuuagccaucgaggagagagaccucacccaaucugauggcaggagaaucuggaaguagaacuuggagaaacagagauuauugaaauugaacaaggucaggcaauguaggcagguggcauggguuuugagcaggaaacacauuaugaaguuggcauuugaagauguucuuaaagcuggaugagggcugggugugguggcuucugccuguaaucccagcacuuugggaaguugaggcaggagaauggcuugaccccaggaguuugagaccacucugagcaacauagugagacccaaucucuacaaaaaauaagaaaacuagcuggguguuguggcacacuccugugaucccagcuacuuaggaggcugaggggggaggguugcuuaagcccagggagguugaggcugcagugagccaugauugcaccacugcacuccagccugggcuacagaaugaguccgucuccccaaaaaggaugaauuggaggagagcagauguaggugccaccugaaggcauugaaugguuguagcaggagaacaaaggggugaagccagaagccuguuggagugaaggggagacucuagaauucagaauagaaaggaagucagggcugggcgcggugacucacgccuguaaucccagcacuuugggaggcugaggugggcggaucacuugaagucaggaguucaagaccagccuggccaacauggugaaacccugucuacuaaaaauacaaaaauuagccggggaugcuggcaugcacauguaauuccagcuacucgggaggcugaggcagaagaaucucuugaacccgggaggcggagguugcagugagcagagaucccaccauugcaucccagccugggcaacagagcaagacucuuaucucaaaaaaaaaaaaaaaaaaaaaaaaaaacagaaaggaaggaagucagguuggaaucaacauucccaggccauguuaaggugucagagaugcuguggcugccaagaaaaacuggacaagugagagggggacaguuugagacuuggguuacuagguucuggacagaaguuccugggacaugccucauccaguugcaaauacggauuuagagaguggagccugcguguccccagccuggagcuguaguuuggagggggagauggcugaguuguuuugccggguauggaggaacagaggugaccccugccccagccugcccucccugcccaccaccaagcccccggagcuggcgccagcugggcuuugcugcuccccccccgcccauugcaaaagaugagcagcugauuggcuaauggaguccuucuggaaggagugagagcauugucaggcacuguggaggcagcccugggcccggcccauucugggguuggggggccugggcaggccccuugucgccuuccuguuaucuccauccuugccugcugcaggcaggggagggacagguguccccuugggaguuaggaacggccugccuccuggagccgcuguccucuaaagucauucuggauuagccagugggauuggugcagucacagcaugcggcagcucugguggccacagggccacaagagaccuucuuugcacugccccacagcagaaccaucuccuugggcagcagacacgcaggcagaaaucugucucuaucacucucucucccucuguuaguguucucucucucuccccuccccccgccuuaucuaucccucucuucucuccccuccccucucucccucucccgacuucagcacuuugcaucacgcuugaauuagcuugaaucagccagggcagccauaaauggcagcgugcagccugcagggcgugagcuugguucacugugucucccagcuacugcagccuggccgggccccucagcuuggccuccggggcacccugguccuaggcuccuagcacuggggaggcugucaggaggcacgucccguuugccuucccccucccgccuccaccuccuccauuggagggaaaagcugaauuagaaaauuaucccagaacaugacauuaaaauguggucucuauucagucauaaaaugcugagacucugaucagugaagugauggagcuugggcucagcccagccugcccuggggaccagccagggugacgccagcugccugucucaauucacuguuuccaugaaauugauugacuuucaucagaaacaugauguauucauuugccagggcugcuauaacaaaacaccacagaccgggcaccuucagcaacagacguuucuuuucccagaguucugcagacuggagggccaaguucaggguguccgcagguucggguccuccuaagcccugucucgcuggcuugcaguuggccgccuucuccgccuccucacauggucuuuccucugugcacucacaacucucaugucucuguguguguccgaguuuccucuuauaaggacagcaguccuuggguuagggcccacccuaauggcuucauuuuaacuuaaucaccucuuuaaaggcccuguuuccaaauagagucaggcugagagguaguuggggccaaggcuucagcauaugaauuggggcguggaacacaguucagcccaugagccgaguagccugaacacuccugggaccaagggcauggacaggaacuccgcggugaugauggccuugggugagguuugagucagcgcucgagcagcugcucuguuccguuuccuuugagaccucaggaagaaucagcugcguacucuguuggguucgugccgccuccaggaaaugauccuggucgcacccaccauggcacagcugccugaugguggggaggacucagaccaugagacccuggagagauugccuuuggcuggccgcaccuucacggauucauucaacgcugagcugaaggccaggugccuuuagcaucgcaguuugggccuuuaucaucucuccccugagcucuguacccucuucucauaguuccuccugccucuucucuugccccauugcaauccucccaccucagccucccaagugcagcucucacucuguuuguccguguuuauuuuuuucguuuaaaaaauuuguauugacaccuguuuauuuuuuauuuuuauuuauuuuuuuagaggcagggucucccacugucacucaguuggaguacaguaacaucaucauagcucacugcagccucaaacuccuggacucaagcgauccucccaccucagccuccgaaguaucuggggcuacaagcacaugccaccacccccggcuaauuuguuaauuuuuuauagagaugggggucucacuucauugcccagguuggucucaaaccccuggcaucaagcagcccucccaccauggccucccaaaguacuggcauuacaggugugagccaccgcgcccagccuuguuuaucccuguuugaaaguuucagguggcuucucacuuccugaggaaugaaaccaaacgcuuuaguguccuguauaugaucucugugguugcagacccugcauuucugcacacuguuucuuucuuucuuuuuuucuuuuugagauagagucacgcucugucacccaggcuggagugcaguggugcgaucucggcuuacugcaaccuccgccuccuggguucaagagauucuccucccucagccucccaaguagcugggauuacaggcacccgccaccacaccuagcuaauuuuuguauuuuuuuaguagagagggggucucaccguguuggccaagcuggucuugaacuccuggccucaaaugauccaccugccuuaaccucccaaagugcugggauuacaggcauaagccacaacacccagccucugcacacuauuucugacugugucacacccacccugcaaucauacccaagucuguagagccacuggaagagccgagguguuccgugccuccaugccuuuacaugggcugugcacucugcccagaugcccuucucucuacaucugccuggcaagcccaucucggacccagcguggcuuucucauccacucugaggccuucuuugcucccugcagacacagcugagcucccuuuccuccaggcccccaccgugcacacuccugaaaacauagcugcaaauuugauugugccaaagcggaaggaaagaugggcgugcuaugagggaggcacgaagguaaaauccuuagugccagcucucuguugagcacagccuuagacgauggagcucugguauuucgcacaagguuuugcuuuaucccuucccaucccguugcacacacacacacacacacacacaccugaagcuaaagagccaccccuugcagaaggguuugugucuuugucuccauugcacugugucugaaaccggcacuucuuacuacuggagucagcacuuucacuuuucuguuguguccacacuuuuauaaaaucagggcaaaaugcagucaacacuggugguuuuauuguuuuauuuuguuuuguuuuguuuuugagacggaguuucgcucuuguugcccaggcuggagugcaauggcuugaucuuggcucacugcaacccccaccucccggguucaagcgauucuccugacucagccucccaaguagcugggauuacaggugccugccaccaugcccagcuaauuuuuuuuauuuuuuaguagacccaggguuucacuauguuguccaggcuggucucgaacugcugaccucaggugauccacccaccucagccucccaaagugcugggauuacaggcccccggcccccguuauuuuuuaaaaaaguaaaacaccacagccagaagcagggaggcugaggcaggcagaucccuugggcccaggaguucaagcccagccugggcaacauggcaaaaccucaucuauaccaaaaauacacaaauuagccaagccucguggcccaugucuguagucccagguacuagggaagcugugguaggaggauugacggagccuggaagggcaaggaugcagugagccgagaucgcaucacucuaccaacagccugggugacaguaagacccugucucaauaauaacaauaauaauaauuggaauucauucaauuauuauuaguauauucuuuaaaagccuaacaaguuacccagauaaaagugaggauguuauuuccaguagaagcccaggugugaggcccugggaugccucuaugaggugcaguuugauaaccacucaaaaaaacauuccauggcuauccaacccuugacuucagcagagcugagauuugaugcaggcaaauuugagauguucuuggccugcaaagucugaguguggugagugguggacaggagaggugucaguggauggcggacaccgugguccaggggcugugggaguuggaauggagcgguucucaggcagggaaaggcaggguggaauggccucaggacaagcacaugguaggggagggggcucuccaacgagucucuccacccgggcccacucuaggcagcucacugcucuggucccagaggguccuugucccccaagcagaaauugggcuccugggccuaugcccccgcccauccagauaaguagauggaagggggaggguuugaccgccccaacuggggccacgggauucaagggacaacuuccaaaagaacaggggauuucugcacagacaacaaaauaaauggccaauugagcaguguuuucaagcuuuuuuuaauuaggugucacaauaagaaagaaauuuuaaauuacauccuguauauaaagucacacagcuacaccagaaguuuuuuguuguguuguuguuuuguuuucuuuuguuugagacaggcuuucacucuuucaccuaggcuggaguguaguggugugaucucggcucacugcagccuugaccuccugggcucaagugauccucccaccucagccucagcugggacuacaggcacaucccaccaugcccagcuaauuuuuguaauuuuuuuguagaaaugagguuugacauguugcccagggcggucucaaacuccugggcucaagcaguccacuugccucagccucccaaagugcugggauuacaggcgugagccaccucaccuggccccagaaguuuuauaaaccaguaucuaacucuaccacacacaaaacacuguuugucuuuaauuucuuuuucuuuuuuuuuuuuuuuuuugagacagaucucaaaaaaaaauccagucuguugcccaggcuggauugcaguggcgugaucucagcucauugcaacuuccgccucccaggguccaacgauucuccugccucagccucccaaguagcugaagcagucgugcaccaccacacccaacuaauuuuuguauuuuuaguagagacgggauuuccccauguuggccagacuggucucgaacuaaugaccucgugauccauccgccucggccucccaaagugcugggauuacaggcaugagccaccgcgcccagccuugucuuuuauuucauucugggauacagggguguccccagagucuuagugcaguuuuaauaaauaacuucagauguuuaaauguacaaaccuacaaaacaucaguugaauauuuacuuauuuaaauuucuuuuccacuuaguuuccugacagucaagugcuagauuuuuucauuuuaauucuccgcaugugcuagugucuggagggacaggcaggcaaaggaccccuuuccugggcugaauugaccucccuugaggucacgugugcacaaaauccaguucuuuggaaccuggugaagcuggaaucaccagugcaaucuuuucccgucacugaccaacagucgauaaaagguuuuucgaaguuugaacaacuagagccauguauagcacuagaggggguacuguaagaaucugagugagagauaucaagguauuuuaaauguaaauaaccuuucaaaugucauuuuuugguacauuuguaguaucuauacuucugaaguuauuaaagccucaaacuucaccaagacuuuggucgcccauuuuuuuuuuuuuuuaacaauacuaguaaggccuucucauuugcuuuccugacccaucaaugggucaugaccacagcuuuuuaaaaaucagacuuccaggccgggcgcgguggcccacaccuguaaucccagcaguuugggaggccgagacgggcggaucaccugaggucgggaguucgagaccagccugaccaacauggagaaaccccaucucuacuaaaaauacaaaauuagccaggugugguggcacaugcccauagucccagcuacucgggaggcugaggcaggagagucgcuugaaccugggagguggaggcugcagugaggcaagaucguaccauugcacuccaaccugggcaacaagagugaaacugucucaaaaaaaaaaaaagaaaaaaucagacuuccaaagucaaguacaauuuuuuuuuucuuuuggugacagggucuuacucuugcccaggcuggaaugcaguggcacccccauggcuuacuacagccucaaccucuugggcucaagcgacgcaccugccucggccucccaaugugcugugauuacaggugugagccacugugccuggcccagaaucuaaauguguaccagccucucugugcucaggagggcuugggcacgucagcugauacuggguccuuuggggauacggaucugcccuggcucauggacuccucgcccuggagugcaauuauuuguuugucuuuccuacuggaccacgagcuccguaaggcagggacugugcucauuguugcuguuguuuuucauuuaaucuuuguguccuuugcacauaauaggagaacuggccuccugucuauucuugauauugggcuuaguuccggggccgugcccugaauaggucagugacuguuugccugucauuaaagagagacaucaaccaugagaaaaaccaacuguuuuucuguccaugcacacaacacuccacagaacccuucacuucugauaccaaauaugcagccagccccaccccugcaaccaacaccuucuccagccacccagacaccaaguggguguccucccguucaacucugacauuaacugccuggaaucagugcagaccccacagguuagggcccagucccacagacugcccccuacuucaggggccaaucacaaguaucagguccccucguuccccacacuuugguccuacuugccuacaaaucaaggguuccaugaaccccuccucaaguugaguaauuugcuacagcgucuuacggagcucagggaagcacuuauguuaacugguuuauuagaaaggaagugauaaaggcuacagaugaacagccagauggagguaccuaaguagaguaagguccaguaggguccugaaugcaggagcuuccguccccauggaguugggguacgcuacccccugcgcacgggaaugcauucagcagccuggaagcucuccaaacccuaucgggauguugacggaggccucaucacauaggcgucaucgauucuuaacucaaucuccagcuccucuccagucucuggaggaagcuggggggugguggggcugaaaguuccaagcuccucauugcagcuugaucucucuggugaucagcccacccaggaguuaccucauuagaacaaaagacacuccugucacccgggaaauuccaacggacuuaggagcucugugccagggacugggaucaaaaccaaauguuagaacaaaacaugcugcuagcaccccuguaacuuaggaaauucaagggacuuaggagcucagugucagggcugggcaugguggcaugcaccugugaucccagcuauuccagaggcugaggcaggaggaucgcuugagcccuggaggucaagacugcagugagccgugauugcaccacugcacuccagucugggcaacagagcaagauccugucucaaaaaacaaacaaaauaaaaacugugucaagaacugggggccgaaaccaaauauauauauauuuaggauguuacauucuuucuacuuuuuuuuuuccaagugauccuucugccucagccuucuaaguaggugggaucacaggugcgugccaccaugcacagcuaauuuuuaaauuuucaguagaggcgaggugugcacuauguugccaggcuggucuugaacuucugggcucaagcagcccucccaccucagccucccaaagugcugagauugcaggcaugagccaccacaccuggccucuuacuuuuuuuuucuuuuuuagaauauauaagaaaauaaauaaagaaaaaauggggucuuuggaucugacuguccaaagacaccauuagcauuuaaaaaauauauuuagucauucaugcauauuaauggaaaguccaaauuauacugaacucuauaagacggaaaggaaaagcugccccccaagcuccuuucccaagagguagccacugcugacaguuucucgugggcccuuccaaaaaacaaaccuuuucucugcauuuucgagcacaugcgugcauuuccacuuugccauuuacagcaagaugacugcgcugcucacguggggcugcugcuugcauuuuucccucgauuuaucuugauguacuuuucaugucagcaccuaucaacgccuccuuuuuuuuuuuuuuucuuuuuuuaagaugcagucuugcugugucacuaggcuggagugcaauggcgcaaucuuggcuuacugcaaccuccaccucccggguucaagcgauucuccugccucaaccuccugaguagcugggauuaaaggcaccugccacaacacucggcuaauuuuuuuuuguauuuuuaguagagacgggguuuugccauguuggccaggcuggucucgaauucccaaccucagcugauccacccaccuaggccucccaaaauucugggauuacaggcgugagcgaccgcacccgguccccaguucugucuuuucaacugcacgcggucagagucauuauauaaaaauccugauggacauuucuccagucuggagcagaucccuagaaguggguuugcugugucaaauggagcggcuccucuuccugcccccggaagaggccugcccacuccgaccucagccauagagauacuuugcugugcaaaauuugggaaacgucaggacacacaggcaccacuucgccauagauagcacuaagucuguguguacaaagugcccaacagggaagacgcuguguugccugcgcagcuccccccaggcagcauuuuguguagucaaggaagucccucaggccaggcacaguggcucacuccuguaaucccaacacucugggaggccgaggcaggcggaucaccugaggucagggguucgagaccagcccggccaacauggugacaugccaucucuacugaaaacacaaaaaaauuagcugggcuuggguggcgggcgcccguaaucccagcuacucgggaggcugaggcaggagaaucgcuuaaacccaggaggcagacguugcagugagccgagaucgcgccacugcacgccagccugggcaacaagagccaaaacucugucucagaaacacacucagaaaaaaacagaaaccaaacaaacaaaaagucacucagaggagcucaaggccccucuggguuugccacuuccgacccgcuguggggcuuguaaaaacuuugccucccggcacagcucaguguuuuguuagggagccucccgugagcggccgacgcuggcugggcuccaugggaucagcuggggcugcucauucauucauuuccacaucuacccacugggcuuccaaguugaaguuccuggggcucccauguccccuccccaugaccuucaaucccacagagcccaugggcacggcacgucgcucucauccucugacauuccugcaagcugaagucacuucuuccuuccaccaaggccaucccgggccauuccucugaucaucuguuuauugugucucugugugggagagaacuggcugaagagguggggcuccaguuuugggaacauggacacugagagaguuggggauggaaaacaacauagaaggaagcaaagccagaggcugcgauggccaugcugccuggcccuggucccagacagacaccccagccagcuuuccucuugcacccuuugucugcuggccgcagcgucgcagugggaguccugggcccacuucuccaaauggcacacagaagccucaacaggcacccaccugggaaaggccaaggccgagggcuuggggugcacagucaagaacacgccucagcucagcauuugugagccgagucacuuuggcccaucguuuguacacagcccccaccugcugguugaccaugaccacagggcaggcgcugccacagggcgugggcaggcuggaccuucgagggccuccucugucuccccuaccuucugcccccccaccacuucccaucacccagucugugccaagggcacugacccuguccuugucuugcaggaagaggagcaggacuuggauggugagaaggggccaucaucggaagggccugaggaggaggacggugagugggaccucugcgcucaugagggggccugacagugucggggguggucuguguccugcuggggaucacaggagcugggguucgagugccgaggggagggauggggugggacaguggccugaguggggcaugagagguagagucuggcgccauggauguccugcccuggccugccuguagcccucccucacccccauugcacuuuggggcuuggcuuucccaucccggggccccucuugggaacacacuacacgcccugccuggcucuguccugcgcugccuccuaacuccccuuuugugaccgcgcuguacauuucacgauucucuccaaacaucucugaccuauuuuacugagacgaaaaccacucacacggccucccccgugccuucuucagaacgaaggccccaggagggcacacgccugcuuucuaagcagcucuggcugacuggccacaggccccagccaugagacugagaggagaaagggagugaccgagaacaggggagacacugccagaucggacccggccaggacagacagaggcggaaccaaacauggaguggcuucugcuggguccauccacuuauuucucuaaaaaagaaagcggaggcagacaugcaagaugucagcguuuguuggcucuguguggcaagcacagggaggauuagugcuuucugcauuuuuguauguuugaaauauuucauaauuuuaaaaaagcaagucugcuuuugugauguuaagucggcugcuggcaggagcaguggaaagagaagguuucaggaauguaggaaccagcuccugcgggcaggcugggcuggggugcagagcuuccccugaggcagugccuugguuuccaucagcacagccugaagcaggaggggagaaugaagcuugggugcaggcggugggcugcagguggggacauuagucccuuaccaggaaggacccuugcucccugcuuuuggggacuggggacucaccgcagccauggcccuggcaucugucccugccauguggccugagacagcugaagggaugcagggauccuguuagugacuuggggacacgggagggaggcccuuuggcaaggacaaggagagaggcucgcagaccccucucccuggcauagcugccagagggcacagucccccagcacugucaccagccuccccccuuaucugcaccgcugcuccugaacaucccccacccccagcgccuccugccaucuuagccuccugccaucucuagcaaggcagggaaaggaaagguuuauggcuccagcuguuggaagaaugugugagcaccuccagccccucugcaguacgaggcagccucagagguuaauuauuagugucgcuaaaaugacuucccugagcgacuaggugaauucacaggagacuggaggaagaaaccucccccgucccucggaggcugucacguugaauucuggucuagcaaaacuggaugcgcugccuggugcacugcaugugacugagcgaaauccuuuucaagucguuuguucugucuggcucagaaaacaaaacuaaucagacuugccccauaaauugaaaccuaagacugggaccaaggcaggauuuuguauguuuucuuuuuuugggggguagggggauacuggaaucuuacucuauugcccaggcuggaguacaguggcgcgaucucggcucacugcaaccucugccucccggguucaagcgauucuccugccucagccuccugaguagcugggauuacaggcgccugccaccacgcccggcuaauuuuuuguauuuuuaguagagacgggguuuugccacauuggccagguuggucucgaacuccuggccucaagugauccaccugccuuggccucccaaggugcugggauuacaggcaugagccaccacacccaaccagauguuuggguucugaauucgcaucuagaaccuucuuccuuucacccugagagcccccccgccuccccaucgguccacaucagccuauccgguagcaugaaggcugcaagcuagaggggaggggccuggcuuuucgggcugcuggacaggauauggagggacagagagggcagcacuuccagaauagcagcugaggaucucucuaugccucccucacuggguccuuuaguuaguggaggucgauaagaggccagccagcucugcccgacaccugcuggauucaggaaccaagagguugcucccccauggggcuuuucccucuggaagcucagcuuuucucuccucaccguggcucaugugcccggagccuguguccacuccaggccacagguccuggcuuccucugugcccaccaccuacccauccaugugcccucuucaggccucgagaucuguccguuuuuugcaggcagcaauggggggucuccccucggggacuggcaaaucgggcucugccucuucagcgguacacacgucaaaccugcugcagcaaaucccgcaucccuggccuggccacugugggcugccuggaugcguguuuucagauuuccaauagccacaggggguggggggaugacacaagccuccccaagcccaggcaggcguggugugugucccaagaugagcugugcucugcuugccggaguugucgccucugagcucaguagccgagaggaccugcugggcagggccagggcaaggcagagcacugcagauguugggagggauguggcaucuggagacagcuguggacuaggaguaggacugcuuucucucuggcugucucguuguaggauuuaagggaaagcuauggaacgagaggggguauaggcgcuggggugagaugucucugauagccagauguggccucugcuugagguguuucuuuuuaaaccuagggaaagggggccgggguuuguggggccagccucuacagcacuccuggcacuuacuggguccccccuccacaggagaaggcuucuccuucaaauacagccccgggaagcugaggggaaaccaguacaagaagaugaugaccaaagaggagcuggaggaggagcagagguaggcugcagccccuucgcuggcgccuggcgggcucuugggggaggggggugccccucugagcccuucauguuccugccccuuggcagaagggcccagaaaggagguggggcuccuacacgcucugcccaaccaccgccccaccuucccaguuuaggaguucuuuccugcccuggucagccaggcucgcacaccccuggcaccccucccuggcacugaccagaaggaggccacuggugaugggggauacagagcccauuuacugcacccccccacccccuccacaccccacugcccccaucuaaagaaaugagaugccaggaaagagccuggagcagaccuggcugucacucacacacacaguccccaacagagcugauuucuccauuucuccuucgggacacagcggauucuuggugcucauccuucagcggccucccaggccggcgccugcagcagcgccuuguagcuccgggcagugcagcuauggcuucucguuguuggaauuggcucccccuucccauuuggacacccccugcacagccacugggcaccccgccaccuuuucccuccacaccauccugcugggcggggaaggggugcgcugggcacagugggacagcuggggaggucucagcagagggacaguccuuugcaccaggcgcagcaggcuccuggugcucacccacacugcugcccuucugcagcguggccuggaguccuuugguuaaagcagaagucuaggugguagcugugccauuuuccaagccuggcgacccagagcagcuugugggaaucacccccuacuugucagcagaaaccagcggucuaggguccgagcaggaggggugguuuaugauuuuggaaucagaacucaacugcccucucauggcugcaugccaagccacccgccgggcagcccucuaaccucacagcugcucugccggugacaggcccugucuccccucccgcugcuggcaucagcgcucucgacccucagcaggaaagcucuucacccuggguggguggggggcgggcaguguaagcacagccaggaggaagagcccuggcaggagccccgaguccucaggugcugaggaugcugccgcuuggcaugaccagguuugcugcauuuauauuucaggauugagcugaccucugaccucacuucccuguagcaaguuccuuagguccugagccacaaauauucuugcaaauccuuuugguaaggacacugauuucuuagacuaguggugcuccccuucuacugcgugcuaacgugcccccaaacaacugacgcggccucaaccuccccuccuccaucgccuucauaaccgauuaauacauuucccaccugagcccuucucauucuucucaagcacgaggaaucucuggcagaagaggccccgucugggggcagagguuccuggaggggaguuaagucccugaguuccuggagggggccuaaugggccggcagguuggggugcuagcgcccccucgcaaggcugggggaacugucacccugggaccucaggcuucggaaauguggaugucgucacccugcagccuugggucucacccugagaagaugaggcagcuucugcacagugcacagcagauacucugagaacgguccgugcucccaagcugugagacaggcagguucuuaggaucagggcaaggguuagcagacaacggccgggccacaucugaucccccaccugccugugccaauccagcguggcaguaguagcaacacucacccauuuuccuguggucugugccucuuugugccgcaguggccgaggugagucacugcagcagagaccacacagccccccaaaucuaaguaguaucuggcuguuugcagaaaaagguugcagucccuggacagaggcuagagggggcuggacacaacugccagcccuugaaggucccuggggacagaggcugcucaggcagauggaucuggagggccucuuagaacaagaaagaccaggccuccggcugggggugaaacugccacugccacccacguccagagcugggaccuuggcaguggggagggaaaaucccuuccccuuauuuucagagaguagacccucugcugcccauccuucccccacuggaucuuuggaggucucuagaccaccaacccacacuuggcuguucugugggaccgagacugugcccgaggugcugcuccugggacgagggaagacuccucgacuccucugcaugcugcaguuaccacuuugugcccugaauugagaaggaggggccggaggacuucuuggggcaggacuggaguucacguucauucccaucacugcccagcccgcaugcucccuguggcuccuaggcaugccgguggcaucugcuugcucccccacaccucugccccccugcaugugguugccccucgcagcacugcguggggucuccgcggcuccacaucacgcuguccucacacggugaugcuugggguugcagaggcuggucaguuuggcuuuggcucuucaucuucagcacgaugguucucauggggguggggagcgcuggcagcugugagacaguucuggucccagccaaguccagggaaccgcccuagaaucaucaguaugaaaaauaacaugccuguuguuaucaaaccacuaaaaccacaggccagcuagcagggugcucucucuccgccugucagguuccacccucccggccuccaugccucugaugccuuucccagcucucaggguccagucgaguugcagcuacaagcugcacguccccuaacuuuaaauuuacuagcucagccaacagaucugcaucuagaaccugaagcuuuagugguugccaguuccagcacuccccaggagcuucaguucacaggcucucaugacaauuaggaagugggacuggaagcagaaggcccccaauuaguuccccgacaugcugaaguggucagucucauccuugaacuacucacagaucaaauuccuuccgccuggggccagaaagcggucaggucuguaaauccagaggcagcugcugcuuaagauccugcuugccacugucugcccgccuccucagcucuccccucgggccggaguuucacacacuucaugccucugguggcgucccuggguuccgcugaagcugcugugggaagugccaccuccaguuucacaguguggcuaggacagugggcuugcaggcuggugacagcuccccugagcaagaggccuccuccuccucccccagagcuagggaagcuggcagggcuuggcuggcuucacagcuuggcaggagaaagaacaggcgcggcugucagcuccucuccaucacuucuucccaccuuguggucucagagggaaaaugaacccaggcuauagacugggcuggcucugauagaucaggacccaccccuccauuugaggucugcagggcugucuugacuccucuggaaauggacaugacucuagaggaaggugcuagugugguaaaacagggaaggggaggaggaggccaaggaaccccagcugugggguaguucugguucuuccaucugauguaugcaagaaacuacagacaauagaccugccagugugaauuuccagcucaggcuggaaaugcgugcugacugugaccaccaggagagggcgucagagggacaagaucagaccugcuggguucucaguggucccagggcuggcagugugucuugguucauaaaagacgggcaugcaguuggcuccaucuggaagcgugcauccuagggugccaguaucccccgaggggacaaaacucagccagcgggaaugggaaauuaucuagggugauaggaauauugucagcacaaccacacaacccaagaucagaaaggcccuuggcaacucaaaugcccaaguuccuuccuuaaguacccugcagaggcugaacagggucugugggcugccagguucugugcgggaucaaggggagcucugcaagcucuggccggcuuggcggcacagacugucuugcugcaagcgaugagaagcaaaucagcagugguuugagaaaccagagucuagcgcagcuucugcaauuccaaacauucuccuuccucguccccauuucccccuuuccuugcccauggugcaggauggaaugaguaaaauaaauuaucuuuuucuccccauuucucuuuacagaacugaagaauaacgaaguuauccuuagcguccuccuaaaggcuuuuccuuuuggcaucuuaaaagcuugagagauaaaacggaaaccccagagaggagucugggcaggcucccagggugcaugcugccuccauaaaucugcugagcucuagacccucaaucaggacuugucccuuggcuagcaggauccugggaacaccuuuggcccugcccuguguagagauguucaugucuguuccugugggucacuuuguuaagcugaagaguuuuaagagguagagcucagacccuggacugggauuuuucuuaccacucaaacuugcuauccacacacccugcacaccuuagauaaaaagaacauuuuaaaagcagaguucacuuucacuccagucuccccucuuuugcccucacugaagccaaaccacagaagacuuugaggaaugagagacaaaugagguagagcucaccugugcucaccagcuccgucaggguggucagccgaccccuuucccugggaaccccacuucucucuguggcuggcuugguugucgggggugagaugccauauugauuacagggcagcaaagaaccaguaccaggaauuuacuugaccauuccccuuauuuuucaucuagaggaaucucggauucagcccuuucauugcuaagacaccuuuucacugagguucuuaccagcucagccaaaucuccacucugcuauagcagaagcaauaauguuugcuuuaaaaagauuucuugaccuaugccuuuucuuagaaaguuugauagauuaguuagaacuucagaucaucagaucagucucaaauggguuucuuggaauuuuauauuugacaauauuuauacuauaccaaacucauuugcaguucuuagguuuguugguuaaaacauuuuuuuaaagcaguaaguuuauagaaaauguuuucauuuaauggaaggcuggggaauguccagcaucaaccccuauggcaugcauucccaggggccuucucaucugggccuggaaccuuugguucagggcuuaggggagaacaggccacauggcaacagccacacagucauugccuucaacacagagccacguguccccaaacagcaauagucaugcccuuguccaggcugggaucuaauugacacaauaggucguugacucccuccuaguagagcuaucuagguuugucuggaaaguuuccgacccuggcuuauaggcaccacaccucauguacuccucauggcuuggaucucuguauucagccuuuguucaguccaauaaacuuugaguagaugaucucaauuacuguguguuuuuucaguuugcuuuguuuuaaaacaaaaucccuuuugaacccauugaaguuugaccuuucuuucauuuugaugccucuuacucugcagcagaguacaaagccauacauccacccuguuaaaaaauaugcagucaccauggcugucaaaaccacaugacaugaucuguguucacucagggacauauggauugugcuuccauccacagagcucagcacauccuuucuguucacgggaauuccucuucuucuucuuuuuuuuuuuuuuuuugagacagggccucccucuguugcccaagcuggagugcaguggugcaaucacagcucacuguggccuggaccucgugggcuuaagugauccucccgucucagccucccagguagcugggacuacaggugcucaccaccacaccuggcuaauuguuuuauagagacagagucugacuauguugcucaggcuggucuugaacuccugggcucaagugaucuucccaucuuggccuccuaaaguucuaggauuacaggcaugagccacugcaccugacccucuuucuucuuacaggagggcacaaagcacacaucauaggcugcugcuucaccagacaggggaaccgacuguagacacagcuuucccaggggacaagggaggcugggaagugggacuucaguauuucaacuacuagaugcugcucuagacagaaaauuuugcaggauggaagaugcggggcugaggagaggagggaagggugaagcaaaggaauaugguagcaaaaguaugggagcgaacguggagaccaccccuccaggcagugugggggaugccaguggcccagggcuaugcugagguccugcgguugcagagccuguaacgugcuuacagccgacccagcugcagagcagggcugagagguccgacacugugaugugguuuacguucucugaaggcacugagcccgugguguguggggggcaggaacugcagaaaccagaagagugagaugcagccaggaugcagugcccggcugggcugaggagcacagggcaccagaguggagcaaacaacaaacauauggcucccuggguucggcagccgccucgccccaccugagguguuugugcugcagaaguuguccugugcuggucagaugguguagcugagccucauaaagauaacaagacauugcucccagcacagaacccgcguggagcaaacauuuaggccagucuuccuccacacccaucccuugauaaaaggggcagggccgccaccugccauaggguaucuugugcaaauuaggaaaaggcaccccccuuucucuggccagugaaaccccacaggcuucccuccccgcuccuuugccaagcaccgucuugcacacacuuguaugcucccugauuucccagcugauaauguuuuuucuuucuccacuuucggcucauuccucucaacgaaggcuguuucuaaccuacuucuucauagcacuaccucaagcugcuucauggagccuaucuucuuccucauuacaucacugugggacaugcagucaacaaucaaaugaggcccaaagggaaacugaggcacagagcaccuaagugauaccugggguccccaaaccuccccggcaaaccugagauuucgcaucccaguuuuuagagcccucaaaaguugcgugugucagacccaaccagcuccgauguucuaaguggguuuuauuuucauuuucuucuuguucugaaaagcaaccgcagucacacaagagagaggagagucccaacuccgccggcugcacacaggcucccucucuccccagugggcuaggagcaccuucuuccucuuuguccuuucuucucgacagaguucagaaggaacagcuggcugccaucuucaagcucaugaaagacaacaaggagacguuuggcgagauguccgacggcgacgugcaggagcagcuccggcucuacgacauguagacugcgcccacgggaugcacagcggccaugccugaugcuguccccacccuugccccaugcccuuguucuuuccagacuucuguaggccuaauuuucccuuauaaacauagaugcaggcguacauucuauagguacuugccgaguucuugcaguguguauauuacuuugcaggaaucaaaauuguuuuauucagaagacaaagucccugaccccucugguuucugcuugcuggugagguuccagcuguuauugggcucugaggcccucuccugauccaaaucuuuuuuuguuuguuugagauggagucucacucugucucccaggcuggagugcaguggcgugaucuuggcucacugcaaccuccaccucccugauucaagcgacucuccugccucagccucccgaguagcugggauugcaggcaugcaccaucacaccuggcuaauuuuguauuuucaguagagacagcguuuugccaugcuggccaggcucgucucgaacuccugaccucaggugauccgcccaccuuggccucccaaagugcugggauuacacgcgugagccaccaugcccggccaauacuacacucuuauucugccuuacgaggauuucuggaagcuucuguaacuguagggaagaaagcuguaggggagcaugguuuuuuuguuuuguuuuuguuuuugagacgaggucucacugucacccaggcuggagugcaguggugccaucaugacucacugcagccuugaccucccaggcgcacaaaauccuccucucagccugaguaacugggacuacagguguguaccacuacauccagcuaaaggagagcguuuuuuucuuuuucuuuuugagacagagucucacucuggcgccuggucacugugcccuucaccuucuggguucaagugauucuccugccucagccucccuaguagcugggauuacaggcaugcaccaccauacccagcuaauuucuguauuuuuaguagagauggaguuucaccauguuggccaggcuggucucgaacuccugaccucaggugauccaccugccucggccucccaaagugcuaggauuacaggcgugagccaccaugcccagcugggagcguucuuucagcaaaaagucuaauucagagacucaccuuccauccuggcacuaaacaauaguacuagagguaagaucugccaagaauuucucucacuuaagcaggauacuuacuuuaaauauaauuaggcaagacuuauuugaguacuugccuaauuguauuuaauuagaacuaugcuggaugcuguagacagaagaaauaaaauacucaacuuggucccuaucuuccagcagguuagaggccuuuagggaagaaaagccugugugcagggaaagagaaccucaccagaaaguauucaauaaaaugccaaagugaucuuacagaacagugccugugacaccggaggggauuguucugucuuugugagugaacauacaaugauggggauaacugguccucauaccaugcaggucccauuucugaucaccccacuggcaggacaauucacaguucuugagcaaacugaguuagggaggguaugcuaacgacagaaccuaugcaaguucuuagaaauauuuuuuguuugcugaaauaaagcucaaucaacaca

SEQ ID NO: 16930 - RNA, 8347 nt, Homo sapiens
agauagaaaauggauucaauuuuuauuaaauaauguaaaggauuuucuuggcacuauucacauucucuugccugaguaaaacaagccgcguuuaucugcauugguagcagagggaaagcuacuggagcaaacgcuaagugaauggguucccgugccgaggguguccucauucuugggcucugucaggccuccccuugucugcaggacuggacaggccacccuccccaggcccugcccuugccgcgagcguguccuuccauacagacaacagccuugcugggucaccuggaggagcugcgcucuuugcugacacagucguccugggaggugguguccccguuucccaccaugcugcacguccuccucuucuuccugcggugcacugucccaucgcccucggauccagacucgcacuggacacaggaggacagaaaacaaggagucaaccuggaugcaacccacuucuucauuaaacaaaccucugaccucgggagacagcacagauauuggucacuuucucccaaaugcaaagcagucauuaugacagcuccacaauguagccuucauagccaccuccuuggauguuccuggcucccuaagaauuucaaacuucccucagaggccaaguaucccuccacuguucucuuaaccgugugguuaucugucugaauaggauacccauuguaaaaaucuuuuagucagaauucugaaaguacauuauaagauuucacucuaccaacagagcuugauauaugaaagaaguagguauagcacugaacauucccagagccuguuccccgccugacgagaaaagacucaaucaguagacugugugaaaagacagaauuuuuuuuuuuuugagacaaagucuuacucugucgcccaggcuggagugcagugguaugaucuuggcucaccguagccuucgccuccuggguucaagugauucucccaccucagccuccugaguagcugggauuacaggugugcaccaccacacccaacuaauuuuuguguuuuuaguagacaugggauuucaucauguuggccaggcuggucuugaacuccugaccucaaguaaucuacccacuuuagccucccaaaguguuggguuaacaggcgugagccacugcgccaggcugagauagaaauuucaucuguuaaaggugcagggcccucucacccaguauuacugucagcuucaaguuuaagguuacuggauuugcugaauuuccaggcuuacaauucaccauccaugggggaaauucuucauaugagcuuugaggucagaaggaugaguuugaaaucugacacugcugcuucaucuugagccauuuacuucacuaaauccccaaauaccccugauaccucgaggcuauuuuaacaauucuuagccgggcgcuguggcucaugccuguaaucccagcacuuugggaggcugaggcggguggaucaccugaagucaggaguucgagaccagccuggucaacacagugaagcccuacugaaguauacagaguuuauagucucuacuaaaaauacaaaaaauuagcugggugugguggcaugcgccuguaaucccagcuaccagggaggcugaggcaggagaaucgcuugaacuugggaggcagagguuacagugagccgagaucgcgccauugcacuccagccugggcaacaagagcgaaacucagucuccaaacaaacaaaaauucaugcacaugugcaaagcuguaaaaugggcaagauacaccacucagcaggaauggugacaacuguguaacccuuagaacaacguggaaaaacuuucauauccuucuccuggauaggaggaggaagagucacaccugguuaugacugaguuacaugagccuuggaggcuccaggagucagccagagagcaaggccucaccucugagucggagucugacgaacuggagcuggaggagcuggaagagucgcuggagcugucggaagcuaucccuguggacuccugaaggucaaccgagucugcgaggacugccaacucggggugcucuugcuucaaaauccugagaggcaagaaguguuguucucagugcacugacagccauacccacucacaaagacucacucagagucgaggccugugucucucagaaacaccugggaaugccagguguguccguucagaauggauacuguacaauggugaggacaaaaccccaggcugggaacaagagaaacccaauacggugcccauguuuuucugcaaggaaaauuauacuaacuacacacaauuuacuaccaccugcauaaaugagccagccgugccaccaauacacgaggcacaauuuuccuuaaguuagucuuaguuuuauucccuuaggacaaaaaguuucucuuccuaguuuuacuuccugaacccuucccaguugauuuuuaaaaaaaucuuuccuuuccacagcacagcacauaaugaucagaguugcauugguuagauucuauuucuaagaguagaaacaauuagauuuguaagaaauacgaggugucaaauaacagagaugguccccccucacugggagcguaaaacugaacugaagagcagcagcccuccccuucagaaaccuuaucuggcauccacuguauccagugacaaaagaccuguuguaucauaaggccugcggugugaccaaaucacagcacgcaguggccuacggggcgggguaagugggccucagaugcccaagaguccagggagaacagaagccaccacccuuacuggcccucucagcagggaggcugagcauggaacaagccagaaucccucucuuaccccgagagcuggucccuccaggucaggguugggacacaguggcacgggguggcuguggguggcuugcacugccgcugcccgugcuguaucuguucuguggauaaacagaggagcuaagucuccagggcagucaccucacucacaagaacugaagguauuaaguucaaaugggaauaaugcuucuagguaagaaaaagaaacaacccaaauaaaacccaaauaaaaugauuuuagcuagcgcuagcuuugaaaaacaaaacacaaaacaaaacgagaaacaaucccaauuaugacgucuugacugaguggcuuggauucaacaugcagagucucacccugccaccucgaggcuggcgaacacccugaggacuugcccugaccuuggccccucucuccucuacccagagggucggcagccccagcuuugcccaggccuguguacgaucagcacacaucaucgcagcaguggacuagccauuuuaucucuggggucgaaauugaaaccaagcagaaauaagaaaaaaaugacucucaccuauaccauuuccuugauaacuuuggucucccucuuaccgucuugugccauaccacagggaaguuggugcugcuggcaaaauuuugggugauggcgauaguagugucgagauugaggacaacaugccaccagccuccugaaauccaacaaauaaacaguuaaacaagguuugauccuauaccuaauuacuguauaacacacacaccagaaauugggaacuccuacccauaagggagagccuacagagacaugauacaggguaguuccuucugauccagggauugcaaacaacuuguuuguguaaaucaaguuuuaucggagcacagccaugcccaccuggugacggauugucuagggcugcuuuccagcuacaaggccagaguugagcaguugugacagucuggcuuaccuaaaauauugacuccccggcccuuuauagaaaaaguuuguuuacuccuguuaauccaaagcuaugaccaaaagugcaaaagcauaaaguucuucagccucuacgaagaggacaccuacuuuaaauacacuuaccuuacuuuccuucacuuaucaaagcgcaguugucuggugugggauuuccugacucaacacggacagugcuauacugcaucaaaaacccaauuuaggcugcgcuuggugguucacaccugcaaucccagcacuuugggaggcugaggcaggaggcuuguuugaaccaaggaggccagccuggguaacagugagaccuccaauucaauuuacagaauuaaacccuggccgggggugguggcucacgccuguaauccuagcacuuugggaggcugagacggguggguugccugagcucaagaguucaagaccagccugggcaacaugaugaaaccccgucucuacuaaaauacaaaaaauuagcuggguguggcggcaugugccuguauucccagcuacuugggaggcugagacaagagaaucgcuugaaccugggaggaggagguuguagugggcugagauugugccauugugcuccagccugggugacagagcgagacuuggucucaaaaaaaaaaaaaaaaaaaaaaaagaauuaaaccccaauuuacagaaacacaaacaagccgcuacacauacacaaacaaagaaaaguuguaucuuuacauacaauuuuuuuuuuuuuuugaaauggaguuuugcucugucacccaggcuggagugcagugacacaaucucagcucacugcagccuccucuuccggauucaagugauucuccugccucagccuccugaguagcugggauuacaggcgcccgccaccacgccugauuaauuuuuguauuauuaguagagacaggguuucaccauguuggccaggcugaucuugaacucccgaccucaagugauccacccacuucggccucccaaagugcugauauuacaggugugagccaccgcaccgggccugcauacaguuuaucagguuuuauagccauauaaaaugugaacaagagcucccaaaguaugugacacuauagcuacauguuacugucagaggugaguaccaguucauuuaccaggcagcauccaaaggauuuuuuggacucacucucuaacaguucugcuccaaaaugacaaaauauugaaaucaaagaauguacuuucuuuuuuuuuuuuuugagauggagucuuacucugucacccuggcuggagugcaguggcacgaucuagacucacugcaaccuucgccaccuggguucacgugauucuccugccucagccucccgaguggcugggacuauaggcgcccaccaccacgcccggcuaauuuuuuuguauuuuuaguagagacgggguuucaccguguuagcaaggauggucucgaucuccugaccucgugaucugcccgccucagccucccaaagugcugggauuacaggcaugaaccaccgcgcccggcaaagaauguacuuucuuccaguucaucuauaccugguacaaagacagucucuccugguuuuuguaagauuuccagggguuugaauucagguggccagguuggaagcuguguccggggauaaauaacauuaaaccagguaauagcuucgucuugcugguucccuccuucgucucgggucacuuugaugaguucccugggagugcugguaggaaacaggcaccagcgcuuguggcccugaacuaaggcauuccaggcacugguucccagagggucgaugugaaucccaguuccggagcgugguggccccaucacaaaccaccuacagaauggagauauccaagaugugaaguguaauuuacuuacacacauaccacacaaaacaauaaguuuuuaguuuuucuuugagagucuugcucuaucacccaggcuggaaugcaguggcgugaucuuggcugacaguaaccucugcuuccccagguucaugugauucuccugccuuagccuccugaguagcugggauuaccgacgcacaccaccacgccuggcuaauuuuuguauuuuuaguagagacaggguuucaccauguugccuaggcuggucucgaacuccuggccucaagugaucaccugccucggccucccaaagugcuggaauaacaggcuugagccaccgcaccuggccagguuuuaauuuuaugugauaugucaucuuuauuucagagauuauauaaauucugguacacagaaacacugggugcauuguucauggacugauuccuaacaaaauaagaaaaaucagcuggggcgguagcucacgccuguaaucccagcacuuugggaggcagaggugggugcaucaccugaggucaggaguucaagaccagccugaccaauacggugaaaccccaucucuacugaaaauacaaaaauuagccgggugugguggugggcaccuguaaucccagcuacucaggaggcugagacaggaggauugcuugaacccgggaggcggaggcugcagugagcugagauugcgccacugcacuccagcuuggacgacagagggagacuccaucucaaugaagaaaaaaaaaagaaaaaaaaagaaaaaucacuaaugugguuuauugcuggacuuuauuaaaaccucccuuagagaucagugcuucaaccauagcugcacauucaagucaccugaagagcuuucagaaauucugaugcgcaggcaucacccgaauuaaaucagucuccccaguagggcccaggcaggccucaggagcccccuaaaugaguucaauguacagccgagggaguacucacuguuuccaaaaaagauuagcaacugaacucagcgagcaaaugcuguuguagauaagauuuuaaccacaggccgggcgcgguggcucacaccugcaaucgcagcacuuugggaggccgaggcgggcagaucaccugaagucgggaguucgagaccagccugaccaacauggugaaaccccgucucuacuaaaaauacaaaauuagcugggugugguggcgcaugccuguaaucccaguuacaggaggcugaggcaggagaagcgcuugaacucgggagauggagguugcugugagccgagaucgcaccacggcacugcagccugggcuacaagagugacgcucugucucaaaaaaaaaaaaaaaaaaaaaagaaaaggauuuuaaccacuuagcugcagaauacuuuaccuguaagggggccugcgcuucuccccagcauacuggaaaaggucaucagugaaaaacuuuggcaccuuguagucuuccaaaaguuuccuucuuuuaggguguucaccauagcugcugucaaagauguaaaggggacuaucaucucgagugcucuccauguacucgauguaguauuucaucuucaucuucacugaguagccaucguuauccucaccacacuugaacuucugguuccgauauuuccuuuuuaggcgcuccagaguccauuucuccugcgcagaccagcccucuugcgcauucaacaaaaccacgggcuuguaaggucuuucauaccgcuccacaaauucuuccacagacagcuguaaagcaucugcccuuuccacguuauccugagggaauuaaaaaagaccuguccaguuaaaaaaaaaaaaaaaguccaguggcagauaaggguguccccaaggccaacugguaaugacaaaccgaaggaaguugacucucgucuggcuccuccggggugggggcagggcgcgugcgugaggccacgucguuccuagagccaccccccaugagccuugacagccagguccccuaggggacccgccgcccaaaggagucagggacgacgggccuucuaguugagagcgccacaggcgugggacucccgucguccgccagagcagacgggcggccacagcacgggaggaagcagacccgccccggaauccgcgccucggggaccccaaacuccgcggggugcgggugagccucuacgaggucccgggcgcucggggcgagggcagccucgggcccagagaaaggugcguagcggcuggaggugccgaugcccggccuggccacccccgcccgacccgcucaccgccacggccgccgggcucagcgagaagcucucguaguaguugugccggguccaauccagcgaguccuugagcuccggccgcgcacuccgcuuggccucgcggaugcgcuucuugcucuugugguucauucugcggggucgccagcugguuccgcuacgaccucggcgcagcccgcuuccugacacuaacgcaccccuccccggccugggcggcggcgacggcaguacccaaacgcccuucgcucagucccggcgccuuuaaagucgccuuccagaaaauucacuccccagccaccucccgagccucggguugggcaagcggccgccgucuuccccgccccgacgccucucgcgguuuuccauuggcuuuggcuccccugggguacuccuucacauacggcgggccuccgccauguugggaaggucacgucggcugcgucaccgcccc

SEQ ID NO: 16931 - RNA, 3225 nt, Homo sapiens
auauucugagaaaagcuaacaccaagaaaauguuuuaauuaaacuacagaaacaaugguuauaauacagaauauucauaagcaaaaagauacaccauguuauaaguacuuacaaaguuacaaccauuugcuuccuuaacauuuuccauguuaaguucauacauguagauaugaucagauuuaccauuuuuagggggaagagggaaaaaaagguguauuuaucaucagcuagaugugcucacuguaugcuccguuauuuauaugcaaggcccgggugacuggaagugcaguugucaggcauuuuaauaaacuggacagccauuuguuucugcacgacaaggcaucuuuacacaggagcaaucgggagaaaacaggaaacagccaagcacucugcacugcaacacgccaccuuaacagcuaaccagcauuacucaacugcuacacaacugcgccuagugcacaaaaauacauaagagaagagauuagaauuguguuugauaaacaauccuuucaaaaaaucaagucuuuucaccugaaaagucuuuauacaaauuuggguucagauuaccauuuagaucugaagguaaauaacauauacaaauuuacaccaacuuuuguagguuuuuaauuuuaaggaaugaaggcaaugcugagucaaucucuugacagcuuuaggcuguguguaauggcugcacacguuuuccuuaaaagucaggaggccacaaauuagguuaccaaucuguuuaauuucaaacaaaaaaagucagcacuauauaacaaaaugaaauuuuaccucaaauauccaaauccaauaaugaaaucugaagucguucaccucacuaaauuacaagaaauuugaauaacagcaacaaaauggcacauaaaaugaaguuugccaacugaggcaaagcuuaaacaaguaaaaaguuagacaaauguuacaaaauaaccuuuucaauagccaguugcuuguuccaaggacucuucuucgauggacuaugugguccuuuuuccccaaguccuccguuuacacugcuugccgauacaucuagguuugaaaagaaagaaguucagcuuaccuuccauuaaagugcacaugguuucaguuucaggcacguacuuacuaaggcucuggucaaaccaguaggguacagaaauguuccacccagccauguuuuuaaaaggcccaauuaggaaaauuucacaaaggcuaccaucagcauguacaaguuugaauuuacguauuccuggccaaauaaccaaggugaagaaagguaaggggaagaaaaaaaaagaaaaaaaaaagggcuguauccaaacaaaaacaacucgagaucagagaauuggucuauauuucauuaagauaaauuguuucaaaugaaacauuugguaauugagaauacuacuuuaauaucugagcuacuuagggcccuuuccuuuuuaaaaaauaggaccaaacaauuuaagaguuaaagacacacuauccuuuccccacccagugcaauaccuguaacuuucuuuugggguuccaaauguucacugcuucuuauugcaauucuuuugccacauccauuagaauaugaagucccagucaguacaacaauaguugaacugauuguuucucuaagaggauagugcaucuuuaacauuuaaagacaaaccugcuccaauacacgcccacagaaacuggucccuggaggaucagccaaaucaguuaaaaucugcaauacuggccaauauucuuuuaucaaacaggagaccgcagcuuuaaagggggaaaaugcagacguuggauaaaaacagcaagaaauagucauuuucauuaauaggucucaaacaguuuacgaaacagccauuauuaucuaagcuucauacacauccuuucugcagaccccucucuucaguauuacucccaaaggugaguaaccuccgagcagcacuccuaaugauaggagucauucuuacauuaacacgacucaaaaagaccuaccccaaaucccauuuaugaauuaggguuaugugucucggauucccagacauuaccauuuucuuaagaggacaccgcuccuuccucuucaggagacuuggggggacucuucgaucgcgaccuggauuuggauucccucuuggacacugggggaggacuccuggaccgagaccgggaccuggaccgcgaacgagaucuggagaccgacgaggacuuggacuuggaccuucgugcggaucuggacuuggaggucgaccgagaucgagaacgagugcgggaccgagacuucgagcggcuguagcgagaucggcugcgagaccuggaacgacuccgacuccgggaucggcugcggcgacgccgccuagggcugcgggcgggacgagcaagcacagcgggguuaauuccaggcagcggggccggccccgcccgcgcgcucccgcccaggccgccauuaucucgccgccagacgccauuuccccagucgcgaggcgggguccuccgccccgcgccgcccacaccccggccacucccgggucgcagacggcggaagcucgcgggguggccggagggucgcgagacgcggcgugcacccccgccccguccgggcccgcaccacgugcuucgccgcggaccuuugugaggucgcccgggccucccgcgcgccccgccccgccucccgcgguccccucagccccguuuaccugcggcuccggcguccguagccaccgcccccguaccugcgggguggcgguccccggcggcuguggugugaguccggggggcggccguagcgcgccauuugcacccgcagcucgcggccguccagcacggccccguccauggcauccauagcguccucagcgucgcgcuugucgugaaagcgaacgaaggcgaagccgcgggacuccuugguguagcggucccgcgggauguacacgucgccgacgcgcccguacuucucgaagacgcgccucagcgugucgggcgaggugcgguaggucagguuguccaccuugagggaggucauacccuccacaucgggaggggggcggccguagcucauagcucugaguggcggcccggagccccgcgaacuggcgccggcuuccucagcucugggcggugcgacgccgcgccucucaggcaguugccuuccgcguggggacacugggaaaggccuugccgcagaacagcacggacgggcuccgcaggcuagcgcaccugaguaacaacugggcg

SEQ ID NO: 16932 - RNA, 4803 nt, Homo sapiens
gucaccuuggcguguaucuauuuauagccauacacaacagggucuuaagcagucaccauucaaaaaauauguggucaagaacuaaaccaaacaaaccuggaugauccuaggccaaaacaauuccuuuccaggcacacaggcccagcagagacaaaaccagauauucauucaucacacacacaagucuuccagaaacugaccugcaaagaaaaguauaugcaucaguucuuauucuacuuuaccaagucugaauauuuaaaacugugagcuccaugagauacucucuaaaaucuaaaauccaccuuccaccuagaacaugacaugggagguacccugggauucugcccugcggggaaugggcccccagccaccccucauucuuccaagucuacagguaccacugagccaagggcuggucaccuccuacucaaagacaucacaaggacuuccuaaccucaucuuucccuuucuuuuuuuuuuuuuuuuuuuuuugagacggaguuucacucuuuuuagcccaggcuggagugugcaauggcgugaucucggcucaccgcaaccuccgccucccggguucaagcaauucuccugccucagccucuugaguagcugagauuacaggcaugugccaccacgcccagcuaauuuuguauuuuuaguaaagacgggguuucuccauguuggucaggcuggucuugaacucccgaccucaggugauccgcccgccucagccucccaaagugcugggauuacaggugugagccaccacgcccggcucuaacccaucuuucuccaggcugucaucuguagaccaccacguugcccuuagaaaccugcuuguuaaaaaagccacuugaacuuugacauucaagggcccuacaaccugguuaucaaccuacauauuccaacuuuacuuuucuucccuucccuccagccacauauuacucaguacagcucucacuagggagcuccccacauucuuccaugcuucccgccuuuugucacauuucagcagauggaaacagccuuuacuuccccgagagggucccauccccugaaggguucaacagaaaauguccuuuccuguuguuccauagugccuacugacaucgcuagauucuaagccccuaacaccagggaccauacuuuucuuuauauucccuccacggcguaugacucaaugugcuuaccccuguagguacuuaauugcacugaugaugucacuucucaaucugugugcuaacaaaaaacaggcaaagacagaaggaagacgcugcuucaugaaggagcaggcuaaacuacagccgagaaaaucaauauuacauuccauaaacaggccagguguaguggcucaggccuguaaucccagcacuuugggaggcuaaggcaggcggaucaccugaagucaguucaagaccagcguggccaaaauggcgaaaccccgucucuacuaaaaacacaaaaauuagccgggugugauggcaugugccuguaaucccagcuauuugggaggcugaggcagaagaaucgcuugaacccgggaggcggagguugcagugagcugagaucgcaccacugcacucagccugggcaacagaauaagacuccuucucaaaaaaaaaaaaaaaauuucauaaacuguuauugucucuguuggagaccuccaggagaaaucaacaugaagguucucccagaagcauaaucucaaccuucagccaagacgggaggaagagcaggagaugcaaaaggguucugugugccacgacucccggaaagguggcacugcucccucuaaugcacuguagaccaacacagcagccacuagccacaugugacuauuuacaguuaaaauaaaaaauguggacucacagucaccaaaugcucaacagcuacauguggcuugcggcugcucuggauagcauaaaauggucagauaggccauuuccaucauugcagaaagugcugcuggacagcacaucaucuauguucugcacauagugcucuuuugcaauuacagauuugucuguaucauccucuuacauaaaacccauaaaggggcagggcaaggugguucaagccuguaaucccagcacuuugggaggccgaggugagcagaucaccagaggucaggagucugagaccagccuggccaacgugaugaaaccccgucucuacuaaaaauacaaaaauuagccgggcaugguggcgugcgccuguaaucucagcuauuugggaggcugaggcaggagaaucgcuugaaucugggagguggagguugcagugagccaagaucacaccacugcacuccaaccugggagacagagcaagcuccaucucaaacaaaacaaaacaaaacaaaaaccccaaaaaucccauaaugguaucccauuauucuuaggccaaagaccaacauccucgccugagccgcaaggcccuguauggccuggccuucccuaucuuuuuuuuuuuuuuuugagacagggucucacucugucacccaggauggacugcaguggcaccaucaugacucacugcagcuuuaagccccccaccucagccucccaaguagcugggaucacuggcaugggucaccacacccagcuuacuuuuuugauuuugcauagagacaaggucucguguuacccaggcugaucuugaacuccuuggcucaagcaaucuuccagccucagccuccaaaagugcugugauuacaggugugagccaccgcgcccagcucuucaccuuuuuagcuucauuucccaccauucuccacuuugcuuucugggcuacaaaggccuucuuucaguuccuucaccagcugcaccugcuggggcacugugcccagcaaacuuuuacccauccuucagauucuagcucgaggguuucauccucagaaaagccuucuagucuccaucggaucuuuuuuuuuuuuuuuuuuaauaauuaaaaaacauagaaaugaggucuuacuauguugcccaggcuggucgcgaacuccugagcucaagugauccucccaccuuggcaccccaaagugcucagauuacaggugugagccaccacacccgccagauccuugggauauauguucuuacguucccuuccuucagagcacucacuuuggcuugaauuaugcccuuuuuuuuuuuuuugagauggagucuugcucugucacccaggcugcaguauaguggcgcgaucucggcucacuggaaccuccaccucccggguucaagcgauucuccugccucagccucuugggauuacaggcauaugccacugcacccagcuaauuucauguuggccaggcuggucuugaacuguugaccucagaugaucugccugccucggccucccaaaguguugggauuacaggcauuaaccacggugcccggccugaauuaugacuuuuuuuuuuuuuucucggaguuuugcucuuguugcccaggcuggagugcaguggugugugugaucucggcucccugcaaccucuccaccuccuggguucaagcgauucuccugccucagccuccugaguagcugggauuacaggcacaugccaccaugcccagcuaauuuuuuguauuuuuaguagaaaugggguuucaucauguuggccagacuggucucgaacuccugacaucaggugauccacccgccucggccucccaaagugcugggauuacaggcaugagccacugcaccuggcugaauuaugcccucuuaagugugaucauuuaaccuugucucccuaacuggguuguaguucccagagaacaagggccaugacuguuuucuucaucucuguauccguaacauuuaacaugaugucaggccaauguaucaacaaauguuuauugaaugaaagacaugacaguaacauuguuuaugaaguuuugaaaagcaagggcucucugauacuaacuacaaccauuuucuuuaaacguagguccuguuugcaguaucauacaugaucaucaaacugcugcuagaaugcucacaccuguuacugcaaauucaaaacccaggaaagacuucuuccgggaauuuacuuuaggucaggguugggcugccugguaccaugcugcacccacaacuuggcaggcucaacaacacaggagccuuuccccagaccgucugaccugaacacuuugucaccaugcuugacauaccuggaugcccugcugaggucacuucgaaugcucucaucaacgaggggcaggaagaaaauagugguugcugcauguuuucagccaaucgucgggggauauuucucauuuucuguugaaaccuugggggaaaaaguaacauaaugugcuuuaaaaggacaaaagucauucgacgcuuaccacacuccuagaaaccugggcuaacccagccagggaccccaaugcuuuucugcuggcuacggggccucccuacagcuccucauuccaauuucgguggcugugugcggaccaaguucucuuuugucgccucccguccaagcccuacuugcgaugggagaagccguccccgaaaucccgggcgccguggagggggucuggucucugggucucuggucacccggucagugccuccagcccccggcagagcucuguuaucgucccggggcgagcccaauuccgcaggcuagggccgauggcggcggaacuguggucagggcugcccugagucauccugcggacugcgagucggcgaccaccaggaggcgagagcggguuuccccuccaacaggccaaagcacgugucuccacuuacuucccacuccccugggcggaaguagcuccgucagcaacuucc

SEQ ID NO: 16933 - RNA, 1928 nt, Homo sapiens
ugccccgucggauggugugggagcaccccgucugcuuggcccgggugggcagggcgggugacucaggggcgccccugucaccacccccguccaggcagcugcgggagcccgcgggggugcagaccuugcgcuggcagcgguggcagcgccggcggcagacgguggaaaggcgccugcgggaggcagcgcagcggcuggcccggggccuugggcucugggagggggcgcucuacgagaucggggguaggacccgcgcgacccgcaccuccccuugcccucucuggagccccacugcccagaucggaaaaaggagaguggcaucaucccaccugccuucacccgggucccccgaccaaucggccccuccccccucccaccccuuccgcccgcaggcaccgcaaaccucgggcccacgcagcacccccaggugacugucagcgguaccuccggacucgggcgggugggagccuggcgggcaccccacgccguccggugggcccgcccuuggacucucagcgcggccccagccccggccccggccucccugacccacccugcucucccacugcaggccucuucggcacaggaauucgguccuacuucaccuuccuccgcuuccugcugcuacucaaccugcugagccugcugcucaccgcaagcuucgugcugcugccccuggucuggcuccgccccccugacccaggccccacccugaacuugagugagugugaggcccaccaggggaagugcuccggugcccaccugcgccaugggggggcuggcccagggcccagagcguggcgacaacgcugggcgugguccugccgugcaggccccggggcucucucucccugaccucgccuuguguggggcacgccuuuggcacauccucagcccccugcccaggccuccccaggguuggggguuauagagcaguagccgcagagccucaccuaugccuuggggaucccucucuauugacccccuuccuccucaacagcccuccagugcccugguagccgccaguccccgccuggcguuuugagguuccacaaucaacuuuggcauguuuugacuggcagggugagugaggucugucccggcuaugguccagagucugggagacccagggaacuggcuucaggggacacaagucuaagaggaccucugcuccuccagggacauuucggcuccucaggggauggucuuaccuagacagacuggccuggccgguggugggguuagagagaggcugaggccacugugcccaacauagacucauggacacaugcccgugguccucagagcccagcugguguaggcggugccagggacaaagggggaaaagugccccggccucugggagaagcacuuccccacccucauccugggaagccaucgaguggucaccaaugggguuccuggguuccagucguggcucuauuucucaaagcccugugaccgugggcacguugccgaaccucugugggcccuuguaagacgggacacucccuaccugauggggggauugcacgggggcuaacaagaucauauauggaaagcacuugagcagagccuggugcucacccgggcuggguaucuucgucgcuguccccaggccuucaccaacaccuaucucuucuacggugcguaccgaguggggccggagagcagcuccguguacagcauccgccuggccuaccuccucagcccgcuggccugccugcuccucugcuucugugggacucugcggcggugagagcgagguccacaccuucaccccuuccccagggaaucuucccugaucaccccuuccuuggcaggguacccucccauuggcaggaaggcccauggcccggcacagcaggcuccugggugcuuccucagcccaggcucuggccgcaaaccuuaggaacagggccaccgcc

SEQ ID NO: 16934 - RNA, 6146 nt, Homo sapiens
aacaccuccacucccugcuuccaccccagcccgggcacagggucccggucacuccguccucaggacuccaacggccucagcacaaacucccacuuccucagcaccaguucaguguccuacaccgagacgucgcggugccacacggaagcacggacugcucuguccauaggaacaguggcacgcacgccacguggccagugugggccagcucaucagcacucacggcccgcaacccagccaugcucaccaccaccauguucgucuccacgaaggugggaucaacugagcagacggacaacaccagcuccuggaguccugggccagguccugaggugagcagaggugaccccaggcccugacccugaccccauugccagcaaggucacccgggaggcagggggcaguucggucacgguaggagaaggaagggcccuguguccugacuuggccuuugcagucacacagacugggcucugcugcguuuagcuaugugaucucagacaaaccuauugaccucucugggccucuguuuccucauugugaaguagggacaucaugggauuguuggaggacucagugagcagauggaagacccagguuagaggcucugccagacucugcagagcaucacaauccuggccguccaccgagggcuuccccaggcuggacucugcgcugaguagggucugcugaagcagcuggugcccugggucccgcccuagugacucaauggccacccugagucccaggauccagaagccugcaggccugcugggggacccccgacggcacagcucaggccaagucagaggaagcacagggaagcgaggguggggcguccuguccaggcaccuugggugaaucucugggcguucccauggucuugccacagugccugcuuugugucaaccagucccaccagggccaccgcagccagcauccccaccuggugcaugcuuccacccagggcuuuuuggaggcgccaggcuucuucaaugaaguccuugggccucccagccagggaccccacuggggcgcccaggcccugggagguggagaggagagacuccugccagcucacaucccuguccuugggccaggguggggacagaugcguagccccaucugcagagguguuaaaggggaaccuggggccagcugccagggauggagcucaggaauccaacccugccuccugcuggggcgccccaccccaccugucugugggaggccagcccagggcuuucccaccuuggagaggcagaaagacacagagucacagugcuccacaauguaggugggcgggacaugcagggccagcaccacguucaucagcugggcccuguccagguggacccaggccccauaggucugggccaggaggugcaccugggggugaggugcaggcagagucagaggggccaggccugagggaggcauagagggaggaggguccugggcuuagcugccugaggaaucaggagggaucaggagaccuggcuggugacuggcucuggugaucugggacccaagcagucaggcugugcugccuaagccuccaugcugggcucugggaggaucugggggugcacauuuaacccagcuuugucgcacacugagcaugggccaaacgaccgugggccaaggguaaaugugugucaccucauuuaggcugcacaacaacucgagggagacgccgcugcucccauuucacaggcaaggaacgcaaggcuuggagaguuaggcugcugccuaacuagugucugguaaacagcagagcucagacacugcggccuccucaccucgcacguggguggcaaggaccagguggagggcacucacacgagcuuguuccugcagccucauggggcacacguuucugcgccagggcagcagguccuggugcugcucugggacucagcucuggggacuugggggugggggcaucucugcuguugggcuggugcagggacuaggggcccugaccugggguaauaauucccuuugugucucagccuaggaccacacauguguccuuccugugacaggucuggccgcugaugggugcccauggcauaaaucagaggggacugaaccccaggaugggccaggggcacaggaagccaggaucaggcugguggggggcacacagugguggggcugggccuaccuggcguagguaguugauggggaggauccggacccccgagaugcugugugaguucuccaggcaaaugagcucgcagaccuggugguagggacucuggaggccccgcgugaucauccucuccagcucagccaguccagagugcaguggggcagcucugggagggagugggagugcacuccagcccucugugggucaggaagaggaugagggcugagggguccaggggcaccucuuggcggaguggggggcuccucuggaguaaggagccagacccugaguccugugucugcucccccgaggccugggccuuggagccuuuccucuguucugugcaucuagacagacgucccagcuggggggcacugggccccuccccuauuaacucuucagaugcugcugucuggcucccgucgggagcgcgggagugcuccgaguguccacuagagggcaccaggcaccaagcaccgcccaggugucugcccggcaagccuggggccagccccagccgcugccgcccccacguggcaaaucuggggcucugcucuccuuccuuccuccccuggagaggcugccaucccagccagcuucuccauggcugucccuuucuccccuccgcaggucccagccuggugccugggaaggggguuugccccugagcagccugugcuggcuggaggaugcccagggccccaggugagcaaugccugcuccuuaccugagccaccccacccugcucauagacguggagguggcacuccugcccaaggaggagcugggagccccggcgccagcagugacacaucacugagacagaaggagggcaggucuuggcauugagucuggaggcauguggcccugcucagcguggcuaggcugagcccuaaggcuacagucaacucacaaaugccugaggccggcaaggaaacagcaccuucaagacaccucagugcuacgugccagaagaccaucccauuaaacacacaagucuaggauagcugugcugcgcugggaaucgcugggccacacccagccugcacaccugcgccuggaggccccuccacagagcaucgccugcuggagaagcugcugcaaugcugcuucuugguggacacgcagccgaggcaccugcagucgucagacccuggcaggaaacagacggcacacacacacugggaaacuggcaguguuuaaucaugggacgguuuauagaggggaggcaggagcagggaagcccggagaacaggccugaggggugagaggaagguguggcugcaggaacccggagccagggcuauguggagaggucccugacgcuggcccagaggcccuggggacccucggaagaggagcuagggaggagcagaccugcagcccccacuguccuccucccccaucuccuuccagggcuccccaccaacccaacagaaauggaggaaugugguccaugagugucagagcccccccauaugcacugaggaccugcuaggcagacagaagucgcccugcgcucaccagagaugagguuggccauaguguuggagggcacaaagagggugcgccccagcccuagcagcuccacagccauuucuugcagcucugcggagggacagggaagccgcugugcuugcacacucgggugucagcaccguccaugcugcuuucccugugucacuugggccagagcacgcccugagcccaggugaggccccuagcccgaggcuccggugagcagcugaguggguuuggagccccauccaccagcugcacacucugugggcuuagcaaccacacauccagccccacagggcccucagucaacucugcaccccaccuacccugggccauggccucuccccgcuccccccaagaaccucucuugugguuugaaccuguccccggcagaccucacaccugucucacuuccuuuccccucagcccuuugcagguggggccugugguuucucugcugacuuccuuuccucgucaggagggaugaguggggggcuggacggggugugagggugcagcuggagggugaggaaggcucccgcucuugcuguaaagcccacugugguccccccaacuguggcaucaaguccuuagcaugacacucagggcuggagugaccuggccucugcccccccuccucagagccuccugcacucuccacaccugccacauccccaccugcgcccugaagaccuuucucaccagucugcuucugcuccugaagaccccugcccugugagccggcgcucccuucccugccugggaugcuuccacucagccugcaggagggcuccucugugaagcccccuuccccgugagccacagccucgccccauccucugcuucccagggcacccucucuagacucccaucaacucaagcgccuccccagccucuccuugagcggcagugacuuguugacaugugaggcugccugggagcauggagaucagcaucuccagcaacgcugggcagcagcuggauacaugcuuagccccagccaucccuuaaccccuuagcagacgggcccucgggauucaacuggugaccccauggcuuguccuggccuagcugaggggugugcacaccccaacagucaaagugguucacuauggcaacucacaacccagggcuggggcugggggucgcuguacccuggagacacucccuagguuauuagaacccacuccuugcgaggugcagccuguagaaccugccccuuucuacaucuauuuuccauuugccuucugugggggaaggcagugcaggagaacaguuguggguuucagagucagaagacccggguucaaaccuugguucugccauuuacuaaguauggggccuggagcgccucccuccacaucucagaacccuccucugcaagacuggacaucacccaucucagggggcagcugggugacaaugcaggacacacacaaccaccuggugagccuauagaaaugcagguucuucucggcaggccaugugaaucugcauuucuuuuauuuauuuauuuuuauuuuuauuuuuuuuuuuuugagauggagucucgcucuugucgcccaggcuggaaugcagugggacgaucucagcucacugcaaccucugccucccggguucaagugauucuccugccucagccuccugagaagcugggauuacgggugcccaccaccacgcccagauaauuuuuguauuuuuaguagagaugggguuucaucauguuggccaggcuggucucgaacuccugaccucgugauccgccugccuuggccucucaaaaugcuaggauuacaggcuugagccacugcgcccggccggaaucugcauuucuaacuuucagguaacagcagcacgcacgcagacggcaagccuauccuguggcagguguucauuacacccauuuaugucggagguugcaauuuuuugaauuuuugccaucagaccuuggcgaugaccuugagcaguaggacauaaauaccucccagaugcuuagcguuccaauaauggaacacuaggcauaaauggguuuuaagcgccaagggagccacuuccccugcgucccagaccaucacggacagcgcuccgcugccgccuccacgacccccggccugcacgccggucuucgccguagucgucgucccccacgaccgccucggccaugacgcaccucauggccggcccgggccuggucaccuugucgcugcgcaggcccaccacguaggcugcgacccccgcgcucccacaccccgcccggagcgccccauguaccggggccgccgcucgggccagucugcggagcauggcgcgggcagcgcccgacuccccaccccggcgggagcugcugacuccucuacuccccagcgaaggcggcgagagcgacguggucggugcggccagaauuccuagagcugggaagcagccgcccugggccggggguccagggagcgagccccguggcacgcug

SEQ ID NO: 16935 - RNA, 4151 nt, Homo sapiens
auguuuuucauuaaaaaauagugcucuuuauuauaaauuacugaaauguuucuuuucugaauauaaauauaaauaugugcaaaguuugacuuggauugggauuuuguugaguucuucaagcaucuccuaauagccucaagggccugaguaggggggaggagagaggacuggagguggaaucuuuauaaaagacagagugauugaggcagauuguaaacauuauuaaaaaacaagaaacaaacaaaaaaauagagaaaaaaaccaccccaacacacaacugcccuguccagcccaauaccugacacagaauacuuuguguuuguuuaguugcccccccccacaaaaacaaaaacaaaaacaaaaacaaaaaacuguuccagguaauuccaucgcugcuacauuccuguaaauugucacugaucagugcuauggcagagcgggagcacccgggguggcagcaguccagccucuccaaugaccuccagccucccccacccaggcaggagggagggcugugcagggcucggggcagugggaccugguggcucugcucugaccacgaggcgccugacuggccaauacuuacugggcugacauucccagugcucagcugggaggcauggguuuccgcccccccuccccacuucccuggcugugggcuggcuuggugcccuccagugagucccucagccucuccacccauccaggcugaguauguggcuuuccuaugcugggucccucuccaugggacagggagcauuuaaggcgaaucucuuagccagacauagucaggaggcacagaguagaauccccugucuucucuaccaggagccugaggugaaagaugucccgucuccuccauccucccgcuccauccacccagguacaggaagguauaguaugaguaggaaaaggagaccagcugaccagcccauccauccccuccaaauguugcuucccccuuaaaacggaggaagggcccugggcucucaggcaccagguagacuuuggaaccuguguuuucggugacugucccggaggagaggaugugggguaccaggaugguucccuucaggucaccccaagcccuucuccccggagccagggagaggagcaugucaccaggauccucgccuggggugggcggggggugugaccauuuccuucgccagcccgcagcccuggggcccucaggaccucucucucuuccaccuuucccaggcuccacaaccagcucagguuuaaaccaaaucaaagagcaaacaaguuccguuggaaaguuugaagauucccuggcaguucucauuaguucagcauucccgaaguguccccuguuuggaggcagaggggaagcugaggaauugaaggagaauccacuugugguugcuaucgucccaccaggacagcuggcuccuccggagaagcuggagacucaggugguacucccccuucccuccaacacauuccagguccgccugccacauucugcagggagagggcagagggaggggccuguccgcccucuuuccccccagagcuacaggacucucuccugguuggcuucuugugcuugugccaugugccacggaggagaggggccugcguccccucucccgacccaugcccuuugcgcccuuuaccccuuaaagcggggcaucguacugguccaggaacucccgaaugggccccggcagcugggugacuuucucauaggaguccagguggccguugacggucuuccgacagagaugcugaagaguggccacguuggaggagaggggccggcucaacaccagggggaucuucucgcccccggaguagauguaauaggcucuucuggggggacucccagggaguggcugggcagacggcugcucgggcaccucggaggaggguucaguagguggcgaggggaaggagggggcuccagggggcggcauguaguggugcaccagcuugagcacgcagucgaagcggggcacgggcugcgugcuccggggaucgcucugcagagagaagcugccccccucacacuggaugcgcagguucuuggucccagacugggucuugacgcugagcgugaagaaguggcgcugguccgagcugucgcggaucagaaaggugccggcgggcucggcacugagcagcagguucgccucgccgccggucacugcgcuccaguagaagccgcucuccugcagcuugcgcacugcguucaccaccagcugguacucgcucuuggagcugaaggucuugaggcgcaggcugguguccagggggcggcucaucccggcggcgggaaacuugcugugggugaccauggcgcacggagccagcguggaucugcgcggcggcggcugcagcugcuucgcggccuccgcacagcggccgcuaccgcaucccggggggcugcggagaggaaggcgcgagcgcguugagugcccggaacccuccagcgcgcccggcccgccccggcuccccugccuucgccgagcgacuggggcacccacugccccgggggcccucuccugggcccgcgcuccgauccaggcgccucacggagcccgcacggcucccgccccugccggcaggguggccccgggcagccccuucccaggcgcgcacugcaagggcgcagcgugggaaacucgcgcgcggaaguuaggucuccaggaguguggccggguggggagcaggagaagggcccccgggacugccugggcgccgcucaguccaguagccccgggcgguguggacggagggagaaacccgaggcacggggguagggaggggacaggagaagcccgaaggccccagccggaguauuccgggaaccugggaucuccggcuuccauccgcucugccccuaccucgucaccucccugccgggaaugacccgggaaggggaggggaaaccgggaaaagcucccgggacugagcgagaccccuccccacgccgcgcuccuccuuccuaccuggucccgaaucgaagucuccguccuuggggcugagcccccucggguccccaaggcgacgcggcggcgagacggccagcgguggcccgcgcugcgcccagauguuggcggccgugaaguccacaaaggagccuucgcgcgcgcgucccucgagcuuccccugggcgcccgcccugcccccugcgcacccccggaccaaccgggaggggaccaggagagggaccgcggcaaggggccgcggcgggagcugggccgggcgggcggcuggcggcuggcugcgugcggggccgaagcggcagcagcggagcagggaguccaagucggagccgccgcggaggccgcgcucgcggguauauaggcggccgccgcgccccgccccccgauuccuggaacugcgcggccggccuucuuguaauguuuagucacuacucgcagcagagaaaggcugagcgcggagggugagggaggggccgcgggcgccgagggcgggccgcgagcaggggcagggaccgggagggacgcgcgcggagacaaagcgcgacgagaggcggccgaggcggccggugggcgcggcgccagccccggcggcgcguuccuggcagcggccccuccccgccgcgcgcuccgcccccaacuucucauucacacuuuccccccaccccccucccuucuaagaaggcugauuucuggcagaggcgggggcgccgcuucgggagagcgggcaguucuaggaggccgaccuggagagccucccgguuccccuuccccuuuucccggaccccgcggggacacccccucgccgccacccgggccuccccgagggcccaacugcgggucaggcggcccgggccagccgaaagggaaguggggcuaccccacagccaggcagcggggcuggggucagacccgggagccggagguuggagacgugcgacagucaccugcgggcagauuccagaggggagacccagggcugcaggggacgccccuucguggcagcuacccagccucggcccacugccagguucuuugccaacccugacgcgaguguggagccccccuccccuccccuaugaaaacgcuuucaugcacuggggucugcaaaccugguugguccgguguggguugggccaggugcucucggccgggcuggagagcucgagguggaacgauggc

SEQ ID NO: 16936 - RNA, 4151 nt, Homo sapiens
gccaucguuccaccucgagcucuccagcccggccgagagcaccuggcccaacccacaccggaccaaccagguuugcagaccccagugcaugaaagcguuuucauaggggaggggaggggggcuccacacucgcgucaggguuggcaaagaaccuggcagugggccgaggcuggguagcugccacgaaggggcguccccugcagcccugggucuccccucuggaaucugcccgcaggugacugucgcacgucuccaaccuccggcucccgggucugaccccagccccgcugccuggcugugggguagccccacuucccuuucggcuggcccgggccgccugacccgcaguugggcccucggggaggcccggguggcggcgaggggguguccccgcgggguccgggaaaaggggaaggggaaccgggaggcucuccaggucggccuccuagaacugcccgcucucccgaagcggcgcccccgccucugccagaaaucagccuucuuagaagggagggggguggggggaaagugugaaugagaaguugggggcggagcgcgcggcggggaggggccgcugccaggaacgcgccgccggggcuggcgccgcgcccaccggccgccucggccgccucucgucgcgcuuugucuccgcgcgcgucccucccggucccugccccugcucgcggcccgcccucggcgcccgcggccccucccucacccuccgcgcucagccuuucucugcugcgaguagugacuaaacauuacaagaaggccggccgcgcaguuccaggaaucggggggcggggcgcggcggccgccuauauacccgcgagcgcggccuccgcggcggcuccgacuuggacucccugcuccgcugcugccgcuucggccccgcacgcagccagccgccagccgcccgcccggcccagcucccgccgcggccccuugccgcggucccucuccugguccccucccgguugguccgggggugcgcagggggcagggcgggcgcccaggggaagcucgagggacgcgcgcgcgaaggcuccuuuguggacuucacggccgccaacaucugggcgcagcgcgggccaccgcuggccgucucgccgccgcgucgccuuggggacccgagggggcucagccccaaggacggagacuucgauucgggaccagguaggaaggaggagcgcggcguggggaggggucucgcucagucccgggagcuuuucccgguuuccccuccccuucccgggucauucccggcagggaggugacgagguaggggcagagcggauggaagccggagaucccagguucccggaauacuccggcuggggccuucgggcuucuccuguccccucccuacccccgugccucggguuucucccuccguccacaccgcccggggcuacuggacugagcggcgcccaggcagucccgggggcccuucuccugcuccccacccggccacacuccuggagaccuaacuuccgcgcgcgaguuucccacgcugcgcccuugcagugcgcgccugggaaggggcugcccggggccacccugccggcaggggcgggagccgugcgggcuccgugaggcgccuggaucggagcgcgggcccaggagagggcccccggggcagugggugccccagucgcucggcgaaggcaggggagccggggcgggccgggcgcgcuggaggguuccgggcacucaacgcgcucgcgccuuccucuccgcagccccccgggaugcgguagcggccgcugugcggaggccgcgaagcagcugcagccgccgccgcgcagauccacgcuggcuccgugcgccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaagggguaaagggcgcaaagggcaugggucgggagaggggacgcaggccccucuccuccguggcacauggcacaagcacaagaagccaaccaggagagaguccuguagcucuggggggaaagagggcggacaggccccucccucugcccucucccugcagaauguggcaggcggaccuggaauguguuggagggaagggggaguaccaccugagucuccagcuucuccggaggagccagcuguccuggugggacgauagcaaccacaaguggauucuccuucaauuccucagcuuccccucugccuccaaacaggggacacuucgggaaugcugaacuaaugagaacugccagggaaucuucaaacuuuccaacggaacuuguuugcucuuugauuugguuuaaaccugagcugguuguggagccugggaaagguggaagagagagagguccugagggccccagggcugcgggcuggcgaaggaaauggucacaccccccgcccaccccaggcgaggauccuggugacaugcuccucucccuggcuccggggagaagggcuuggggugaccugaagggaaccauccugguaccccacauccucuccuccgggacagucaccgaaaacacagguuccaaagucuaccuggugccugagagcccagggcccuuccuccguuuuaagggggaagcaacauuuggaggggauggaugggcuggucagcuggucuccuuuuccuacucauacuauaccuuccuguaccuggguggauggagcgggaggauggaggagacgggacaucuuucaccucaggcuccugguagagaagacaggggauucuacucugugccuccugacuaugucuggcuaagagauucgccuuaaaugcucccugucccauggagagggacccagcauaggaaagccacauacucagccuggauggguggagaggcugagggacucacuggagggcaccaagccagcccacagccagggaaguggggagggggggcggaaacccaugccucccagcugagcacugggaaugucagcccaguaaguauuggccagucaggcgccucguggucagagcagagccaccaggucccacugccccgagcccugcacagcccucccuccugccugggugggggaggcuggaggucauuggagaggcuggacugcugccaccccgggugcucccgcucugccauagcacugaucagugacaauuuacaggaauguagcagcgauggaauuaccuggaacaguuuuuuguuuuuguuuuuguuuuuguuuuugugggggggggcaacuaaacaaacacaaaguauucugugucagguauugggcuggacagggcaguuguguguuggggugguuuuuuucucuauuuuuuuguuuguuucuuguuuuuuaauaauguuuacaaucugccucaaucacucugucuuuuauaaagauuccaccuccaguccucucuccuccccccuacucaggcccuugaggcuauuaggagaugcuugaagaacucaacaaaaucccaauccaagucaaacuuugcacauauuuauauuuauauucagaaaagaaacauuucaguaauuuauaauaaagagcacuauuuuuuaaugaaaaacau

SEQ ID NO: 16937 - RNA, 8869 nt, Homo sapiens
uacaaacaaauguaggaaccucaauguaauuuuaaugaccucagaccagugacaagggcagacugaccaggggcuguggggggaucccagagcaaccucgagggcguccuggugcuuaccaccuggaaacuggugagguggugggagaacuccugguggacccuaguggaagccuuccaguaauuucuugaagcugagcgcucaggugaguagggcgacaucugguggccgguuguugaaggucauugcagagaggaaggaagccgaggaggggagccugcagugagggcguccugggguucuccgguucucaccacccuugggccacgccgucuaguccacaccugaggaguuggucagguagaaggggcggaugaccgugcggaagccguugaagugcccugccgggcaggggaaggaggaggugcucuucgagcuguugguguccagggcacugggaaucgcagccuuccagcccucgaaaucggugacgucugccacgaagagcccuucgcagagcaucagggcuuuguuuucguaggcaauggugcgaucugagccgccagacuuggugaggcccaggacagggagcucguccgaggagcaggagaagccguaguuccagcagcucuggaugguggggagguagaccagggaccaggacacccucuuguccuggaagaggaagcugggguguuguggagucuggaaggacugguagggguaguaucuguagucagagggggcuuggaaguaaucagaagaauauuugaccaaaggcccccgucuggacugauagaccaguugugacuuccgugcacuccaggaacugucugucacaaaggcacuccaggugggcgagguguaaauccggggcuuguagguauccucggugagguucaggccuuuguaccgggccagcaacuggaagggcacaguguggaauuccagggccugcagagucuucuucuggaacagggccucguggcuccaguacagggacagguugaacugcagcucaaagagcuccucagggagcaucauggggaagcggaucuucuccaccaagcccuccaccuccucaugggaggcacgcuccccccagcuccagguguccacggccuucaguagggccagcucgcugggcaccgccaggucgcuccugggcagcagcaguuggagcaggucuguggggacacugggccaggccucggccugcgucaaggccucgaaguuccaggccaggaacuguaggcagagcuucuccagcagggcguccccuguggccacugcauaggcauacagguccaggggcaucuggaacgagggguccugggggaggaggauggcaaagaggcuugcgcaguagcccugcagcugccuggccccauaggcagaggccagcuuguggaagcacuugacugacgacagggugaugucaauccuucgggaguagaaguaccuggggagaaagaaggagagcagaugccggccccacaggacagcaggggagcccugggcccaacuguccaacacagccaccugagugcacacagugugggagugagcaugcgugugugugcaacugcgugagugcaugugugacugcguguguacaugugcaugcaugaguaugugcagguguguguguggggggcugugcuuuugaagaggggaggaggacaaagccccuggcggccccagagccugaggacgagacggcucaccugagaaggucccugaccaugggcacacacucagcauccacacucauggugacauugcugcccggcuccuuccacagggccugggccuccagguuggcagucaggaugaccguguggccacagaagcccagggcguccucgcccugcacauucacgcugauggacaggucgcagccccgcuggcugucaaagaucuggccaagggccuccgagagcucccuggagagguccagggugugggugcuccugguuucuaagaaggggcgggagggaagugggcugcguuaggagccggggcacugccacucucuggggucagugucuucaucugaaagugagggauuuguggcugccucauucacucuggaaggcuccugggaagacgagggacaagagagaccggaagugucggauuccuggacccugaggccccgccccuuccagcccuggggaacaagagcagcuaggaccuggccaagccuguccaggcccccgcuuuaggcccucugcucugugcugcucccccgacucaggcagcagcuccgcauggagacuuggugguacugacuccggagcccccacuccccagccuuggucaccaaucaccacuaacaccaaaaccacugccugcuuagauggccugaaaaguuaggguccuguggcaaccccauuuuagaacuccggggguccucgagcagcuuccugucggggagaaggccugcagaagucaugggaggcucccggcucgggggucaguguggugcacccucuccccuucuuugagccccucucaaagccuaacucaaaaugaaaucccauagguuuuucuucgccacaaauauaguaguuuugaaguaacugugaccuuucaaccaggugggcuugcccugggccuccuaaaaccugagccaccgcaggacccccagcucccucccaccugcacgccuuaccacagcucuccugccccaggagcuuuggccgugcgcccauggccccgugugcuccccgccgccuccccuggcccccgacagccccauggcgucuccugggcuucccccacugugaguccaggcucagcuccagccacuuguccaucccaugugggcacaggggcucccugggauucgacccguccugccuuaggggccuccaacuccuggcaaagggcagugggcaggaaaugcccagguugucacgugcaagcccaggaagagccaccucggcaugaaagaaaaacaagaaacucagauccagaggcuccaaccugcagagcagccuggguucccuccaaacugggccagguugggggaagcaggcugaggcugcgaguagccgggacucccuccgccaggacgggcuugagccugucgcgugcugugaaguguauuucugagcggacgcuggcauuucaggucaggcuggagccaggugucaugcucacugaaacuguggcucacugccccacacucggguucugcauggagacuuggugguucuggguguuucuccagaaggggcuggggaggagucugggacugugggacugggagcuggugggcucuugggacgucugggccucuccaugcggagugggcaggcgguaguggaaggaaccuuugugugcuucaugugcguggggggguggugcugggaggggcaggggccacgggaccccagggcacacuggggccuccgcagggaggugcgcccccgcucaccauuggugcagaccacaccagcgucucucucgugccugcaguugcucuucagccagcccagggacuugcagucggccagugaggccucgguucccgugcacuggaccucauccagcaugauggggccugauccuguggacacagcagauggcagggcugggggcgugacgacugcacccaggagucccacagcgcgacucagcccuuuguucuccgccccggccguguggguccaucugcuuacagguccuucaccagcgaaccacggaggauauuccagcaugggcuggauuugugauugcaaugucaggccauaaacuuagccuucaugcuuauaaagcuuaccggcugcuucagcgacaucacauucauguauaguaauugugugacuaucccugcaacaucaguuucacauacuguaauugugugacuaucccugcaacaucagguucacauacuguaauugugugacuaucccugcaacaucagguucacauauuguaauugugugacuaucccugcaacaucagguucacauacuguaauugugugacuaucccugcugcuaaauaguuuauggauuguuucuuuuuuuuccagaaucgcaacugcugugucaguggaaaucuuccugcagacuuuucuuuugaggagaaauuguuucaaugggauaaacucccuggaguggaguuucugggccggagggaacgagcccagccgagcucuugaaccugcccaagcacccgccaccaucacuggccaaguguggguggagcagucccaucagaacuugauccgcaggccuucagcaccauugaaaauguuugcucauaggccgggugugguaaucccagcacuuugggaggcugaggcgggcggaucacuugacaccggaaguuuaaaaaccagccuggccaacauggugaaacucugucucuacuaaaaaauacaaaaaucagccgggcaugguggcagguaccuguaaucccagcuacucagaaggcugagacaggagaaucacuugaacucaggaggcggagguugcagugagccgagauugugccacugcacuccagccugggcaacagagcgagacuccaucucaaaaaaaaaaaaaaaaaaaaaaaaaaaaaaaaguguuugcucuugcuaaauuaauaggaauccaauuugcaugucuuugaaaccugacuguuucgucuuaggggauuugccccuccugggagcuggcugugcugugggucucagccucaguggaaggggacagcaggcccuaccuugcccgaaggcagcucugcccagagccuggguggcguucucgaagcccagggcccggcagacgacgcuggcaucagucaggucccacagguugucacacacagugccccacuggccucuguagaagaucuccacgcggcccugguugguggcgcccccaucggccagccgcaugucaccaucguucacgccugcaggcagagaccagcgagggcgaggcuggggccugcagcacccaccgcccacaccuccaggccccauaugcuguccugggucuccccugcugagcuuguauuucagggcuucaagguccccuggccucuccaugaggggcaccuccaugagggaggaguggaagauacauacagcccccccuaccccgcaaggaggccaaacucgccuuuccuuguuuuaggggucucagcccuucacuccauagacagaacaggggcagagaagcccugaguucuccagcacugggaguggagguggcaagacccugagggaaggauaggaggggaacggaggccccgugcugacccgcccugcagagggugucugcaguuugggggugcuggccuaugggggcagcaggccuagggaccccugggagcacaggcagaauguuuccagggcagauaaugggauucccccgccccacauguccuucugggacucaguccaccaacacuccagccccuacaggagcugacagagccgggcaggagcugggugccugaauccagucggggguacaucuggcuuccauggggcccccaggaugagcaugagcuuccaggggcucacaguguaaagaaugugaggaaaagcagccaggacccucuggaagacugaccugcguccaaggccacugaccucacaacggccccugugacugcugguuugaucagccccucugguucccucuggacggaauggaggauucccuaguguccucucuauaaccugcaucucaccugaacccaggugagcccccgggaaccuccaagucaucaucacuggggauaccuggugcuucaagcaggagagaagaucuggcuaaccgcugggccccgggccccaggcagaauaucuccuugaagcucugagcagccccagggugcaccagccuuccacacuucugcuuuugguauuucccaggggcucagcucaccuuggguuccugcaaccagcagccacacccagaagagccucggaggggucauggccgugccuggaugcccagauccugcagcagacagaagcggaggggugaggcacgggagccagauggcccgaggccccagggacuggccugcccauucacccuucagcccaaccugggcuguguggcaggcggggucccucucuugcagagcccacuaugaucccaguaagugugacgugugcuguggaugcccccgcgggggccccucaccuggucugcagugugguccuggaaggauguguaacacuuggcuagaugaagcgugggcugggggcacccccuggcaguaagggcagcaagaauuggugacuagaggcaagugagcucaucucaaaaaaccaggccccgggcaaggcugccacacgggcaugggcggggagauggaggaggccacaggcgugggcccaggucgggaggccgggugagccugguuaagaucucggccuuaagcuucaggcaacagaccccugcagggacugucccagagggucucagcaggcagagacgaggcugcagccuggagaguggaugggaggggacucgucaggagagggcacagaauccgggcgaggggugacagagauaaguggcagggagauauaucggggcuccgugguguuccgauggggaagauagaugaaaagggucagggcugcagcccagggugggccaggcugggggaagaacagggaggaaaugcugaaguauccccaagacacugacacucaggccaggacuggggagguccgggucuccaccuucuggccugguguucuugccuccguguaauuuccacgcuuuugucuucgucugccucccucccccacacccugccaauggagagacaguuaugguuucucuggcucgguaagaauccugugauaccugacacuguccccucaguucagcaagccuggggcaggccucuggguggcacugcugugggcaccggcugggagucugggccuggugaccuugaggcugcuuggagggggccugguggacggcugcaauggcauccccagagcuugucggaaaugcagucauggcuggccuugcccuagccccucugcaugggagucugcaugaacaagcgcccugggagcugggugcacuggcuggugagcagcuuugcucugggacucgugcucgcuggcacugugcagccaccccuugucggggcuccccgggcaccacuggaggccuuaccgugacccugagaaccaccuuaguuacaccucaccuuacaagugaaugagcugacacccagagaggcaaaugggcuccacauccacagucagugagccacaggcagggggucugcucgggggagcccaccucuccucccugugucaaugucaguagauggcuaaaggggccagggugugaccgccuguccugugugcuggggacugugcugguuuuagcacugaaguuucccuguguccugggaaaccccucagucccaggcacgccgguauggguggacgcccucuccacuucugcccccagccacuucacucugcugcagccacuagguuuguccguccugggagaguaacucagggccuuggaaaaauggccaacuggccaggcgcgauggcucacgccuguaaucccagaacuuugggaggcuggggcagguggaucacuugaggucaggaguucaagaccagccuggccaacauggugaaaccccggcucuacuaaaaauacaaaauaauaauaauaauaagcugggcaugguggugugcaccuguagucccagcuacucaggaggcugaggcaacagaauugcuugaauccggcaggcagagauuguagugagccgcugcacuccagccugggugacagagcaagacucugucucaaaaaaaaaaggggggggggcaacgaagcaccuggcagguggcgucgcugcccuuuguguggcagcggcuauuuuugccugauuccuucauacaguugagacccggcugccuguguuggccccuucgugcaaaucagaaaaaaaggugcucuuccuuggagugggugcaggccuaggccaaaugcacaggucugagagagggccaagcugaauucuaacccacuugcccuuuggcugguauccuugugcagugaguaaucugcccaacuguacacagaggcccugugggccugggagcagcaaugauuguugcuggacucaggagcccuggauccccagcuccaggccuaugugcaaacagggaggcaugacccccacuugccuguguagagagaggggugcccuggccgggcgcgguggcucacaccuguaaucccuacacuuugggaggccgaggcggguggaucaccagaggucaggaguuugagaccagccuggccaagauggcgaaacccugucucuacuaaaaauacaaaaauuagcugggcgugguggcacgcgccuguaaucccagcuacuugggaggccgaggcaggagaaucguuugaacccaggaggcagaggcugcagugagcggacauugcaucacuguacuccagccugggugacagagugagacccugucucaaaaaaaauaaaaauaaaaaagagagagagacugagaggggugcccaccugagagcuagaggcaggagcuuaccuggcugcgguagcugcaacggccguguggagccuccucgcuuccagccacaggaucccucugcagacugguccuuugacccagaagccucucccaguauggagcguggucaggcugaucccaggaaaugcuucagaaaagagucuacuuucgauuuccagaaaccaccugacauagaugucuuccgggauuggcugcugcugauacuccccagggccccucucuuuugucucagcucugccuguggcuaucagugccaggcuggcagaggcccaaggugggagucug

SEQ ID NO: 16938 - RNA, 8869 nt, Homo sapiens
cagacucccaccuugggccucugccagccuggcacugauagccacaggcagagcugagacaaaagagaggggcccuggggaguaucagcagcagccaaucccggaagacaucuaugucaggugguuucuggaaaucgaaaguagacucuuuucugaagcauuuccugggaucagccugaccacgcuccauacugggagaggcuucugggucaaaggaccagucugcagagggauccuguggcuggaagcgaggaggcuccacacggccguugcagcuaccgcagccagguaagcuccugccucuagcucucaggugggcaccccucucagucucucucucuuuuuuauuuuuauuuuuuuugagacagggucucacucugucacccaggcuggaguacagugaugcaauguccgcucacugcagccucugccuccuggguucaaacgauucuccugccucggccucccaaguagcugggauuacaggcgcgugccaccacgcccagcuaauuuuuguauuuuuaguagagacaggguuucgccaucuuggccaggcuggucucaaacuccugaccucuggugauccacccgccucggccucccaaaguguagggauuacaggugugagccaccgcgcccggccagggcaccccucucucuacacaggcaagugggggucaugccucccuguuugcacauaggccuggagcuggggauccagggcuccugaguccagcaacaaucauugcugcucccaggcccacagggccucuguguacaguugggcagauuacucacugcacaaggauaccagccaaagggcaaguggguuagaauucagcuuggcccucucucagaccugugcauuuggccuaggccugcacccacuccaaggaagagcaccuuuuuuucugauuugcacgaaggggccaacacaggcagccgggucucaacuguaugaaggaaucaggcaaaaauagccgcugccacacaaagggcagcgacgccaccugccaggugcuucguugccccccccccuuuuuuuuuugagacagagucuugcucugucacccaggcuggagugcagcggcucacuacaaucucugccugccggauucaagcaauucuguugccucagccuccugaguagcugggacuacaggugcacaccaccaugcccagcuuauuauuauuauuauuuuguauuuuuaguagagccgggguuucaccauguuggccaggcuggucuugaacuccugaccucaagugauccaccugccccagccucccaaaguucugggauuacaggcgugagccaucgcgccuggccaguuggccauuuuuccaaggcccugaguuacucucccaggacggacaaaccuaguggcugcagcagagugaaguggcugggggcagaaguggagagggcguccacccauaccggcgugccugggacugagggguuucccaggacacagggaaacuucagugcuaaaaccagcacaguccccagcacacaggacaggcggucacacccuggccccuuuagccaucuacugacauugacacagggaggagaggugggcucccccgagcagacccccugccuguggcucacugacuguggauguggagcccauuugccucucugggugucagcucauucacuuguaaggugagguguaacuaaggugguucucagggucacgguaaggccuccaguggugcccggggagccccgacaagggguggcugcacagugccagcgagcacgagucccagagcaaagcugcucaccagccagugcacccagcucccagggcgcuuguucaugcagacucccaugcagaggggcuagggcaaggccagccaugacugcauuuccgacaagcucuggggaugccauugcagccguccaccaggcccccuccaagcagccucaaggucaccaggcccagacucccagccggugcccacagcagugccacccagaggccugccccaggcuugcugaacugaggggacagugucagguaucacaggauucuuaccgagccagagaaaccauaacugucucuccauuggcagggugugggggagggaggcagacgaagacaaaagcguggaaauuacacggaggcaagaacaccaggccagaagguggagacccggaccuccccaguccuggccugagugucagugucuuggggauacuucagcauuuccucccuguucuucccccagccuggcccacccugggcugcagcccugacccuuuucaucuaucuuccccaucggaacaccacggagccccgauauaucucccugccacuuaucucugucaccccucgcccggauucugugcccucuccugacgaguccccucccauccacucuccaggcugcagccucgucucugccugcugagacccucugggacagucccugcaggggucuguugccugaagcuuaaggccgagaucuuaaccaggcucacccggccucccgaccugggcccacgccuguggccuccuccaucuccccgcccaugcccguguggcagccuugcccggggccugguuuuuugagaugagcucacuugccucuagucaccaauucuugcugcccuuacugccagggggugcccccagcccacgcuucaucuagccaaguguuacacauccuuccaggaccacacugcagaccaggugaggggcccccgcgggggcauccacagcacacgucacacuuacugggaucauagugggcucugcaagagagggaccccgccugccacacagcccagguugggcugaagggugaaugggcaggccagucccuggggccucgggccaucuggcucccgugccucaccccuccgcuucugucugcugcaggaucugggcauccaggcacggccaugaccccuccgaggcucuucuggguguggcugcugguugcaggaacccaaggugagcugagccccugggaaauaccaaaagcagaaguguggaaggcuggugcacccuggggcugcucagagcuucaaggagauauucugccuggggcccggggcccagcgguuagccagaucuucucuccugcuugaagcaccagguauccccagugaugaugacuuggagguucccgggggcucaccuggguucaggugagaugcagguuauagagaggacacuagggaauccuccauuccguccagagggaaccagaggggcugaucaaaccagcagucacaggggccguugugaggucaguggccuuggacgcaggucagucuuccagaggguccuggcugcuuuuccucacauucuuuacacugugagccccuggaagcucaugcucauccugggggccccauggaagccagauguacccccgacuggauucaggcacccagcuccugcccggcucugucagcuccuguaggggcuggaguguugguggacugagucccagaaggacauguggggcgggggaaucccauuaucugcccuggaaacauucugccugugcucccaggggucccuaggccugcugcccccauaggccagcacccccaaacugcagacacccucugcagggcgggucagcacggggccuccguuccccuccuauccuucccucagggucuugccaccuccacucccagugcuggagaacucagggcuucucugccccuguucugucuauggagugaagggcugagaccccuaaaacaaggaaaggcgaguuuggccuccuugcgggguagggggggcuguauguaucuuccacuccucccucauggaggugccccucauggagaggccaggggaccuugaagcccugaaauacaagcucagcaggggagacccaggacagcauauggggccuggaggugugggcggugggugcugcaggccccagccucgcccucgcuggucucugccugcaggcgugaacgauggugacaugcggcuggccgaugggggcgccaccaaccagggccgcguggagaucuucuacagaggccaguggggcacugugugugacaaccugugggaccugacugaugccagcgucgucugccgggcccugggcuucgagaacgccacccaggcucugggcagagcugccuucgggcaagguagggccugcuguccccuuccacugaggcugagacccacagcacagccagcucccaggaggggcaaauccccuaagacgaaacagucagguuucaaagacaugcaaauuggauuccuauuaauuuagcaagagcaaacacuuuuuuuuuuuuuuuuuuuuuuuuuuuuuuuugagauggagucucgcucuguugcccaggcuggagugcaguggcacaaucucggcucacugcaaccuccgccuccugaguucaagugauucuccugucucagccuucugaguagcugggauuacagguaccugccaccaugcccggcugauuuuuguauuuuuuaguagagacagaguuucaccauguuggccaggcugguuuuuaaacuuccggugucaagugauccgcccgccucagccucccaaagugcugggauuaccacacccggccuaugagcaaacauuuucaauggugcugaaggccugcggaucaaguucugaugggacugcuccacccacacuuggccagugaugguggcgggugcuugggcagguucaagagcucggcugggcucguucccuccggcccagaaacuccacuccagggaguuuaucccauugaaacaauuucuccucaaaagaaaagucugcaggaagauuuccacugacacagcaguugcgauucuggaaaaaaaagaaacaauccauaaacuauuuagcagcagggauagucacacaauuacaguaugugaaccugauguugcagggauagucacacaauuacaauaugugaaccugauguugcagggauagucacacaauuacaguaugugaaccugauguugcagggauagucacacaauuacaguaugugaaacugauguugcagggauagucacacaauuacuauacaugaaugugaugucgcugaagcagccgguaagcuuuauaagcaugaaggcuaaguuuauggccugacauugcaaucacaaauccagcccaugcuggaauauccuccgugguucgcuggugaaggaccuguaagcagauggacccacacggccggggcggagaacaaagggcugagucgcgcugugggacuccugggugcagucgucacgcccccagcccugccaucugcuguguccacaggaucaggccccaucaugcuggaugagguccagugcacgggaaccgaggccucacuggccgacugcaagucccugggcuggcugaagagcaacugcaggcacgagagagacgcugguguggucugcaccaauggugagcgggggcgcaccucccugcggaggccccagugugcccuggggucccguggccccugccccucccagcaccacccccccacgcacaugaagcacacaaagguuccuuccacuaccgccugcccacuccgcauggagaggcccagacgucccaagagcccaccagcucccagucccacagucccagacuccuccccagccccuucuggagaaacacccagaaccaccaagucuccaugcagaacccgaguguggggcagugagccacaguuucagugagcaugacaccuggcuccagccugaccugaaaugccagcguccgcucagaaauacacuucacagcacgcgacaggcucaagcccguccuggcggagggagucccggcuacucgcagccucagccugcuucccccaaccuggcccaguuuggagggaacccaggcugcucugcagguuggagccucuggaucugaguuucuuguuuuucuuucaugccgagguggcucuuccugggcuugcacgugacaaccugggcauuuccugcccacugcccuuugccaggaguuggaggccccuaaggcaggacgggucgaaucccagggagccccugugcccacaugggauggacaaguggcuggagcugagccuggacucacagugggggaagcccaggagacgccauggggcugucgggggccaggggaggcggcggggagcacacggggccaugggcgcacggccaaagcuccuggggcaggagagcugugguaaggcgugcaggugggagggagcuggggguccugcgguggcucagguuuuaggaggcccagggcaagcccaccugguugaaaggucacaguuacuucaaaacuacuauauuuguggcgaagaaaaaccuaugggauuucauuuugaguuaggcuuugagaggggcucaaagaaggggagagggugcaccacacugacccccgagccgggagccucccaugacuucugcaggccuucuccccgacaggaagcugcucgaggacccccggaguucuaaaaugggguugccacaggacccuaacuuuucaggccaucuaagcaggcagugguuuugguguuaguggugauuggugaccaaggcuggggagugggggcuccggagucaguaccaccaagucuccaugcggagcugcugccugagucgggggagcagcacagagcagagggccuaaagcgggggccuggacaggcuuggccagguccuagcugcucuuguuccccagggcuggaaggggcggggccucaggguccaggaauccgacacuuccggucucucuugucccucgucuucccaggagccuuccagagugaaugaggcagccacaaaucccucacuuucagaugaagacacugaccccagagaguggcagugccccggcuccuaacgcagcccacuucccucccgccccuucuuagaaaccaggagcacccacacccuggaccucuccagggagcucucggaggcccuuggccagaucuuugacagccagcggggcugcgaccuguccaucagcgugaaugugcagggcgaggacgcccugggcuucuguggccacacggucauccugacugccaaccuggaggcccaggcccuguggaaggagccgggcagcaaugucaccaugaguguggaugcugagugugugcccauggucagggaccuucucaggugagccgucucguccucaggcucuggggccgccaggggcuuuguccuccuccccucuucaaaagcacagccccccacacacacaccugcacauacucaugcaugcacauguacacacgcagucacacaugcacucacgcaguugcacacacacgcaugcucacucccacacugugugcacucagguggcuguguuggacaguugggcccagggcuccccugcuguccuguggggccggcaucugcucuccuucuuucuccccagguacuucuacucccgaaggauugacaucacccugucgucagucaagugcuuccacaagcuggccucugccuauggggccaggcagcugcagggcuacugcgcaagccucuuugccauccuccucccccaggaccccucguuccagaugccccuggaccuguaugccuaugcaguggccacaggggacgcccugcuggagaagcucugccuacaguuccuggccuggaacuucgaggccuugacgcaggccgaggccuggcccaguguccccacagaccugcuccaacugcugcugcccaggagcgaccuggcggugcccagcgagcuggcccuacugaaggccguggacaccuggagcuggggggagcgugccucccaugaggagguggagggcuugguggagaagauccgcuuccccaugaugcucccugaggagcucuuugagcugcaguucaaccugucccuguacuggagccacgaggcccuguuccagaagaagacucugcaggcccuggaauuccacacugugcccuuccaguugcuggcccgguacaaaggccugaaccucaccgaggauaccuacaagccccggauuuacaccucgcccaccuggagugccuuugugacagacaguuccuggagugcacggaagucacaacuggucuaucaguccagacgggggccuuuggucaaauauucuucugauuacuuccaagcccccucugacuacagauacuaccccuaccaguccuuccagacuccacaacaccccagcuuccucuuccaggacaagaggguguccuggucccuggucuaccuccccaccauccagagcugcuggaacuacggcuucuccugcuccucggacgagcucccuguccugggccucaccaagucuggcggcucagaucgcaccauugccuacgaaaacaaagcccugaugcucugcgaagggcucuucguggcagacgucaccgauuucgagggcuggaaggcugcgauucccagugcccuggacaccaacagcucgaagagcaccuccuccuuccccugcccggcagggcacuucaacggcuuccgcacggucauccgccccuucuaccugaccaacuccucagguguggacuagacggcguggcccaaggguggugagaaccggagaaccccaggacgcccucacugcaggcuccccuccucggcuuccuuccucucugcaaugaccuucaacaaccggccaccagaugucgcccuacucaccugagcgcucagcuucaagaaauuacuggaaggcuuccacuaggguccaccaggaguucucccaccaccucaccaguuuccaggugguaagcaccaggacgcccucgagguugcucugggauccccccacagccccuggucagucugcccuugucacuggucugaggucauuaaaauuacauugagguuccuacauuuguuugua

SEQ ID NO: 16939 - RNA, 18166 nt, Homo sapiens
ccaaaaaaacacaaaccacagcucccagcagcccucgcgccguccgcgcgcagccgcagagcagaggcugccgggaacgcgggcccagaggcggggcgagcgcgcgcggggcggaagucggccaccuuccuccgucccggccguuagcccagccaagcccagccaagcccagccaagccccgccgaucgcgggcaccggagccagccccgcagcgggugagugacugcgcccgcggccgccggcgcccugccccagccacgggcccggacccccgucccggagccugccgccgcccuccgacccugccgcgucccgcccccugacccgucaggcccccuucccgucccacccgugcgggaucucugcccccugacucgcagacugggcugggacucugcccucugaccugugggaaaguccccuucuuccgacaggcgguggacaccacccccucugacuuuugggacaccucaucccugggacuagcguggggaccauuacccucugguuagugugggcaccccuccucucuaauuaguguggggaccauuccccucugauuagugugggcaccuccccccucugauuaugugacuccuccccgcucugauuagugugggacaccccccuucuaauuaguuuggggaccaucccccucugauuacuguggggcaccuccccgcucugauuaguguggggaccaccccccucugauucauguggggcaccucccccucugguuaguguggggaccaucccccucugauuagugugggacgccuccccgcucuggcuaguguggggcaccccuccugggaaugacccccucccaccaccuucugacuucaaauaccccuccucuggucuaugcagggucuccuuggacugauaagggaauuuucucccucugacuggcacuuggucaaaccuguaacaggccaaccuuccccaccccaucccaguccuugcucucccugcccucauccaauuuggagccuuccuccaggcacacagcucacucucaucuuccugcaugcaaaugauucgcccuccccaccauaccugucucacaccccuacugccauccggucuggauucucucauccuuggagacugguaccuccuugccaguccauguugccuggugccuuugcuucucccuccgaauggucuuucccuugcccucuguguacccuaggcuuggcacagagcaccugugaccacucuuccaucagcagacacaucucucucccaaacaccuuucccccuuagugaccccuggaaaagccgucucuuagugucccagcuccauuucuuauuuuauucuugagguuguaugcccuauggccuuuccuaccacauuuucaacaaagcagagguuuggaaaugugaggcucuuggugucaagugaauccggcuagcucuccaguguaagggcccaaacuugaaacaagugucaggucguagaaggcuccuaaaaggaagcgggugccgcagcccuucaggauccgcuaucucccagcucuuccucccucucccucugaggagcuuugcugagaaaggucccuccaggccuggaccacagacccucccugcagccccaccgcaggccucucagcaggacagucuggcuggagccuguggaacggcaguggggcuccucccaggugcuccucccugcuggccucaaugagcccucuauccuagcacacgccccugcugaaaggcacacugaaggagccaacccucuccccucuggacguggcaaggguuuccugucggggcagccccaggcaucuucacggccaggacucaggugaagcauggauuuguccaggcacugucaugaggccaccgcagcaguguggggaccaacuucuagugucacuuuuucauguccaaauuaacgugaucacaaaagagaaugacaugucacaaggugguagagggaacccuccacucgcagcgggauaggaccccuggacccugggacaccucgcuggaggggcacaucugaggcuugacgcuucugauugccagaggucuccuuucuuccccuuaggcuauaaccauauuuuccuagcccauggcagcuuaguaaauguguugguguaaaagcucuugguacuccagaacguuuucacucacccgucacugugcaccuggucugcaggaccccccugagcugcagaguacgugaggagacccagggugugguagcagcaguucuccuggcccuguggguguuuuuacccugccaccuggauguggcuuucgaggugugugugccugugcaggcucccccaaguacauauggcccguccucggagucucgguacuuucuggcaaccguauagguagauagguagauguauaaaugcuguaguguuuucucuuucaaaaacagaagaucugagacuuggaacuauuguccagguccugaaaugggucaguacuaucacaaggaggucauuuuucuauuguuuguugaaugguaccagggaugccaaggacacacagcauucauucuuuucacucagugcacucugaacuaucgagauuuccuggaaagcucuuaugaaaugccaauaucaagggaauuagaaacuuuuauauuaauucuuaagaauguucauguugauuuuccuuuuacuuuaaucaagaugguuaauuaggaaaaaaucauccuggcaguagagaagucuguuuggggagacguucuguuuuuuguuuuggacccugcucgucuuugucaugcgugcaguggucauguggagcgccugguucccaggcaggacgcugcuccccgcguuccucugggaugguuuuaugggaagugaagaaggcguugaagucuggcuuaagacuuaagacagugcgugaugccaccaugugggaguggggcagaggugagacugggaccccccagaauggcucugaggguguugccggguugagugaaaguccuggcgauucggccuuugugucccgggagccgagccuggaggaaagcgugaggagagaagguggcaguaagcaggugggcucgugcaggugccaccgcgguguggaaggcagcccugauccagguccauggggcgaugaucccaucccguuauuuucacacacucuggaaaaggacaccuucccagauguguggugccauuuggaaugugccuuucaacugagaaggucgccuuuuggcuaaaauuccuccagguguaacaucgaugauacaaauuaagcagacacagccucuuuacaaggcaguaacugcaaaccguagaggguucugaagcugugcgcccacaccauagacagugacugguccuggcccuuggaaaaaccuggaggcucuuuccccucuuccuccugugauugguggaggaacagcuccccgagauguccacguccuaccuucugagccugugaauauguuacauuacauggcaaaggggaauuaagguugcugaucagccggccuuaaaguagugagaugauccuggauuuucccagggagcccaguguaaucacaggguccuuaagaacagaagagggaagcagaagagccggagggagaugauggccaagagccuuggggaagugcagugggcgggcuuuggagggggaggaggggccaccaggcagggaaugugggugccuccagaagcuggaagaggcaugagaauggagccauggcccgugugaggcuucugucccacaggacggugccugcugccugccgugugcuggauacuaggggcggggacaggugcagaagucagucagauccugagcuugaccuuuaaggagcgugcugucuguggaggcaggauggccuaaccagacucccugugaccuucuuccuuucugguuuccuuguacugcccacccccgaggagauuugccguggaauuugcagguacaauaguuagccuugcaagugccaaagcaggaaucagguaacguuuucaaggagucuggcccauagcaggcauuaauaaguguuucuuugagaugcgccacccguguucucucaggcgcuguuagcaugagugugugaaggccuuggcuucugccuuggcugugcugaagagucuguaggucagugggguuugcucuuuaccauggcagugaacacagugggcacucugaggccugccugccugcucucugggugugggaagggaaaggaagguagcucuucuccagagauaagggguuggcgcaccugccaccugccuacccgucccuuccaaggaggugggggcuaggauguggcggccucuuaacaggaugauguggcuuccugcccugccuggauccugaaagggaggagccuggcagcccucaguaaaccugcugguucugccaccuguccuauuccacuccugcaggaagcuggagaaacaaacccucuuggcugucugcuguccagggagucgccacucccuucauuauagccuugcucagagugcagcggcaggccuggggauggccucgggagguagguggccccugagcccuucuccugggaaagggcagcagcagggagacgccuccugggugugcacagagaaaagcacaguuucccuaacuccccgcucccuaacuccucgcucuuuaacucucaccucccuaacuccccccucccuaacucccuucucccuaacuccccucucccuaacucccuucccuaacuccccucuccuuaacuccucucccuaacuccccccucccuaaauccccucucccuaacucccuucucccuaaccccccucucccuaacuccccucccuaacucccccuucccuaaccccccucucccuagcuccccucucccuaacucccuucucccuaacuccccucccuaacuccccucucccuaaccccccucucccuaacucccaucucccuaacuccccccucccuaacuccuugcuccauaacucccccccagcuccccucucccuaacuccccucccuaacuccccucuccuuaacuccucucccuaacuccccccucccuaaauccccucucccuaacuccccucccuaacuccccucccuaacucccccuucccuaaccccccucucccuagcuccccucucccuaacucccuucucccuaacuccccucccuaacuccccucucccuaaccccccucucccuaacucccaucucccuaacuccccccucccuaacuccuugcuccauaacucccccccagcuccccucucccuaacuccccucucccuaacuccccucccuaacuccccucuccuuaacuccucucccuaacuccccccucccuaacuccccucucccuaacuccccucccuaacucccuucucccuaaccccccucucccuaacuccccccucccuaacuccccucucccuaacuccccucccuaacuccccucuccuuaacuccucucccuaacuccccccucccuaacuccccucucccuaacuccccucccuaacucccuucucccuaaccccccucucccuaaccccccucucccuaacuccccucccuaaccucccucucccuaacuccccucucccuaacuccccucccuaacuccccccucccuaacuccucucccuaacuguccucucccuagcuccccucucccuaacucuccucucccuaacuccccucccuaaccucccucucccuaacuccccucucccuaaccccccucucccuaacaccccucccuaacucccccccaacuccucucccuaacuccccucucccuaacuccccucccuaacuccccucccuaacuccccucucccuaacucccccucccuaacuccccacucacuaacuccccucucccuaacuccccucuuccuaacuccccuccccaauuccccccucccuaacucccccccaacucccuacucccuaacuccccgcucccuaacucccagcucccucacugguggcuccccugcgcucugggaguguccugugggauggacagaugccuccguggugccuugcaagccuugcaggugguuauuccuccugugagugcuccugugagugcucuccaggcagcagcagggguccugucccuguaggccccugagucugggagauagcugguuugcagccccacugaacaggagagccuggcuggccacagaacccaugacuuugcuguagucccugaguccucuuguugcugauuaucuaaaaucaaaccauuacucugcaggcacuggguuugucaaucuuuucacaauaaagcgagcauuuaaacugcuuaagcuuugagggguguagggagaagccucacacgagccccuucuggaaaggacuuuguccaucuugugucuuacccucgccgguucauuucuguuguuucuggcuggcaacaaacaaaagagcccccccaccccccacccccgaaaaagaacccagcuuuuuaaagaacaugcaaacucuugccugcagcaggcgccggcagccaggcaccccggcagccagugguagcucauacaccagcaugggcuguggcaaaggcaucugauuugaaauuuuuuugcaaaauaaaauaauuccuugggguccugaaggagagaugaagcccaagggaagguguucuggugcugaaguuaaaggaauuuucuggaagguacacagaguucucuugucacuagaagcagucccuuguuuaaccaaagguggcugaggcccuggcgucucugccccucuguuagcucuggggaaucagcgugaccucgagguaacacugaccacacgggacuguucaaagucugucuccccaacugugcugagcuccuggaggaaaggccccugccuccgucacacugauuccccagaggggcagagacgccgggacucagacaccucugguuccauguggucagaggacaugagccucccggguggggagcgugugccacgguguagaugccaggagucuggaauaggaaggcgugcaguguugcacagcgaccugggagagguccugcuccugggagugcagggggaaaaacccacugaggcuuucucugcaggcugagacguuuguccuucagauggaaggcauugggaucuacuagacuuggaauccagacuugcuuuuuggaaaaauuauucugucaguuuuguggagggugauuugagauggucuugaccagggaucugucgagggacagggagucaguauuuucagccuccacagucuguugcgaccacucaacggugcagccagacucagcaugccagggaggaguccuagcuggcuuuaaucagccacaucuacacaccaggacgugacuacacagcaggccgcgucuacgcaggccgcgucuacacaccaggcagagucuacacaccaagcugcaaccacauaccaggccacacaggccgcaucuacacacuaggcgggagacugcauuuggcccacgggugguaguuugcaacccucccagcaggcgagaggguacuuguagagugagugagaagcaguagcagucagccccugugcacaguucucuaaccccaucagcauggcuccgggaaguaaacugaggccaagggaagucccuuggcugagcccagauggucuauaucagggguguccaaucuuuuggcuucccugggccacauuggaagaagaauugucuugggccacacauaaaauccauugauagcugaugagcuuaacaaaaaaucucaucucaucauguuuuaagaaaguuuacgaauuuguguuggaccacauguuggacaagcuuggucuagaucauuagaccaagacucugagagucaucagggugagauggaacuggagccgaggcuguguggauggggagaagggaagcgagucucaagcugggugggacacguggggcuggggagggaggaggguuaggacgaauugcuuccugggauggcuccugagggccggcacugccaggacagggaguuccugaggaggaccugguuugcggugccuguggguaucggaugaggaggcucagagacuaggucaggcuagaaaggcgugggggucuucaccuuagagggcaggcccugggagaggucagugggcugccagcagugggggccgagaagaccugccugggaggaggcccacagagagugccccccugccucgaggagggacacugacaaugugcucacuggguuugccacuggugaaggcuucagguggcugcuucugaggauuagccagagggaaggagaggguguaggugugggugcucuuguaccauggugggcgagggggccugggcgggggugggaagggacagaggugccggggacucagggaaggguuuuccuucauuaacagauucgccauuuauucagcagcaguugagugucugugggaguguggggucuggagguaaaauggugacaaggugggcgacuuggggcagccuguggauggaagggaggaaccagaagagcaggugcccggcggcuggggggacugaccugaguggcaggugugagccccacccaggggccucggcugcugaaguuggccacagaguggucuccugggagaagugggccggagauuugacaggaauggugaaggugaggacaguggcucuccggagugcugagggaguugaacagggaagaacauggggguuccaggggcuggugacgacgacaccucacgaugucugacagcagucuaugcaggcaccguuguucugugcuggcaagcaccgucuucccgggccugcagcucagauguggcagcugagcagcucgaucuuuggggugcuugauccagguuguggguucauaauaugccuaagguggggcccccgguagagugcagaggggcuguugaagaaguggcuaauggcucaccuggcaucucuuucccuucagccaaugcgugcagacugucugcucccugccuggcagugcgucaggugcuggggcugugacaguggccagaucccugccccaggagcagaaauaaucaccuagccaggcagggacggugggagagccggagcggcaugggagggagggcgagugggcaagucuucccagggagcugaugccccguaggagagaccgagcugcuggugcgaagagcaggcccgacuguuccaggcagggggaacugcaggcucugccagggccaguguggucaggggacagaaggaggucuauguagccagccggcaggcagaggagaugguacagugugagggcugagcgggagcagaguggguucaccccaggaccugaggaagccgcugaagcugggagugugccaucugauggaugcuacuucauggcagguggcgagggagugucaggggauguugguggggggcagcuggcagggcaacuucauggcgggggguaugggagugucaggggcggagaggcaggagggguggagggaggcagccggcauggcauggugaggaagggccauggaagaggacagaaccuguccacggagucaaugcugaggaaggaagacggaggaugaggccagucagguuuuucgugguggcagugccuuauguuuuuaucgaaguguauauucacacagaaaagcacaucucccaggauccugagagagcuugaaccagaccacuguggacacgguggccacccgucaccacuacccuucccaaggggagacgaggagcaaguaggcuugagggaaaagcugcacaggacucgugucuugaaaugucuaagacgcaugucagaaaugcagguaagggggggugcgggugcucgcaccugugaucccagcacuuugggaggcugaggcaggaggaucacuugagcccaggaguucaagacuggccuggacaauauaacgaggccucaucucuauaaaaaaaauuaaaaauuagcugugccccagguguguuggcucacaccuguaauccuggcacuuugggaggccaaggcagguggaucaccugaggucaggaguucaagaccagccugaccaacauggagaaacugcaucucuacuaaaaauacaaaauuagacgggcgugguggugcaugccuguaaucccagcuacuagggaaucugaggcaggagaaucacuugaacccaggaggcggagguugcagugagccgagaucgugccauugcacuccagccuaggcaauaagaggaaaacucugucuccaaaaaaaaaaaaaaaaaaaaaaaaaaauucgcugugcgugguggcacacgccuguagucccagcuacuugggaggcugaggugggaggaucgcuugagccucagagguugaggcugcagugagcgugaucacuguugccugggcaacagagcgaggcccuaucucagaaaaacaaaaaaagaaauguaggcgggauuggcauagcagguaagauagaguaauucgagcucaguggagacuucuugggccuggcugggguuuugaggccuugggacuagaaaaggggcagggccuggaugcagucagaggaggauguccagcacggggaaccccagcccugcugccgggaaggccccggugaucagcccugugaccaccucaggggguccugagaggccugccccuuaaagggagcauggagucuucccugcgggccuggaggaacugcuggcagccccccugugcuguuaggaggaucacucugagcagcagguuccacguaugugccuuguucacuccuugaaccucacccuggggcuaaaaccuaggacuguccgaaaguuccauguggaauugucacccuguuuuuguaucuucucagcccagcaggcugcggcguggagaagggggugucucuggugggggugucuguugcuggcugccgugcaccagggccucgugguccacauauuuggggcccagaauugcacggagccacuggaguccccaagcccuucccaggcgcccuggcagggaggacagcgucugcccauaaaggcacauguuugcugcuuuguuguuuucucaaggaggacccagccagggaagcuucucaggccgggauucacugagcuauaguuggagggcagagauauggaaccucugcccagggccaguguucucgaucgaagcaccgggagcugucuccccacgccccacuguggcacuuggcggcuguccagagacaggcagcucucaccaaggcggcgcagacgugggccuggugccccauggcugcacugagccaucaugcuguaugcccgggaagugggcuuggcgacagcagugaagggcugcaguuccuggccgccaccagcacccugacccuggggcucugccacagagccacgccugggguggagggugagcugggagaggccugcggccgagccaggccccgcagugagccgagcaguucuuuggcgccaaggcacagacacgcuggccuccaggcagucagggcagcgcagacucuggucccugcagucauuugcauuaauagaaaggcgccaggggacagacacugccaaaaacaacaacagauacgaaaaagaaggaguguuuuuauuugguuuggauguguuugguauuccaaugcugcaggagccuaacccagaggaaguggagacuccuuuacugcacaucugucugcuccaggccaggcacuguucuaggagccaggauacagagguggagacagaaacaaacaaaccgauaacuguauacaauacucuaacgucagguggggacaagggccaaggacccagggacggagggugaugucugcagcagggcagucagggagggcuuccuggaugagguggcauuugaguaaaauacagaccuguacccugucuaugauccuaucccacuucaccccgucagccuuccccucccaccugacucuccugcgcuucucucuuuagagggaccacagagcaccagccugcauggaacuuccuuccucacucagcuucccacguugccagcugggacaggggagauggaguaauuuugcuguggaaagacuucacgucuugccgaaugaaaguaagcaaagauacugcuagagucgggaaucuagagucgggaauucauuaagccaagggaguaagaauggccacagaguagugaaauacuguuucuucuggaaaagucagccuccagcgccugcagcuuccggaacuaagaugugacugggcuugcggaggcgcugacuccucuccucccucccuggcugugcaggucccgccugucugucacgcugaugcccgugcagcugucugagcacccggaauggaaugagucuaugcacucccuccggaucaguguggggggccuuccugugcuggcguccaugaccaaggccgcggacccccgcuuccgcccccgcuggaaggugauccugacguucuuugugggugcugccauccucuggcugcucugcucccaccgcccggcccccggcaggccccccacccacaaugcacacaacuggaggcucggccaggcgcccgccaacugguacaaugacaccuacccccugucucccccacaaaggacaccggcugggauucgguaucgaaucgcaguuaucgcagaccuggacacagagucaagggcccaagaggaaaacaccugguucaguuaccugaaaaagggcuaccugacccugucagacaguggggacaagguggccguggaaugggacaaagaccaugggguccuggagucccaccuggcggagaaggggagaggcauggagcuauccgaccugauuguuuucaaugggaaacucuacuccguggaugaccggacgggggucgucuaccagaucgaaggcagcaaagccgugcccugggugauucuguccgacggcgacggcaccguggagaaagguaacuggacccugagguuuuauggagguguggguggggagugggagcucagggccuggcuggcaaacacaggcacaugguaaagaauucacacaccuagaagccagggauguggugagggagcacgucucccucuugcucugaccugcggcccccuuacccuuagccaggagcauagccuacugucacuucacacugagcaguuucuaggaggaagagcuuaucgcuagaggccugugggagacguggggaaucucuccaagauguuuucggcuguauccgcugcugcucucggagccucugggaacacgcccuuuuuacaccuucaaagguucucaagaccacgcuaggaugugccuaccaggagccuugcccugaaagccauggggacagaugguucucacucaaaacccagacuuugguuucauguuacugaaggguaaacugcugcccagcccuccucucccugaaccccagcagggggagggcaugugugagcugugccaaccccccuggaguggagccugaugccagccuuuuuguucaccagaaaggaggugcugcuuccacagggcagggacaggcuuuggggaggcacgguggccagugucuuccuccagagaggagcuggggaggugccaaggacgcuggcagaggagcugccagcuccucugagcuccguuugucugagcuggcgguggauccccaccuucuagaaagcuaaaugccaccgcaggcuuucugaggucaaggaggaacugcacuaaacaacggcccacacaguucauggccggccaggcccuccccacacccggugauaaaaucuucaguguuugcccagggcugggcaggggacggaccucaccugagguaucaacugaggcguuggucgccuacuuccugccucgcacuugucaggguuuuaggcaacccuaguguaguucuguccuucccuuggauagggaggaaagcgggguacagggagcucugggguugggcuguacucaggucauccgggagggauggaagacccuggcauggagaaugucucaucgcacaagcagaccaggagaccgcaggucccuccagggcccugcagagaagcuacuacagucucgggcaguucagagggcacagcuccagcucucaggggcaagaagcuggcaaaauuuggggaaagcaaacagaaguuagaacaccaggguguagggaugauaagaauacacgguagaacacaggcucccacacagccugaacuguggcagccuucaaaguuaggcuuauuuuaaauaaaucaguuuaaaaaaagcaaaaacagcuucugaacaaauccauugaaaggaagacugggagccccagcaccaagccccucuccggccacuggaguuagagugaugcucggugagaccucagguguggccgagggcagcacccgcacuccccugggacacacgugccccuucagagugcugucacuuuucagcuuuucuagccuuuaaggauaauccuaagguugggguuacagcuugaggagcggggaguuggggaucagaggagacuugagaguggucacugaaccuucaggagcugaggggagggcagccggccggcccugggcgggagccaggugcgggccggaggggaggcagguguggagccgggcgggagucaggugcggggucuaaggacaggugcggggccgggugggagccaggugcaggggugcggcgggagcugggugcggggccuaaggacacucugcuuggccaggcuucaaggccgaauggcuggcagugaaggacgagcgucuguacgugggcggccugggcaaggaguggacgaccacuacgggugauguggugaacgagaacccggagugggugaagguggugggcuacaagggcagcguggaccacgagaacuggguguccaacuacaacgcccugcgggcugcugccggcauccagccgccagguaagagacgccugccccagcccacaguguggcuuccacagcccagucgcugggaaccugcuuccuccugcauuugccuccaaaaccguuuuuuauuuuagacauagucuugcucugucaccccgguuagagugcaguggcacgaucucagcucacugcaaccuccaccuccuggguucaaacgauuuuucugccucagccuccccaguagcugggacuacaggugugcaccaccacgcccagcuaauuguauuuuuaguggagacaggguuucaccauguugcccaggauggucucgaacuccugacuucgggugaucuggugauccaccugccucggccucccaaagugcuggcauuacgggcgcgagccaccacacccagccuccaaggccguuucuugcuugauuuuagugauuuugguugccucugaugguggcuucccucaggccaguggauucuggcggcaaaugagcuguuuucucuuuccugccccacucgcccuggcagcuggccuccuagcaucccagccuguggcccgguugucugcacuggugggucaggcccugucccuaccccuggcgcugggccgugguguuccacaccaacauagggccagcagcacuuuggccucccccuagucaggauggaguaggccuuaggugccugagguucaggaggaagugacugagucugugccuggggccccagacgcugucuccucuuccuugcagccucaaggcagccuccccgccgaugccuccccacauccaauggggguuuguucccuuuccuuggguuccucuggaucagccccgaggaggcuccgaugagcccaaaucccugaugcagcucacaggcagcucucgguggaacgggaggaggcuucaagggagcgggugcugcagguucccugcaugggauaaccgagaacacagaaccuuccagaauccuggagagcagggaggggcggguugcugugagcuggugggcccugguggucgcagccccuugccugcuacugcgcacggccugaugguguggggcugggcacaccaggccgcaugcgugucugacccgcggucacccgguucccaggcuaccucauccaugagucugccugcuggagugacacgcugcagcgcugguucuuccugccgcgccgcgccagccaggagcgcuacagcgagaaggacgacgagcgcaagggcgccaaccugcugcugagcgccuccccugacuucggcgacaucgcugugagccacgucggggcggugguccccacucacggcuucucguccuucaaguucauccccaacaccgacgaccagaucauuguggcccucaaauccgaggaggacagcggcagagucgccuccuacaucauggccuucacgcuggacgggcgcuuccuguugccggagaccaagaucggaagcgugaaauacgaaggcaucgaguucauuuaacucaaaacggaaacacugagcaaggccaucaggacucagcuuuuauaaaaacaagaggagugcacuuuuguuuuguuuuguucuuuuuggaacugugccuggguuggaggucuggacagggagcccagucccgggccccauaguggugcgggcacuggacccccgggccccacggaggccgcggucugaacugcuuuccaugcugccaucugguggugauuucggucacuucaggcauugacucaaggccugccuaacuggcugggucguuucuuccauccgaccucguuucuuuucuuuccuauguucuuuuguucagugaauaucccuagagcuccuaccauaugucaggcccuaugccucacccugagaacgcagugagcaugagguggaccuguuugcugggaaccccaggucacccccuuuucuuccuacucugugccuggagcaucauguccaccccugcagauccuuggaaaagaaaauguuuauguugcaggguauugcauggucacgagugagggcaggccccuggggacacaucugcccacagcugcacaggccagggcgcaggcacaucuguugguucucaggccucagauaaaaccaucuccgcaucauauggccagugaccgcuuucucccuucaagaaaauucuguggcugugcaguacuuugaaguuuuaauuauuaaccugcuuuaauuaaagcaguuuccuuucuuauaaaguggaaucaccaaaucuuaucacacagagcacaguccuguaguuacccagcccgcuccagcagugcgggagauuguaaggaagcgguggcggcuggugaagcaagucucacaugucggcguucuuggccaauggauacaaagauaaagaaaauguugccuuuuucuaggaacugucagaaauccucaugccuuucaagacuucugugaaugacuugaauuuuuuauucccugccuagggucugugaacgaggccugucucuucccugggguuucuuuccauggccuuuauuucuccucuuccagugggaguuuugcaggcucuucucuguggaaacuucacgagcguuggcugggccucggcuucgcuggaguguacuccagggugaaggcagagugggauuugagacccagguuaggcacgacccaggcugagaagggacguuuccaucauucacagugcccuccccacagcacuaccucaccccgacccccacccucacuccuaccccaccccgcgaucgucaggggugccacggugggccggagggugccggcucuggcugucccugugccggucccucacaaaccucucccccuuugaaacucaagcacagcugcgaggagggcagcgaggagggaccccucucucaugguugucucuuucccccgcuaugucauagguaguggaggaagcgaaggaagugaacgcugaaugugacgcauuucugaagagcucagcugucaccgggcauagccuggaagccccaagucuguucugacuuugccuggcugucuccuugacccgccuccuagaucauuguccuugauguccaggcugggucauuuaaaauagagaugcaaucaggaagguugggggacuugggacuguggcugaauugagaccuugcugauguauucaugucagcaccugagucacagcccaggugcccggaagcagccucuucgcauaggcagugauuugcgauuacuuuaaagcucaccuuuuuucuuccccucucuguucgcugcugucagcauaaugauuguguuccuucccuaugggauccaucuguuuuguaaacaauaaagcgucugagggaguguagu

SEQ ID NO: 16940 - RNA, 1601 nt, Homo sapiens
aggagauuagaaaagggauuacucauuuuccuugaggcagaaacuggggauagggaggagugguaucaaacgguaacaaagagagccugggguuucccaagaucuugugugagacccaaggcucggaggcaugggaacuuccaaagaauaggaguugaggucugagcacaugucuuaggugccaccaucauggcucacaacucaaggcagcaggcaaugggcaaagacucacaaggccagcucccagagaauacaagcuuguccucaauaaagugaaaaaaaaaauccaaaauagagagcaugccagguuccuaaugcucuuugucaucaacuucacuucugcuuuguaauuuuaaguaggaaagauggaaacuuuggcaagcaagggauguccuugcagaguggcugauuuucuuccuucucagccuuaggugcccccaagcaacaagaggcagaguguuuucccuuuggcaaaauccuuuccuguugggcaacaacaacagaaaucaaaaauaaaaaucagccacagugccugggggauuucaucagcccugagauuaugggucagaagucaaagccaacuuccagaaagacugaguccccuccccaaggucucucucuuagcccccacaaacccauccuaaaacucccuaggagcucacaucuacacaaggugucugggucaaaaccccuaaaggcuuccugaauauucccaaaucaucccauauucuuagucaaggguagauccuagaaugggaagaaauauuuccuggaaccccuggcagggaaggcagcacguucugugcccucccugauuugguaauucuuucucucucccugggccugucaccaccacucgcugggucuguuuacuuauugcuggaaaaagcaaugugaucucaguuaaagucugcaagacacucgguuccagauaagcacagcaugucauuagcagcacugugaguuuucccaccgcggcccuaacaucccgccuuucccagcuauuuugggucgggcugcccagucaucccacaagggcagagauugguauugcaaacuuugaauucuguucccaaggguagcgaccggccggcuccgauggugacgucccacugccaaggggugggaguggggagagucuccacagagcuucggagaagcugcuaagauggaaaaguggaaacuuggcagacagauccagccucccuggccacuggcccaugcucguggcuccuggauggcgcugccacguucugagcagcuugggacagguggagaucaggacuggcagcugcaaggacacaccaggugaauagguuucuuuaugguccucacaccugcagaaaaccaggaggguaagggcguucccucuuccaggaagccaugccuuuccacagaagucuccccugaggccauguacacgugugccuugcaacucuaucaagccauuuaauuucccuaugccucaguuuccucaccucugaauauuuacucuccuguuuuggcaaugaauguuuucaguuacauggagacaggcauauacugaucgacuaggcaauauuuuacuugauaaauaagaugggagggcccccugguggacu

SEQ ID NO: 16941 - RNA, 1723 nt, Homo sapiens
gaaccagaugauagagaggauaggcagaggcaggguggcagaauuagggggucuggaaaagaaagugcagaaaagccugaagugcacacaauuccucagugggguggcggggacagagagagacagacagagacagagaaggaggaagaggagggggaaugagaaaggaaagaaguagggggagagaaaaaagaagaaagaggagaaagaggaaaaggagacggaagaggaagaagaagaaaaggaggaggaggaaggugcucacccuguaaccccagcacuuugggaggccuagguggguggaucacuugaggucaggaguucgagaccagccuggccaacagggugaaaccccgucucuacuaaaaauacaaaaauuagccaggcgugguggugggcgccuguaaucccaguuacucgggaagcugaggcaggagaaucucuuaaacccaggagguagagguugcagugagcugagaucgcgccacugcacuccagccugggugaaagagcaaggcuccguuucaaaaaaaaauaaauaaagauaaauuaaaaaaaaaaaaaaaaaaagagggcgcgguggcucacaccuguaaucccagcacuuugggaggccaaggcagguggaucacgaggucaggagaucgagaucauccuggcuaacacggugaaaccccgucucuacuaaaaauacaaaacauuagccagacgugguggcgggcgccuguagucccagcuacuugggaggcugaggcaggagaauggcgugaacccgggaggcggaguuugcagugagcugagaucgccccaucgcacuccagccugggcgacagagcgaaacuccgucaccggaaaaaaaaaaagaggaggaggaguaggaaaaaagggugaaacagaagcaauggaguggggccccagguccuugucucauguccucuuucucacagggacauccucagagcuugcucugguggugaacaagcaaaggggcaggguggcagaauuaggcaggaucagaaugagggacugaaguggcugagccuggcauccuuccuaaauauuuuccaaauacauuucuuaauagaaaaggaaucacagaaguuuuuaggacccaagucuccaaagacuggcucaaacuaaagucuucucauuaaaauauuggauccaagaaggaaauaagaugccccuguaggaaggagagaccccagcaacguccuucagcugggcaccgccuguuccacccaggagcaccuaggacgagcuccugcaaaaggaaugcauucacugcaagccugggagcaacgucccauccgcuucugguauaacuaaaugaagccaugaucccccucuccccgcugccaagcaacgcucaugugcuccaggaagccccacgcacguucccacggcucaugcgggcagccugugucucggcucagcccucaagggugccaugcuccccgugugauggauuccaguuuaacagcuuuuaaaaacaagcagacaagagacgggcgugauggaugagugcaggaagcacgcucauuuggagaugauuuaugggaagucauguguugccgcucaugggugcgucccugagggugggggccgggguggauggaugaguuuggauaguguaagcugcacuaccacggcaggcucacacucagccccauggcgugugcggcagcucccgcucccaucucaucacggcaggcucacacuc

SEQ ID NO: 16942 - RNA, 4968 nt, Homo sapiens
cucuauuuacaaaguauauauuuaaacacguaaaaagcgguauuggauacagacauucacgaccgcagaagauagguaccgaagcuucacucuugagcugaggcggagaucgauuggagauuuguacaaaucuuagaauuaaauaaacccaacagcgcacacacccugcgcgguugcagacucccagccacguggcccccggccccugcccacccaccccccaggucagcgucgcaagagcgagagaaggagacacauacacacacggccacggacaaacagcaggacggaggggcggcagggacagagcuggcuggaaagaagguccaagggaaggggcaaagucagcccccaggaagggagggaggugggaguaaaggacaggcgggagagaagggaaggcggcggccaggugaagacgcguaucccccagucccguccacuagguaacagacaugccccuucagugaaguuucaucugaaaauagcaucgacauuuaaauagauacacucggucaacggcgcuucuuuauacaaagucuaaaauaccaguuuuacaaaugugaguagauaaaaauccccauuccaggggcuucucuuuauaggcgcaauuugauauucaaaaacaaacacaaucauguaguacaccguuucccuccuuuucucucuuuaaaggcaagaaagucuggaggagaggcugagaagccgggagugcggaggacgaggcugggguucccucccagcaccccccaccccacgcgaagcucccccacccccgacuccccgccucgcuccccccgagucugugcuuccucuggcgugcagggcccccgcgccccucccucaacaagcaaugggaaguuagaucuucgcuggcccuuuaagggcggggagggcagggaggcugcgggauccgugcuccaagagacggggguggaguggaggggacugauuugugcuuuugagucaaaagaggggcgcgcauucugcguccucggagcgcagagcggucaaguccgccgggcaggggcgucccaggccccgccgccucgcacggccuuccccgccgcggccguccccacucccaacucccgcuccucccucccccuuuggcggaguuugaaugucgaguucaaauagagaacacugcgaaucgaaaagaccuauaaauuauagcuuuugcuuuuaagaaggacgggggaaaaaaaaggaaaaagcaaaaguuccgaugcgcauucuuggaugaaaaccccgccucgccccuccuucccgugcccggccggagccgcgggggugagucuagccccagcuccgagcuccgagccgugguccucagccacacuccaagccuggccguggagaggcccugggugcgaagccacugcuccuagcagcgcccgccgccgcgccucccuccgugggucccgcagggugggccugucuggccauguguccaccacagagcuggcggcccgcccuccccaggcagggaggcuuguccaacucuuccugggaggugggggccaccgucucuucuccuggcaaagcuagaggacgcgaaaaggaaaaguccaccccaacacuuuucuugcaaaacaacugucucgaacucucagcacugacacgcaauccucccaauuuauccuggcauuucgggaauguaaacagauucgcuggauuucuuuucuuucugcggaguaaggaaaggaacgagggaacggggagauuuuauccacaugacauacacacgaucugcguguaccacacacacaccccucccuaaagugcauuuccuggugugguccuggggagaaaccuccugucccugccugcuggggacguuuuaaccuucaacaucacacacgaaaagcuuauucaaguuaauacuuuuuucccuaauagacuucuuuaccuuaaaaaaaaaaaaauagaaaaaaggaaaacagacugaccccacccccccuuuuuucugauuggggagccaaccuuuuguuggccugccuggccaaugggaagagagagcaaaucugggccgggccuuggugccaggagucuggcauugggcugugggagaagggaggaggggugaggugggcaggccaagccccuccagacacucucagaaaccuguacccagggcccaacuucccuagagcucuggggcaagggggccccuccugccccagcucauucgggcugccccaacuaaagcacaaugagagucucucuccuuuaaauaaaacaacuucgaguugaaauauauauauuuagauauuuuucuuaaauaacauauuuacaucuaauagaaaauauaacucuagagauaaucuuuccaacaaaaacugagggggaggaaggagggaugaaaggggcugguggggugggggugacaucagggacgggaccagccaaaaggccacaucccacccagaaauaaaaaucacuaugccaagcucacgcucacucucuccccugcucuccuccuggacacacccacccagcauucaucuuuucucuuuaaaaaagccuugguccguguuacuuuccuuaauggugacggucaaaaaguuugaggucacguccgugaccaccaccuucuccagguuagucagggaggggcuccaggacucuuccuccgggucccccaggauucuggccacagggauccuggcgaugagggagggccuuccccccugggcccccaugucccgguacaggccccccccagagcugggggggccugagccaugucggacccgggugccauugggaucuagggcacccuggccuuuggccuccaggaaggcagcccugugcuuuaucacccuggccgggaagguguccacagccaguuugcccguggccucagcugagcuagggcuggucacaccacacugcaccagguccgaguccugucuucgggccagcuggaucacacuguggccggcuggaaacuuuccugccccggaaggggugucguccagcuuccugcccuugagguacucuccgaggccggcgcuggguucgccuaagggccucugugagggguccgggagcuccuuccggggcuuggggccucgcuucuucgagcugucccccggugagcugggcuugucauccacucugcugguaccccgcucucguucccucucacguucccgcucccucucucgcucccucucccuuucucgaucccgcucccggucccuaucccggucucggucccggucccgaggggccucugcgcggcaggugcugcuggugcuggugcugcucgcuggcggggacaaacccauguuucgaaggcccucccgggcccgggaaguggaggccagguccuggggcgagcggccaggguaggggauccggaugccccuggcugagucacuucgaaacucguaaguuuuggccuuugccuuggccugcgccugcaggagagaagauggucucaagaguggggcagggcccuguccacccccacaggacuccuccucuaucccugaccuccuaucuuuacccuaugaugccugggaauuucuacauggaugcauggauggguggguggguggguggguggauggcuggaugaaugggugggauggcuguuggagcugagagguagaaggaugagagaagagguagaagauuuggcuggaaguagucauuugcaaaaaguacacuuuuugcauuugauuauuguguccauuugggagggggagcguaaaggaauucuaguguggccaagcccguccccccagacacaguuggugcugcuacugacuuggugacaucuugucagggaacucccuccuacauuacaaauaggcaacauguguggacaccccauuggcucacagcccucagagcccccuucccacaaaucacuccauaacaugguccuccaccauuggacacugccaaccuacuuugaggaggaagguuuugggcuuggguccacgcuuuuuggggccauagagcuccaucucucuuucccuggagaaagaagaaaaggagaaagggugcgugaguaaagaaagcaagugggacucuaguccaggcuggaaagaagccacucuacuuguuucuaagugagcggcugggacuuggaagggucuguaccuuuccucaaaggcugcgagcaagcgagcauccaggauguuuuccuccgguucccaugugcuguaccuaaagggaaucaggaagaagugggcaucagucccaggagcagggugagagcagaggggguguguguguguguaacuuuucucauugcauuguauuguauuucaauguaaaggcaaaaagaggaagaaagaaaccucccgaauaacagucugggguugagaauugcauauaaccuacuuacuucugcgaccaucccuuccauuucacgagguauuccaugcgucccugcgggugcaaaggcgauaaugugugugcauggggagaaacgcaugacgaggauacaagaaaugcaugcgaaaaugcaugcaccagaugaaugcucgaaaccccgccgcaaaaggcacgcgcccgcugcaucaccccugcaccuaaugcugcacaaagugcaugcaccggcauucauuccccaccccgccccccacccaugcaauccgugcaucgcugcaagucuaaggaaagcgccugggcucagagcugccgccgccgccgccgccacggccgcggccgcugcugggaccugggggaagggaagcugggcugcagcagggggagggaacccgggccgggaggggagggcccggccgcacggaggcccuaggcccgggggcaccuacuuuccguaugcgccgcuucaggagggcuucggccgcgaacacccgcucccccaccgcugaaagcuccauguugacucgccgcuuccccccuuggccgcuuccaggagcagaaaagcagcagccagcgcacgacagaccauaauacucucccgcugacgucaguucuccu

SEQ ID NO: 16943 - RNA, 4596 nt, Homo sapiens
gcuggcgcuuguaauguuuauccguuuaaacauuucguccuccugguacacgaagggaacugucugcccaggagccugagccucaggcuguuggagaagcaucugaugccuuuuucuuugcugggggucuucuacgugagguuccuuggcguuguuuaaggucaacuccaccaaauacagcaaccagcuggggcuugaaugggucgaugugugcgugugucccugcgugcaugcaugcaugcacacgugcgugcguguuuguguuugcaagauccucugacaaugaucugcuuugucccagggacgugguaguguauuagcugaccaaccaagacaaggacaccuggaaauaguuagacucuuccacuucccuucaggaccugugaacucagauauguaagucagcuucucagguggucggacgugagagcgaccacagugaaggagccagcacucagggcucucugccuucuaugugggaaugaggucuucccaacagacucucccucuuccaaaagauuguguaucaguugcuccuucugggauuuagagauggacagaaaagggugugcgaucuaugcugugagaacucccagccagcuuagaagugucgagccauuugcacagaaagccacuccuugagcgaggagaccaaaucccuccugaaauccuccaucgcguccuucuggggagaaaaacccuugaugugcugagaaccaucauggggaccaggauagaaggcuucuucccacucaaagcuuuucucccuggagggugggcacugcugggccaugccacuucaaagcaguguuccucagcaggaaagcggaggucaccacuuaccggccuccuccaccuucucggcuucucuuuucuccaugaacccaggucguccagcagguacuuccaaguucccaggucugucugccuaagagccuuuugaggagaccguccuggagccccaucagugcccagauccugggguaccgaccauugcugucuagcagugggggauccuguggugggaauggggugggcuucucauccauguugcuucugggaagagaggguugccuuucugggcuagggagguggcuggagcuucugcccugacccuccgcuagaaaccaguuauauccauugccacagcaauacuguguaacaaauccgccaacacucgguggccugcaacagucagcacugaucuagggcaggagucagcagucugggcagggugauucuucuggucuaggcugggcuuguuuguuuagggccaguggguuguuaagucccaggggaugcucauggugcagaggucggaccuggcccugcucuguggucucuugcaucccuccugcaggccagccauggcacagccaaaggcacggagggagagacagcaagugccuuuccaagccuugguggacaccacaccugcagcucuccccuuggccacagcaagucacguggcugggcucagcauuaaggggugggggacaggccugccacuuuauuguccgcucugcacagucggguggcaguaggcugagaauuuggagggcuaaacaacugggacucuggagagucuguguccuaauaaugccugcuuuggagcacuccuuccccacccgccugcuccaggggaauagcgucccugguccuagcauuucacuagauaccucgugccuuugaaccgcuguguuugggagggaggaagaggauagacagguccagggcuccccucacuugggaagguccuaguagaaggcauuccuucugagucuccuggcccuacagcuucucaccccugcugcuccccaagaccugacccggaccaaucagcugcaucucugcaccaagugccacccccaccgugcacugcucgcaccucacgcuccccaugggcuggcccggaccccagugaggucugcaccucucggaccagccaggaccucggaagccaugagcuggguguucagggcuuggcggaggagacgcugcuccgcgggggauggagaagccccgccccuccacaacucccuuaaucuggaugcaauuagaggaaaccagccaaaaaccccgcggcagcuguugccccgggauuauucccagccagcgagaggcauuagggcgauaauucagucauuagacuucuagccuucccaccgccagaacgugcaaauaggggauaaucagcccugcacggccauccucagcaaugcugcuuauuuaacccauuuuuuaaaaugacacuuaauguuauuggcuggcguacgugugugcgcauacuuaaaaguugaugcguggugcagcucugcugcuaaugucugcugacagcgucgcccgauguugcucagggccucugggaagaggggacaccuuugaugugggcgugcuggcacccaagaggcaacguggucaggcucgaugcuugccagcccuggaaggucccgccaggguuggggggucgggugagcacucagagaucuggggaggaagcgaggagccugguguccucaccaggugcagaggggaaaugcguacugcuccagaagguucugacucaagucucggcccugaggacucagaacucacaagucauggaucaaguacagagggagggagggccccagcccaccccugcgggggaggaggagggucugaaggugggagggcagcuccaugagcagccacuguuccugaccagccgaagugccaggcagggggagguuuccauguccaggagggagaggaccuccacccucugaccuuucaguuuuccauagcagcccagugugaagcucggcgggggugggcagggcaucaggacaagaugaagaugcuggcucuggaaugaggacuccccuugggcuaagggguaguggcuggcagagguugcccagcucuuuuggaggccacagggaauagaggugggguggugcuuccguuccugugaggcccgccccccugagcccccucgucugcuucuuguuuggcagaaauagauguggggcacagccccuagaugaugggaaucugcccaagcugugcccucuggggaaugaaaucuugcuccucgugcagcuuccccuuucccuugcggggugggggcugggggugccaaggcuccacccuuggaggggguugcugggggugccaaggcuccacccuuugcucgcugggcagagggaaggaagcaccucccuguaugcucugcaggggccccugcaggccacuuugccucagaggaaggaggagagguccccugggaaaaugcgcacacacacacacacacacacacacacacacgcacaugcacacacgcacgcaugcacacacacacacacauaugugcaggggugcagccuaagucaguggagccaggacuggcugcgcagcugggccugccccauucuuggaguccccagggaaugagccucaggauccacuucgucccuuguuucuaagccaggcugcacggccguuccugggugugaaagcauucuguccugucuccagucagagggaaccgcccccaaacuagaaagcuaauuucccccgaagguucaugaagccagaggcaugcccuuggggguuggucgggagaagggugagaggcagugcuguggaaggggccuggccccugcugccugcgauucuccccggguauguggccuucugccuccuucagccucaguuuccucaccuguaacaugagaauaaugaugccugccugcccaggccaccuccugggagugcauuggggacucuaaguguaaaacugucaugaggaugguuuaugaagucccagggaccacaccugccacucagggaagagaccgcugaccucagccaucagccgugugcaucgugaggggcagcgagcucaggacggagagcucucccuugguucggagucagcacaccugcacucccacacgcccacccagcuguguguccuccgccgagggcgagccucucugugacucuucuguaaaaugcaccccauucugcccacuccugccacgagacccauccucugcgaucccgccaggcaugugugugugaaugcaugugcaaagcucuccaucagaaggguggugugggcccugcagguccuaccccucggccuugaagcucccucgggcugcggacucugccuccugggucugagcauuagaaccaggagaggggugucccugggcagagccaggggugcaaacagccugcagccaucuggccuuuuaaguauagugugucgcauuuccggguaggaagguagcauuucaaguucaaagagaggucaagucaugcaaccaucuuuccuccagcacuuuugggguaaggaggacaguuuuuguuaugguuuaggggaaauuuucaugaaauuuccaccauuaccaauagauuacugauguccauggcaagugaucuguucuugguauuuuguuuuguuuuguuuugguuuuuaaauguaaucacccauuggucaggcccaggacuggucaccaugagcucugcuagccacggccccaacgaugcuuccggcucucauggauuccacagcaaauaaaacuguacugacaacagaugcac

SEQ ID NO: 16944 - RNA, 1603 nt, Homo sapiens
agcuguucugggacgauggagagagccuggaagugcuggagcgaggggccuacacacaggucaucuuccuggccaggaaugugaguccuggggcugcucaggcuggugggcaggggccggcucgggguugagaaggggugaggggaccugggcuugggggucccacgauggcuaccugccacuaggacacucuagcagguggccugggguccuagagugagcaguggggccgugcacucugcccuuucguguacacagagggaggucaccucccugaugccaucaugagucccuguucucauggguguuccugccccagcugucugcugacaccuccacauucucugccuuuucaucucucucugcucggcccagaacacgaucgugaaugagcugguacgugugaccagugagggagcuggccugcagcugcagaaggugacuguccugggcguggccacggcgccccagcagguccucuccaacggugucccugucuccaacuucaccuacagccccgacaccaaggcaagagggcccagaguggcacagggaucgcgucccccagccguggugcagggggcagaaggugcugggcguccuggugaccgaugccaggaacagaggaugcugggaccucccaagggggucuuuggggaggagugggaagggucaggccacacaggcugugccuuuccuccuccugugucuacacgugggugauggggccacaaugacgaccucugagccguguugaagcagcaccgcguuucuggcgugcguuaaggugacccgcacugagagccggggucccccugcgccugccggggaggaaccgggugcgaagcaucccagggccagacggagcugcccccugagcgccgggccucgcugcugcugggaucucggggccagauggagccgccuucugagcgcuggggucucacugcugcugggaucucgggcugcuccauuugugcucucucuuuuccagguccuggacaucugugucucgcuguugaugggagagcaguuucucgucagcugguguuagccgggcggaguguguuagucucuccagagggaggcugguuccccagggaagcagagccugugugcgggcagcagcugugugcgggccuggggguugcaugugucaccuggagcugggcacuaaccauuccaagccgccgcaucgcuuguuuccaccuccugggccggggcucuggcccccaacgugucuaggagagcuuucucccuagaucgcacugugggccggggcccuggagggcugcucuguguuaauaagauuguaagguuugcccuccucaccuguugccggcaugcggguaguauuagccaccccccuccaucuguucccagcaccggagaagggggugcucagguggaggugugggguaugcaccugagcuccugcuucgcgccugcugcucugccccaacgcgaccgcugcccggcugcccagagggcuggaugccugccgguccccgagcaagccugggaacucaggaaaauucacaggacuugggagauucuaaaucuuaagugcaauuauuuuuaauaaaaggggcauuuggaauca

SEQ ID NO: 16945 - RNA, 14538 nt, Homo sapiens
cacgugaccggggucggggcagggggcggggccgagcgggagaccagagagccggagccggaucccgaucccgaguccgagccgccgccgccaugagcugccccgugcccgccugcugcgcgcugcugcuaguccuggggcucugccgggcgcguccccggaacgcacugcugcuccucggugagugccggcgccgcccccccacgcccaccugcgguggcccggggaaguggccacuggccuccuccccacccguggucaaugcugacccuagugugcccugcccuuguaucccccgcugccauucccucucguccuccucucugugccgcccccagacucuucacgggugucuccccagagagggcagcaaaggcuggaggagugagccccagcauccagcaccccuacacuuaccucgugccgccugucccacccuccucugacccugcccagccagggcucagggguccacggaucucaaaucccucuugggaggggaucccagaggaggggcuggugcuccgguccccagagacugcagacagggugcccuccuggcucucauuuccgaccccagagccugugucucagcugucuuuucccuuaucccaagggcacagcccuccaccacccacccaccaccgucucccccaaccccagucccucucagaaaccccagguuccuccagagcaagcaccgugcugcucacaagacuuccgguuuagguaaucaaggcucuggcucaugacaagugacaaggccaaacccaaggccugcgauucuuuccccuucugaggucuggcgcccugccaguugcccucuuucugauuaauuuuguggucucugggcggggguucggcucacuguaacauaaacagcucuccugccaacuccucgccucccagaaacacagcagagaaucugcauggacccucaccugcggaucagaauuccuacaggaggcugucagaguccaggcuaugcggccccugggcuagggccuuucuuagcacggacugccauggaucggcuuaaacagaaauguauuucucacaguucugugggcugaaaauccaaggucagggugccagcuugguuggguuccagugaggguccacuuucggcuuacagguggucacccucucacuguuuccucacaugacaagcggauggggguggucucacuuccuuuuccuuucuuuuuccuuucuuuccuuuuuuuuuuuuuuuuuuuuuuuuugugagacagggucucacucugucacccaggcuggagcacaguagcacaaucacagcucacugcagccucaaucucccaggcucaagcgauccuccugccucagccucccaaguagcugggaccucaagugcacaucaccaugccuggcuaauuuuuguauuuuuuguagagacaaggucucacuguguugcccagacuggucucgaacuccugggcucaagcaaucuuccugccuuggccucccgggugcugggcuuacgggcaugaaacacugcacccggcccucucuuucuuuuccuuuaaguccacaguccugucagaucaggaucucauccuuaugauucauuuacccuuaauuaaggacccugucuccagauacagugauguugacguuagggcuucagcauaugaauucugggaggacacaguucagaccauagcaggcccacagccaagugccgagacacucuggguuuggagaagggcagcuuucuuccuggccugcggguacggagcacagcccaucccgcucucccuccagguuuacguggcugccaugugcucacaccuguggguacugugggguggaggauggaagcccaacuggaaggugcccagccuccucuguccauccauggaccacauugccucugagggagcuggggaaaguguuggucuggggguucccaccagccucuccuguggugcccccaguguccucuacuccagagcagggggaagaagcuuggugugguuguaggaguucagcggccugucccuguuuccugcugcccaguguguggcccugggcacugcaccucaccuuucugggccucagcugcuuuguguaggaugaaaggguugaaauagacaaccugcaaggucacuaggccuuugagauggcaucagugagaagcagcggugggacgcacacacauagagcuuuagacgcgcccugggcgaggcucuccugcccucugccccaugcgguuuccgcugagcccagaauugcccagcaguucuguggccaugcgcucagccgcugucugccuaaaugccuagccggcuaacacgcccacccagguagcaugccugcugggguaucaucaagcuuguugggucaucaugccugcaugaguaucuugcccacuuggguaccaugccugccugcuaacaugccuaugcagguaccaggcuugccuggguaccaugcccaucugcuuauacccaccagcuaucaguccagccuguguaccaugcccaccugccaacauacccaccggguaucaugccugcuuaggguaucaucaagcuuauugugguaugaugccugcuuaucaugcccacuuggauaccaugccugccugcuaacauaccaaccacgcaucaucccugcuggauaccagucuaccugcuaacauacccacugguaucaggccugccuggguaccaugccuaccugcuuauacccaccaucuaucaguccagccuccauaccaugcucaccugccaacauacccaccaucuaucaaucaguccagccuccauaccaugcucaccugccaacauacccacuggguaucaggccugccugggcacccugccugcuugcugauauacccaccagguauugugccuacuagguaccaugccuucuugcuaacauacccaguggguauggggucuucuggauacaugccugccugcuaacauacccaccaaguaugagaccugcuaacaugcccucugauaccaugcuugccugauguacccacucgggugucaugccuccuagguaauggagugcucugucacgauagcauuucgcgcugaguguucacacugagccaguaccaugcccaccugggugucucgccuucuggcaucacagucccagccucccucacucccagugcuguuucucgugaccgcagccgaccgugcacucucugucucccaccucacgcagcggaugacggaggcuuugagaguggcgcguacaacaacagcgccaucgccaccccgcaccuggacgccuuggcccgccgcagccuccucuuucgcaaugccuucaccucggucagcagcugcucucccagccgcgccagccuccucacuggccugccccaggugaggugcaaggggcgggaggagggggugggcagggaguagacaggcugcguccggggcccaggccucugccacgucucccaucccugggaucccgggggguguugcccacuuucccucccaccuccaggaggaggcacagccuauggcugugagugcagacuaggggcuccgacucacccgccagcccuggcugcacugcuguguguggccuugagcaagucaccuaccuccuugugccucaguuuccucaucuguaagaugguggguguaaugagaugccacucuaguuauggagauuggcggggcuaaugcuuuguauguaaacacuuagugcgaggccuggugggcucacucagcgugaaccgccauggccacagugucccaggaacgccauggugcagggagcggacaccguuaaggcacacaugcuccuauuuuacugugguaaaaugcacaaacaucaacauucccaucuuagccauuuuucagcgcacaguuccggggcauuaagugcauucacaguguuaugcagccaucaccaccauccaucuccagaacuuuuccaucuacccaaacagaagcucugucccaugaaacaccagcuccacauucucccuccccauccccugucucuaugaaucugacugcuccaggggccacauaagaguggaaucacacaggacuaguccuuuuuuuuuuugaguuggagucucacucugucacccaggcuggagugcuguggugcgaucguggcucacugcagccucugccuccccgguuccagcgagucuccugccucagccucccgaguagcugggauuacaggugcgcgccaccacgccugucuaauuuuuguauuuuuaguagagaugggguuucaucauguuggucaggcugguuucgaacuccuggccucaagugaucugcccgccucgaccucccaaagugcugggauuacaggcgugagccaccgagcccggccccccuuuuguguccuuacuucacucagcacaauguccucaggguuaaccauaugcuguagcacgagucagaacuucccuccucuucagggcugacucauauuccaguggauggaugggccccguauuuugcuucuccauauucauccgucagugggcacuuggguugcugcuacccuuuggcuguugugaauaaagcugcuaugaacauggguguuuaaggacacuuguucuuuuagucucacucuguugcccaggcuggagugcaguggugugaucucggcucacugcaaccuccaccucccagauucaagccauucuccuaccucggccucccgaguagcugggacuacaggcgcccgccaccacgcccagcuaauuuuuguauuuuuaguagagacgagguuucaccauguuggccaggcuggucuccaucuccugaccucgugauccaccugcguuggccucccaaagugccgggauuacaggcgugagccaccacgcccggccggcagucugaguuuuuaaaauguacacaucuuuuacaauauaaaauaacuagguaauaaaacaaggccugacccugucuuuuucacucuguaacgugugaucauaacagaagaguucaaaaguacggauacgcaaaaagaacaucaaggccacccucgugucggugcacgcccugcagguccccuucuuucuggcgaaguccuccuuucacgggagggacccaugggccuaucgggcagggagugggagguacagccagugucucugggugcuggccacucgaagucuaaaucagggccccgagaaggccccuggggaugggagggccgugggagaacaggugcggcaggcgggcucuggcuguccgggggccccggaccucaugcgccuuugcuggcagcaucagaaugggauguacgggcugcaccaggacgugcaccacuucaacuccuucgacaaggugcggagccugccgcugcugcucagccaagcuggugugcgcacaggugaggaccccgugccgaggacagggcguggggugaggcacagaggccaggccagagcccaggagguucggcaccuuguaccaaggcacgcucagcccccguggccugcccuuagcucuugucccaaaggaucugggccugggucuccuggcugggcuguguguccacgagaacccacagugcgcuuagggccgagaggggcagagaagggagcagaaaggguugggaggcugaagggacucuggccaggccucucuucccgcccaggcaucaucgggaagaagcacguggggccggagaccguguacccguuugacuuugcguacacggaggagaauggcuccguccuccagguggggcggaacaucacuagaauuaagcugcucguccggaaauuccugcagacucaggaugaccgguaugagucggggccccugccccuucccccuggcggccgguaccagagcacagcccggagucuuccggcgggaugcaugggcccccacguggcucgaaugggggcaggggagaagguuccagguacucgaguuagccuggucagagggagaagggacguggggaaacugaggcagugagggucacagguugacuuccagauacagaggaggaggcagagccgaggggcuuccugugccacguggcaguggccccgcagccuuggcaaugagccuccucccgugcaggccuuucuuccucuacgucgccuuccacgacccccaccgcugugggcacucccagccccaguacggaaccuucugugagaaguuuggcaacggagagagcggcaugggucguaucccagacuggaccccccaggccuacgacccacuggacgugcugguaggacggccccuccuguguuucaggacgcccgucagcccugggucggggacccuggccuccuacgagcuugcagcccuggcccuagaugaugaagaaagaggcucugaccaaaucggauucagguucccaaccucggggccacagagagaaccguagagagacggggugguccggagugaggcuguucugggcuaacccauuugcaggaggccccggggagaaggcuggacaccgcucccccggucugucuguucuaagccuggcuccccaccgccugccccaggugccuuacuucguccccaacaccccggcagcccgagccgaccuggccgcucaguacaccaccgucggccgcauggaccaaggugggcuugcagaaccgggcacuggagggggugccacggccggggucccccauccugggccagcgcccucuuaggucacggcauaaugugggugagggucccaguguggcaggcccugugcugcagcuggcagagcccacauugagaggaggggccuguggguggcaucaggacccaaccccggggcugcccugauguggaccugcuccugggcuggggccuucgggugccccagagguugcgugaagacuucagauauuuccagucacaggaccugggucagauuuggggguuuggaguuccuuagcauaugcagauggagaucuugaggucugugaguuuuuugugguugauggcuuacagcaaccaaaauuuguacucccacaguucaggaggccagaaguuugaaaucaaggugucagcagggccaugcuccccugaaggccuaggggagacccugccuuuccucuuccaacuucugggggcugugccagugcugggcguuccugggcuggcggcagaaucgcccccauccccgcugaagccuucacauggccuuuuuuccugugucuccucuuugugucuccacuucuucuuuuuuuuuuuuuuugagacugagucuugcucugucacccacgcgggagugcaguggcgcaaucucggcucacuacaaccaccaccucccagguucgagcgauuuuucugucucagccuccaaaguagcuaggacugcaaucgcaccgcacgccaccaugcccagcuaauuuuuauauuuuuaguagagacgggguuucaccacauuggccaggcuggucuugaacuccugaccucgugauccgcccaccucagccucccaaagugcugggauuacaggugugaggcaccgcgcccggccuguuuccgcuucuuauaaggaccccgucggguuuagggccuaccugagcacuucaggaugauuuugucccaagaucuuuauucgugaaguuccccuuuccaaacaagaaccccuucacagauuccagcacacaugucuuuuggggucagggacgacaggaggucaggaccuuugccauuucccuauuggugccauuaauucuuagugagcugggaaggagcggguauagaggaagccuuguccucuggccccagcugggaaggagcgaguauagaggaagccucguccucuggccccugcccuauuugcuccaugggacagacacgagauuccggagaacucaaaagccggcgggcaccagggagcagcugccugggggugacacagaagugccaagggauggcuggagucccuggaggcccauucgaggccugcucagggaaugggagcugggcggagcugggcaagagcugggcaagagccagggccauugggaagaacuacagggugcuuucgaauccggaaagcgcuggagcccagcggccggaugcagcagcaggugggucuacacacaccacccgcugccucccuccgugucugcggcugagcucugcuucucggccccucaccacaggaguuggacuggugcuccaggagcugcgugacgccgguguccugaacgacacacuggugaucuucacguccgacaacgggauccccuuccccagcggcaggaccaaccuguacuggccgggcacugcugaacccuuacuggugucauccccggagcacccaaaacgcuggggccaagucagcgaggccuacgugagccuccuagguaugccuuugucugucuccgucaggaaaggugugggaguggaucugggacggggccaugaccugucagaugcugcuccacacccauuaccuaauguggcucucauaucaucugggugaggaagggacugucacucccacucuacagaggaaaagaaugaggcucagagaggugaaguaagcugcucaggauugcacagcugguaagcacuaagcuaggauucucgccuggauccugcugcuuucaaaaccauugccuuuuccccgccuaccuccgaugagcuucagaaucaccugggaugcuuguuaauauccaaauugcaaaucccaggguguccgauucaguagaucuuggcgggcucaagaauuugcaugucugacaaguucccaggugaugccgauacugugggccuggggaccccucucugagcauccgugcaccccauccugccuuccugggggacccaaagcaccucaugacccugcucauuccuaaaaagaccuaggacaucuagucccauguuauggaugugcagacaaagacacgggugcaggaagacuuugugaggggcucggggugaccccuucggcacagggcagaggcucguguguccugcccacugccuggcagagccuccagguggggugggcccgggacagcaggaaacucagguucccuuucccuccgagcucgcggcccacaucucucuuggggcccacaucucucucuggccccaaaugaugagccaggagcacuguggccacacccaccacaggggcuggaguacacgagcuaccaaaaaggagacuucuuuuccaguccaugggauuuuagaaggauccuaaaugucaccgaaucagggccucuuguuauaccauucaaggcacugaggcccagagagaugacguggcggugagaggugucggcucgacaaggcaccucccgcugcugauuggauuggagaagggagccgcccagaguggcguagguucggcccuuccgagggcagcuccugugugcugagggcucugcugcucugagaugccgcgucccuuccagaccucacgcccaccaucuuggauugguucucgaucccguaccccagcuacgccaucuuuggcucgaagaccauccaccucacuggccggucccuccugccggcgcuggaggccgagccccucugggccaccgucuuuggcagccagagccaccacgaggucaccauguccuaccccaugcgcuccgugcagcaccggcacuuccgccucgugcacaaccucaacuucaagaugcccuuucccaucgaccaggacuucuacgucucacccaccuuccaggaccuccugaaccgcaccacagcuggucagcccacgggcugguacaaggaccuccgucauuacuacuaccgggcgcgcugggagcucuacgaccggagccgggacccccacgagacccagaaccuggccaccgacccgcgcuuugcucagcuucuggagaugcuucgggaccagcuggccaaguggcagugggagacccacgaccccugggugugcgcccccgacggcguccuggaggagaagcucucuccccagugccagccccuccacaaugagcugugaccaucccaggaggccugugcacacaucccaggcaugucccagacacaucccacacguguccguguggccggccagccuggggaguaguggcaacagcccuuccguccacacucccauccaaggaggguucuuccuuccuguggggucacucuugccauugccuggagggggaccagagcaugugaccagagcaugugcccagccccuccaccaccaggggcacugccgucauggcaggggacacaguuguccuugugucugaaccaugucccagcacgggaauucuagacauacguggucugcggacagggcagcgcccccagcccaugacaagggagucuuguuuucuggcuugguuuggggaccugcaaaugggaggccugaggcccucuucaggcuuuggcagccacagauacuucugaacccuucacagagagcaggcaggggcuucggugccgcgugggcaguacgcaggucccaccgacacucaccugggagcacggcgccuggcucuuaccagcgucuggccuagaggaagccuuugagcgaccuuugggcagguuucugcuucuucuguuuugccccauggucaagucccuguuccccaggcagguuucagcugauuggcagcaggcucccugagugaugagcuugaaccugugguguuucugggcagaagcuuaucuuuuuugagaguguccgaagaugaaggcauggcgaugcccguccucuggcuuggguuaauucuucggugacacuggcauugcuggguggugaugcccguccucuggcuuggguuaauucuucggugacacuggcguugcuggguggcaaugcccauccucugccuuggguuaauucuucggugacacuggcguugcuggguggcgaugcccguccucuggcuuggguuaauucuuggaugacgucggcguugcugggagaaugugccguuccugcccugccuccacccaccucgggagcagaagcccggccuggacaccccucggccuggacaccccucgaaggagagggcgcuuccuugaguaggugggcuccccuugcccuucccucccuaucacuccauacuggggugggcuggaggaggccacaggccagcuauuguaaaagcuuuuuauuuuaguaaaauauacagaaguucuuuuucugaacucauuuaugaugauaccaaccugaauucuagaacagcuuccugauucuuggacacugcugucaaaaugacauucagucugcaacagccccaggaggcaggggcaaggccaggugcuggcggaccuggguccuccccgagcccugaagguggaguaaagauguuuggcccaagaagggcuggggugcaaagccaggucaggggaaggcagaguccgcugggccuuguacggggguacuggugccaggcuucucugggacacccccaccgaacaggcacaggggccacggggcacagacccacugaaaguaccgucuccaccacgcagaggcuuuauuuacaaguaaacacacuggucucuguaaacuggaguuccugaggcaucgcagccucagaagcugagaaaagguggccagcgucacagcauaugugggcuucugccucugccccgggcaaggguggcagcgaccuuggggaccacccaggcgccccacccgcugccucugugcuuuuggucacuccaaaagccuuugacacaucaaaauguaaaagggaagugcagcccccauagauuugaaucgggccugcagacaggcgguuuuccagagaaguccggggccuccgguucuagggaaggcaugggaagacgucccuccugucccacugcagaaacauucucaggguuuccaguucagaccaugccaagccugguaaagggugaagauguuuccacagaaaagugugcaguuacaaguggcuucacugugugugaccugcacguggugaggguucaagguuagaccccagccaguggggagagccggccucaugugccaaggagcccacagcugugccaagagggccugggcugaggaacaggacugcauuaacaggcacacagaagcccccacagucccgggaaggggcacggugcaucaucgggggcucugcuccguccacaccaccuucuucugcucgucggcgauggccuggcggacacagcugagcaggccguccaggucgcuccagccgucaggagccaggcugcuguauagacagggcgcccgguccaggucucccuccuccugccucgcagccuccaggagcugcuccucugaggugcccaaccgcuguaggcccuuccugcacaggccagaguuggggggggcgggcucaggggagagcaagggcccaggagcccuggcuaggguagugaugacaugcacccaaacaccccuaaacacagguggccucgcuuugaggggaccuuguaaagaaaauaggccccaggccccaguggugggaggcagguugucuagaacacagccuugcuuccuggaguagaaagggcacaguagcaggacaucuuggucuguccccaggaaaccaaguaauuuuuuuacuuuuuuuuuuuuuguccuuagccgacaaggauuagauugugcuagccaagcaccaguaaguggagggucaguggagcugaggccgggugggguucuggccuuacaaugguccucugagcugcucuugggggagggagugccaauuuguuaauuuacaacuuuaaauuucaauuauaaaaugucauuuuccagugacuaggcuacuuuugcccacuguaaaaggcaccgucauccugguaucaagauucuggagaggccagauuugaaaucaaguuuguuugguaagcgugaaaucagagcaguuguuguuguuguuguuuuguuuuguugagacagagucucgcucugucacccaggcuggagugcaguggcgcgaucuuggcucaccgcaacuccaccucccaguucaaguaauuaucaugucucagccucccgaguagcugggauuacaggcgcccgccgccacaccuggcuaguuuuuguauuuuuaauagagacaggguuucuccauguuggccaggcuggucucgaacugcugaccucaagcaaucugcccacccuggccucccaaagugcugggauuacaggcgugagccaccacgcccggccaaaaucaggggaaucucaugagcaaucagcggggcccuugucccaaaguugugcggaaacggcccugucagcgccucagcuuccugcaaaccgcagagcacacuccagaggcaccugccgugggcuuugggggagcccaggagccgcuucgaagccccugcccagcccccagcgugcaccuacuugagcuucuuugccaucuucucguugacagagacguggaugacgauggggaagauguccauccugugcagggugcagacacuguccagcuggacguccaggagggcauggguguucuuugugggagggagagaagaagugagucaagaucacaggccucagaggaagcaaagggagccaacgcccaggucagaagggcccuccggacaggcugagggcagggcaggagcugggcagagcugaauuuuguagaggagaugagggaauagagcuugccacuuucuucucucuuuuuuuuauuuuuauuuuuuauuuuuuugagacggagucucgcucugucgcccaggcuggagugcaguggcgcgaucucggcucacugcaagcucugccucccagguucaugccauucuccugucucagccucccgaguagcugggacuacaggcgcccaccaccacgccuggcuaauuuuuucuguuuuuaguagagacaggguuucaccguguuagccaggauggucuugaucuccugaccucaggugaucugcccgccucggccucccaaagugcugggauuagaggcgugagccaccgcacccggcccacuuuuaauuuuuuuagcuuuuaaauguuuuguagagacgggugucucacuguguugcucaggcuggucucaaauuccugggcucaagcaaucuucccgccuaggccucccaaaguguggggauuacaggcgcgagccacugugcccggcuacuuucuucucuuuuuauuuuuuaauuuuuuuuagagacgggucucacuguguugcucaggcuggucuugaacuccugggcucaagcgauccucccaccucggguucccaaagugcugggaugacaggcgugagccccaggcccagcugaguuugccacuuucuaaaugaggcugugugcuaugcaguauuaagaguuuccaucccuuugauuuuucacugggaaaaucuagaaauugugagcucuggggaugaggugaacuuggcauggagcuccgccagccccuacaggaggcacgcagaugccagacucggcuucccgugccugugcagacacaaagcugugguucacggggagcugcuuuucacgcguuugcgccuucaaacguggagaguguuguuagcucggauuuauucauucucgaacaaauaucuauuaaacaucccccaagcugaggaaacuga

SEQ ID NO: 16946 - RNA, 8327 nt, Homo sapiens
gugcaaaacguuggauaucacaucauuaaugcggcauuuuguguucagagccagugggacagugauuccugcacaagauuccugaaagccuggggagacugaauuauguuaaucuaaaaggaucccaccuaauuaggagauaagaaauuuuugccuucaccugcacaggaagggugcacggaaacacgucauuuagaacaucccgggcccgaacaucgcgggcccuaacauccagguauccgugccacuucuccguaccgguccaaggaggccgcgguguucgcggcggucgccgagaccggcgggcugugguuucgaacccgcggcaacggcgcgcggccggaggcggcgcucggccuucgcguuccgcggcgccuggcccggcgcggccgccguagcgggaggacccgagcuacgguggccgcggggcggcgguggcgauuggacuuggugggucccgggccaggggcgggcgccgccauggguaaccuguucggccgcaagaagcagagccgcgucacggagcaggacaaggccauccuggugagggcccgggcccggggucagggcuggggccgggacaggcgacggggccggggcgggcggcggggccggaagagccccgcgcccucggccccccgcguucggauggggaaacugaggcgcagcgcgcagccgggccccucggucucuccgcccugcgucccuccucgcccgcggggccucgggccggggucuccugcgcggcgccguggcugccgucuuccccggggcccgcgcguccgccucugcgagccccgccggggugggcgcggcuggugacugcgggauucgacgccggcguucggggcucggccacagccuggcggcccguccgugggguccgcgcggcgcugggcuuucccuggcucugggcccgcgggagcaggucccggcucucccggagucgcugcccccgcccccgucccgcggcucauuugccuccuggugcccugggccggagccccggcggugcugccggcuucgcgaggcagcgcggggcauccccucucccucaccccauccaggccaggacuggaaggaagucugcccugguccgaggagcggccgacaggugcgccgaacgccugccgggguccugccgggguccugccgggcuuccgcagcgccuggguacgggaccaccguguuuggcgcguuuguuugcggcgacuccagacugaccccccggggcacagccgggccggugguggugccuuuucccaugugaaaguuagcuucuguaggaggaggaaucgccuggcaugucagggacagggcggguuaagaauaguccauuuuuguaacgagauaaacgugucacgaaagagaccccgaaaugaaagcagggcuagcuuuuucggaugcuuucuuuucuaaauuuugugcaacagaaauagguuaauuuuauacuaaaagagaagcgaauguaaaugaaagagggaaucuuacguuggcaucugaguccauaagcugugaaaagaaacaacgggcacauuugucccuagagaagaugggcacagcgcugggcaccgucccgagcugccugcaagacagcuggacccagccuccaucguccaccuuccaccuacccugccagccccaaggcacucccuccccucucuuuaaggacucagcuccgguuucucuucaagcacagcuuuccacuugccaagggucacugugggcucucggcugugcagacccguguugcgggcugccguaggucucccugggauuuugggugcuugggaacagcauccuuagcacacacuagcacaaaugauugcuuuuuuuuuucuguuuuucuaggauaacagguguuccccacguggccugugacccuccacugagaccuuguuuuacaggggggcagccuggccacaccugccugccuuuggccccugggucuccccagcaguggggcugggcagggggcaccuuucacuguagcaacgagaggacccacaggccuuggcacggcgagggggagacuccguggguggagggaaccgggaaugagcccucucagguagagggagcacuggcuucccaugcggagucuuaaagaggcacacaggcccugacugagcuaauucuccucagccuccugccuuaaggccauaaucccugugccugcacgggcucagcauugucugaagugaugacguuuggaaaacuuaaggaccugauagagcaggacuggcugaaguuccucaguggccgagugcccucucugggacggcacacagaugagaggcggucagcggggccgagugggugucccugcagccggaugguuggcaaaggggcagggaagccacaggcaucucaugcggcugaagcgcaaggagagaagccggggggaugucugagcccuguccuggccguguggcugguggcacuuggguacucgccaccugcauguucuugagucggaacuuuuuuuuuuugagauggagucucacucugucacccaggcuggaacacaguggcauacucucggcucacugcaagcucugccucccggguucacgcuguucuccugccucagccucccagguagcugggacuacaggcaccgccaccacacccggcuaauauuuuuauguauuuuuaguagagacgggguuucaccauguuagccaggauggucucgaucuccugaccucgugcuccgcccgccucggccucccaaagugcugggauuacaggcgugagccacugcgcccagccgaguccaaaccuuugagguccuggcagcugcucccugaccugagccuagagugcuuguaccgcuggcaggcagccucgaggguggacccacagcaaugccacgguggucuuccccaucccugugaugggcuguggaguccgggugacccucugguggggccgccucuuguguggcaggauguggagcugagucccuggcuuccacccccagacguguccagacagcaccaccuguccccuggaaggcaacccugccccaugaaggacacucacggagggccgcccggccuccaugccuggcgcucaguagcguggccagggcucccagugugggcucggugacgccaggcccucucucucuuggcagcaacugaagcagcagcgggacaagcugaggcaguaccagaagaggaucgcccagcagcuggagcgcgagcgcgcccuggcccggcagcugcugcgggacggcaggaaggagugaguggggcccgggcagcgugggcacccugucggcugggguggggggcccgggcagcgugggcacccugucggcugggguggggggcccgggcagcgugggcacccugucggcugggguggggggcccgggcagcgugggcacccugucggcugggguggggggcccgggcagcgugggcacccugucggcugggguggggggcccgggcagcgugggcacccugucggcugggguggggggcccgggcagcgugggcacccugucggcugggguggggggcccaggcagggccacagcgggucacucucgggcuucccucugcagacgggccaagcugcugcucaagaagaagcgauaccaggagcagcuccuggacaggacggagaaccagaucagcagccuggaggccaugguaggcggccgggugcuucgcccuggagugcaggugcagcuggaggcagcuccgcccggcugcguggacaucagaaauuucucccgagagcugaaagcuccucucagaugccucgggcugaagcugaccugaagaggggcgggccuggaaucccggggagucugccaggaagcuaauggucuuaagaggcuggggggcagguuggcucucgcaggacugagguggggaagguugggccaccccugggugguguggguaggucaggggucugcauggggacugagugucccugguguuagggacccgagcggcgugguucugcucuuugguaaccagagcuacuaacaagcaaccagcgguccccugagugugucccuggcaccugcucaguccugcgcauccccaccuggcagugggagaggacagggaggagcaggugucaggagucacccucacgcccagcagcacccgcccagcaagggugucauccugaacccugccccagggccgggaggagggcaccccggauccucagcaccugcgucugcucugguuuccuuuucagguucagaguauugaguucacccagaucgaaaugaaagugauggaggggcugcaguuuggaaaugagugucugaacaagaugcaccaggugagucucugcagggccaggggcauggagguguggggagcccauugggcuggagcuggggauagggcggggggcuugucccacgguguucgugucagacacagggcaagaggcuggcaggggagauguguugggugcugccaggcaggcagggaugcagugaccgggugcagcacaggcugggaacugugggaacuggguccccaggcgccgaagugacauagaagggaagucugaggguggggagggggcuggcaaacuaaucacagaaggcuuccuggagguggcgggugugguggcucacaccuguaaucacuuuuggaggccaaggcaggcagaucaccugaggucaggaguucgagaccagccuggccaacauggugaaacccugucucuacuaauaauacaaaaaugagccaggcgugguggcaggcaccuguaaacccagcuacucaagaggcugaggcaggagaaucucuugaaccgggaggcagagguugcagugagaugagauugcgccacugcacuccagccuggaugauaagagcaaaacuccgucucaggaaaaaaaaaaaagaaggcuuccuggaggaggugaauaccggccucaucucaggccgggcauggaugugaagcccagcguggccauaccacguucccccaccaaccccaucacacuccugacaugggggccaguagguggggcuaguuggagagccagggacucaccuggcgggaggucuggcugugcuacuuuuccaaguguuuggugaguacugguggugugugccggucaagcacaaguggcccuuugaccuuuugccacucaaaagaaaucaagucaccugcccagaauguucuaccuguugcuuguuuuuacuggcggcugugagagcugacucagggugagagggggcaucgggcgccagggcagugcagucguggccucugaaaagacucaucaaacggccccuguggccucaggacaggcccaugccugggacacacauguccuggccucauuuaaacagggacaggagcugggugugguggcaugcaccuguagucccagcuacuuggacggaucgcuugagcccagccugggcaacacagccagaccuugucuuuaaaaauaaauaaaaauaaacagaggggugaggccauggcccugagagcccaggaggccucugucgggggucuaccauuggccucgcgacaggggucaacacccaucacccucguccacaggugauguccauugaagagguggagaggauccuggacgagacgcaggaggccguggaguaccagcggguagguggcacccugaccggccugcccccaacugugagaacccacaaggccacccucgagggccaaacugucccacauccuagagcggccgccuucucucaaggggacgagacccagccacaggccaucuccuuccucccugaggggccaccuccucgcugcucucaccaccgccuguccuuuugcagcaaauagacgagcuccuggcaggaagcuucacucaggaggaugaagacgccauccuggaggagcugagcgcaaucacucagguaacggcccccccgggacugagcacagucacucaggcagcgggacccccagagcucagacccccaggaggcccugcccauggugaucucguaugugguguccuuuaaguaaauagucugcgguuugugacugguuuuccuaccugaggugacucuguuuucaggguugcucacccaacggucuggugcaggcaggcuggccccgugcccuggacagagcgggggugcugggccuuccuggcgccucggccccuuucuguccccggcugucacggauguggugcuggcuuuccccagccguggcugcugacucacgucccacauaggcccucgcugcgggggccgcguccuggccccaggcucacauccaggcucugagucuguauucacuccccgacacagggguuguccucucugugggccccugccucaguccgccaaauucucauggugcccccagagccggccucugccccagcccugcugccagcugccccggcgcccuggugcugugcggcccauggugccugcacccacuugcuuguccaguuacuuucuccugaggguccgaguccuccggggccuccagggaaggccagcugagaggcagaagcacccgugcuggcuuaggcagccaagcucgcugggacagcguuguaccgcagcccaccccgcagugguggacaccagcgugaccugggugucugugucacccaccccucggucccugagagccagggucucuggggcacacccaggacgucgccuccuuacagccccucagcgccccagggucuguugggaggagccuccaugguagcggcugcgucaccaccuaggggauucugguggcaccagaagccggggcgguugcagacuugggucuucugagcagcacguuccuguccgcuuuaacuccggcugagagcggcugacggacaggauccguguccucucggggaggcccaggcagcccggggcagaccugucaccugcucauagccuuacccuuugcuucuugcaggaacaaauagagcugccagagguucccuccgagccccuuccugagaagaucccagguauuuccauguuugauucuuuugaaugguuggaauucgcaggagaaaaguggauucuagaagggaacaagacagaaugcucccaggccuuccugggccgugggcaagcccugcugccuggcuguuuggcuugggggcgugcgugccuggccuugggguugggcuuggguuucccagggguucgguaacugggcaaccucauaagagagccauaccccauucaaagagacacauucagaaaucagaacuggggaaaggcuucuuuagcagcaccagcucauucccaggguguagcccaggauuagcccucagccagggauggcucuccccguggcaccauucagcacaggcucuccaaccugcccacugggaagcugacuuuagaaccguccauccacguuuguucuguuccuuuacccaucuuuggggcucuucuccucucugagucccgcugggaggggcugugcuuuccuggcccacugucccgugucccuggcccugucugucagccccauuggcuuccuguuugucacuugccucccccagagcugggcgugcccuucccuagugcgaaguccccggaacuggcccuugccaccccuguggccucgucccucucuggaggucucugccugugggucuuuggcgugucauaaacaucucuguuuccuccacagaaaacgucccugucaaggccaggcccaggcaggcggagcugguggcagcuucguaacguggccucgucuugugggacucacggggaugccccagggacuguggcccacagagaguuugggucacggccagccccugaccggguucccuggagcccagugcgcacggugcugagcagagcugcagccacgcaggcgcauugcaggaggacuccagagcgucuccuggagaccuugagccugaacgcacucaggcgccacuggccugcucucaguccggauuaacucucgaccgagcccagcuucugccgguugugggcucccccgguggccgaggcccaggcccaacgccucuggugcuguuccccugcagucccagccccgcguggcucgcgcucgucugugaggaagacaccuccagaccuugggguccccgcgcuuccucuugcuccucgcugcucccauuagcuggugcaggcuuccguuaaggggucccucccuuggccuggcuucccggcgcaccucagcuucccugcugguggggggauccccaggagaccagcaugugcugaaccucucugugccucugccuccgcacccuagacacccaccuccaguuugaagguggcgggccaggggcuuucuugcugaauugacgacuccgagagccc

SEQ ID NO: 16947 - RNA, 2278 nt, Homo sapiens
ccuccuuuccuccgccguccucccccagcagccuggaaucacuugcugcuucccagccauucggucuacgcgcucauucauuagacucagagugagcagcuaggugccaggaauccacagaucuaucgggacccuucucuguucucuccucuccccggucuccauuucuacccgaggaauucucauuuguccuucaagcuccagccuagaagccaccuccuucuggaagcccucccggguuucccuguucauguaagccuccaccucuccuguccccuccaggaaugucccuugcucuuuucgugugaaaaggugaaguucaacauugccacugaucugggcgcaguucggcagggcaccgccuccccuuggagcuguguggccuuagcggaguggccgagccucucugugcccagcguuucauuccuaccuccuaggugcuaauuccucacaacagacuauuuuucggcugaggcagucagggcccccgcccccgugcccuggcgccaagcacucgccccagaaucgguccugggaauaaaggucaaaaaggaacccuuaaacccgcuccuccccggaaggcacagcgccuccccuucucuccagcccgcgacugcccauccaaaccgaggccucgcggggcgagucccuuguccuccagcucguugaacuggggccccgggcacaggucggcuggaccagcuuggcgaaccggacagcugcgagacccucaggugcccaccggcccaguuuccgcccgccccuccgggcccgccucucauuggcucgcgucccaccaaacccuacccccuggccgucacuuccgggcaacggagcccguggaaggcggaagugugagcgccgcggcggcagcugaguugggcugaggugucccuagcuggcucugcggcucuuccgggucugggcucggagauucacaggcggcccgcgaggccgagcgagggacgcauggcccugaggcggccgcagggcuuggcgggguccggagguugaccucgcccccgcagccggccuucgaggcugccuccuccaggcagccucuggggcccgcgcccgcgccugcucaggcucccguguucaggcugcccauccccuccccaccggcgucccggacguugggaccugugaccguggccucgggcugggcuuccaaagccggccgcagcccggcgacccccgaggccucucgccccgggccccuagaccucucacuaugaccgcggccgccgccuccaacugggggcugaucacgaacaucgugaacagcaucguaggggucaguguccucaccaugcccuucugcuucaaacaggugaguccggugggcccggagaucaccgcccucgccucccccgcagagggggcgucuggcugggucguccugguuaaaguucccgccggggcagggcuucgcugggcgggugcaggcggccgcgggcggggcgacccucugggucccggcgcaguucccguagagaauccguggaugagaagcgcacggcguuggcccuggcagcccuugucagcccgggccggaaaguuccccacacucaaaaacucgauaccgaagcaaaguguaacaaagcaaaaugauccuccagaaucggaagggaacggugggacuccguauuuuuacauuuuaucguguuuuuaaaaacucugacccaacugcaccugucuucagaagcacacaacucaccacucccaggcuucgacacuagauagggaccuugguugcaaggugauuaaaaacauccaccagguuauacaccuaagaucugcguuucacaaaaaccgcacauuuggcagggggugguggcucacaccuguaaucccagcacuuugggaggccgaggcgaguggaucaccugaggucaggaguucgagaacugccugaccaacaugcugaaaccccaucucuacugaaaauacaaaaauuagccgggggugguggcacaugccuguaaucccagauacuugggaggcugagacaggagaauagcuugaaccugggaggcgaagguuucaaugagccgaagguugcagugagccgagaucacgccauugcacuccagccugggcgacagagggagacuccgucucaaaaacaaaaacaaaaaacugcacauuugaucuaaugugugcagacguuaccacaguuggaaaaaaucucaaauacaaaaaguuuagcgucauuccagcauugaauaacacaugaaagaaaauggccauuucuaagugucaucuguuuaaucua

SEQ ID NO: 16948 - RNA, 3436 nt, Homo sapiens
cggccccgcccgcgccacccccgcgcgcucgcgacccugcgcgggccggcgggcgggucugaguuggggcgcccuccgagggucgccgggagggccgaagggcugacgggccuggccccuccccgggacugccgcgccguggggagggcccugcugcgccccgaaacugccugacccggggcggggccgcgccggagcugggguggguccccgaguccccggccacgcugcggggcuuugcucccugggacgucccuugcaaucuuuccccucgggcuccacgaggaucucgggcgccagugccgggcugaggaaggggcgcggcggggguccgcgacgcucugcgucccugggcgcgggggagcucucaggagcccucaccucgccccggucaccauaggaaacagcccgcccguccccaagcgcagccaccaccaugcaggucccuccacggggcgcccugccccggaucuccguucguuugaagaccgaggccccuuucuacccgacccgacacaucccugccccucaaaucacaggccugauuguccccaggcgcgcgcuccggguuggggcuaccccgcccccuuaugugcugagaaggugguguggagugaggccuuuguuucauucuggucaccuguagacauuauagggaaacugagguagacaaugggagcccugacuuuuuugaaggucggcuccccagcuucgggcggucggggggauacccucuucuguuuacgaugcuaguuaagagcagcgaucagggcuggcguggguuuagccacaggcuuguccagggcgcucacuccucgccaggagcggcgccggugcuuugguuacaccccgagaggcgcccggcacuacgguuuccuugugcgcugcuggaauuuucaggguuggagcgccggccgcguagggguggcagugaggccgcgcagugaggggacggacucgcccgaggucgcagagcguucagauugacucgacaggcuggggggcggggccgggguccccacgcggaguccggggcccugcaacguuagcucgcgaccccguguuugggagugacaacagcgagucagggcaaggcggccggcccagcucaccugcgggcugcagucagcccggacgccgagacccgugccuaaggcccccgugccccaggccucccaggggugcugagcgcccccaggcccagaaucuccgggggcccgggcaaggcugucagguauguucccucccguggcgaagccggggcugggccuccaacagacccacccggacucgcgucccugggcagaaccacacagccugcucgacccccgggugaggacuuccacuuggggggucccaagaugcgacgucacacaccgagggacacgaggcggguggggaauagccacaagccccuccauccugcguucaccccacacuacguucugcuccgggccggccggggacccugccccuccgggucucuggucuccuccgaagcuucuuugucuaggaagugcggggaggugccggccccgggcgcgcguccccgucccccaccuuucuuccccacguugcggacccgaggccgccagggucgugggggcgggggcgaggcuggcgccucgagacccccggguuccccgccacccgcagggccugagccgcggggaggggcggggaggggacgccgccgcgggccggggguggagagcgacuuccuccuccgcggccgcgucacgcggcaggggucaagguguggcccagguacgcggcggggggcgguggcgcggccauauuuggcgacuucggcgccgccggagccccgcccgccuccgccgggaagcccggcccggggcagcgccauccccgcccgccgccgggccugagucacggcgggcggggggcggaaguaacggacggggggcgcccgcccggcgcuccuggccuuauuuagucaaggaggccgccgauuggcgcgcgggacagaggggcggcggccgggcagccucggggcguaggaguggcccggcgccuccgaggggucggggcgggagccgggcguggggggccucggagccuggggagucccgggaccgacggcggcggggaugcgggucugccugucccugggaugcgggcgggcgggcagggcgaggccuggagcccgcggggcgcagggggcuggaccgcgcgcugugauuuuucuguuuagcagcggggccucgcccaaggucgcgcggggccuguccuggauaugcucugggaagccaguggcgcagggcagccgccacccuucuggaaccagugccggagagggccgggcagcugggccuggggaggggaccgcauggauggagcuggggguagcugggcggccuccggagccgggagagucggcagcugcacuuccgccagagguggguguguccuucacauuucaggaagggagacuuggggccuggagaagcgaugugauuuuucuuuucuaguucagugcugguuuugauggcuuuuuaucaugaccuuguuaugucuuauuuuaguuucggcccauuuaguggauacgacaacaguggcccagggagguauggcagagcugaggcuuaacccagggccugcgcccuccacggccugcacugccccaccuccagcuccuugcccuguuccucccucugcaccggaucagcccccggacucugggucaccuccacaccaguugacagggccccccaguccccaccgccaaccaccuggccggcuacuugucagacagacaugggggcgugggcauggguccccaccccuagccuuugccucugucacucuaccugccuggaaugucuacuuuuucuuuauauuuuauuuuauuguauuuuugagacagucucauugucgcccaggcuggagcgcaguggcgcgaucuuggcucgcugcaaccucugucuccgggguucaagcgauucucgggccuuagccucccgaguagcugagacuacaggcgugcaccaccaugccuggcuaauuuuugcauuuuugguggagacaggguuucaccauguuggccaggcuggccugaacuccugaccuuaagugauccacucgccuaggccuuccaaagugcugggauuacaggcgugagccaccucacccagccuggagugucucaucuuccaccacuaaaugaaacgauggacccugaacagaaaaaggaacagugguggaagaacuagcaaagcccacagccuugaguuuggccguaaguaucaagguuaaucucucaguuauggcaguugucccaugaccguguaagaugccagguuaggggacacugggaauagagcauugggaaaccuucccacugucuuugcaacuuuucuguaaguuuaaaguucucccauaauaaaaagcuaacuugaauccaaggcaagcaaag

SEQ ID NO: 16949 - RNA, 7232 nt, Homo sapiens
gcaccggugacccagcucucccacccaggccaucgcagggcagccucagggcaggcgccaccacugcuccugcucagcccgcaguaucugcaguugcugcagcuguguggcuugguagaaaagucucaggcacugagguuuacuucaagggagaacugacuggugcccccguccacacucaucacccuggacacaaccucgggggcuucacuaaaggagggaaggauguggaaacuagucucucucacuccccuuuugugcaguuuuuaucuuaaaaaaaaauaaauaaaagucuucugggcaggaauuacugauaacuguuauuauaaccaaugcagacuuuaaaaucccaccuggacaucgggugagaggaggagggcaggcagcaaaccgaccugcagaccugcagaggggagccguguccagggccacugcguccccaccagacaacagcuacuagaagaggaaaguggcccucacaggcagggugccugccaccaagcagucagacaaggggguaaccaagagcucccagccagaaaaacaugggggcagggaggccaaacaaaaagcacugaaaauaaagagaaggcugggugguggcagcaucggccccucccugugcgccccaauuccaggugccacguagaggcgagaggucuuuccaacacggcgggggacuugucaacaggauuaggcgugaggagccgcucugcguuuccagucuggagacugcauucagccugcagaauaccagccguggcgcccgcucuccagggaggaacgugcugagaagcuucagugggucagggagcccaggacagccagccccuuguuccuccagggcugcccacuauggggcaguuacagggaacacacucagcaacgcuucuggcuucaggaagggcugggcugggcccgguccuagccagcagagggcaggcgcccuagguccuggggaggcugcacaucucgcaguggccugugccuggcugguucaugaacgugcagugcugacaggcccacauggcugcaguggccguguguguggagcccccgacggcgccguacucauggagaccugggagcugcccgccaacugugccugcaggguggaagagaaaugagcacucaucauuucuggcccaccagagacugccagagugugggcaugggggcaggggcaggcagcugagagcuccccgcccccaacaucccacccagugcugguccugcccacacagcacucccaccacaggcacacuuugaagugcuuaaugcccucagaaaaaugccuccugcaccacagggaguaacagggagccugugcuugcugguuccuuuuuguugcagagggugcuucuccuugugaauaacguaacuccccgggggaugugcauuuggguuguuuccagcuuuuuuuuuuuuuuuuuuuuucugagguagggucuugcucugucacccaggcuggagugcaguggcacgaucucggcucacugcaaccuccaccucccggguucaagcgguuuuccugccucagccucccaaguagcugggauuacaggcaugaaccacaaugccuggcuaauuuuaucuauuuuuugguagaacuaggguuucaccauguuggccaggcuggucucgaacuccugaccucaggugauccacccaccuuggccucccaaagugcugggauuauagguaugagccaccaugcccagccuccaguuuugagcuaauaugaacaaaguugccaggaucauucuucuacaauuucuuuguggaccuguguuuuuauuucucuuggauaaaaacaaagagugaggcugggugcagugggucacgccuguaaucccagcacuuugggaggccgaggcggguggaucacuugaagucaggaguuugagaccagccuggccaacauggcgaaacccggucucuacuaaaaauaauuagccaggcguggugguagacaccugccguuccggcuacucaggaggcugaggaaggagaaucccaugaacccgggaggggaagccugcagugagccgagacccugccucuucacuccagccugggcgacacagcgagacuccaucucaaaaacaaacaacaggccgggcgcgguggcucaugccuguaaucccagcacuuugggaggcugaggugggcagaucacaaauucaagagauggagaccauccuggcuaacauggugaaaccccgucucuacuaaaaaugcaaaaauuaccugggggugguggugcgcaccuguaaucccagcuacuaggaaggcugaggaaggagaauggcgugaaccugggaggcggagguugcagugaaccgagguugcaguaagccgagaucucaaaacaaacaaacaaacaaacaacaacaacaaaaaaccuaccuaggaaugaaucugccggcccacaggguaaugaauugugugcugaacuuucuaagacccugagacacaguucucgcgaggguggcacgguuuugccucccacucgcaagguacgagagucccagcugcuucacaucuucacucacacuugacauugucgcguuuuuuucauuucagccacacugaugaauguguaacggcuucucauguuuuaauuugcauuucccugaugacuaaugauagugacuguuccugcaucuccuuuuuuuuguuguugccgaggcuggagugcaauggcgcaaucucggcucgcugcaaccucugccuccuggguucaagcgauucuccuaccucagccucccaaguagcuaggauuacaggcacgugccaccacaccuggcuaauuuuuuuuauuuuuaguagagauggguuuucaccauguuggccuggcugucucgaacuccugaccucaaaugauccaccgccucggccucccaaagugcugggauuacaggcgugagcuaccaugcccgaccugcauuuccuuuugugaaacguuucacccuccgcccagcuucuucuucugcuuucuguuugauuaacaacaggcagaguuauuuuuaaguuucagauagaagucauguuguguguauguacugcuaauacugcgucccccauuggugccuuuucauguuucuaacagugcccugugaugagcacaaguguuuuguuuagauaaauuuauuuaucaauuuaccuauuuuuaugccaguguuuuucuguguucuaccccaagguccugcauccugccuaaaagaaucuuugcguaccccaaggcccugaagagauucaacuuaauaacuguuuuacaguuuuuauuuuuuuaagacaggguauugcucugucauucaggcuggagugguauaaucauggcucacugugaccucgaccuccugacucaugggauccucccauuucagccuccccagaagcugggauuauaggcguggaccacucaccaugcccagcuaauucuuuuuuuuuuaauauuguuuuuuuguacagacggggcuucacuaugcugugugggcuggucucacacuucugggcuacaguguccuccagcuuuggccuccuagaguguuaggauuauagcuaugagacaucaugcccagccugcuucauaguuuuaccuuuuaccauuaggccuaugacccauccugagcugaucuuugugucuuguguauacacgucuguaaucccagcacuuugggagaccgaggcagguggaucaccugaggucaggaguuccagaccagccugaccaacauggugaaaccccaucucuacuaaaaauauaaaaauuagccaggcgugggugcacgccuguagucccagcuacucgggaggcugaggcaggaguaucacuugaacccaggacguggagguugcaguaaguggagaucaugagauugcacugcagccugggugacagggugagauuccgucucaaaacaaaacaaaacaacccaugagggccgggcgcgguggcucacaccuauaaucccagcacuuugggaagccgagguggguggaucacuugaggucaggaguuugagaccagccuggccaacauggagaaacccugucucuacuaaaacuaaaaaaauuagcugggugugguggcagccaccuguaauuccagcuacuuaggaggcagaggcuggacaauggcuugaacccgggagguggaggcugcagugagcugagaucacacuacugcacuccagccugggcaacagaacaagacuuugucucaaaacaaacaaacaaaaaacccaugaaaaaaugcccaacaucacuaaucaucagagaugcaaauuaaaaccacagugagauaccagucagaacuuacaccagucagaacugccuauuauuaaagaguuggcuggacaugguggcuuaccacugcaaucucagcacugaggcgggaggaucgcuugggcccaagaguucaagaccagccugggcaacauagugagaccucaucucuacaacaaauuuaaaaaaucagccagggaugguggcacaugcuuguagucccagcugcucaggaggcugaggcgggaggauuguuugagccuggggaggucaaggugagacugaccucaaaugccacugcacuucagccugggugacagagugagaaccugucucaaaaaaaaaaggaggggggaaaaaaaaaaggucaggugcaguggcucacagcuguaaucucagcacuuugggaaccaaggcaggaagaucacuugagccuaggaguuugagaccagccugggcaacauggcaagaccacaucuuuuuuuuuuuuuugagacagagucuugcucugucgcccaggcuggaguacaguggcacgaucucagcucacuacaaccuacgcuuccugggucaagugauucuccugccucagccuccugaguagcugggauuacaggcgcucgccaccaugcccagcuaauuuuuguaguuuuaacagaaaugggguuucaccauguuggccaggauggucucaaucccuugacguugugauccaccugccucagccucccaaagugcugggauuacaggugugagccagccaccgggcccggccaacccuaucucuuaaagaaaaaaaaaaaacaccaaccaaaaacauuaguuggguguaguggcucauguuuauacuccuagguacuccgaaagcugaugcaggaggaucgcuugagcucaggaauugaaggcuguagugagcuaugaucacuccacugcacuccagccuaggcaacagagugaaacccugucucuaaaagggaaacaaaaaagaaaaaaaaaaaaaagacuggugucauuguuagaacugcaucaaagggcugggugcaguggcucccagguauaaucucaggacuuugugaggcugaggugcaaggaaugcuugaggccaaaguuugagaccagucugggcaacacagugagaccucauugauacaaaaauauuaaaaaauuuugcagccauaaaaaggaaugaaaucauguccuuugcagcaacauggaugcaguugaaggccauuauucuaagcaaacuaaugcaggaacagcaaaccaaauacuacauguuuucauuuauaagugggagcuaaacauggguacucacguacauaaagauggcaacgccagguguggugguacacaucuguaaucccagcuacucgggaggcugagggaggggaauugcuucaacccaggaggcagaguuugcagugagcuaagauugcgccacugcacuccagccugggagacagggugaggcuccagcucaaaacacacacacacacacacacacacacacacacacaaagagcagggcgggcugaaaaacuauuagguacuauguguaguaccugggugaugugaucaaucauaccccaaccucagcaucaggcaauauacccaggugacaaaccugcacauguacccugugaaucuaaaauaaguuaaaauuauuuuuaaaaaacaaacaaauaaaaagcaacaacaaagccccaagaauuagcugggugugguguugcaagccuguggucccaguuacucagcaggcugaagcagaaagaucacuugagccuggaguuugaggcugcagugaguuacgauugugcaacugcacuccagccucggcaauagagugagacccugucucuacaaaaauaaaaauaauaaacaaagaauugugugaaaagaaaaccucggcugggcgugguggcucacaccuguaaucccaacacucugggaggcagaggcaagcagaucacaaggucaggaguucgagaccagccuggcuaacauggugaaacccuggcucuacuaagaauacaaaaauuauccaggcaugguggcacaugccuguagucccagcuacucaggaggcugaggcaggagaaucguuugaacccaggagguggagguugcagugaggcaagaucacgccaccacacuccagccugggugacaagagccaaacuccgucucaaaaaaaaaaaaaaaaacaggaaaugguauaaagguguuugaugugucuuuugaaggcuguguuaacagaaggauucuagcauuuguccagggccguagcucccgggcacucuggugcucucagcugcagggacucagggcacucgggcugcacgaggcaccacggugcgugaggagucccugcagcaaugcugacagaagguucucacgaguggggaaucguucaggaccuggugacugaggguccggaagacacgcaaugccugcgguccguuccguaguguccaccagcaacaacauggaugcugcaggcuucuccuccuuacagcuuuaagcacuaaagggaaauucucaaggagaccaaaaggucccacgcuuccggcgcuuccauaaaguuucugauucucuuaagacaaugauguucaaagugcuccuaggaugccuggagauuaguaucucugauguacagguuuauaaaauuuacagggcuguguaccuaagacguacggccuggacaacaugucugcuccaucaccggagccugccacgugccuggcagggaggccgagucucuacucguugcauugccgauggcaccugccaggaugcagcugggugcggaauccagggcaccaccggcaguggggagcugugcagagugggcugcucuccggccccagccacggggugccggggcaggggguggggguacucacugcacagcugcucgaugguggcccacugcucagaccucu

SEQ ID NO: 16950 - RNA, 7232 nt, Homo sapiens
agaggucugagcagugggccaccaucgagcagcugugcagugaguacccccacccccugccccggcaccccguggcuggggccggagagcagcccacucugcacagcuccccacugccgguggugcccuggauuccgcacccagcugcauccuggcaggugccaucggcaaugcaacgaguagagacucggccucccugccaggcacguggcaggcuccggugauggagcagacauguuguccaggccguacgucuuagguacacagcccuguaaauuuuauaaaccuguacaucagagauacuaaucuccaggcauccuaggagcacuuugaacaucauugucuuaagagaaucagaaacuuuauggaagcgccggaagcgugggaccuuuuggucuccuugagaauuucccuuuagugcuuaaagcuguaaggaggagaagccugcagcauccauguuguugcugguggacacuacggaacggaccgcaggcauugcgugucuuccggacccucagucaccagguccugaacgauuccccacucgugagaaccuucugucagcauugcugcagggacuccucacgcaccguggugccucgugcagcccgagugcccugagucccugcagcugagagcaccagagugcccgggagcuacggcccuggacaaaugcuagaauccuucuguuaacacagccuucaaaagacacaucaaacaccuuuauaccauuuccuguuuuuuuuuuuuuuuuugagacggaguuuggcucuugucacccaggcuggagugugguggcgugaucuugccucacugcaaccuccaccuccuggguucaaacgauucuccugccucagccuccugaguagcugggacuacaggcaugugccaccaugccuggauaauuuuuguauucuuaguagagccaggguuucaccauguuagccaggcuggucucgaacuccugaccuugugaucugcuugccucugccucccagaguguugggauuacaggugugagccaccacgcccagccgagguuuucuuuucacacaauucuuuguuuauuauuuuuauuuuuguagagacagggucucacucuauugccgaggcuggagugcaguugcacaaucguaacucacugcagccucaaacuccaggcucaagugaucuuucugcuucagccugcugaguaacugggaccacaggcuugcaacaccacacccagcuaauucuuggggcuuuguuguugcuuuuuauuuguuuguuuuuuaaaaauaauuuuaacuuauuuuagauucacaggguacaugugcagguuugucaccuggguauauugccugaugcugagguugggguaugauugaucacaucacccagguacuacacauaguaccuaauaguuuuucagcccgcccugcucuuuguguguguguguguguguguguguguguguguguuuugagcuggagccucacccugucucccaggcuggagugcaguggcgcaaucuuagcucacugcaaacucugccuccuggguugaagcaauuccccucccucagccucccgaguagcugggauuacagauguguaccaccacaccuggcguugccaucuuuauguacgugaguacccauguuuagcucccacuuauaaaugaaaacauguaguauuugguuugcuguuccugcauuaguuugcuuagaauaauggccuucaacugcauccauguugcugcaaaggacaugauuucauuccuuuuuauggcugcaaaauuuuuuaauauuuuuguaucaaugaggucucacuguguugcccagacuggucucaaacuuuggccucaagcauuccuugcaccucagccucacaaaguccugagauuauaccugggagccacugcacccagcccuuugaugcaguucuaacaaugacaccagucuuuuuuuuuuuuuucuuuuuuguuucccuuuuagagacaggguuucacucuguugccuaggcuggagugcaguggagugaucauagcucacuacagccuucaauuccugagcucaagcgauccuccugcaucagcuuucggaguaccuaggaguauaaacaugagccacuacacccaacuaauguuuuugguugguguuuuuuuuuuuucuuuaagagauaggguuggccgggcccgguggcuggcucacaccuguaaucccagcacuuugggaggcugaggcagguggaucacaacgucaagggauugagaccauccuggccaacauggugaaaccccauuucuguuaaaacuacaaaaauuagcugggcaugguggcgagcgccuguaaucccagcuacucaggaggcugaggcaggagaaucacuugacccaggaagcguagguuguagugagcugagaucgugccacuguacuccagccugggcgacagagcaagacucugucucaaaaaaaaaaaaaagauguggucuugccauguugcccaggcuggucucaaacuccuaggcucaagugaucuuccugccuugguucccaaagugcugagauuacagcugugagccacugcaccugaccuuuuuuuuuuccccccuccuuuuuuuuuugagacagguucucacucugucacccaggcugaagugcaguggcauuugaggucagucucaccuugaccuccccaggcucaaacaauccucccgccucagccuccugagcagcugggacuacaagcaugugccaccaucccuggcugauuuuuuaaauuuguuguagagaugaggucucacuauguugcccaggcuggucuugaacucuugggcccaagcgauccucccgccucagugcugagauugcagugguaagccaccauguccagccaacucuuuaauaauaggcaguucugacugguguaaguucugacugguaucucacugugguuuuaauuugcaucucugaugauuagugauguugggcauuuuuucauggguuuuuuguuuguuuguuuugagacaaagucuuguucuguugcccaggcuggagugcaguagugugaucucagcucacugcagccuccaccucccggguucaagccauuguccagccucugccuccuaaguagcuggaauuacagguggcugccaccacacccagcuaauuuuuuuaguuuuaguagagacaggguuucuccauguuggccaggcuggucucaaacuccugaccucaagugauccacccaccucggcuucccaaagugcugggauuauaggugugagccaccgcgcccggcccucauggguuguuuuguuuuguuuugagacggaaucucacccugucacccaggcugcagugcaaucucaugaucuccacuuacugcaaccuccacguccuggguucaagugauacuccugccucagccucccgaguagcugggacuacaggcgugcacccacgccuggcuaauuuuuauauuuuuaguagagaugggguuucaccauguuggucaggcuggucuggaacuccugaccucaggugauccaccugccucggucucccaaagugcugggauuacagacguguauacacaagacacaaagaucagcucaggaugggucauaggccuaaugguaaaagguaaaacuaugaagcaggcugggcaugaugucucauagcuauaauccuaacacucuaggaggccaaagcuggaggacacuguagcccagaagugugagaccagcccacacagcauagugaagccccgucuguacaaaaaaacaauauuaaaaaaaaaagaauuagcugggcauggugagugguccacgccuauaaucccagcuucuggggaggcugaaaugggaggaucccaugagucaggaggucgaggucacagugagccaugauuauaccacuccagccugaaugacagagcaauacccugucuuaaaaaaauaaaaacuguaaaacaguuauuaaguugaaucucuucagggccuugggguacgcaaagauucuuuuaggcaggaugcaggaccuugggguagaacacagaaaaacacuggcauaaaaauagguaaauugauaaauaaauuuaucuaaacaaaacacuugugcucaucacagggcacuguuagaaacaugaaaaggcaccaaugggggacgcaguauuagcaguacauacacacaacaugacuucuaucugaaacuuaaaaauaacucugccuguuguuaaucaaacagaaagcagaagaagaagcugggcggagggugaaacguuucacaaaaggaaaugcaggucgggcaugguagcucacgccuguaaucccagcacuuugggaggccgaggcgguggaucauuugaggucaggaguucgagacagccaggccaacauggugaaaacccaucucuacuaaaaauaaaaaaaauuagccaggugugguggcacgugccuguaauccuagcuacuugggaggcugagguaggagaaucgcuugaacccaggaggcagagguugcagcgagccgagauugcgccauugcacuccagccucggcaacaacaaaaaaaaggagaugcaggaacagucacuaucauuagucaucagggaaaugcaaauuaaaacaugagaagccguuacacauucaucaguguggcugaaaugaaaaaaacgcgacaaugucaagugugagugaagaugugaagcagcugggacucucguaccuugcgagugggaggcaaaaccgugccacccucgcgagaacugugucucagggucuuagaaaguucagcacacaauucauuacccugugggccggcagauucauuccuagguagguuuuuuguuguuguuguuuguuuguuuguuuguuuugagaucucggcuuacugcaaccucgguucacugcaaccuccgccucccagguucacgccauucuccuuccucagccuuccuaguagcugggauuacaggugcgcaccaccacccccagguaauuuuugcauuuuuaguagagacgggguuucaccauguuagccaggauggucuccaucucuugaauuugugaucugcccaccucagccucccaaagugcugggauuacaggcaugagccaccgcgcccggccuguuguuuguuuuugagauggagucucgcugugucgcccaggcuggagugaagaggcagggucucggcucacugcaggcuuccccucccggguucaugggauucuccuuccucagccuccugaguagccggaacggcaggugucuaccaccacgccuggcuaauuauuuuuaguagagaccggguuucgccauguuggccaggcuggucucaaacuccugacuucaagugauccacccgccucggccucccaaagugcugggauuacaggcgugacccacugcacccagccucacucuuuguuuuuauccaagagaaauaaaaacacagguccacaaagaaauuguagaagaaugauccuggcaacuuuguucauauuagcucaaaacuggaggcugggcaugguggcucauaccuauaaucccagcacuuugggaggccaagguggguggaucaccugaggucaggaguucgagaccagccuggccaacauggugaaacccuaguucuaccaaaaaauagauaaaauuagccaggcauugugguucaugccuguaaucccagcuacuugggaggcugaggcaggaaaaccgcuugaacccgggagguggagguugcagugagccgagaucgugccacugcacuccagccugggugacagagcaagacccuaccucagaaaaaaaaaaaaaaaaaaaaagcuggaaacaacccaaaugcacaucccccggggaguuacguuauucacaaggagaagcacccucugcaacaaaaaggaaccagcaagcacaggcucccuguuacucccuguggugcaggaggcauuuuucugagggcauuaagcacuucaaagugugccuguggugggagugcugugugggcaggaccagcacugggugggauguugggggcggggagcucucagcugccugccccugcccccaugcccacacucuggcagucucuggugggccagaaaugaugagugcucauuucucuuccacccugcaggcacaguuggcgggcagcucccaggucuccaugaguacggcgccgucgggggcuccacacacacggccacugcagccaugugggccugucagcacugcacguucaugaaccagccaggcacaggccacugcgagaugugcagccuccccaggaccuagggcgccugcccucugcuggcuaggaccgggcccagcccagcccuuccugaagccagaagcguugcugaguguguucccuguaacugccccauagugggcagcccuggaggaacaaggggcuggcuguccugggcucccugacccacugaagcuucucagcacguuccucccuggagagcgggcgccacggcugguauucugcaggcugaaugcagucuccagacuggaaacgcagagcggcuccucacgccuaauccuguugacaagucccccgccguguuggaaagaccucucgccucuacguggcaccuggaauuggggcgcacagggaggggccgaugcugccaccacccagccuucucuuuauuuucagugcuuuuuguuuggccucccugcccccauguuuuucuggcugggagcucuugguuacccccuugucugacugcuugguggcaggcacccugccugugagggccacuuuccucuucuaguagcuguugucugguggggacgcaguggcccuggacacggcuccccucugcaggucugcaggucgguuugcugccugcccuccuccucucacccgauguccaggugggauuuuaaagucugcauugguuauaauaacaguuaucaguaauuccugcccagaagacuuuuauuuauuuuuuuuuaagauaaaaacugcacaaaaggggagugagagagacuaguuuccacauccuucccuccuuuagugaagcccccgagguuguguccagggugaugaguguggacgggggcaccagucaguucucccuugaaguaaaccucagugccugagacuuuucuaccaagccacacagcugcagcaacugcagauacugcgggcugagcaggagcagugguggcgccugcccugaggcugcccugcgauggccugggugggagagcugggucaccggugc

SEQ ID NO: 16951 - RNA, 4848 nt, Homo sapiens
uagcaaggauggggcaagguggcaguggugcccgcacgcacugcccuggcacagguguguaguuagugaccugaagcaugagggcaucucccugcccaccccagcuggagauaagccccuugcggggcccacccugcugauaaaccccagagcaguauggccugugucagaaugaccaguaggagggccccgggguagcagcugcccagcccagcugcgugugugugugaaguauuuuccucaacaccuuauaccacagaaggcagauuuugaaacucgcaucaggccagaaaaagaauuucugaauggacacuucuaaggggugccugguuacucaucugccucuucccccugcaggguagaggggcauggguuugaaguucccgggggcucuuggagacugcagacacggacgagcugggguuccuggaugcugcagcaguuggggccccuggcugagcgcaccugccccaggaggcccugcgugguucccccaguagccccuucacaccacaccgcagugaggaugcccugucuccugccgaucccaucacaccaagccuuuucgcuguugggcuccuggcacugcccgauccuggagggcacuuggcugcggcuguggcugugaagggcuggugcucuaggcgccuccguggcccccguugccugggcaccuacuuccugccucagccacagcugcauccacgugcgccaggggccacaaggccgacccuggcuugggccuguuccucccuggguuuccuugggauccagucauuggagggcccgcgcacagcugggccaacucgacaccuccaagcccggccagggaaucaagcagcucucccucuggcagcaugagcuacacaagccaggcccgucuucccauucccuuagcaaggaggggcaaccccagccaaggccuucugcacuguucuagacuguugcugccuagggcuacuguagcugggagucacauuccuuucuccccagauaguugcaaggggcccagcagccacagcacuucaagggggcccugcccuuccccucccaccaccccaccaggguccccaucuuccccuuugucuccuaaagcccgugaggcaguagaggagccaggcccuccccugccacacccuggagaagccaagcagcagacacccccagcuccuucaggggcauuuauuucccggucagaaaagaagcagggacaggcgccucugccugagccuggcagacacaacacgaagaccggggauggggcgggggaggcacaggagacggcucucagcaaugugugcacuuggucccuuguuuguuccuggcugggucagggaaggccugccgggggugguggcacugagagccugggggaacaggcgccaggccaguggcccagggacggcacggacggaggcaauaaauacugauggccaggcggggcuccuggcugggcccagguggggugagugaggcuguccaucgagggcucuugggggggugugggcucugggcacugcccgcugagacagaaaaggcagaggcaggacaauacccagccuccuggaugguacugaggugacuugaguuuuggcaauuuggcuuuccccaagccgccggagccaucuccacagcccuguccagggaagggggcaggcuggccaggcacuggugggcuggggagcagcagcagcacaccccacgugucccugggucacuggguucgccaccggggaagggacggggaggccacaugcucaugcagacacagggaguuagaggcuagugaggccccacgguacacuccacauguuaaggcaucaugguuagacgggaccgacagcgacaagggggcuggccagggagcagcggggcuggaggacggcccggcccccacgaggccgugcaucccacaccccagcuccaccccggagcagcagacgcacacguccaggggcaaccacggggccuggagaauggcugcuccgcucccuccugaagccaggccucgggugugacggggagauagaaccuggggggcacagaaagggcagcagaggccuggcugcggccucucucccccacagcacaggcagaagcagcaacgagacaggagaccgaggaggcugggccugugggugggggagggcugaggaggggggucggaggcacucgguugagccaggccagggaggcggaccagggugggaggggcacggagggccugucagcacuuugguauggggaggggaggggcugggggggacacauccgccuguccgucguccguccgucagucugcccugcccgccucuggcugggcucaguccuuccaguccuucuugauggugagauuccacucccaggacagguggucggucuugucgucgucugugaagcgggacuugaugcuguagcugccccgggccagcauacccuugggugccuccuccacgggggucaggaacucguacuccucggcccggggcccauagcugccuaccauguagucagucuugucaacugcggcacaaggaagagggcggucagcggccccgcuuccccgccuggcagcacgcacccaagcggcccccucugcccugcccggggccccacucacucuugacgccuuuccuguacguaugcuggauguacuucaugccggacacuaucucucgguuaaccugcaggacccgaagcgaggaucagggaaggucgguccggaccccagccccagccccgccuccauucccuggccacagcagccuguagcuuacccggaaagagauuuuuauccgguacuccacacccuccuucagcacaaacgacugcuucuugaagcucuccaggucgccuguuggggggaccucccccucaaugacugcccagcagcccugcgcgaagccccagcccugcgcggcccccuggcugcacuucccgagauccccaccaggggccgcccggacccccgcggccgcagggcacucacccgucagguccagcuccagggggcccggggccgagcugcacaccagggucaggccagucaccacgacguuggggacguuggggucuggggagugacagcaggugagggccccacccccaccaguggaaguaggggcuggggagcggcaagacagcuggagugaacgggcggccacccggcucccgcagcccagacucaccugcggaaacggccacgcggcccagcagggccuccuuguacuuucgcaggcucucgucguccuuguccagcuccuggaucuccuggaugcucuucugggccgggggcuuguaguugaccgagugcucauccuccucguucuccgcugcaaucugggccagcugcucggcugugggcuccugcucagccaugcucaagcuuagccugggucgggacaccugugggcgggacggugacaggccuuggaccuggauccccaacggaggcgcacuucugagcaggagugugggcugcagccggagcuccaaaagggcuccaagggggccaccuucgcuccucuccacccccgcgauuccugcucaggggcauccucuggggcagugugaggugcccccaccccagguauaacaucuaagacaaaaugggaacugcagccgaucauggggagagaggacacaccucccccuccacgauggaggaggcagcagcccccuguauguguggggcggggcuagcaggccccagaaucaaccggcggggcccacacuaaacccucucuuagggucuugccgcucuugagcugcccaggcccucgcccuacgggguaacggggcucgguaucccucaguaggguugcuccucuggccgugguagucacauguaaacguguguggucggcucagcgucaucuuucaaacaggaugccccuggagcucggauguuaggggcagcuagaauaccgcacggggccaccuggacacggggauccuaaguaucugcgguuucuccacaauugugagggucugugaccuacaacuugggagcuaccacagccacucaguacucucgggcccucuuguagauggugggcccggagugcccggggcagcacugacccggcaggggaucugucaggcucagauccuucccggcagcgugggaggugggucagggagcagcacacccgggacacccaggccgggguccaggccgcccugcuuccuccaggggcuggggccuccgcgccgcgcgaggauagccguaggcgccgggauccuagggcgcggcccgcacuuccgcagggcccgcaauccgugccgggcguggcccgggcgcugggggaggccgcgccccaauccccgcgucgcccccgaacgcgauggaccgcggcugccggcccggcgccccccgcguccccaaggaggggcccucaggucuggcccgggccccacgcgccucggcggccaugaaagaagcuccggaccgcucgggaggggccggcacuccccugguccccgccgccccuccggcccgggacccgcacguggggccggggccgccgccgcccggucccgccccggccccgcccuagcccgcaccgcccuggcccgcugucaccgcgcccccgcccgccgagacccugccgcgggcucagggcggggcgcgaacaaaggcggaagcccccaccucagcgccccccgcccccgccggcgccgccgguccccgccccgacccgccgccuccgccccgccgccuccgccccgccacggccacucaccggaggguucggccgcgcgguucaggaucccucccgcacuaaaugacgaacgucgucggccgccccgcccgcccugccugucacuuccggggucacgagacuu

SEQ ID NO: 16952 - RNA, 3365 nt, Homo sapiens
agccaucuccacagcccuguccagggaagggggcaggcuggccaggcacuggugggcuggggagcagcagcagcacaccccacgugucccugggucacuggguucgccaccggggaagggacggggaggccacaugcucaugcagacacagggaguuagaggcuagugaggccccacgguacacuccacauguuaaggcaucaugguuagacgggaccgacagcgacaagggggcuggccagggagcagcggggcuggaggacggcccggcccccacgaggccgugcaucccacaccccagcuccaccccggagcagcagacgcacacguccaggggcaaccacggggccuggagaauggcugcuccgcucccuccugaagccaggccucgggugugacggggagauagaaccuggggggcacagaaagggcagcagaggccuggcugcggccucucucccccacagcacaggcagaagcagcaacgagacaggagaccgaggaggcugggccugugggugggggagggcugaggaggggggucggaggcacucgguugagccaggccagggaggcggaccagggugggaggggcacggagggccugucagcacuuugguauggggaggggaggggcugggggggacacauccgccuguccgucguccguccgucagucugcccugcccgccucuggcugggcucaguccuuccaguccuucuugauggugagauuccacucccaggacagguggucggucuugucgucgucugugaagcgggacuugaugcuguagcugccccgggccagcauacccuugggugccuccuccacgggggucaggaacucguacuccucggcccggggcccauagcugccuaccauguagucagucuugucaacugcggcacaaggaagagggcggucagcggccccgcuuccccgccuggcagcacgcacccaagcggcccccucugcccugcccggggccccacucacucuugacgccuuuccuguacguaugcuggauguacuucaugccggacacuaucucucgguuaaccugcaggacccgaagcgaggaucagggaaggucgguccggaccccagccccagccccgccuccauucccuggccacagcagccuguagcuuacccggaaagagauuuuuauccgguacuccacacccuccuucagcacaaacgacugcuucuugaagcucuccaggucgccuguuggggggaccucccccucaaugacugcccagcagcccugcgcgaagccccagcccugcgcggcccccuggcugcacuucccgagauccccaccaggggccgcccggacccccgcggccgcagggcacucacccgucagguccagcuccagggggcccggggccgagcugcacaccagggucaggccagucaccacgacguuggggacguuggggucuggggagugacagcaggugagggccccacccccaccaguggaaguaggggcuggggagcggcaagacagcuggagugaacgggcggccacccggcucccgcagcccagacucaccugcggaaacggccacgcggcccagcagggccuccuuguacuuucgcaggcucucgucguccuuguccagcuccuggaucuccuggaugcucuucugggccgggggcuuguaguugaccgagugcucauccuccucguucuccgcugcaaucugggccagcugcucggcugugggcuccugcucagccaugcucaagcuuagccugggucgggacaccugugggcgggacggugacaggccuuggaccuggauccccaacggaggcgcacuucugagcaggagugugggcugcagccggagcuccaaaagggcuccaagggggccaccuucgcuccucuccacccccgcgauuccugcucaggggcauccucuggggcagugugaggugcccccaccccagguauaacaucuaagacaaaaugggaacugcagccgaucauggggagagaggacacaccucccccuccacgauggaggaggcagcagcccccuguauguguggggcggggcuagcaggccccagaaucaaccggcggggcccacacuaaacccucucuuagggucuugccgcucuugagcugcccaggcccucgcccuacgggguaacggggcucgguaucccucaguaggguugcuccucuggccgugguagucacauguaaacguguguggucggcucagcgucaucuuucaaacaggaugccccuggagcucggauguuaggggcagcuagaauaccgcacggggccaccuggacacggggauccuaaguaucugcgguuucuccacaauugugagggucugugaccuacaacuugggagcuaccacagccacucaguacucucgggcccucuuguagauggugggcccggagugcccggggcagcacugacccggcaggggaucugucaggcucagauccuucccggcagcgugggaggugggucagggagcagcacacccgggacacccaggccgggguccaggccgcccugcuuccuccaggggcuggggccuccgcgccgcgcgaggauagccguaggcgccgggauccuagggcgcggcccgcacuuccgcagggcccgcaauccgugccgggcguggcccgggcgcugggggaggccgcgccccaauccccgcgucgcccccgaacgcgauggaccgcggcugccggcccggcgccccccgcguccccaaggaggggcccucaggucuggcccgggccccacgcgccucggcggccaugaaagaagcuccggaccgcucgggaggggccggcacuccccugguccccgccgccccuccggcccgggacccgcacguggggccggggccgccgccgcccggucccgccccggccccgcccuagcccgcaccgcccuggcccgcugucaccgcgcccccgcccgccgagacccugccgcgggcucagggcggggcgcgaacaaaggcggaagcccccaccucagcgccccccgcccccgccggcgccgccgguccccgccccgacccgccgccuccgccccgccgccuccgccccgccacggccacucaccggaggguucggccgcgcgguucaggaucccucccgcacuaaaugacgaacgucgucggccgccccgcccgcccugccugucacuuccggggucacgagacuuccgcucacucgggcggggaaggccagggcgcaugcgcggcgcgcggguggccgggggcacgccgucgccaucuugcggcugggccucgugggcgcguuccgcguggguucuggcgucgucaccuuccaccccaagcc

SEQ ID NO: 16953 - RNA, 3194 nt, Homo sapiens
cccuguuucugccugggacaccaguccgugucuggguacagaagacaauggauagacuuaaaccuggggaaggaagaaguaggggucagggccgugggcggagagagaagcgggggccagggccgugggcggcgggagaaccuggggucagggccguggguacagggagaagccggggucagggccgugggcggagggagcagcgggggucagggccguggguagagggagcugaugccagagccccugcggggccgagggccugcccaugccacuaccuacucaccguguggggucuugaugcaggcugaagccuccagccacguucaccacguuauguggguucucaggacccccauggcucaagguaaccugggagggaagggugugggcagaguguguggccuggucuggucucgggccacgccugccccuggccaggagcccugcuagagccccuuugcccacccccucuccccaggcccucggggaggccaggcuuggaaacagcauugaagcauggcaugagcugaguagggggacaccucaggcagagccugggggacagaagauagggaucugaaaccuccagggcaaagcugacccucauucccucccugcuccacgugaugggaccuguuccgacucaccaucaccauacacaccacacccacugcccagcuggcauggggccucacuggcccgagaacugugcuucuccccucguuccucugccccagacaccauaccccaucuguacgugaggacccuguguccaacaggccaaggggccuguccaggguccacccccagccacaugcaaaucccaccugccugcucagccgggcaucgggccggggcaguggggccccugggggagucagggcggggcaaagcccagguggcagaggcacccagaguggcgccuguaccugcuggagcagggugucgggcggcagccucugcagguucuccaggugagaguggaagagggggcugugcagcaggcgggcgcccaggagccccuccacgauguagccaacugugcagucauccggcagccgcaccugcucagcugugcucaugaagcugcccaggcuggggggaggccggucagcaccuuucaggucucagccuccgccucccagcccgggcagcuggacccccacucaccuggcccaugggcucaucuugagggcaaggccucugcugaggcagaacccggccccaccaguagcaaaccagaacuugaccguggucaccugaagauggggugguggucagagcugcccaggacagggcuucucaccccugacucuucaugggacuccccaggcaucuuucuuaagcugccccuuaggagaucccacccagguaacagaagcuucuuggagcaaaaagagccgggggcuucugcaggccauugacccguagccuccagacccuccccaccuggcccagacacccccucucugcccaguacggugagggccuccuggccugcuccugaaacaccacaugcaaaccaccuggguggaucagcuugggcccccaacccuaugcccuucucaagccagcuuuccacgcccucugcugugccucccgggcuggugucaaggaaggcgucugcuccgauggcgucugcuccgacacucacaguucugccacccuggacccucucgguggccucaauggggugguccaggcugggccgccccagguagacguccuggcugggugagaagcuggagagcaggugcaggaggcuccuggcguucacauaauugucaucauccacguggcaaaaccaccugugggcgaggggaguccugggcacgagggccuggcauggcuggacaggaggcccccacccagcuuggcucugagcucucugcgggucgggucagcgccgcguacuugcgcccggacucaaugaacuugucauacuccacggacaucuugcagcagagggccugacgagugcgcaccgccgagcaguugguguugaugacacggucgccugcgaaucagagacgggaagcacgcacguagaggauggcacugggguugggguaaggccugugccccaccugcccccaagggccagggcacaacguggcugucugacaugccuggacaccuugccuggguccaaccacagcccuagcccucacgcgcugacccugcuggugccaccgaggcugaagcaggcggccaucgguugggaucucuugaguggaaacaggacggaggcagcucgcccugaccuggccuggaagggcggauucccugcuggcgcuucuucaggggacguggcacuagccccacgccccgggaagcggcuagugugagaggcugguggggagcagagcuuggcuggcagggugggcccuccgcaggccgcgugaccugggcagcgucggggccuccccgggccucgggagccugggcagagaaaggcacccacagcagcgaaggggccguggcuucggagcgagaaaggcucggggggcagaucccgcgggcgccggggagugggggacacucaccgcccuggagcucgagcucagggucguccccgucggugaagauaaacgucugggggagaaacaaucuaugaggcuucuggggcgcugcccaggccggagaccgacccgccccgcgcggagccuccgggggccugggccgggccuagacccugggaggcggggcgggugggcguggggcucgccgucggggucgggguccggcgcaccugcuggcgggcccgggagauccaggugcgcagcagcagccgcaggcgcggcccgugguucuuccggguggucuugacggcgaugaagacgucgucaggccgcaggcugggggcagcgggccgggacgggggcgcgcgcggggccggggcggggguccgggccggggcgggcgcgcggggcagcggcagcggcaguaacagcagcgcggccagggccgcggccagcgcgaggcaggcccggcacagcgccccacgcgcgcggcucaugcggccgccgggacccccggcgcugcgagcggagaaccuggccggagccgugggugggcggcggccccuuuaagaacgcagcggccccgccccgccccgcgccccggaagcgacggcuucgcugccccggaaguggacggcacgccgcggcggggugggugcaagaugccgc

SEQ ID NO: 16954 - RNA, 6370 nt, Homo sapiens
ccaggucacggauugcuuuuuaaaaccaaauuggagaagucucuggccuggaaagaggcccagccugagcugcaggagccucagccagcagcaccuggaacaccagguggcuucuccgaagucaugggcagugcccuggccugaaggcccacaacccccacccccaggacugcugcuggagccuggacacguccuacuuaagaaaaugccuuuuacucagggaaucuccugcuacuuaauguggaaagacacgcccaugucccccuucggcccacucugggggccuggaaaugcugcaguggggagcaggccccaggcuggaccugcccuguccucagcacgcgugugcaaaagugaacaauaaaucauuucaaagaugcgagagcccacagccugugaccacugcccucucagacccagggaggcaugagccggggcaggugcgguuggggccagugggggcuucugaacaacaggauacaucuaaaugaaggcagcaucuggguagacaaaagugggggcuuagguccccuccccaccuccccuaggcgccuccauaggcaaguggccaaagccuccgggagcuucgugaugccucacagccuuggaagcaccgccugcgaggccacaguggcugcugcugggggcuguugaaucugagggccaggcuucucauuucucucaccaggcccugccuccaagccuagucccagggagacagcccucaggaacccaaggccacccaggggugaccagagccugcacggcaggaaagaacagccaagagcaacgcugagucugcucuuuaauggacaccgcccacuugucugcaccugacugaggcgggaacaggaggggucugggaaauggugccacugggccugggugccgcacagucugcucccuggggacagaaacccacagggucgagcccugcaggccucuccuuccaggaagggccacaacuagcagccgccugccuccucagccccagggagggcacacaggcuggguggcacccaguggccaggccccuuagcugggccgcaggcagcacugagccgccuggagguccgagguccguggagguggggagggggugcagauguccuggaggccaagguucaccccucacauguuggugcucauccgggacuggcuguuggcuggagucagcucccccuggcucccuucucugggcggggacugcaggggagacaaggagcagcucacagccaccaggccccacacgccgugcgccugcccccccucaagccagcccaccuugacauggaucugguugcggagcacagcugcccgcagcaucauggccuuggcgcggcgcuggaacuccuugcccaucaacagagacuucucaaagguggugcugcgcugauccacgucccgggcguauaggaucugugcaggcacaagcucagcggggcccaggcucacccccagcugcccccaccgccccgcagcccacagccaccuugcugugugaguccacacgggcacugaucagccccuccaggauuagcugcgucagcucguccuccagggcggccaccgugguauugaaggcugccgccauccuaugcaugucggcugacacguaggggcugaaauacugcagggcagagggaagucagcuccacagcccccugcaugcccgccugccgugugccagccugacccccacgcuuaccuggaugagggcacgguugcgaaucuggguguacaggguccugacauggggggccagauacauguccaggagcagguuguccuggggaaggggcuggucaggaccaggacaggaggccaggcagggccccaccucaccccuaccccaggcggggcccaccuucaucucguccagcaucuugagacaugaggcguacuuggacucguagaauuugaagaugaugucucggaccuguggcuccagcuccaagaacaacuugaaggagcuggugaggcagaccccucagaacucuguccucugccugccccucccuccaaguggccagugggacaccaguccccagacaaacaccugagaaaacgcuggggccagggggccaggacaugcaaggccgaagcagcagccacggagagggacggggacagccuucagggcugcaggaccggggcaccuaccugcuggagaugacauugcgcugcagcuccugccggucaaagguagccaaggcgcacaggccaccguagauggccacguugcugggggacagcagcugaggagcagagaccuggcgucacaggcagugaagggccaggccaccccugccugcccaucacccgcucggagaaugccuaagaccccauuugugagagaccucacccuccuacagaagcagccugacccaugagcccaugcucugccucccaaguccccagagggcuccucaccucagggaagucacagugaucaaaggaagccagcaggaggcacuuggcagccugcuuguacuuccuggcggccagcucugccaagccuaguggaaggagccgggggcggggaggggggagaggggguaagaccccagagccuggggaagccgcuaacgccuggaaaccagggagaacgcgaccaccagccggcucgcuggccucuccugccccgggagcuguuccucagcgcuggggacagauacucuagucacggguggaaagagccccaccaaugcugaggaggcucccugaagccaggcaugcagggaagcccuaggugcuagcagggcugcaaaggacaccccaguucagagcagcucgggcuggcagaccugccucacgcccacagugacagcagccagacccugaccacacgucacccacuggcuuccccggggcagacuuuaggcaccaccuacaccuguacaugugcccacaacauccugcgcccugccagggaaguuuucccuggcugaggcagggaccagccuacugcccugggcugggaggacuuagcaacaggggaacguggggucagcugggcgugacccaggcccucaccugcggcacacuugagcuuggugaggauggccugggucuggcugucacgcucuccucgcugcuguaggaggaagccacaugcgugaggcccaugcuccacauuuccuagagcucgaugcccagcccccagacugagaggggaugaaggcagauucagaucugggggagaaugaggugggggaggacaggaggggccagcaguggucaggaauccugggggcaaggucucugaggagguggcccguaccucggcaaucucugggguggacucagccuugcugacguagcugagcacaugagaccaauucugcaaguagacgcugaccuggcgggggggcgcagagccaagugagcccgggcgccccaauggcccagccaugcugcccacccccgcccgccgaggcaggccgaccuugaugacauugaggcacauguugaugacguguuuggcgcuggugcaguagucccgggcccgggaauagcacuugagggcguugcugagguccccacaguccagguaguggucgcccaggucgucguggccgcgccggaugcucucuuugauggaguugcccuuguaguucuucaggucuguguccagcuucuccagcuucagcagcgccuucuuccgcguggccuccacccaggccguguccagggcugggggcuccacgccgcucucagggauggcgucgggugcguucugcagcucccugagagaggaccuggccaucaggauggcggcggucacgggggccagggaggaggggaggaagccgccaaucucaggcugcccucaaaggcccaaccggcacacaggugggcaccucccgcuggccucaaaccccaccucuagggaccagucugcaccagggccacagagagaacugcugccccaggagccuacagccggguggggaaaccagcagggaggcggccccugagccacagucuccaacagcuccccuuggaaucaaagcccugcaugcacacacacagaagccacacacacacagggcacuuccacugcuggccaaaagagagcgagagcucuacccgcccgacuucccagcacaggggugggagaugcagggcacaggaagggggcccagucccagacacccgcgcucccuugguggccucugcuuccucucgccaagccccuggccucaccugguggccucugagagcuugcgguggaucuccucguacauguccacguuaaagguucucugcacgaaggagagggccaucuucagggccuccacccgcagcguggggcagugaucagcaaugaacugcagccguucgaugcgcaucaggccgcuguagcuggccgcguacuguuccagauccugggagcaggcacagacaagagucaggcaggaugggaggcaggacccuggccccaggcccugagggucaggaguuggggccugacuguccuagccagaaugucgcccugggcccauaaccagaaccgggcauggggguacgagacugacugcugucccaggagcuacgaagaccgcuggggugggccuggcgcaggagccucaggagugggacccugcacccgggggcuuucggggauagacacccacuagugacugcuggucgcuaggcugagcggggaggagaccugcccuggcuucuccaugagcagcaucugaagcugagcuacaagccucaugugagugcgcaaucagaaacgcugaugguuucggggucagaaaaagacgacagcgaucacugaggaggaucauucuaccugcugugcaggcugcagcggggagugugcccuggaccccucagcaggacugagacacccaagguccccccacugggcuccguaccaggcugggguucuccaccacguaguugacgucaggugcauucugcgggucuuccuggggguccacgucgaucugcaugggcuccacggcccccugcaacaugggccaggcaccuggcaccucguccuggggacugccccaggagggcgagagacccgcacuguucucugaggucagcucugcccaagaucuuccaggccagucggaccacacucccgccgcugcugucccccaggugugcccucccagucacccccgcccccacccaggcuccugugccaccacaucagggaggggucuccucacaagacucuaaggcucagaagcagaaaccccucgccugauucuagccgcucaucucugaaagccagaaagcagacaggggacaaccaacuacacaggggccucugagggccccuacacguucccagccaccauccugauguaguuuccuccaagccacggagaagaacgggacgccaccucaaccccaggaggcaggaggaccagcccccggaaucuguccugagcagcggagcagcaauacugggcugagagucacgccacggaguugggagaaggggaaaagagucaucucagggagccucauggcccccagcugggagacacagagaagccaggaccucggcuuaacacaaagcaggcuggaaaagccgccaugccgggcacucgccggacccgugggccucccgcgcuccuucgggaaaagcaccaagagcucggcucccuccgcaggccccgggcccaccggggcucccuccccuccugcgcuuggcacugagucccuguccucggccagcagagcagcaggggcccagccacagcaggggcggccggggcccugcuccccccucccucgcucgggggucccuguccuggaagguaccucguagagcagcguacaggccgacaggcuggcgcucaggcugaaguccccggccgugccgggcaggacgaggucugaccuacugcugugaggggugcaguacagaucugucacugacgaggaggccgagcugggggccgagcuaucccucauucuguccugacuuucugcaccccccgacccugacacagagcuggcuggcugcugaagggagaaagagcguuagcgucggggcggccgggaaccucucccgugagcugcugggaggggaggcggggcgggcgcggcccggcggcccccgaucgcagcgcgcagccacggcggagacgcgcccucggcccugcagcccccgacgcgcgcugcccgcggaggcccggcacggagcgugcccgaccgacuccuggcgcaggccccgcgccccugcucgaccucagcccggccccaguggcggggggcgcgggggcgcggaggcccggggcggccucggcucguuaccugcaaguuaaacaccugaaccggcagcggcaucuugcacccaccccgccgcggcgugccguccacuuccggggca

SEQ ID NO: 16955 - RNA, 10068 nt, Homo sapiens
cgggcaccuuccgguggcggcgcggagccuugggcccggcugcggcccggcggcggccccggcgcggugcgggcguucgcggcgccccgggagcugcaggggccccgggcggcggcgaggccggagaggggcgggcccgggacaccggcacccggcgcccucggagccaaaggcgcgcggcggacacggcggggcccucgcgcggugaggacgcggaggcgugugggcuccugucacuucacacagcaaacgcugcccgccgcguggcuccggaggagucucgcgaggggcgccccuguggcguuucgggccagccgggccgccuggccgggugcggagaaggaagcucugcccuuccccuggcccggcgcggagccgauucucccgggaaggggccggggguccuaacuucaccgccgggcggccugcucagggccaggcccgcggggacgcuggcgucaagguuucuucccccuucacgccaguccccuaccaggccgacaucgagucccgcuccccagggagggucaagucccagggguccagcggcucccccgagguccgcuaggagguggcggcacuggaguggccguucuccagccugcaccgacccccgccuuuagugcccccgcgugugacccaacggugguacuggagcggccuuagaagggugaccgcugccucugaguugagucuuaagccccucguugggccuggcugaaccccgggucugcgccuuucccccagccuggagacgaugccaaagcugcagggcuucgaguucuggagccgcacccugcgaggggcccgccacgucguggcccccaugguggaccagagcgagcuggccuggaggcugcugagccggcgccacggggcacagcucugcuacacgcccaugcugcaugcccaggucuuuguccgcgacgccaacuaccggaaggagaaccuguacugcgaggugugccccgaggaccggccccucaucgugcaggugcgcaggaggggcuguggccgcggccgcgguuggguucccgguccuggaaugccuggggaaaaacccuucucucuguggcgggacaucacuuucagccuuuccagagacagcucaauuccaggaggagagggagaagguggcaccaggcauguagaguccacguagccacagcagugauuccugugguggagccagggcugccaggugcaccugccagaauccaaccccauucucuaggaguggcucaggcagccugggugcugugagguuugcagcccugcuggggccucuggauugcugccucucacacucacacucccucuucagaaccaguggagauggcucugcucuucagaagucagugauuguggcuucugccacaguucagaagaaaaucuguaaauccggguggcuuggggacuccucccggcuuugucauauuguaagccuccgcaggacagagcacccuccugcagugaaccugggcccacacccucauggggucacacuggaccucucguagggcugggcagcaagggacuagggccuggcugggcccguggcugacuccugcaucuucuccaguucugugccaaugacccggagguguuuguucaggcggcucuccuggcucaggauuacugugacgccauugaccugaacuugggcugcccacagaugauagccaagagaggugagcuccauguggagcaugggggcaccuggggcaggggccagagccagcucagugcagccccagguguggugagcuuggaggacggcaggcccugccucugucgugacaguggcucaggcuggagccagcuguccucugugcuccgccucuggaggguggcuguccucaggccuugggggcuaggggccgagcccuacuggcucucucuucccucagggagcucccucugcauaaacaugauugcugauacaggguccccauuacccccuugcacugcuguguguggggcugagccugcuaccucaccgggccccugaggagguguuacuugguuccagaccgugcaggguggggguuccauucagcaccuucugagcuuaggcagcugggcaaauagagccccugagucugaugccgacaaaccacugcucugacugucccacugccccaacuggagacacugcugguucuggggaccugugucccgccugacagggcagcuccuggccugcguggaugcaggaaagggugcagagggggugcaaggcuucggccccaccagccuuaacacaggugccagccaggccaugcuugcuccuugcaggucacuauggcgccuuucugcaggacgagugggaccugcuccaaagaaugagugaguuggcuggguggauggugaaggacccccagagacccucaagagggacacaugggcacuguccacuugguuggggcucaggagaggacaggcguuggcaggaguucucagcaucacccuggggcuuccugcccacagcagccucucugcuggaaggagguggcugugaaguugccuguccugcaccacccaccccuuaaaaccagacaguaggugccagggcagaguccuugcucgggcccagccccagauguccugggagacagagccggccuuggcccugcuuguuugaacuucggagggccggggguauggcggagggagccugcccagcaaccugagggagacacccagaugguggcccgggcugccucccagccucccggcaaagcugccugggcuccgcugucugcagggcccugggcucuggggcuuggccgcuaaagugggaacaccauggcccccucagaagcugccucucuucuccccaguuuugcuggcccacgagaaacucucuguuccugucacgugcaaaauccgugucuucccggagauugacaagaccgugagguacgcccagaugcuggagaaggccggcugccaggugagcccugggcucgcgggggugucaugggccucagcugggccuuugcgcagaggacauagcugaggcucuuccuguguccagacaccgugcaccgucggccucaugggggcaguggcccuccugacuggccuguccccacuggcucugagugccaccaccccaagcccaggccucuacaacagaaacugcuuuccuggcuccaggguuuugucccuguggagagaguaaugucggcaucucugacauauuccuagugucacagaggccggcagggccuccuuuggggauacucagcauccagucucccuagagggugaggaaggggccaccaggcugucagcagagcugcuccccugcccguguuccccgcacacugagccuggccuggcgcgggccuggaugggcugcugucuccgggggugccccucaagacacucaccuucugaagguggacagcaaccuuggugacccggggaugagcuugcacaggggcugccaggcccaggacccacuuucccccccagugccccacuagccuggagucagucccucccacaccuuuggccuugggcaguggggaugcugccacuucccggccuggcucuugcaugggccugggcagcacaugcagccugagguucccacagagugcagaggccuugggguaggccccagauggccauuccucagcccugcuucaggagcugauauggugagggaaaggucccugcagucgggcauggggcacagggcugggaggggcagagggggcucggagggguggaguaggggcagagggggcguggaggggcggagggggcucugaggggcggaaggggcuuggaggggucaagcgaccacugcucuguccuaguugcugacggugcacggacgcaccaaggagcagaaggggccccugucgggugcagcguccugggagcauaucaaggcugugcggugagugggugugggugacacagcccucaguccuuggggcuuugcugggggucccagcuccacaccucagggugcucggcacgccugacgcccgugaccacccagggggccguggcugggggcagcaucaccugggugcuguuccgggcggguggaaacaggcauuucucugccaacaggaaggcuguggccaucccuguguuugcuaacgggaacauccagugccugcaggacguggagcgcugccuccgggacacgggugugcagggcgucaugagcgcaggugggcagggcccaggacagcagccagggccccaugcacacggccugauaccaccgcccaggucggugccucccacugccuacugcccuccccauggugcuguucacagaugguguucaucaaucccagucugcucugaugggccugagcuggccuugucccuugugagguggcacagaaggguguccugagugucccaggcuuuccugugccguccaccuggagcaacccacgagguguccuuccccgcuccuccucccacagagggcaaccugcacaaccccgcccuguucgagggccggagcccugccgugugggagcuggccgaggaguaucuggacaucgugcgggagcaccccugcccccuguccuacguccgggcccaccucuucaagcuguggcaccacacgugaguugcccccuaaggcagaagccacguuggagggccgcccaggcagauuccgucagaccccaccuggggcauuuugcagguuuugucaaaacaacuugcugcuaagucaggucuugaggggcuggggugacuuaggaguggaguugggcaggaagagacacagguccccgugugcccagugcucagccuggggccugacgguggagccgggagcccagccugcgugacagggccucugucucaggcugcaggugcaccaggagcugcgagaggagcuggccaaggugaagacccuggagggcaucgcugcugugagccaggagcugaagcugcggugucaggcaggugcuggggcuggugggagcccggccuugcagggggugaggggcuggggccaugaccagggccuugggcuuuugcaggaggagauauccaggcaggagggagcgaagcccaccggcgacuugcccuuccacuggaucugccagcccuacauccggccggggugagagcccagccagcccugggcggggaugugcaccaaggugugggcuccacccugugcccacagugcugcgccugcccugcuuguccucagccauuauggucagucaucuccugcccaagggaaaggaggagggaggccucggcuccgagcagcacacaccuuccacgugccccucgguguccuugguggaggaugcugguggcucagcuguguccucccucaguggacgcucggauuuuaaaucuuuucuuccauaacauacuucucugagcuccucugauccugguggauuugcccgugggucaagagguugaccccagcuucugcuggguucucagaggugaggccauccguggccacagcccucccuggagcuggugguucagagcuuggggcugcccgagcugcggacuccaucucagaggccccggacucccuagugacgaguccugaaugggcugcccgagggaaaggagggcacuccucacagcagcggcacucgccacggccgccuggccccucacccagacucagacccguguggcuguggcugcugggccccucucacaguguccuugggcucugcccgcugcccuccccucaggcccagggaggggagcaaggagaaggcaggugcgcgcagcaagcgggcccuggaggaagaggaggguggcacggagguccuguccaagaacaagcaaaagaagcagcugaggaacccccacaagaccuucgaccccucucugaagcguaagugcugcuuccgcugaugggcccgagagagccucuucaucacccccauccucccuguugccaguaacaggaacccagacuuguggucagcaaggcucaaggcccagagcuggaagcagacaccuggagggcuuggcggaguagucagccagacuuggggucagaacggggacccugugcaggccacagcccgugcaugugggacaugggcucagugaaucagaugaggcuaugggacaagcuuuucagccaggugaagcucgucuacagcucagggccucgggucccugcggcugccccugcccagccucacacaggacaccugagcagcugcugagagggaggcugggguccccgggagugugugcaugggucuuguugcugggccaaaggcacgggacgaggcugcucgccccucucuuagccaccaguggcaaggccucagccuagugcugucuccccugagaccccuggucgccgccguauccugggccagcccaucugggcccucaacagguggcagccucccagaucucugacaacuuuacaagcugcaggggagaccagcgauaacccugaaaccuucccauguaacccccagggcgcuggccaguccaagagcagcugccacaucaggcuggugccagcagucccugccugccacacugccccccaccaggccacugaaugaggcagcugggagaggcaggaaguggggcuucaggcugaauucuugauuugacccuucuuggcccuuuugcuugggagaccuggaacugaagggcauggaaccccccuuggacccugugggcaggaaaacugcuccccuugucccugccuggggguaggacagauaaggcugcucguccugcggcggccccccagcccaccugcuuccuauccguuuccugcaggauggugcccccugcauccccucacccauugcucacggaaggaaaagcagacguggccagccugcauccucugcccucccugagccuccuggccuggcuggccacagcuggcauggacgccaucagcaggcuccgugcaggcggacggggcagcccccacagccagggcacccuggcccucacucaccagcacccuuuuguucuuuuccuagcaaaauaugcaaagugugaccaguguggaaacccaaaggugaguggguuccggcugcaagccaccaaggcuucagcuuugggggugggcaggguggucucugcacugcuugggguggcaggucuggugcccgcccagcuggguuugcaacguggcucaagguggcauggaugccucaggacggccccuugcuuccagccaagccccugcccaggccuggaggggaagagagucugggugggugggggugagggagaggcaucuggcuugggagcaguucccagggcugcauccaggccgugggcaucuggcagaggcuuccccaguggggcugcuccccugcuggccagccuggccccgggaguggugcuggccacaggcucccgagauuuccugugcccagggcaacagauguguguucagccugugccgcggcugcugcaagaagcgagccuccaaagagacugcagacugcccaggugagggcgccuaccacccgccccgcagcaggcaaacagacccccuccgccuccugacccccgacuccucucacucgcucugccaggucacggauugcuuuuuaaaaccaaauuggagaagucucuggccuggaaagaggcccagccugagcugcaggagccucagccagcagcaccuggaacaccagguggcuucuccgaagucaugggcagugcccuggccugaaggcccacaacccccacccccaggacugcugcuggagccuggacacguccuacuuaagaaaaugccuuuuacucagggaaucuccugcuacuuaauguggaaagacacgcccaugucccccuucggcccacucugggggccuggaaaugcugcaguggggagcaggccccaggcuggaccugcccuguccucagcacgcgugugcaaaagugaacaauaaaucauuucaaagaugcgagagcccacagccugugaccacugcccucucagacccagggaggcaugagccggggcaggugcgguuggggccagugggggcuucugaacaacaggauacaucuaaaugaaggcagcaucuggguagacaaaagugggggcuuagguccccuccccaccuccccuaggcgccuccauaggcaaguggccaaagccuccgggagcuucgugaugccucacagccuuggaagcaccgccugcgaggccacaguggcugcugcugggggcuguugaaucugagggccaggcuucucauuucucucaccaggcccugccuccaagccuagucccagggagacagcccucaggaacccaaggccacccaggggugaccagagccugcacggcaggaaagaacagccaagagcaacgcugagucugcucuuuaauggacaccgcccacuugucugcaccugacugaggcgggaacaggaggggucugggaaauggugccacugggccugggugccgcacagucugcucccuggggacagaaacccacagggucgagcccugcaggccucuccuuccaggaagggccacaacuagcagccgccugccuccucagccccagggagggcacacaggcuggguggcacccaguggccaggccccuuagcugggccgcaggcagcacugagccgccuggagguccgagguccguggagguggggagggggugcagauguccuggaggccaagguucaccccucacauguuggugcucauccgggacuggcuguuggcuggagucagcucccccuggcucccuucucugggcggggacugcaggggagacaaggagcagcucacagccaccaggccccacacgccgugcgccugcccccccucaagccagcccaccuugacauggaucugguugcggagcacagcugcccgcagcaucauggccuuggcgcggcgcuggaacuccuugcccaucaacagagacuucucaaagguggugcugcgcugauccacgucccgggcguauaggaucugugcaggcacaagcucagcggggcccaggcucacccccagcugcccccaccgccccgcagcccacagccaccuugcugugugaguccacacgggcacugaucagccccuccaggauuagcugcgucagcucguccuccagggcggccaccgugguauugaaggcugccgccauccuaugcaugucggcugacacguaggggcugaaauacugcagggcagagggaagucagcuccacagcccccugcaugcccgccugccgugugccagccugacccccacgcuuaccuggaugagggcacgguugcgaaucuggguguacaggguccugacauggggggccagauacauguccaggagcagguuguccuggggaaggggcuggucaggaccaggacaggaggccaggcagggccccaccucaccccuaccccaggcggggcccaccuucaucucguccagcaucuugagacaugaggcguacuuggacucguagaauuugaagaugaugucucggaccuguggcuccagcuccaagaacaacuugaaggagcuggugaggcagaccccucagaacucuguccucugccugccccucccuccaaguggccagugggacaccaguccccagacaaacaccugagaaaacgcuggggccagggggccaggacaugcaaggccgaagcagcagccacggagagggacggggacagccuucagggcugcaggaccggggcaccuaccugcuggagaugacauugcgcugcagcuccugccggucaaagguagccaaggcgcacaggccaccguagauggccacguugcugggggacagcagcugaggagcagagaccuggcgucacaggcagugaagggccaggccaccccugccugcccaucacccgcucggagaaugccuaagaccccauuugugagagaccucacccuccuacagaagcagccugacccaugagcccaugcucugccucccaaguccccagagggcuccucaccucagggaagucacagugaucaaaggaagccagcaggaggcacuuggcagccugcuuguacuuccuggcggccagcu

SEQ ID NO: 16956 - RNA, 20457 nt, Homo sapiens
cguggagucggcggccgaagugcgggcacgcggguccguccguccuuccgcgcgccuguggguccgagcgccccgccgcagccggcuggacccccgguguggccacgggguaguccccaguguggcccaagcauucccaucccgcacacguggccccggcggacacgggggucggggauggcucgggaggcgcgccgcgggcucggucgcagccgcgugcgcgucggggcccgcggggcgggaggcggaagucggggggcggugguuucccgcccgccccgcccccggcgcuccucagucccagccccacccccccaggcgcguucccgcgcagggucccggcucgggcggcggcgcgcacgagcaucaccccaccggcggcggcgcgccgggucccggggcgcagccccgacgcucauuggccugggcggcgcagccaagcugucagcccauguggcguggccgcccggggauggccgcgguuuaaauagcgucggcgccggccuagagggagccagagagacggcagcggccccggccucccucuccgccgcgcuucagccucccgcuccgccgcgcuccagccucgcucuccgccgcccgcaccgccgcccgcgcccucaccagguacgagcagccggcgcuggggccggggcgcgggucguggucggggcugggcccgggguucccgggguggcccggcuccucauccuccgcucucggggcgcgcguggcccggccccguauccaggggucgccugggcggccuguccgggucucgguguucgugccccuucggaggcgcccggggccccgcggaguaggugggcggauggcgggggaaggacgccggggaaagccaccaacagccgccuucgcuucccgugggggaggccgcggacccugaagggccuggaggagcccccggcucggccuccccgcgcccacaaaggcgccgccgcauccuccucccggagccgccccggagccgaggcccagcccgaaggggacgccgcgagggaggaacgggggggcgcaggggccgcgccgggaccggccuccccaucacguggcgcagcccggccgaagcgcaggggucccgagcagcccccgcccggggcgaagggaggccgggcgcgccgcgguguucccacccccugccuggccgucgaccccgcgugaauagcaagcggcgaggacccagcgugcgggccuggagcuggcccggggcagccaagccucugugaaucgcagcgggugggaaggcggccgccucccugccgggacggcccaagggaggccgcacugccgaggggcggcgcgcguaucaggcccuggggccucgugcaaguggccagaccagcgcuggccuccgcccccuccccccagggccgcaccagcccucaugcuggaggaggagccggcggccugggcacccguuccgggucuuagggaccugggcuccagggagggccuccugugguguguggguugguauggggaggcaagcgucuguggguucacccgcgcaggugaagggugccaggcaacaccugcguguccuggccaggagugguucuccagguuggacccugcuggagggguuggacuggcugggucgguccacaguggggcaggggccaccuuucccccagagcauaggcuauccccauuucgucccuccccagcccugguggcucuugggcuggccuggacagcgggcccccaccccaacacgggugagcaugggugcugaguaccccccucuagggcucccagccaccuccaugccccggcuuugggacccugccucuccauuucuuugauggcccuuagcaggcuggccaccugaggccuuguccccaucucaggugacccugccugcuccucacugugagcccccuggugcccuagggauggccugggacaagcuccaggagccuuggaaggcugagacucaggcgaguggaagccgacacaggcgcagaaaccaguaacugcuggggaggccagggcugcagggcuccagugggguaccccagccaauacccugaacugaaugggucagggcccagaggcgggccuguucccagagcacgcagccccucccagcgagagcggggucagggcccaggaacuggccacaugaggaagggagccgcaggagccagggcccgcacggacccucaggguggugcuuggccccauggguguccaccuguucugggugccgaggcuguugacgggggugucguggccgggauguguggggcacucacaccgcccgcccugcagagcagccauggaggagguggugauugccggcauguccgggaagcugccagagucggagaacuugcaggaguucugggacaaccucaucggcgguguggacauggucacggacgaugaccgucgcuggaaggcggguauguggcugcggggcuccccgugccuggggugugaagcuccaucuccaccuuuguccucacagcagccucccugcugugcuguguccucaccacccaggcacuggccugaggccggucccagcugcagagccacuggucacccaugggcgaggccuagcugcagccuccuuccuggacauugcaccagaguggccuagaaaaugcgcccagccugccaggagguucccucaacggcugcaaggccaacaggaggcucccccaauggcugcaaggccgagggcuggcccaggcagggcccaucugcuuguuacggaggagccaagcucagaggaugggugacgggcuggggucucucacccaugcagggggugcggggggccagagcccuuccggccaggcugccccugccugugucuguccugagcugggagguugcauaccagaugugcuccgggaggcuggagcaacugccccacacccaguaggcucuuccacagagcagcucuaccugacaggcaagcugugagucagcaugguagagccgaggcaccagcccggcagauggucccccagccucacucccgccgagcucucugcucugcggcccaucucaggauuggggcuuggggcuuggggcuugugcagcagaucuggucguaccaguccccgcuuuggggccauggucuuccccuccuggggagccugcuccauuguuugggccucccaggcauagcagagaguccucaguuccaccauggccccuccaggggccugcagcaccccacagggcccccaccucugggcagcuuccgucagagauuuaaacacccgccugucccacagggcucuacggccugccccggcgguccggcaagcugaaggaccugucuagguuugaugccuccuucuucggaguccaccccaagcaggcacacacgauggacccucagcugcggcugcugcuggaagucaccuaugaagccaucguggacggaggugggucgggcauucgcgacugcugcgccgagggcuccugcugcucacguggaauaggcaguguuuucucuucuugguucugguagaaccaggugcuggcaccaccuacccuccccggcugugccccuggccuggccaacgggcucagggaggugugggccacgggguaggccgcaguuucccaacugcaccccagaggugucgcgggugugcccugaccugagcguaccagucuccucgcuucugaugucuggcuggugcuggggccggggccggggcuggagugacgagaggcaaagcaggagguucuugaggggcccuccaggcccccacccccaccagccaagcagcggacagcaccggcccugcugucucuccccucccacccuccccacuacccuugcccacguccccccaccccaggcauuucaacccucucccgccagccuggcccucgcucugacuggcauuugaccucggacaagcgccacgccguuuuuuuauuuuuauuuuuauuuauuuauuuauuuuuaagacggagucucacucugucaccagguuggagugcaguggcgcgaucucagcucacugcaagcucugccuccuggguucacaccauucuccugccucagucuccugaguggccgggacuacaggcgcccaccaccacgcccggcuaauuuuuguauuuuuaguagagaugggguuucaccauguuugccaggauggucucgaucucuugaccucgugauccauccaucucagcuucccaaagugcugggauuacaggcaugagccaccacgcccagccaugccauuucuuaagauccaggugcucccuccccgggcggagaaggaccuccugagggggaggcugagcccugggcugcccuugggugugagcgguucacacacccacccacccuagggcagagccagcccaccaggggcgaggaggggcccugcuggccgagagguggaagcccuucuccugcgcccuuccugcugccagaccccaccccaagacuaagguuaugcuccccgggggugaccggugucccucucuccuucccgagccuggacacuuggccuuugucuccucgguuccuuaucacggccuguucuggugcaggcugcccuuggcgcuggagaggccacuggccgacgggcucaucagagcugccggugacaccaggggccaaaggcgucgccuggggacaaugcugcccucuguccuuccuggagccacucuggccgugccuggugcccuccccugggcccgccugcccccuccgccucguucccucugugaccugguuccuguuccaggccucaccugggcuggcugcuggccacaggcucuguucuggccccucugcaggacaccucacccuccuuaggccccuuccagggucccacugggauggacccccccucaccccaagccagugaggccaagaugggaccuucgccccagagccgggugggugggugggcuggcugcgcuguggggcccggccguggcaccuugaccacuguuuguggcaggcaucaacccagauucacuccgaggaacacacacuggcgucugggugggcgugagcggcucugagaccucggaggcccugagccgagaccccgagacacucgugggcuacagcauggugggcugccagcgagcgaugauggccaaccggcucuccuucuucuucgacuucagagguggguccugcccagccuccugcggagguggguggccuucagguccccacaugcugagcagaaaccacguggcgugggcucacuccgugcaguguguguccagccugguggcaggaggugugcucaggggucucgugugcucacagccccaccugagccgcagcacccuuccuugcagggcccagcaucgcacuggacacagccugcuccuccagccugauggcccugcagaacgccuaccaggccauccacagcgggcagugcccugccgccaucguggggggcaucaauguccugcugaagcccaacaccuccgugcaguucuugaggcuggggaugcucagccccgagggcaccugcaaggccuucgacacagcgggugagugugcggcugcgcggccagggcaggcgggacaguggcacaggacggccccccgcacaguccccacgcugagcaggauccugccagcuccggggaucccccacccaagcacccaccccacaccccagagcuccuccugguggggugggggccggcguggggcugagccccgggccugaggugcugcucuacccagggaauggguacugccgcucggagggugugguggccguccugcugaccaagaagucccuggcccggcggguguacgccaccauccugaacgccggcaccaauacagauggcuucaaggagcaaggugggcucugccgggguuccggggugcuggggggcaggugggagccggggcuggggcugcagcacugagccgagcccuccgcaggcgugaccuuccccucaggggauauccaggagcagcucauccgcucguuguaccagucggccggaguggccccugagucauuugaauacaucgaagcccacggcacaggcaccaaggugaugccccccccccccgccccacucaccaccccaugagccuaaccuacgcccaugccuggagaggugaccuggccagagccccucaccccccauguuucccacaggugggcgacccccaggagcugaauggcaucacccgagcccugugcgccacccgccaggagccgcugcucaucggcuccaccaaguccaacauggggcacccggagccagccucggggcuggcagcccuggccaagguagguggggcugggcuugggggucccucaggcuccugcucccugggacuggguugcgccauggcugggcacugcugcuuucucuuugccaaguggaggcgggggcuuccccaccaggagccucugucccccgggcuaugcugcaggucugagcagaggcacugaggcugacagcagggagagcucguagccaggcucgcugggccuucccuggaggccugaugcccugcagagcgucugccggacacggagccgagcuggaggagccgcuugggugggaagagcgaggcaggagcaggccuggggggguccacggcaccaucagggucucccgugucgcccacccgucccuacagcuuccugacccacuagcagaggccuggggaccuuuagagagaccaggcacaggagccccaacacccaugaucacucacgcccucugccccccaacuucugcagccucugagaugcaacaucugggccaagggggccuuaguguucaggccacagccaggcuuugguggguccacaucaggcugggaggcagcaaggccggaaggggaggucuuggaccaagcugagggcagggccauggcggcucaguccucggaccccugugccauggcagaauuagguuggggacaggaagugcaucggagagggcccuggaacccuggccccacaugagagucucggggaggugccugcccccagcucaggcagugguagagggaguggggcggcugcccauccaccacguacccccgcaggugcugcugucccuggagcacgggcucugggcccccaaccugcacuuccauagccccaacccugagaucccagcgcuguuggaugggcggcugcaggugguggaccagccccugcccguccguggcggcaacgugggcaucaacuccuuuggcuucgggggcuccaacgugcacaucauccugaggcccaacacgcagccgccccccgcacccgccccacaugccacccugccccgucugcugcgggccagcggacgcaccccugaggccgugcagaagcugcuggagcagggccuccggcacagccaggaccuggcuuuccugagcaugcugaacgacaucgcggcuguccccgccaccgccaugcccuuccguggcuacgcugugcuggguggugagcgcgguggcccagaggugcagcaggugcccgcuggcgagcgcccgcucugguucaucugcucuggugagcccacacucugcccccaagguggucccuucccuggggaaaggcaggcgaacuggagcuggugguccccugaggugcucucugggacggggaugggcacacaguggcacgggauggggcugagccucgugacgugcucucugggacagggaugggcacacaguggcgcgggauggggcugagccucaugcgccuggaccgcuuccgagauuccauccuacgcuccgaugaggcugugaagccauucggccugaaggugucacagcugcugcugagcacagacgagagcaccuuugaugacaucguccauucguuugugagccugacugccauccagguagggcccagccugccagcgugugagcaacgccagccccagggcucuggcuuucccuggagcccaggagcugcaguguugaguccggggccccugacagccccuuugcuaggcagagccuugugcugggggcaggacgggaggggaggaggggucucaguggggcugugugggggccauaggggcuucuuuccuaucaggagaccugggagggucgauggggcgcggggguggagauggccuaguggggccgggggccgcccccaacagcugcaccugcuggagguugcaaccugaguguccuguucccaccccagauaggccucauagaccugcugagcugcauggggcugaggccagauggcaucgucggccacucccugggggagguggccuguggcuacgccgacggcugccugucccaggaggaggccguccucgcugccuacuggaggggacagugcaucaaagaagcccaucucccgccgggcgccauggcagccguggguaggucucccggaggggcccccagcaccuccaagaaaggaggcugccuucucgcugugggguccucaccugcagcccuggccuggcccccguaggauagaguggcccccgcuggcccggggacacccagcucggacacagccgugcgcgaguccccugcagcugccccacuggccccacaccuggcagccuugggccuaggcacguguccaugggcaucaggccugcguggagcccccgugugaugagcacacagcugcagcauagcaagaacccaggggcucuggugaagccaacacacgggucaucaggguucccucagacuggugcccucuguuggcacccaucucugagccccaugggccacaugugggcaggaccuggaaagaaccuuggcugcagaggacugagggggccaccaucuggggacugggcucccaggagcugccccuggaguggcagcucuguaaugacaccuccacccacgggucaaacacagcagggggcgaaccuuucucaugaaggcuccaaggcugccauuaccacacuugucauuacugcccccagcugcaggcagugucuggguggguggguggcugggagcggcucgguguccacgcuaagccucugaggcuggcucugccauaggcuuguccugggaggaguguaaacagcgcugccccccgggcguggugcccgccugccacaacuccaaggacacagucaccaucucgggaccucaggugggugcugcggccugggcgggcuccucuguccccugcgccugccauugcaagucuggcagggacacgcggccacggucuacgccccaccaagcucugacgggccuggggcauggggcagguuuguccucaggucccuugcccauucccucucgguucccuuggggugaggugggugcgcccuaccucuccgagccugaggugggugcccagccaggaugcuuauccaggcucccacgauguccaggccccgguguuugaguucguggagcagcugaggaaggaggguguguuugccaaggaggugcggaccggcgguauggccuuccacuccuacuucauggaggccaucgcacccccacugcugcaggagcucaagaagguggacuaauacggccuggggggugcggggcgggccaggggacccacaacccagcacugaccuggccccucaugcaggugauccgggagccgaagccacguucagcccgcuggcucagcaccucuauccccgaggcccaguggcacagcagccuggcacgcacguccuccgccgaguacaaugucaacaaccuggugagcccugugcuguuccaggaggcccuguggcacgugccugagcacgcgguggugcuggagaucgcgccccacgcccugcugcagguaggcccagccugggggcagcaggcgccgggagccugggaugggcgccucagcugagcaccaagagagcccaccugcccugccgcccccaggcuguccugaagcguggccugaagccgagcugcaccaucaucccccugaugaagaaggaucacagggacaaccuggaguucuuccuggccggcaucggcaggcugcaccucucagggugggucccuucccagcccgggucucgucucccggagucggggacggcguggggugggugagcggggcugcgggccccucacugacccaggccgguggcagcagcccuggaugguccaccgcaggcagugggugggcugaacccagagccccuggaccccggugacgggugugcuacccaugccucccuucuccguagcaucgacgccaaccccaaugccuuguucccaccuguggaguucccagcuccccgaggaacuccccucaucuccccacucaucaagugggaccacagccuggccugggacgugccggccgccgaggacuuccccaacgguucagguucccccucagccgccaucuacaacaucggugagcaggggcccggcgggugggcagacucuucccuccccacagacgcccgcucugugcugaggccugugcccucccgcagacaccagcuccgagucuccugaccacuaccugguggaccacacccucgacggucgcguccucuuccccgccacuggcuaccugagcauaguguggaagacgcuggcccgcgcccugggccugggcgucgagcagcugccugugguguuugaggauguggugcugcaccaggccaccauccugcccaagacuggugagggguaccccaggaccaaggcggggguagcuggggggcgggugcugcccucugaucuccaacucucccgcucugcagggacagugucccuggagguacggcuccuggaggccucccgugccuucgaggugucagagaacggcaaccugguagugagugguaagcagggccgguggcacgggagcugcggaggcugugcccgcuggccaugccgcccguccucaggcccuuccgcaccucccuuuccacagggaagguguaccagugggaugacccugaccccaggcucuucgaccacccggaaagccccacccccaaccccacggagccccucuuccuggcccaggcugaaguuuacaaggagcugcgucugcguggcuacgacuacggcccucauuuccagggcauccuggaggccagccuggaagguggguacugacuacacugcugcccaagccaccggggagggcggucgucauuguggggaccacagagggcacccacagcuaggcaugcagcuugggagggagcagaggggcccggugggcucugggagguggccccagggaccugggaguuccacagcaccaaccaggcccugugugcaggugacucggggaggcugcuguggaaggauaacugggugagcuucauggacaccaugcugcagauguccauccugggcucggccaagcacggccuguaccugcccacccgugucaccgccauccacaucgacccugccacccacaggcagaagcuguacacacugcaggacaaggcccaagguagccccgccccagccccagcccagugcccccacccaaguaugccgcacucacccagccuguccccacaguggcugacgugguggugagcagguggcugagggucacaguggccggaggcguccacaucuccgggcuccacacugagucggccccgcggcggcagcaggagcagcaggugcccauccuggagaaguuuugcuucacuccccacacggaggaggggugccugucugagcgcgcugcccugcaggaggagcugcaacugugcaagggugaggucccagcccugcuggcuucggacaccucuggcgaugaggagcgaucgccuccccucacguugaccccagacuugcuucuccacggggcccccuuuggggucagcaacccuagcccaacccuccggccggagcucacgauggcggccucccucccucccccagcccccagccuuccucgucccuggucacuguuccucagucuugaaaggguacuugggggcaaagaugacagauucagccuaaggucacaccuuggcuaggcacagaguagccccugcagcugaaugcggccccucacugcguccacagugggcaggagucagccucccaguggugggcagccccuuccucaacccucagcuauuucucauccugugggcagagcggggugguggccccagaaggacagagugggucugagagcccaugccaggcagaugcccuggggcuuugggaacaccaggccugccucccucccuccccagggcuggugcaggcacugcagaccaaggugacccagcaggggcugaagaugguggugcccggacuggauggggcccagaucccccgggaccccucacagcaggaacugccccggcuguugucggcugccugcaggcuucagcucaacgggaaccugcagcuggagcuggcgcaggugcuggcccaggagaggcccaagcugccagaggacccucugcucagcggccuccuggacuccccggcacucaaggccugccuggacacugccguggagaacaugcccagccugaagaugaaggugguggaggugggugccuccugggcagccaggccucugccccggacaugguaggacccacccugacaucaguugcaggagacagcacagacacggggcgggcccugggcgguggguggggccggccaguucccugugugguucugugcacguguccugugcgguccacacagccaccguggaggguccgcccgugggcuccaagaggugcagccuaggcaggaccccagggacaagaccaguggcauccaugcgugcccauggcuggcaccgucaucagguugacggggaagccuuucugccagacugaggccucauggacauuuugcccagccccaggucaggggcaccugccugguguggggcugauuccagaauucacccccuacaggugcuggcuggccacggucaccuguauucccgcaucccaggccugcucagcccccauccccugcugcagcugagcuacacggccaccgaccgccacccccaggcccuggaggcugcccaggccgagcugcagcagcacgacguugcccagggccagugggaucccgcagacccugcccccagcgcccugggcagcgccgaccuccuggugugcaacugugcuguggcugcccucggggacccggccucagcucucagcaacaugguggcugcccugagagaagggggcuuucugcuccugcacacacugcuccgggggcacccccucggggacaucguggccuuccucaccuccacugagccgcaguauggccagggcauccugagccaggugcggccgccgggcagggggacagggugggggccgggugagggccaggcgggcagggugcugaccaccgcccccacaggacgcgugggagagccucuucuccagggugucgcugcgccuggugggccugaagaaguccuucuacggcuccacgcucuuccugugccgccggcccaccccgcaggacagccccaucuuccugccgguggacgauaccagcuuccgcuggguggagucucugaaggucaggcccugccccaccuccaggccccaccccaccucccaacuugccgaguguggccugacccuccccgacccgcuguagggcauccuggcugacgaagacucuucccggccuguguggcugaaggccaucaacugugccaccucgggcguggugggcuuggugaacugucuccgccgagagcccggcgggaaccgccuccgguaggagcacggccccucaccacuuccccuuccccaccagccuccccauccccagccugagcuccccgccucugcccccaggugugugcugcucuccaaccucagcagcaccucccacgucccggagguggacccgggcuccgcagaacugcagaagguguugcagggagaccuggugaugaacgucuaccgcgacggggccuggggggcuuuccgccacuuccugcuggaggagggugagcccccgacacugcccugccccucccgggagacugcacccgaaggccccgcagcagccccaccucccuguuucccuagacaagccugaggagccgacggcacaugccuuugugagcacccucacccggggggaccuguccuccauccgcugggucugcuccucgcugcgccaugcccagcccaccugcccuggcgcccagcucugcacggucuacuacgccucccucaacuuccgcgacaucaugcuggccacuggcaagcuguccccugaugccaucccagguauggguggcauggggccgugggaguggacugggccggggagcagagaccccagcagcuaggaccugccugggagccccucgggagggaagggcaggcggugaggggcucagugccgucucccccagggaaguggaccucccaggacagccugcuagguauggaguucucgggccgagacgccagcggcaagcgugugaugggacuggugccugccaagggccuggccaccucuguccugcugucaccggacuuccucugggaugugccuuccaacuggugagugugucgagggugugagccugggccccacguggauggcggccaggccugugcugacccaccugcugcauccccaggacgcuggaggaggcggccucggugccugucgucuacagcacggccuacuacgcgcugguggugcgugggcgggugcgccccggggagacgcugcucauccacucgggcucgggcggcgugggccaggccgccaucgccaucgcccucagucugggcugccgcgucuucaccaccguggguaaggccccgcccccggugccucccgcugcccuccuggccccgccgcccuggcucaccagccgcgcuuccucucuucaccagggucggcugagaagcgggcguaccuccaggccagguucccccagcucgacagcaccagcuucgccaacucccgggacacauccuucgagcagcaugugcuguggcacacgggcgggaagggugaguggcccccacagcccccaccugccuccugccuagccuccggcccagggagaagcagggucuggcccucuggacugugguggcugggcuugcagugggugugauugucuggccccucuggcccccuaggcguugaccuggucuugaacuccuuggcggaagagaagcugcaggccagcgugaggugcuuggcuacgcacggucgcuuccuggaaauuggcaaauucgaccuuucucagaaccacccgcucggugaggccggcagcgccugggcgggggugggcauggauggguguggguggaccuguggaaggcccugggugagcacggccccugcccgcaggcauggcuaucuuccugaagaacgugacauuccacgggguccuacuggaugcguucuucaacgagagcagugcugacuggcgggaggugugggcgcuugugcaggccggcauccgggauggggugguacggccccucaagugcacgguguuccauggggcccagguggaggacgccuuccgcuacauggcccaagggaagcacauuggcaaagucgucgugcaggugaggggaggagucccggcgccucgggcaccccaggcucugguccccaggcagugccugagccggugggugcugcuuggacgcaggugcuugcggaggagccggaggcagugcugaagggggccaaacccaagcugaugucggccaucuccaagaccuucugcccggcccacaagagcuacaucaucgcugguggucuggguggcuucggccuggaguuggcgcaguggcugauacagcguggggugcagaagcucguguugacuucucgcuccgggauccggacaggugagucggcaggggugcuuguggaccagccugggccaggcacagccccgggccccugagcccuucucugcagcccaccauugugggcugucacggugccuggggucugucccccuccaucuuguggggggcuugcuggauggggcucugcggcugcuccccacuuccccagcccggcguguagggaagagaccguacccuggcccaguccagcccacaguccugugucccgcaggcuaccaggccaagcagguccgccgguggaggcgccagggcguacaggugcagguguccaccagcaacaucagcucacuggagggggcccggggccucauugccgaggcggcgcagcuugggcccgugggcggcgucuucaaccuggccguggugagggaaggccccaaauggggcccucaaaagccccaagaccaagggggggacccuggguggacgggugaggcccuggagcugcagggagugcugaggaugccucccccaggucuugagagauggcuugcuggagaaccagaccccagaguucuuccaggacgucugcaagcccaaguacagcggcacccugaaccuggacagguggguaccgcacagcccugcucccgccucugccgggcucugggcucagggccgugggagccaaggugguuuguugacagcccucucuggcguuuccuggggaugggacguugggggcuccuggggaugcuggccaauggggagugacacgcgugcccacagggugacccgagaggcgugcccugagcuggacuacuuuguggucuucuccucugugagcugcgggcguggcaaugcgggacagagcaacuacggcuuugccaauuccgccauggagcguaucugugagaaacgccggcacgaaggccucccaggugggccccacccucuccccucgacccugcccacccugcccucucccaguggccacuccccacccccaccuucuccccgcagcccugcccaccccacccucucccaguggccacuccccaccccgaccuccccgcagcucugcccaccugcccccucccccacaggccuggccgugcaguggggcgccaucggcgacgugggcauuuugguggagacgaugagcaccaacgacacgaucgucaguggcacgcugccccagcgcauggcguccugccuggaggugcuggaccucuuccugaaccagccccacaugguccugagcagcuuugugcuggcugagaaggcugcggccuauagggacagggacagccagcgggaccugguggaggccguggcacacauccugggugagcacucccaguaggagccgcgccagguguuuccccugcuggcaucagggucuugggacauagcagucgugccccugugcgccucaguuuccccaucugcagagccagggugcgggcgcaggugucacuguggugguggugcuuugggagaugcacagcccacgcaccccugggugucagcccugccgcauacaggccguccccaugcccccucuggaguugccgacccggcgcaucccuuccaggcauccgcgacuuggcugcugucaaccuggacagcucacuggcggaccugggccuggacucgcucaugagcguggaggugcgccagacgcuggagcgugagcucaaccuggugcuguccgugcgcgaggugcggcaacucacgcuccggaaacugcaggagcuguccucaaaggcggaugaggccagcggugcguguggguggccaggcgggagugggguccccgggccuccccagcccuuccuccuuguugucuggaccgugucccggcaggcauaccgcccuucgucacgggugccauucugagcguucccaccccgacucccaccugacguagcaccguggggaccugcgugcgugucuguguguccuugcgugggugccagggcucugcacccagaccagccuggcaucugccccugucuucacagagcuggcaugccccacgcccaaggaggauggucuggcccagcagcagacucagcugaaccugcgcucccugcuggugaacccggagggccccacccugaugcggcucaacuccgugcagagcucggagcggccccuguuccuggugcacccaaucgagggcuccaccaccguguuccacagccuggccucccggcucagcauccccaccuauggccugcagugcacccgagguacucccgggcccuccucuggaagcgguggucagugcuggccaucacggggcccguggcugccgccugcacaugcugagugcccggcacugccauugcagcugcgccccuugacagcauccacagccuggcugccuacuacaucgacugcaucaggcaggugcagcccgagggccccuaccgcguggccggcuacuccuacggggccugcguggccuuugaaaugugcucccagcugcaggcccagcagagcccagcccccacccacaacagccucuuccuguucgacggcucgcccaccuacguacuggccuacacccaggugagagccaggcugguccuagaggccuacggcaaacgucugggcuccccaccugugcccuggcuuugggggaccgucgcuuaggaggccccgccccuuccaucugcucagcagucccuccuuccucucagagcuaccgggcaaagcugaccccaggcugugaggcugaggcugagacggaggccauaugcuucuucgugcagcaguucacggacauggagcacaacaggguggguccuggacaccccugaggccgcaggacccagaguacugggcaggaacggaagggggaagggaaggaugggaugggacgcgaagagcguuaaaggccccccaacuucaccccuuuaauagccgaucccggccggaugcgguugcucaugccuguaaucccggcacuuugggaggcuaaggcgggcagauuaccugaggucgggaguucgagaccagccugaccaacguggagaaaccccuucucuacuaaaaauacaaaaauuagccaggcaugguggcacucaccuauagucccaccuacucgggaggagaaucgcuugaaccggguagguggagguugcggagggaggagaaucgcuugaaccggguagguggagguugcggugagcugagaucgccccacuccaucuagccuggguaacaaaaaugaaacucgucucaaaaaaaaaaagcccacccgcaguguagcacagggcaggccggugcugugggugcugccagcaccugcucagagcccgaccccacaggugcuggaggcgcugcugccgcugaagggccuagaggagcguguggcagccgccguggaccugaucaucaagagccaccagggccuggaccgccaggagcugagcuuugcggcccgguccuucuacuacaagcugcgugccgcugagcaguacacacccaaggccaaguaccauggcaacgugaugcuacugcgcgccaagacggguggcgccuacggcgaggaccugggcgcggacuacaaccucucccaggugcgcaaggggccugacgggaacggggacagggacaggaguggggugggacggcagcugaucgcauccccugcagguaugcgacgggaaaguauccguccacgucaucgagggugaccaccgcacgcugcuggagggcagcggccuggaguccaucaucagcaucauccacagcucccuggcugagccacgcgugagcgugcgggagggcuaggcccgugcccccgccugccaccggaggucacuccaccauccccaccccaccccaccccacccccgccaugcaacgggauugaaggguccugccggugggacccuguccggcccagugccacugccccccgaggcugcuagauguagguguuaggcaugucccacccacccgccgccucccacggcaccucggggacaccagagcugccgacuuggagacuccuggucugugaagagccgguggugcccgugcccgcaggaacugggcugggccucgugcgcccguggggucugcgcuuggucuuucugugcuuggauuugcauauuuauugcauugcugguagagacccccaggccuguccacccugccaagacuccucaggcagcgugugggucccgcacucugcccccauuuccccgauguccccugcgggcgcgggcagccacccaagccugcuggcugcggcccccucucggccaggcauuggcucagcccgcugaguggggggucgugggccaguccccgaggagcugggccccugcacaggcacacagggcccggccacacccagcggccccccgcacagccacccguggggugcugcccuuaugcccggcgccgggcaccaacuccauguuugguguuugucuguguuuguuuuucaagaaaugauucaaauugcugcuuggauuuugaaauuuacuguaacugucaguguacacgucuggaccccguuucauuuuuacaccaauuugguaaaaaugcugcucucagccucccacaauuaaaccgcaugugaucuccaccaccguccuuucuucccuccucccugaccuggcagcugcaagcucu

SEQ ID NO: 16957 - RNA, 3478 nt, Homo sapiens
cuccagcccccagaggagcugccucuccagggccuuccugcaggugcccaggggcugcacauggcccuccuuggagggagcuggugacucagcacuuucauuuccuggaaacugaggcucaugggagauaugcagaugagcccagagcaccaugggaaauggcccuuuauauacccaaaugggcucugccuccuccuuucccugggugcccacaugaacagagacaccaggauggugagaucucccgaggaggggucucugaggaggggucucggagacacggccuggugcugggugagggguugggaggcugaagcggggccaggauuccucagguucccucaguuucccucaaauuucccucaguuucccucagguucccuaagguucuccaaguucccucaaauuucccucaguuucccucagguucccucaguuucccucaaguuucccucaguuucccucagguucccucaguuucccucagguucccucaguuucccucaaguuucccucaguuucccucagguucccucaguuucccucaaguuucccucagguucccccaguuucccucaaguuucccucagcuucccucagguucccccaguuucccucagguucccucaguuucccucaaguuucccucaguuucccccaguuucccucaaauuucccucaguuucccucagguucccucaguuucccccagcuucccucagguucccucaguuucccucaaguuccccucaguuucccccaguuucccucagguucccccaguuucccucaaguuccccucagguucccccaguuucccucaaguuucccucggguucccccaguuucccucagguucccccaguuucccucaguuucccucaaguuucccucagguucccccaguuucccucagguucccucaguuucccucaaguuucccucagguucccccaguuucccucagguucccucagguucccccaguuucccccagguucccccaguuucccccaguuucccucaaguuucccucagguucccccaguuucccucagguucccucaguuucccucaaguuucccucagguucccccaguuucccucagguucccucaguuucccucagguucccccaguuucccccagguucccccaguuucccccaguuucccucaaguuucccucagguucccccaguuucccucagguucccucagguucccccaguuucccccaguuucccucagguucccccaguuucccucagguucccucaguuucccucagguucccccaguuucccucaguuucccccaguuucccucaaguuucccucagguucccccaguuucccucagguucccucaguuucccucagguucccccaguuucccucagguucccucaaguuucccucagguucccccaguuucccucagguucccucagguucccucaguuucccucagguucccccaguuucccucaguuucccccaguuucccucaaguuucccucagguucccccaguuucccucagguucccccaguuucccucagguucccucaguuucccucagguucccccaguuucccucagguucccucggguucccucaaguuucccucagguucccccaguuucccucagguucccucaguuucccucaaguuucccucagguucccccaguuucccucagguucccccaguuucccucaaguuucccucagguucccccaguuucccucagguucccccaguuucccucagguucccucaguuucccccaguuucccucagguucccccaguuucccucagguucccucaguuucccccaguuucccucaaguuucccucagguucccccaguuucccucagguucccucaguuucccucagguucccccaguuucccucagguucccucaguuuuccccaguuucccucagguucccucaguuucccucagguucccucaguuucccccaguuucccucagguucccccaguuucccucaguuucccucagguuuccucaaguugccucaguuuccuucagguucccucaauuuccaucagguccccucaggcucugccaguuucccucagguucccccaguuucccucagguucccucaguuucccccaguuucccucagguucccccaguuucccccaguuucccucaaguuucccucagguucccccaguuucccucaguuucccccaguuucccucagguucccccaguuucccucaguuucccuuagguuuccucaaguugccucaguuuccuucagguucccucaauuuccaucagguccccucaggcucugccaguuucccucagguucccccaguuucccucagguucccucaguuucccccaguuucccucagguucccucaguuucccccaguuucucucagguucccccaguuucccucaguuucccccaguuucccucagguucccccaguuucccucagguucccucagguucccccaguuuccuucagguucccucaauuuccaucagguccccucaggcucugccaguuucccucauguucccccagguucugucaggugaagcugaugggcuguuggggucccugagguguaggggguggcugaugagcccggggaggucggauggaggaacugaaggccucccagccccggugcuguucaaacugagcaggguccccacuaaagggccagucugaaccccaacaucccugccccugcugguccccacaguuugcccccacccugccugcugggggugccuaaccucccuuccuuugccuuuccagcucuccugagaccacagcaacugcagaagcugaagacauuuccagaaguucaagcuuccacccucugcagguccccacugagcugggacccaggucauccaccccaccccaaaucccuggauaggaaaccccuuucuccuccugcuccuuguccccuucaucccugccgcccagcauccuacuggccucagcaccuguggccagaccguccaagauccucugaaggcccagcucuugcuguccaccccggcaguaggcaggcagccuggccaugugcccuccggucagcaugcgguaugaggaagagggcauguccuaccucuacgccuccuggauguaucagcuucaacauggagaucagcuaagcauuugcuucaccugcuucaaggcugccuuucuagacuuuaaagacuugcuggagucagaggacugggaagaagacaacugggacccugagcugauggagcacacugaggcagagucagagcaggagggguccucagggauggagcugagcugggggcagagcccaggacagccugugcaggggggcucugaggcaugggggccagggacccuggcagcagccccagaaggguuggaagaugcaggucuggacccccacuuuguccccacugaacuauggccuc

SEQ ID NO: 16958 - RNA, 2038 nt, Homo sapiens
cugaaggccucccagccccggugcuguucaaacugagcaggguccccacuaaagggccagucugaaccccaacaucccugccccugcugguccccacaguuugcccccacccugccugcugggggugccuaaccucccuuccuuugccuuuccagcucuccugagaccacagcaacugcagaagcugaagacauuuccagaaguucaagcuuccacccucugcagguccccacugagcugggacccaggucauccaccccaccccaaaucccuggauaggaaaccccuuucuccuccugcuccuuguccccuucaucccugccgcccagcauccuacuggccucagcaccuguggccagaccguccaagauccucugaaggcccagcucuugcuguccaccccggcaguaggcaggcagccuggccaugugcccuccggucagcaugcgguaugaggaagagggcauguccuaccucuacgccuccuggauguaucagcuucaacauggagaucagcuaagcauuugcuucaccugcuucaaggcugccuuucuagacuuuaaagacuugcuggagucagaggacugggaagaagacaacugggacccugagcugauggagcacacugaggcagagucagagcaggagggguccucagggauggagcugagcugggggcagagcccaggacagccugugcaggggggcucugaggcaugggggccagggacccuggcagcagccccagaaggguuggaagaugcaggucuggacccccacuuuguccccacugaacuauggccucaggaggcugugccccugggccugggccuugaggaugcugacuggacccagggucuucccuggagauuugaggagcuucuuaccugcucacacuggccaagcuucuuuccuucauagcagggguuucucaaaguggaccugcccccaggggagcccgugguguugaagcugggcauuaccugggcaguggacccugccgaggcugaggccuaguuacuggcccugcagcuugucuccauggugggcugcuaugauaccaucuaccuacagaagaugaccccagacagggcccugaggaccccagggcagcacuggaaauugcugcuggagccuggugaaguguggguggugagacuccaagaugcaccccaagagcaggaccugcacugguggaugcugagcauucuagaaacaucguuaacaggacacagggcagagcuggucccugcagccucagcccugcagaagaggauucaccauagucucuuauucacccuggaccaacagggagagcaagaagggagacucagccuguaagccacaguccuccagccaagaacaggaucucagcaccccugagacacagagcagggguccugaggaaagccuggcuguugcaggagccucggccaugggggagcugcccuguuuccagccucaguccagggccccagaacugagagacuaaggcucauguagcugccauuguccugggcacaccaggacaucagagacugggaagggccagcaauugcuguuccacaacagccaggggagcaguuggcaaaggaaacauggggagcaacuuuaggggcugggagauagggccuguuguggccucagagggaagcauuacaaauauucauaaccuggaaacaaguucuuaccaguugauugucacauaguucuggauguguuggccugaauggcuguugugcugcuugugacauggggggcagggcacagaacuugugccuauuucaccuuggccauggggagggacauugcuuguaaaacacaugcucugcagaacacaccagaaucuguggugaccuggauguguucucgacuuugccaggacaaucucaggggugccacaagacccugucagcagcacuaggaucucuggucuacaguggagggagagcugguuuuaaauguuggccguugaugcaauuuaaccauuuaauuccuguugcucuauauguuguuuuuaauuuuaaaaagucauaaa

SEQ ID NO: 16959 - RNA, 7240 nt, Homo sapiens
ggaccugcucuuggccuccagacugggccugauggcgugggcgccugccugugugcaggcccaagggcucagcugccucugucuguucccagaccccuccuccuguagagaguggugcugcccucucgggauguaccugcagguggagacccgcaccagcucccgccuccaucugaagagggcuccaggcauccgguccuggucccugcugguugguaaggcucuccacgucccuccccagaaccccagaaccggaagccugacuuucaaaaaggaugaaaaugaaacaaaauauuuucucuuuuuucuauuaccuugaaaucuaauggcuauuuuguuucuuuguauccauucaaauucuaucugguguacuugguuuuacagauaaugcaugucuguuuuguccccuuuuaaucacuaacacccagcguauuuaauauacucuaugagcuuuucugaggucaccauauuuuccuuuguacuuguuuugaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuaaccacgugaugggugaucguggguucccaugucuccuccucccugguccucagaccucuucguaggacucacaguccacuuagccucccguccuccaucgcuacccaccaguaggguccuguacccuuggggacagcugcacuuguguugacgggacaccgugugaggaguggugcuggcuguaccucagcagcuggggcccaccuuuuuugugacacgccacagccuccuguguguuuugcaugacacgcuguguuguaauuucuuugugcacagucuucaggccucaccacgugcuacuggaguaacacccgugucaguuauggagccucacacagcagaugugucuaguaaauacugugaauagcguauacuguguuuugcuuuuguuuucuuuaguaaugaggucucguuauguugcccaggcuggucucaaacuccugagcucaagcgcucuuccuuccucggccucccagguagcugggauuacaagugugugauacuacgcccagcuauacugcauuauugaaccagcuuccuggcuguuuccccuacucugaaccugguggucuguaaccccugaccacagcuguuccuacagugggaagggccugcucaucaggggcuguggcuccuggucccgcugcaccagggagguggggucuuaccgggaucaauaggcaggcagucacuuucucuucauaggaaucuugucgauuggccuggcugcugccuacuacagcggagguaaagcaccccccgccccacccccccaugacugucucagcuguuuggaaaacagagaaaagaaggaaaaacugucauuugugacuguccauggggcggccuuuaggaucggcaccucugccccuugauugcuggcgggcaccgcgcccuccaugcgcugcuguucuuccgcacgcccauccugcccagcgcucagcccacauuucacuucuuuuuuuuuuuuuuuugagacggagucucgcucugucacccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccacugcgcccggccacauuucacuucuuaagucuucuguguuuuugggucaucaaauauucccggagagaugcucuugaggaucuaagauccagcugugggaugagguguacuucccacccugccacaaucacugggccugcccagacgggcagaggcccugugcgccccaccugccucucucacguggacucugggggucagagcuggguggggugugccgcguguggguccugaguggccagggcagggucagcagcacaggaagcugcccaggggguccuugcaagcgugggcucuggccagcgucugggggaggcugugcuaggcggggccucccgugggcaugucccuggagcucacaggcuggcgcccuaugcccaucuccagauagccugggcuggaagcucuucuacgucacaggcugccuguuuguggcugugcagaacuuggaggacugggagguaaggccggcucgggugcgggacagaguccagggcuguucagcuccuggguuuuuugcaaugggaaugaaaggaggaggaagggcccuggguggccuagcgccuccccguccugaagcguuggucccugcuuggaggucuccguucaucaggacauggccccugcacucaucugggaccguucuuggccaaggaauuccccgaaggcauuuuucucuuagaagcucuccaugacuaucuucaccaaagugcuuucuucccagaguugccacaaugggaugcgagucagcuuuccccguggccggcccucccaccucggagccccucaugaguccuuucagccuggcccagugcugcccucugaccuccaugcccucguuugcugguuccacugccucccugcacuuguuuugccugcaggguggagcaagcgccugcugcaccugcccaccucuccauuucccaacaggagucggguuggcugccgauauccggcucugacagagcagcaccuguggcuucagggguuuggguucugacugggaggguccccagccccccuucuugaguguccacccuggugagggugggggugaggccccagcggccacggggcccccguuccuggagguucaugguggucagugcaugucgguuuccaggaagccaucuucgacaagagcacagggaagguuguuuugaagacguucagccucuacaagaagcugcugacucuuuucagagcuggccacgaccagggugagucguggggagcguggggacaugggacacggccacagaggcggcgcacuugggcgucugggugacucacggggccuagaggggggccuggaagugccuuugguccaagcucaccugcuuggugaccaggguuguguccugcccgcuggaagcaggaucccacggauacgccccaccugcucaccugcucagcaggguccuagagccuccuggguucuuuagagguuuggccccuggggagagugggaggagcaggggucugaggagcaggggucuggcagagcaggggucugaggagcaggggucuggcccacccgggcucgggcagccucuguuuagcugcauucucccgucugccuggcagccacuuguccgcaggugcagucuggccccagcggcaggucacaggacggggcagggagagccauggcagcccgugggcguucuggaguggggccaccuggcuucuugcgggccuuggcgcugcuccagcuuuccuguggguucuacugggccugcaguaggggcuggaugguccgaggaacuccccacccuugagccugggcacuggcccagcuguggucaguaccaguuuccuguagaugcugccgcacagacagacagaggccccgggguccggccgcccaugcauagccccagaggggacagauucuggcgaccagaguugcugggcagucuuggguuuagugccgcaaugcugcacuucugacaggcugcuuccuggaucccugcagggaccuggccagggcauuggccccaggucaccuguggcuuuggggagagcaguugcagggcuggccugggcugugggaggcagcugugccguuuucugacagccauugggaccgccccaguacccgaagagguggcugcccugaguugccacgggaaacugcaggguggcccuggcucagcagccaaccuuggggagaccuggaggaacagugcaguguaaagauggccucgcgcugagcggguccccgcagucggcacucccaggagaaccagcgggcugugcaugugacccgccagccugcaccgcgggcacguccuucccacccagaggacccugcacugccuucagggccacagcaguccuccggggcccagccucaggcaggaaacagcaaaugcuuuugcugccaaccaaguguggcugucgcuuucgaugaugccaguggcgcuggugcgacugccgggcagcaugugugggcggggauggcucggccacugaccgucuccccgcaguggugguccugcuccaugauguccgugaugugagcguggaggaggagaagguccgguacuucgggaaaggcuacaugguggugcuccggcuugcgacgggcuucucccacccccucacgcagagugcagucaugggccaccgcagguaaggcugugggacuuugaucuggccggagcugcagccguagcaggucacucccguuccugacugcccagagcuauggggcagcugggagaggagaugaguuuguggacgggacacagaggggcccacgggaagcgugugcaggcucaggggcagccccacugugacggggaggcugggagcaggccaggaagugcuggguccaguuugggagcuccagggucugcgggagguagguggucgaggaggagacugcuguggggucucacggugcccuaugccgaggugaccugaccuuccucccguugccggccucgcccagugauguggaagccaucgccaagcucaucaccagcuuccuggagcugcacugccuugagagccccacagagcugucucagagcagcgacagugaggccggugacccugcaagccagagcugacagccccacugugccugagcccgugcaccgcccacaggacccauggcacauucccggugugccugagcccgugcaccgcccacaggacccguggcacauucccggugugccugagcccgugcaccgcccacaggacccguggcacauucccggugugccugagcccgugcaccgcccacaggacccguggcacauucccggugugccugagcccgugcaccgcccacaggacccguggccuuggcuucaguuggugccuccagccgaguuggccuauugccugcucaugcugcugcuugcacacugcaugaaacagcaggccagaccaggacauccagacuuucuccaucgugaggccugggccugccuuucugcagccggaggucucgccagcccuggacuccugcuuugggccacagcaagaccucgggcgaguggagaggcggggccaggccgggcccuugugggugcugaugcugcauguuguccccgacacagcguccucucccugguggacauccccagcggucaggugcuuccccaagggcagugaggggugaacauccagggccuaccuggcugugcacgcugcagccacacuguggaagcugccccuccccgaggacccgccucccuugcugaugccaggaucucggcgcauagaccacucugccccagcggucgucacagaaaggucucucuguuccucacacucagcuucagcauaagcugugaggccagaaaaaaggucagcucuucuaguaucgugcagugcuuaaaaaccgggagcuccagccgggcgcagugguucaugccaguaaucccagcacuuucggaggccgaggugggaggauugcuugaggccaggaguucaagaccagccugggcaacacagcaagauccugucuuuguaaaaaaacuaaccaaacaggaaaaacugggagauuuucugcagaaauugaguuccagccucucucgaaccugggaagaccuggcaggagggggcugggcucucggcuacagacuucuccccaccccguaggagcugaacgccaaccauccugacccgccagugcucuuggucuccugaguguacccagguccucccaggugcggugugcaccgagcgcgccuggccugaugcccuggccugugagcuggggacuccugggcccugugagccccuaggcggcaggcccaggaauggcuggguaggacagggaacaccuuugccccacgucuggcugugaccucggugaaagccgacaggagagagaugggacccuccuccucaguaguggcugccagucccucguugcaggacagggucaucauaaccauaaauaacccuucacgugucaccugcagcuuccacucuuuauuuccaaagaaucagugucacacaugcagaucacaaagcgggucucccugugcugcuuccuucuguguuuucuagucucucccccaggggcugcccagggcccucaggaacugagugugggcaagacacugcugggccagagggcacgacgcccacgugggcccguauugcccaggccauuuggcagugcagagcccccccagccuccagcaggagcccccuggcaugagcucuccccucagggguccugagcaacgucccugccagggcugguggguggcagcgggggggcagacaccucgcugagguccugcagcagagcuugcagccgcugcaggcuggggugcacguuuuccuccagccacuccuccacggcauccggguagaaagccagcugcagggcagccuccagcuccugcacgagggugcuccacugugccaggaggcugcaggugagggcgccaugaacgcacagucu

SEQ ID NO: 16960 - RNA, 15072 nt, Homo sapiens
aaagcucuaggaaucgauuuugcuuuuagagauagacacaaagggcuuauccugguugcaaugggugagcuauugcagaugaccuuuggaggaauugugucggaguguagaauuuucacaguguagcucgccaugcaucaggcacauguagccugugccacaaccauugugcuugggcgggguucuccaugcugcccuguugcaggaggaugcucugccccugcuucucccuauuugucauuuaagaugauuccuggugcuuuuuggugagcgaucaaaugguguucucagaaucuuugggcccuugacaacggagggcuguauucuugggggugugaugugagagcuccuugucugcagggugugaggcuuuggguccugaguguggaccguggcaugugaugucuugucacggcucccugcacggcuguuuaguuucugaaagcuggaaguauaauauuuuuguucuuugccaaaacauacugguguauauaaacagaagugcccaggugagcgacucagcacugcgccuguguuuaugguucugcgucugaccgugugccuuuuaggcugguguagugguugucugaggugggugccugacagggcugggggaccugcugguguccuugcugcugcuuuagggacagcuugaagcaguguccucagauaccccuuggaauugugacaaacucuguaucccucuuacaaguuuuauagaacucuaaccaguugcaaauaacuauuugccauccugaguauugucauuuuaaaauaaaacuauugcgucacucaucugaauaaaucugggaaauugagguagaauaaucuaccauucuucguuaaaaaauuuacagggcugggcgccaugucucacaucuguacucccagcacuuugggaggcugaggugggaggaucacuugagccccgggagguugaggcugcagugagcugugaucgcgccacugcacuccggccugggccagugagcgagacccugucuaaaaaacaauuucauaggcaaguuuuucucucacagaaauuuuauucuuccuuuuucuucuuaagcccauauuuccauuuacuuuuuucccagagcauuuuacccuaauguaauguauuucugugccuaagaaucuuuauugaucuaucauuuaucugcaacgaaagaaaauaacauaaacauaaacuucaacuuuugcauuuuguauggccauaagaugcuaguuauuuauuuauuuuuuccacagguguucaugaccuuuuuuuuuuauuauuuuuuuaacuauacuuuuaaguuuuaaggugcuaguuacuuagaaguuuuuuuagauuggguuuuaaaaaauuaugaguacagaguugaccaaaacaacauaaaauagcauauuauugaaauuuagcucuuaauaagauagcuguuuaguuugaguuaucuuuugaugagucaggcuuuuuuuguuuuuauuuuuugaaaugauucuugcucugucacccaggcuggagugaagugguaugaucuuggcucacugcagccuugaccuccugggcucaagcaauccuccugccucagccucucaaguuggugggacuacaggcaaacaucccauugcucagcuaauuuuuguauuuuuuguagggauggggucucccuguguugcccagacuggucuugaacuccuuggcucaagcaguccucucaccucagccucccaaagugcugggauuaugggugugugccaccaugccuggccgugagccaugcuuuuaaccagaauaaggcaagguucugcaacaguacaauuuuugcuuuuuauuuauguauuuuuuuugagaaaaggucucacucugucacccaggcuggagugcaguagugugaucauggcucacuacaaccucugccucccaggcucaggccauccucccgccucagccucccaaguagcugggaccgcagguaugugccaccacaccuggcugacuauuuuuauuagagacgguguuuuuccauguugcccaggcuggucucaaacuccugaccucaagcaauccauccgcuuuggccucucaaugugcugggaugacaggugugagccacuacgcccggccccuauuuuuacuuucaguuuuaagugcuaagaagucuuauucauucaagucuuauucaaguagcuaggaauggcagaaauuuugcuuuagcaaugcugguguuucaacuuuuuccaagcucacgccugaccucugugcucugucacugagcagcuucaguaggguggccucaguccugugaagugaugcguugacagccaccugcauggggaagcauuucccagucucuggagcaguucccaucguaguguccacugcaugguuuccaguguguugggugagaggcugccuuucuugaaaagugagagaaagggcuguugugagaggggacauggggauggagaaacccuuucucaagcagagccuuaggggcugaggcuccggaagucuacgcuccuaaagcacucugaagccugaggaccccauggauggccauugaguagccccaggggugcuucgcacaugccgguacuugaccacugcuuuaaacccaugugcacacaugcacgcucacacacaugcacgaugcagaagugcauacacacguguacaugugcacacugacacaugcacguugacacguguacacccaaucgaaugugcacaacuacccccacagauagcacacacccacacaaucgaaugugcauacacccacagauacacacacgugcacacccguacaaucgaaugcacacauccgcagauauguacacguggacacccacacgauugaaugugcccccccacagauaugcaccuuugcacacccacacaauugaaugcacacacacccccccacaggcacacgugcacacccacacaaucuaaugcacacacacccccauagauaugagcacguggacacccacacgauugaaugugcauacacucacagauacgcacacaugcacacccaaucgaacgcacacacaccugcagauauguacacguggacacgcacgauucaauaugcauacacccacagauacgcacaugugcacauccacacaaucgaaugcacacccccccgcagauaugcacacgugcacacccacacaguugaaugugcauacacccacagacacacaugcacacccguacaaucgaaugcacacacccgcagauaugcacacguggacacccacacgauugaaugcgccccccacagauaugcacaugugcacacccacacaauugaaugcacacacacccccccacaggcacacgugcacacccacacaaucuaaugcacacacacacccauagauaugcgcacguggacacccacacgauugaaugugcacucacagauacaugcacacccaaucgaaugcacacacacccgcagauauguacacguggacacgcacacgauugaauaugcauacacccacagauacacacacgugcacauccacacaaucgaaugcaccccccccgcagauaugcacacgugcacaccggcacaauggaaugugccccccccgauugcacacgugcacacccacacaauugaaugcacacacacccgcagguacgcacacaugcacacccacacaaucgaaugcgcacacaccugcagauauguacacaugcacacccacagaaucgagugugcacacacccauacauaaugcgcaugcacucacaugauugaaugugcacacacccagagaugcacacacacacaucuaaucagaugugcacccccacacagauaugcacaugugcacacccacaggaucgaaugugcacgccuaaucagauguguacaccccucccacauauguacacaugcacacuaacacaaauguguacacacccgcagguauguacacaugcacaccuacacagucgagugugcaugccccccacggauaugcacacgugcauacccacacaaucccauauacccacccccacaaucacguguacacacccccgcagauaugcacacacgcacacccacaggaucgaaugcgcacacacccacagauagcacacacgcacacccacacaauugaaugcgcaccccccacagauaugcacacgugcacacccacacaauagaaugugcacacacccgcagagaugcacaagcgcauacccacacccgcagacgugcacaugcacacauccacacgaucaaaugugcacgugcaucugcagacaugcacaagcagacaccuacacgcacucgcagacaugcacacccacaugggcgaaugugcacaccccccccacacagauagcacacguguacacccacacaauugaaugugcauacacgcacccguucacagguuaaucgcugccacagcuaucagcucuuuuucauugacuguuacggcaaaauauucuaaaggauaacauagauuuauguuuauuugcauuuuauguuuccuuaugguucauaugaguuuauuggaaaauuagcaacauacacaucauuuuggggaauggaaagugaggcagaguaagccagaacauucacuguaacauuauaagcaaguagaauaaauugauaauaccuucaccaguaaugcacuuucccuaguggaaauaaauuauuuguauaaauagccucuugauguuuguguguuauuuaguuauacaaaucacauuuuucuuuuuuacauauggcacuuuaauguuaguacugaaaauguuuuuucugacauuuuuucaguaauugucauuuacaucaaauaugcagcuagagcuaauagaaaaacaguuaaaacaauuuguuguaauggugagauauuuauaaggaaacauuuauaaaagaucuucuguaagacagcuuagacuugaaaauacauaucagucuuagagucauucagguguuuuuacaaccaaaaguagaagcaccuuuuaauauucaugcuuaauauuuauaaaaacugaauuggaggguuuuuuguuuguuuguuuguuuguuuuuuugagaagcagcagcugcauuuguaaaaaugugaaagugccaguucagagguguuguagcuugccaccuuggaaggcguguguguggccguagcucugugaacacacgugugaacccggcguuaggacacccgggcccuccuucguagugugaacacucuggccguguccugcagcuucgccuucuuagcuccuugcugggauuuuccagcaucccuuagacuuguccucuuuuguccuuugggucugaggucacacugggccucuuggcucuccauggagcucagugugggugugucuugccggcaggcagguuccggggccgcagcauccccaucgcccacccggauguuccuggggcuguaggccgccagcuggcacagggccacggcugccgucugcuucugcuccucgcugcuguccaccgcgcaugcgucuggagccuccucgccggggccuguggguggggccccgucaccgucgaggcugccuggcuuggucucaggguggcugggcccauccucagaaccuucugucccagucuucuguggaacagcagcagcagguucugcagcucguggucgaccggggaaggcaggccucggagccuggguguuacagggguccuucaccgagagauugaguggaagguccugcagcucugagaagcuggcgguuuccgccugggggcugccuugguacguggguucguggguggcugccagguuuaucucugauuucuuggagagguugagggggcccaucccggagcugucguccggacuggaaggcgcggccuccgagacgagagaggcgcuuccggucggagcaggagggucuccguucacaacauugaggcuagaagaagccaagaaaaagcuuaguaggagcuugcuuagaaaagcaacugcgugaagcagugugagcaaguauaagccuggcucauggaacccaaccagaaacauucccuuggagguuuugaaaaugacauuuucuuaccuuacuggagacucugcuguggucucagcagccugggcagguaggcauucugugcuuuucuuaacaggccugaaggcugugaggcuuugcucuggcggguagagucuucccagugcgcuggaggcugccuuguuggagaggucguacaggccuucgcaggucuggcucgucugcaugaagucgguggggcucggccucccuggggagcccguggcugcacucccugcgcgggggcucauuuuggacccuuccgugucucucugcccagccuuggaggagucuuuagccucaggaauuggacuuucgaacucgacguguuuucuguugggguccgaaggguuuaaccuggaaggacucgaggcuggauagaccaggguggcuucuucaagcaggugagagcucugaucucgggugaggccagugacaggugggagucugagaccauaggaggaaaaugcagacucuggccuguaaaauccguaaggaaucggcagguuagagggauauugcuggaaaaaccuguagugaucguauguggcuggagauggagccaggugcuuagggaucggccccgggugaggcaggaagugucucgggucuuggguuccguagacugacagcaggggugcgucacacucaggcgagcucccagccagcagguaaggcgaguagaugguggccagcccgugcucuguguaaaagugaggcggguacucugggauuguggggugcauguaaggggaaauggccccaagccccuuuguagaugagauuuuauguggaaacucugguggaaggaaaggugagccggcuuuccagggguagccaggaguguggaaggccgacuugguguggaaagacacggccuuggcagugggguuguguaaagccagugucucgggcgccucggcguugucuggccccuugagucugugcucgccgacuggaacaaaugcagaaggccgagcugcgccuuccagagcaggcugggcaccgagggcggcuuccggagcugggcucuugcagggugaugcccuguggagggcuggcuucugucccaggcaccuguggguuccccgggcuugcagcuccagguuuuccuugaugucuucccuggcagagcugugcugaagcuucgagucgaaggcagagaguccauuugcgacagacuuggaagaggcuggcuucgccguggcaucgggcugguugguuugcuuggggucuagugaguuagauuuagggcacuugggaacucgauccugcucugauacuaaaguaaucgaguuuuuacaaagaccauacuucaugugauuaaaaagaugugacuucucauugcaaguaaagggacauuggaaacauuuauacuugaagggcuuuccuggaggccuggggauguaauguggcuuuuuuggcuuccgcucuuugaggagacucauuuuccuccuuaugccuuggacucuggcuguccagguggcgugaucacugucgacgccgcgugcacuucgugguuucuaaagaggcaccucccgcuuugcuuucuuucccgaucacuucuaucagaagccagcucugcgugcugagggucuggcgagagccuccgucaucuggcggcugggagcuguaauaaagagcagucuuggugucaggacagcgagugaggggucggcgagaagccggccucggcucgccacagugccacaggaucccugaagcagaaccccugaagggcugaaacugccugcuccugaggggagcagcugccggucacagaagcagcccugcccuacccuugguaaccuggcugcugacuccccaccguguuuucuguuuucugagucugaucugaaagagucaccucggggccuagagguggagugugguguguggugcguugagugucuguucugagaaugccuguaagccuuugaguuuugggaacuuucauccugugaccuggaccuuuccucgaaagcgcccugccgggggcugaggacaccgagcccccucccagggucuggacagaguccugucccagggcugcccgacucugcuuggggguuacacgcuugaagcagugggugugugaucggccacacucucacgugaaauacgaagggguuuguggcuguuuccccuuaacauguacccacagucacagagugccccucacuuuuacacagagcgugggcuggccaccgucuacuugcuccuaccugcuggcugggagcucucccaagugcugugcgccccugccgucggccuguagaacccaagaccauggaugcugcugccuccccuggggccgaucccuaagcacucguggcaguuucugcccacuuuagccacgucguugguguauucuagugugcuuguuuaaaaaugaagaacauucgaacacaagacucuacccuacugcuucuaaagucagcuuuaucauuaaguagcauuuauguugucucagauaugaauacaaaugcuauauuuauguugacuuaaaugguugaaauacuguuggugaauuuguacauccugugagugacagcagcauugugagacaugcuuucacggucacccgguuccugcuggccaggaggcauggccagcagcgccugcccguccagaugcaccaccaaauggaagaaccaaagcuuugccacacuccugcccgagaggagaccagagugaguaguauccgcuuuagagaugguugggucaugggaggaagcuguccuggcccuuaaccuuuagggaguggguucagcccucuggccacacccacucagguccugggacccaccagaggcugugugugugaugucagagcuggccugcucuuuuggauucuuccagagggucucugugucccccuuaccagccucagguuuccuucagaggcugugccgcacgcccaaggcugagaacaaaggcuguuuuucuuuuuuugagacagaguuucucccuuguugcccagucuggagugccauggcgcaaucucagcucacugcaaccuccgccuccuggguucaagcgauucuccugccucagccucccgaguagcuggaauuacaggcgcccaccaccaugcccagcuaauuuuuuuuguauuuuuaguagagacgggguuuugccaugugggccaggcuggucucgagcuccugaccucaggugauccaccugccuuagccucccaaagugcugggauuagaggcgugagccaccgcacccgucccagaacaaaggcuuugagagucugggacuguccaccuggcagcugggccuggagcgacucaagcagcaacugugccugggagacagggugagugggagaugggguggaggugcaauggaucaaggcuaagcacuuuaauucguauuaaaaauguaaaaaagaaaaggucuuuagggucuaaauauuuucaaacagcuuaaaaauaaaguuaaaugacccaaaugccuaucagugauagacugaauaaagaaaaugcggcacauauacaccauggaauacugugcagccauaaaaaggaacgcgaucauguccuucgcagggagaaauggauggagcuggaagccagcauccucagcaaacuaacgcaggaagagaaaaccaaacgugcauggucucacccauaagugggagcugaacagugaaaacacauggacacagggaggggaacaucacacaccagggccuguuuaggggugggggucggggggagggagagcauuaagacaaauagcuaaugcaugcagggcuuaaaaccuagaugaucgguugauggguacaguaaaccaccauggcacacauuuaccuguguaaccuacacguucugcacuuguguccuggaacuuaaaguauaauaaaaaaaaaauacauuaaaguaaaguuaaauggagggcugggggccguggcucaugccuguaaucccagcacuuugggaggccgaggugggaggaucccuugagcccaggagauugaggcugcagggagcugucaucccaccaccgcacugcagccuggugggcaacagaaugagacccugccucaaaaaaaagcuaaauggaaaugacuuaagaaaacuguuucaacugcaguauuuuuuuuaaggaaugggcagaugugcccauucuugagucugugagguuuuauguguagacaucaggguggcuaaaagucaagugaaaagccgccccuugaaaauagagcaacgugugugggagccuaggaggcagcugucccugaagcaaggcgccaccccuccucccugcacccguguccuuccucccacacgccaggggccaggggugguggcugggcuuucauauggcugccccgaacucuggggaagugcucugauuuuguucucagcaaacugguuucucuacugauuuauucauauuucuuucuuucuuucuuuuuugagacggaguuuuggucuuguugcccaggcuggagggcaguggugcgaucucgguucacugcaaccucugccuccuggguucaagagauucuccugccucagccucccuaguagcugggauuacaggugccuaccaccacgcccagcuaauuuuuuuguaauuuuaguagagaugggguuucacuauguuggcccggcuggucuugaacuccugaccucaggcgaucugcccgccucagccucccaaagugcugggauuacaggcaugagccaccgugccuggcucauuuauuuauaauucuuaaaaacacaaccacccuucccccuacaaacugccucuauuaacauacuuuaaguucuuuaagacauuuauuuacuaagaagugguuuggguagaaaaggggcucugcugaccugccaccuucgcugugaugaguuucuguguagcagggacagcgaggcacgguuuggaugaggacaagauguuuguuacccuacaaccagggagggugucgggugacacccugggcucagaccccgcgcucagcacccgucucccaccgugggcugccacagaagcuacaaggcaccgggucaaggccaagcaaaugaaacacguaaugauagcucugucuuucuaauuucccccuauuagaagaaagaacgugaaauaauucuuuaugggcucagucccuaccguguggggcagaccugcucugggugaugaaagcaguuucccugccucccuucaggaaguagagaagccgggugccugguuccagccaaacgcugggccagccagcucagucaguggggccugugccggcaugccucgccgcgcucccugguucugaaggcgugagaaccucugcaagucagguucccaugauuguauaggauguguuacggcagggaucugaaagcugaugauuucaucacuagcuggaagcaucaggaucgaaacgaugacaguugcaaaauguucaucaagugagagcugcguccucgcgagaccgaaacgccgccucuagcaccugaaacacaagcccucagaggagcagaugauucccucaggauuuaagaaaauugaggacuucaguuuucgaagccgcauuauuucacauugcugauaccucuagcgccugaaacacaagcgcucagaggagcaaaugauucccucaggauuuaagaaaaugaggacuucaguuuucgaagcagcauuauuucacauugcugauacuuuuaggcaaaaaaaaaaacaaaacaaaacaaaaccaaaaaacaaaaaaacaaaaaaacccacaaaacccguguugguuagauuuucucaaaagcuuuacaacaggcagguuacguguaagcucugcuguugcccaaaauaguaauuagggaaauaauugcuuuuaaaugaauaugucuguuuucuagucagauuugcccuuuuguucuuugaucaguuaguucacguaagcggguguggcagggaggaagccccugguggugagaguguuuggagcucaauugcucgaagggaauuggugucgauauggagucucgggcagugguuuuaguaaccuuggauaaaccgaccucucaggcuugcacaauuugcuaauuaaaacagggagcacagcugcuucaguuguaagccgggcguaggucaccugaucuguaaaacuacaauagugucagagaaguaagugggauaacauuguugcuuugguaagcuuucaaaugaugaugaugucagccugugaguucuguguccugcuuaagugagguuuauaaggaugaagaaaccaaacccgacggccaguaccucaggcugucacagcugucugugggcacagcguuugaaauagucucuguguggucaguuucuaccagcccgacuuuguacucuggcagcugcugguguuaaauauucccaaaagaguauguuguugcccaaacaguguaacccagaaaucuagcuguuuacaguaauuuggauuuguauuuagaggugcaguuuuucucuagaggggauaaagaagugcggagcgucuuucucuccugggggagguguguuuccauuuuaguuaauaacaugcccggagagcugucugucugucuguuaauaaagcagagucucauucauuaucugcuuucauuugagaacugcagugcuagcguguuuuacagugaagaccucggugugauccugaaggaggguuucauccuccucucauuucccacuggaucggcaggaagcguuagcaggguggacaugccacagagcuuccagaucuggaucaaagguggcuguugcugaaauacuuaugcagagucuucccugacugcugcuggcuaaugugugcccucuucuccaacacaccuccuccgagccuggccuggcacaaagccuucuuucuccaaguuauuucagaucaagcagccaauguagacagugucuacacuaaagggcguaagaacaguggggugcaguggcuucaaacaugcucaggauccagcugagcuuucaccaggcuuuucuugccauauuuacagaugccacucugugccuuucuaaauauuuuaaauguugugugcucagccgaugcacuuggcuucuggaaagugcgcugagcugagagcucgcuucucuuccugcucaacgugcacugggccggguguuggggcguagcugcccacacagacagugcuuugaagagugagugguuucgguuggccaugggguugugucuaaauugccaauauacugucuuuccaaagguuccuaaguguggacaguuaaugcagcagacaguuguuaggguaauagugagaaguugggaugcuuaacaagcuucuaaggaguuugaacuuugaaaaauagacaagagaaagaguucuuaaaaaaaaaaacuuugauaggacacagcggaaguaauuacaguuuaacuuuaugggacguuucugugacaggcuggguaacuaugcuugucaugcguccuaaccugugcccugagauugugcuguaauguuccuuuuggugguguccagcugucuggcaaggagccugcucggcuggagcauugugaagggcaugcuguaauuacaauauugugauguggcguuguugcauaacucaaggacacaccauugucgccuacccacugugaugucgcaagaacgagauuugugaguuuuacuccaauugagcuuuuccagugauugacugccacucccucccagccuuucgguucuuuaaaaugaaagauaaaccucaggacaaccaagaccuggggaaaagacagucuuugggaauguaauuuggaagaauggauccagaaaaacaaccaggggcucuuaacucuaguuucggcaggagaucccgaguuacagaccugagcucguaaacaaacgcucaccacuuuacagucgccgccucauccugaaacuccggucagaaaugcuggaaggccuuugcuaaugcgcagugaaaauuaggggcacagauguggacggacugugcuuggucaguaauuguucuccuccaaaucaaguuuaugagaaauuucauauaaggaaaaaaacccuuuuguaucugugucuauauguacagaagaccuuaacaaccaaacagaaacuuaaccccuuugguuugguuuuguuuucgaaagcuuaugcccaauuuuaaacuucauguaagcuuauguacuuauuuuaaacuuuaaaacuauuaaaaguuaaacuagauaguaaauucggcacugucuaaugugcauacaccacaaacauauaacccuaaauucagcugugucuaauguguauacaccacacauauauauaacccuaaauucagccugauguacuuauaccacacauauauaacccuaaauucagccuaauguacauauaccacacacacauauauauaacccuaaauucagccuaauguacauacaccacacauauauauaacccuaaauucagcccuaauguacauacaccacacauauauaacccuaaauucagccuaauguacauacaccacacauauauauaacccuaaauucagcccuaauguacauacaccacacauauaacccuaaauucacccuaauguacauacaccacacauauauauaugacccuuaccucuuguuagcauuuauuguaguuuguuuuugagguuaggagcaguuaagcaauaauaugaauuuguguugguuuaacuuuuaugaauuuuagggcagaacaaggaguuaauuuccagauaagcuuguucauguucuuagaauaaagugucagccucauuagaaguuuuguaaucguggucugcaucccagccaugcaccugcuggguccugaguaauccucggagcccagagcaaggcagagcagacacggagcaaacgcugcguucagcuggguauuuuagauacgucugagaagaguuuuaaaauaaaacuugaauuugaaaagaaauagugaguacuuaccagaggugggcagugcugggauguggccggucuuggugccgguggcuggcggugcucaggaagcaguaccuguucucacgcuugcugggugaaacuggagccugcu

SEQ ID NO: 16961 - RNA, 737 nt, Homo sapiens
uuccgggucagagccauggugguggcaacuucaagcccugcuaaccccaugguguucuuugaugucagcaauggcagucaggaaguuggccgcacaaagaucgagcucucugcagacguugugccuaagacgaccgagaacuuuggguaguucugcacuagagaauucagaaaagaugggguuccaauaggauacaaaggaagcacuuuccacagggucauaaaggauuucaugauuuaggguggagauuuuguuaauggagaugguacuggagucgccaguauuuaccaggagacauucgcagacgaaaauuuuaaacuuagacacucagcuccaggccugcuuuccacggcaaacagcggucccaguacaaauggcugucaguucuuuaucaccugcucuaagugugauuggcuggaugggaagcauguaauguuuggaaaaaucacugauggacuucuagugaugagaaagauucagaauguucccacaggccccaacaauaagcccaaacuacuguggugaucucaaagugcggggagauguaguccagaccaagacugaauuaggccuucccuucuuggugguguucuugaguaagauaaucuggacuggccccuguguuugcuucccugccugcugcugccccauuugaucaagagacccuggaaguacuggagauucagaauccaagacuguguaaauaaaguuuuuuuguauguggaaaaaaaaaaaaa

SEQ ID NO: 16962 - RNA, 6402 nt, Homo sapiens
ugaugccugacauucgaauucuguaaggaaaagggugaagugggacucggaaguccucuagcccugagaaguccagcuucgguggcuaagagaagagcacagcuuaggagucagggauacauuuguccaucagaaggcagaauggagaccagcugcuacucucaugagaccuccuggugcuggcagacaugagcccaggaagccaugucuuuuuaaucaucuuggagacucccaggcugcccuugcccugguaccaucugggcuccagcccuagggugcuggaugcuccagcuccccaucuuuaguacuuagcugggguuguuccagcuugggcccaagauguaagagcucaaaacgcugccaagaacugaugaagcagaauccgaggcugugagcaacuugcgggggcagggggaggcggauccagagggagaggcacagagcugcaggcucucugggcacaaaggggugucggcuuggagcuaggguuaaccagaggggaaacugaguaacagcacagcaggagccccuuuuguacacccccagucccugcuaugugaacccagggucagcacagcucugugggagggagcccucuuuacuagccauuuauuucagacugaaguuucuuucuuucuuuuuuauaaaaccuuuuuucugguuauaaaauaauacauacuaaucauagaaaaguauagagaagagaagauuuaccacuaccaccaccacuaccacuguuaucuuuguuaucaaacauaacuguuauuggcauuuugauguaauuccuuucuucugugcauaauauauaacagaauuaagaaccuauugcauauuuuauuuguauuggcuuuuuucacauacauucuaugcauuuuccuaugucauuaacucuucauaaacauguugaaugguugccugauagacuaucauaagaccuuucuaaacuagugacuauuagucauuuaaguuguuuccaaauguuuugcuuuuuuuuuuuuuuuuuuuuuuuuugagguggagucuggcucugucgcccaggcuggagugcaauggugcgaucuuggcuuacugcaaccucugccucccggguucaagcaauucuucugccuuggccuccugaguagcugggauuacaggcaugugccacuaugcccggcuaauuuuuguauuuuuaguagagacaggguuucaccguguuggucaggcuggucuugaacuccugaccucaugaucuacccgccucagccucccaaaaugcugggauuacaggugugagccaccgugccuggccaaacguuucacuuuuauaauaaugcuaugaugggcaucauuguaugaaauauuuuacuauguuucaagucauugccaugaguggaaucaaugagucaaaagguaagaaauaaaaggcagccagacacaguggcucacaccuguaaccccagcacuuugggaggcaaggccaguauauagcuugagcucaggaguucgagaccagccugggcaacauggcaaaaucucaucucuacaaaaaauuaaaacauuaggccgggcgcggugacucacgccuguaaucccagcacuuugggaggccgagguggguggaucaccugaggucaggaguuugagaacagccuggucaacauggugaaaccccgucucuacuaacaauacaaaaauuagccaggcaugguagcaggcaccuguaaucccagcuacucgggagguugaggugaaagaauugcuugaacccaggagguggagguuacaguaagcggagaucaugccacugcacuccugccuaggcgaaagaguaagacccugucucaaaaaaaaaaaaaagaaagaaauuagccagguaugguggugcgcaccuguagucacagauacucaggaggcugggguggaaguacugauugagccugggaggcaaagguugcagugagcugagaucaugugagaucauggcacugcacuccagcccggaugaaagagugaaacucugucucaaaaaaggaaaugaaaggcucccaauuugccaaaauaacugcccccacccccugcccaugcgcaagccgcaggagaaugccacucucacagugccuguggcaguauugaggaucucauuuuaaacaucuguucuaauuuuaugacuccaaaaaauccucacauuuuguagcuauuucaauucaaauccuuuugugauuauuggagaugagcaguuuuucucaagguugaguugccaguugcauuuuuaacuucguuuuuuuuugagacggagucucgcucugucacccaggcacgaucucggcucacagcaaccuccgccucccggguucacgccauucuccugccucagccuccccaguagcugggacuacaggcgcccgccaccacgccuggcuauuuuuuuguauuuuuaguagagacaggguuucaccguguuagccaggauggucucgaucugcugaccuugugauccucccgccuuggccucccaaagugcugggauuacaggcgugagccaccgugccuggccuuaacuuugguuuuaacugggguugccagggugcuacccugggucuuaccgaggaacuguggcuggagguggcagcagccuaggagaaacaggauacccuggcccagaaacuuuuagggccacuggcgaugggcaaggauucccuggaagcaccuggccacgcuguccugacccugaccacauucaagacccugagcuggcagcuguccggacuugggaaugaacgaucaggaauacuguccugcugacucuucuuaguuccaguuuaaaaaggcacucccuaaccaagggacaagugacacacauccccagcaugcuggacucguuugucccguccaagugggccuggcuggcaggaaacaacgccugguuggcagaaaaacuucuacccagggcucccuuauguguacaugugaauuaaucuuucuucuuuuccuaacuaccuugcacuccuucaccuucagucuccccagaaucccuuccacaaaugcacgauucauucugugacacccagagcugaccgugccuuucaaaagaaguucagaaagaucaggccuggagggggaggaagcuucuuacucuuccuauucauuuauuuauuuauuuuucgacacggagucucacuccguugcccaggcuggagugcaguggcacaaucuuagcucacugcaacuuccaccucccagguucaagugauucuuguaccucagccaccugaguagcugggacuacaguugugcgcuaccaugccuggcuaauuuuuuguguuuucaauagagacgggguuucaccauguugaccaggcuggucuugaacuccugaccuuaaguaaucugccugccucagccucccaaagugcuggccauauaggcuuuagccaccacaccuggcccuuacugcuccuuuuuuuuuuuuuuuuuuuuuuuuugagacagagucucgcuguguugcccaggcuggagugcaguggcacuaucucggcucacugcaagcucugccuccggguuuacacaauucuccugccucagccucccgaguagcugggauuacaggugcccgccaccacgccuggcuaauuuuuuuuguauuuuuaguagagacuaaauagggguuucaccguguuagccaggauggucuccaucucaaucuccugaccuugugauccgccccgcucggccucccaaagugcugggauuacaggcgugagccacugcgcccggcccuacugcuccucuuaaugggcacaguggagaucuacccaugaccaagggccccaugaagucucugaauccaaggaaagaucagauaauacugauccacugacccugaggaaucacacacacacacacacacacacacacacacacacacacacacacacacacacacuugcaugcacaggcccacugcuggacccaaggguguuacuggaaagggcagucaauggcauucagaggcagccucuggguuccuagaccaaaaugaugcuauguguguggacagcccagcacagcugccaccgggucagcugagucuaaaaaggcugagaaugaacaacaggagagaucucagggaaaaaggggugcagggaggggacggaagagaaaggcaagaagaggaggaaggaagaaaauugacaccagaagaucccuccuccacccucucucacccacaggccuuccugucaugggugaccagcgccagccuguggguguaauggcacugcugguggcugggagccaaccucagcagccuuccuccugauguucaggaaacuccugauccugcuggaacacagugcugaccacaucacacacuacagaucauguguaugugcacaugugucugugugcaugugugcgugugugcacgugugugcaguggcaugaguggcccauccacucccccaccacccugggacagcuuggcagggccugcgugggcagcauguguuacagacauauguggccaugguccuauaccuccccuaacaccugcuucuggacaugcccccacagcuccagccccucuggcucuucauagccauuuugcaaugguggugacucaggaagcuaauucugggagaggaugaggggcuccuuccucccauaccccacucuggccucaccagaggcacucaggcagggcagcugcagaguccacaccuggcuuaugagagucucggggacugggggaacccagacaaugccacacaguugcaccgggcccugcccaggagucggucuacugccuuggaagcauauauucauuuuaauuucuuugugauuaauuguuuuuuuuuuuuuugagacagggucucacuccgucacccaggcuggagugcaggggugcgaucauggcucacugcagccucgaccucccaggcucaagagauccucccaccucugccuccuaaguagcugagaauacaggcacgugcagucaugcccagcuaauuuuauuuuuuguggagguggggucucauuauguugcccaggcuggccucaaacuccuggguucaagugauccuccugccucagccucccaaaguacugagauuacagacaugagccacugcaccuggucaauuucucugugauuuuauuugagagauuuugcuucuauguccaaguaugcuucugugagcuaaguguuuuuauaaauuggaguauguguauguaaaagcguaucccguaaggcaagaugcuugucugaggguguucauucauucuguuauucacucaacaagaauuugucaagugccacugcucuccaggcaguguuagugcuugggaugcauccgugaguaaaacgacggacccugcccucacagagcuuacaucccagugggaagagacagguggugaacaagaaacacagagaguaauguaugaaacauguuaaaaggggaaagaaaccccggcagagugagggaggagugggcaugugggggugugcagggcagcuucacugacaaggggacauuugagcaaagguuugacagaggcgaugcagugagccaugcagaucccuggaggaagcauucccagcacaagcacagacugugcaaaggcccugaggcagugucuguggugugcuggaggggaacgagcaagcaggagggccaaggagauggaguggagaaugcagcugggaucagccaaagugugaacuuuggcucuuuauugguagguguagauuuugaugguuaauggugaguggguguguuucuggaguauaaaugcauauaauucugaacaaaagaguguauggagggcuguguguguguacacauguguguucugucacuggcucucaaauugggcucaaaggacuguuaucuuacauugagccccuuugucuggcccaagcaguuuuuccuuuagaaaccacaugugggggccggguguaguggcucccgccuguaauccuagcacucugggaggccgauguggguggaucaccugaggucaggaguuugagaugagccuggccaacaugguaaaaccccaucucuacuaaaaauacaaauauuagccgggcgugguggugcacaucuguaaucccagcuacuugggagccugaggcaugagaaucacuugaaccugggaggcggagguugcaguuagccaagaucgcgccacugcacucuagccugggcaacagagugaaacucggucucaaaaagaaaaaaaaaaaaaacagaaaccacauguagggagcugggugcuggcccaccugcccggcaacaucagagcagacacagauacuaacaaaagcagacacgcaauggcagguuggaaguuaucuacaggacccaccguugcuucugcuguaagcugaaccaacuacccuugccuuccccu

SEQ ID NO: 16963 - RNA, 6402 nt, Homo sapiens
aggggaaggcaaggguaguugguucagcuuacagcagaagcaacgguggguccuguagauaacuuccaaccugccauugcgugucugcuuuuguuaguaucugugucugcucugauguugccgggcaggugggccagcacccagcucccuacaugugguuucuguuuuuuuuuuuuuucuuuuugagaccgaguuucacucuguugcccaggcuagagugcaguggcgcgaucuuggcuaacugcaaccuccgccucccagguucaagugauucucaugccucaggcucccaaguagcugggauuacagaugugcaccaccacgcccggcuaauauuuguauuuuuaguagagaugggguuuuaccauguuggccaggcucaucucaaacuccugaccucaggugauccacccacaucggccucccagagugcuaggauuacaggcgggagccacuacacccggcccccacaugugguuucuaaaggaaaaacugcuugggccagacaaaggggcucaauguaagauaacaguccuuugagcccaauuugagagccagugacagaacacacauguguacacacacacagcccuccauacacucuuuuguucagaauuauaugcauuuauacuccagaaacacacccacucaccauuaaccaucaaaaucuacaccuaccaauaaagagccaaaguucacacuuuggcugaucccagcugcauucuccacuccaucuccuuggcccuccugcuugcucguuccccuccagcacaccacagacacugccucagggccuuugcacagucugugcuugugcugggaaugcuuccuccagggaucugcauggcucacugcaucgccucugucaaaccuuugcucaaauguccccuugucagugaagcugcccugcacacccccacaugcccacuccucccucacucugccgggguuucuuuccccuuuuaacauguuucauacauuacucucuguguuucuuguucaccaccugucucuucccacugggauguaagcucugugagggcaggguccgucguuuuacucacggaugcaucccaagcacuaacacugccuggagagcaguggcacuugacaaauucuuguugagugaauaacagaaugaaugaacacccucagacaagcaucuugccuuacgggauacgcuuuuacauacacauacuccaauuuauaaaaacacuuagcucacagaagcauacuuggacauagaagcaaaaucucucaaauaaaaucacagagaaauugaccaggugcaguggcucaugucuguaaucucaguacuuugggaggcugaggcaggaggaucacuugaacccaggaguuugaggccagccugggcaacauaaugagaccccaccuccacaaaaaauaaaauuagcugggcaugacugcacgugccuguauucucagcuacuuaggaggcagaggugggaggaucucuugagccugggaggucgaggcugcagugagccaugaucgcaccccugcacuccagccugggugacggagugagacccugucucaaaaaaaaaaaaaacaauuaaucacaaagaaauuaaaaugaauauaugcuuccaaggcaguagaccgacuccugggcagggcccggugcaacuguguggcauugucuggguucccccaguccccgagacucucauaagccagguguggacucugcagcugcccugccugagugccucuggugaggccagagugggguaugggaggaaggagccccucauccucucccagaauuagcuuccugagucaccaccauugcaaaauggcuaugaagagccagaggggcuggagcugugggggcauguccagaagcagguguuaggggagguauaggaccauggccacauaugucuguaacacaugcugcccacgcaggcccugccaagcugucccaggguggugggggaguggaugggccacucaugccacugcacacacgugcacacacgcacacaugcacacagacacaugugcacauacacaugaucuguagugugugauguggucagcacuguguuccagcaggaucaggaguuuccugaacaucaggaggaaggcugcugagguuggcucccagccaccagcagugccauuacacccacaggcuggcgcuggucacccaugacaggaaggccugugggugagagaggguggaggagggaucuucuggugucaauuuucuuccuuccuccucuucuugccuuucucuuccguccccucccugcaccccuuuuucccugagaucucuccuguuguucauucucagccuuuuuagacucagcugacccgguggcagcugugcugggcuguccacacacauagcaucauuuuggucuaggaacccagaggcugccucugaaugccauugacugcccuuuccaguaacacccuuggguccagcagugggccugugcaugcaagugugugugugugugugugugugugugugugugugugugugugugugugugugugauuccucagggucaguggaucaguauuaucugaucuuuccuuggauucagagacuucauggggcccuuggucauggguagaucuccacugugcccauuaagaggagcaguagggccgggcgcaguggcucacgccuguaaucccagcacuuugggaggccgagcggggcggaucacaaggucaggagauugagauggagaccauccuggcuaacacggugaaaccccuauuuagucucuacuaaaaauacaaaaaaaauuagccaggcgugguggcgggcaccuguaaucccagcuacucgggaggcugaggcaggagaauuguguaaacccggaggcagagcuugcagugagccgagauagugccacugcacuccagccugggcaacacagcgagacucugucucaaaaaaaaaaaaaaaaaaaaaaaaaggagcaguaagggccaggugugguggcuaaagccuauauggccagcacuuugggaggcugaggcaggcagauuacuuaaggucaggaguucaagaccagccuggucaacauggugaaaccccgucucuauugaaaacacaaaaaauuagccaggcaugguagcgcacaacuguagucccagcuacucagguggcugagguacaagaaucacuugaaccugggagguggaaguugcagugagcuaagauugugccacugcacuccagccugggcaacggagugagacuccgugucgaaaaauaaauaaauaaaugaauaggaagaguaagaagcuuccucccccuccaggccugaucuuucugaacuucuuuugaaaggcacggucagcucugggugucacagaaugaaucgugcauuuguggaagggauucuggggagacugaaggugaaggagugcaagguaguuaggaaaagaagaaagauuaauucacauguacacauaagggagcccuggguagaaguuuuucugccaaccaggcguuguuuccugccagccaggcccacuuggacgggacaaacgaguccagcaugcuggggaugugugucacuugucccuugguuagggagugccuuuuuaaacuggaacuaagaagagucagcaggacaguauuccugaucguucauucccaaguccggacagcugccagcucagggucuugaauguggucagggucaggacagcguggccaggugcuuccagggaauccuugcccaucgccaguggcccuaaaaguuucugggccaggguauccuguuucuccuaggcugcugccaccuccagccacaguuccucgguaagacccaggguagcacccuggcaaccccaguuaaaaccaaaguuaaggccaggcacgguggcucacgccuguaaucccagcacuuugggaggccaaggcgggaggaucacaaggucagcagaucgagaccauccuggcuaacacggugaaacccugucucuacuaaaaauacaaaaaaauagccaggcgugguggcgggcgccuguagucccagcuacuggggaggcugaggcaggagaauggcgugaacccgggaggcggagguugcugugagccgagaucgugccugggugacagagcgagacuccgucucaaaaaaaaacgaaguuaaaaaugcaacuggcaacucaaccuugagaaaaacugcucaucuccaauaaucacaaaaggauuugaauugaaauagcuacaaaaugugaggauuuuuuggagucauaaaauuagaacagauguuuaaaaugagauccucaauacugccacaggcacugugagaguggcauucuccugcggcuugcgcaugggcagggggugggggcaguuauuuuggcaaauugggagccuuucauuuccuuuuuugagacagaguuucacucuuucauccgggcuggagugcagugccaugaucucacaugaucucagcucacugcaaccuuugccucccaggcucaaucaguacuuccaccccagccuccugaguaucugugacuacaggugcgcaccaccauaccuggcuaauuucuuucuuuuuuuuuuuuuugagacagggucuuacucuuucgccuaggcaggagugcaguggcaugaucuccgcuuacuguaaccuccaccuccuggguucaagcaauucuuucaccucaaccucccgaguagcugggauuacaggugccugcuaccaugccuggcuaauuuuuguauuguuaguagagacgggguuucaccauguugaccaggcuguucucaaacuccugaccucaggugauccacccaccucggccucccaaagugcugggauuacaggcgugagucaccgcgcccggccuaauguuuuaauuuuuuguagagaugagauuuugccauguugcccaggcuggucucgaacuccugagcucaagcuauauacuggccuugccucccaaagugcugggguuacaggugugagccacugugucuggcugccuuuuauuucuuaccuuuugacucauugauuccacucauggcaaugacuugaaacauaguaaaauauuucauacaaugaugcccaucauagcauuauuauaaaagugaaacguuuggccaggcacgguggcucacaccuguaaucccagcauuuugggaggcugaggcggguagaucaugaggucaggaguucaagaccagccugaccaacacggugaaacccugucucuacuaaaaauacaaaaauuagccgggcauaguggcacaugccuguaaucccagcuacucaggaggccaaggcagaagaauugcuugaacccgggaggcagagguugcaguaagccaagaucgcaccauugcacuccagccugggcgacagagccagacuccaccucaaaaaaaaaaaaaaaaaaaaaaaaagcaaaacauuuggaaacaacuuaaaugacuaauagucacuaguuuagaaaggucuuaugauagucuaucaggcaaccauucaacauguuuaugaagaguuaaugacauaggaaaaugcauagaauguaugugaaaaaagccaauacaaauaaaauaugcaauagguucuuaauucuguuauauauuaugcacagaagaaaggaauuacaucaaaaugccaauaacaguuauguuugauaacaaagauaacagugguagugguggugguagugguaaaucuucucuucucuauacuuuucuaugauuaguauguauuauuuuauaaccagaaaaaagguuuuauaaaaaagaaagaaagaaacuucagucugaaauaaauggcuaguaaagagggcucccucccacagagcugugcugacccuggguucacauagcagggacuggggguguacaaaaggggcuccugcugugcuguuacucaguuuccccucugguuaacccuagcuccaagccgacaccccuuugugcccagagagccugcagcucugugccucucccucuggauccgccucccccugcccccgcaaguugcucacagccucggauucugcuucaucaguucuuggcagcguuuugagcucuuacaucuugggcccaagcuggaacaaccccagcuaaguacuaaagauggggagcuggagcauccagcacccuagggcuggagcccagaugguaccagggcaagggcagccugggagucuccaagaugauuaaaaagacauggcuuccugggcucaugucugccagcaccaggaggucucaugagaguagcagcuggucuccauucugccuucugauggacaaauguaucccugacuccuaagcugugcucuucucuuagccaccgaagcuggacuucucagggcuagaggacuuccgagucccacuucacccuuuuccuuacagaauucgaaugucaggcauca

SEQ ID NO: 16964 - RNA, 3088 nt, Homo sapiens
uaucugaaauguggauuuguuuugcuaaguccuggaauguugaaaugaagagcauucugugacauccaagaggugagaguuggaaccaacagaaggaccagugccuacuucgcauuauggggaacgcaccuggcuuuucucacacugagaggcauucgaggcuaaaagaaaaacuaaaaauauuagauaucuuugugggugguucugugaagaagauagcgaguacaaugcaaggcugaugcuggggguggggacgugucugugugucuccugugaagcagacaauggauuugacccauuacauuagacgcggagaaugccaugaugcagccacggugcaacgagcaagacgcagagcagcuauggauccacaggcagaggcacagcccucccacucgacaccagcuucgucuccucuucccacucuuaguggucccccugccccgaccucacuguugccaggauaacaguggcaugguggggcuuggcacuagaagcccaaccccaggccaagaggcaacuggccucuggcucugacuccccucuccccuaccaagcgccuauaagaacagggcucaggguugaugacaccuuguccuaauagcaaaaggucuugggggaaacagugaccaggcuugggcaaagguuacagaggaagaacauucagaaaagcaagagauacaauccaagcuuaggaaauggcagccucccagugucccaagcuccggggcucccaggagaggggccugacgcuuguggucaaugggcgguucuucccuguaagaccggcaugaaggaaaaacaccaucccuaguaacaggugacccugcacguggguuaaagcagaaggagagguggggagaggcagcugugucucugugcagucccccaagaccugaauggaaacccacccagcguccaccucagcugucuccccaggaucccaagggugaagauggggauggcuuucuacccuagacccugugcagucugcccugggcucucccucuacgugcccuggcugcagcauccuccugucugagggugggcacuguggacaguccucaccuccgagggaggaccaggcacagggccaguuaaccacacaggacgcgugugaaggaagcauaggccugccccugucaucccuccaucuucccacauccuccgucaaccauguuccgaucccugggaagugauucugaguaugauucagagaggcucaguuuuguagcuccaccuggcagcaggugugugcugaguggguuuucugggugccgccuguugccagguggcggcuggggugcuuagcaacccucaagguccccaacuaaccccugaaguguggucacaugggaauaaagacaaacaacuccaguucuguccucugggccuccugcucuacccucacaugcccacagagccgggaggcuggaccaaggucagcaugcacccuggcggccccgcaccacagggaagcgccauggcacugccugcgaagccagauauguguucggcagaggcaaagaggacgcuucgcaugccagggcugcaccaagagcuccaaauccacaaggccucagggcagggcaggcuccacuaccucccugaaggagacuggagccagggagguuaaagcagcaaagccacuggaaucugagacccuugccauuacccaaaugcucuguugccucaaugcacccuuugacauguggacaugcucaccccagugaggaggcagaaagggaugccugugcuugagggacugugccgccucacccuccuggaccauggcuggcugcccacccaucugggaguugacugucauuaggaggcuggucaucuucauaacagaagguacaacuucccaggggauggcaagagagagagcgggcucaggucaccagcgcaucccuacaccucacuucacagcagaggaggaagcugaggcccagcgaggagacaccugcugggacagccacauggccagggcugcccuucagccgcacacucuuaaggcagcuuagaaaacaagauaaauagccgagcauggggcucacgacugcaaucccagcacuuugggaggccaaggcaggcagaucacuugagaucaggaguuugagaccagcuuggccaacauggugaaaccccgucuguacuagaaauacaaaaauuagcugugugugguggugggcaccuguagucccagcuacacgggaggcucaggcaggagaaucgcuugaaccugggagguggagguuguagugagccaagaucgugccacugcacuccagccugggcgaaagagugagacuccaucucaaaaaaaaaaaaaaaaaaagauaagagcaccugaccaaauaaaaagugagacauggacccugggcacucaauucuggaaggaggccccuuuuuugcagaggguagauuaacgauuguuuuuauaggagacacucauaauuuuuuuaaauggagaauuuucuuaaaaaagacauuaagcacacauguaaguaagggauggccugcucugacacugaccucaaauggcucuuuggagccacuuccaaaccagguucuguuuccucucauaccaggacugucugcggcccuuuccaaaguguuuuuccaucuauuaucucauuuuuauucucaugaggagcuuuuacaggaggaaagugaaacggggucaugcagccucuaguaccggccugcacucagcuccgaagacccgucagcugauguuucugaaacgucaaaucagcccagagcccacgccacucccaacgucagccccaaugccuugggagggagugaccucuguccuggcuggaagagagaaggggaaggaugcacaggccccagccagcucccauccuaccucaccacccugacuucagccggugccuccccaggggcugggggccagcgugacggcaucuuggagccccaaagggcuucaugguuuuuagacuccccucugccuuauuucaugugauucccaaacuauccccuaacaaugguauuauuuuuaaucccauuuucagaaaauuaaacuaaagaccagagagguaaaguaccaacaccacac

SEQ ID NO: 16965 - RNA, 1433 nt, Homo sapiens
ccgguacuccugcugcuuccuucaacuugccuucagcccuaggaagugggggccccaucaauccggccacagcugcugccuacccaccugcccccuuuaugcacauucugaccccccaucagcagccgcauucucagauccuucaccaucaccugcagcaggauggccagguaauagcccuuccccuucucuccuuucccuuccucuuccuuccuaucccuuaaaacugccuucccuuuccuuuucuuacccuuccucaccaccaccuucacccaaucccuccccagcgccagucaugggcacacagcacauacagacacaagcgcacauaacacgagcggccggcaaaggaaaucucagagaagggccggguugaaaccuuuuuugcccaauuccuuuggugcccuucuccuccugugccacaguuguccucaucccaucagaccugggucacaccuucccucuuuccucucccagccuucccucuucccugacauuuuagcuuucccuucuaaugguggaguucuauugucaaaguuugucccuuuauuuuccauauauccugguucugccucagcuaccauauuugcagaugauucucuguugccagcgccagcaggaggagcagguaaugaaauugaaugaucauaugcuugaacccacuccuuuucaguccccauuucaccuucacagccucagggaacuugaaaagacugcgcggucacaaaucgggauacacaaacacaaacaccuugcugagcucucuggccuccccuuccucucuccuccuccccuccccaacacccucuuuaucuuuguacccuuccccagcuguggaaaacauucgguuaccagaauggaaaagauucuuggggcagcaucuggagccugaggccucagacugccucucauaccugccugaaaugggcucacagaugugaugugugguagggguggggaucuguggggcgaugcaaguggccucuugagagcuccauuauagguggcuggagcuagaauaagggcuuccuuccucaaagacagcuuuccaaauugaggcauuaauggggaucaauggaaaugaaauugccuugugaucacccaucuccaagagcaggggagagaggggguagugugagaauguagaauugaaaaugaguagaacucacucacuaccuugucucuaaagguaucuugcccucuucaucuuuucccuauuuaaaagucaaaaaugccuuccugcuuguaagaaaggggcuuuagcagcuaugcagaccaaauuuucuaugguucuaauaguagugaggggaaugggagagcaagacaguuugcacaucuccaccugaagauguuacaaauuuguaccacuaacuagacaccuuuuuccuccucaugauccucccauuccccugcagacgggcagcgggcaacgu

SEQ ID NO: 16966 - RNA, 1433 nt, Homo sapiens
acguugcccgcugcccgucugcaggggaaugggaggaucaugaggaggaaaaaggugucuaguuagugguacaaauuuguaacaucuucagguggagaugugcaaacugucuugcucucccauuccccucacuacuauuagaaccauagaaaauuuggucugcauagcugcuaaagccccuuucuuacaagcaggaaggcauuuuugacuuuuaaauagggaaaagaugaagagggcaagauaccuuuagagacaagguagugagugaguucuacucauuuucaauucuacauucucacacuacccccucucuccccugcucuuggagaugggugaucacaaggcaauuucauuuccauugauccccauuaaugccucaauuuggaaagcugucuuugaggaaggaagcccuuauucuagcuccagccaccuauaauggagcucucaagaggccacuugcaucgccccacagauccccaccccuaccacacaucacaucugugagcccauuucaggcagguaugagaggcagucugaggccucaggcuccagaugcugccccaagaaucuuuuccauucugguaaccgaauguuuuccacagcuggggaaggguacaaagauaaagaggguguuggggaggggaggaggagagaggaaggggaggccagagagcucagcaagguguuuguguuuguguaucccgauuugugaccgcgcagucuuuucaaguucccugaggcugugaaggugaaauggggacugaaaaggaguggguucaagcauaugaucauucaauuucauuaccugcuccuccugcuggcgcuggcaacagagaaucaucugcaaauaugguagcugaggcagaaccaggauauauggaaaauaaagggacaaacuuugacaauagaacuccaccauuagaagggaaagcuaaaaugucagggaagagggaaggcugggagaggaaagagggaaggugugacccaggucugaugggaugaggacaacuguggcacaggaggagaagggcaccaaaggaauugggcaaaaaagguuucaacccggcccuucucugagauuuccuuugccggccgcucguguuaugugcgcuugugucuguaugugcugugugcccaugacuggcgcuggggagggauugggugaaggugguggugaggaaggguaagaaaaggaaagggaaggcaguuuuaagggauaggaaggaagaggaagggaaaggagagaaggggaagggcuauuaccuggccauccugcugcaggugauggugaaggaucugagaaugcggcugcugauggggggucagaaugugcauaaagggggcagguggguaggcagcagcuguggccggauugauggggcccccacuuccuagggcugaaggcaaguugaaggaagcagcaggaguaccgg

SEQ ID NO: 16967 - RNA, 9787 nt, Homo sapiens
cuucaggaaguucaccuuuaacuucagcauuccagaugaaguuuccugacucagugcuuuugcauaaggaacuagaaaaaaaaaguaaggaaaauuggagaugcuaacauccucccccaucccaacugcaccuuaaaauaugcaugucaccuucaagguuuuauaauugcacuguuuguuuuauguauguacagauuaaaauuauugcuacauuugaggaaaauaaaauugcuugcuucuauguaauuccugucauuccacaggaaauucacuuuuccagcuacugaauagaauuuguuuaacaaccucauggguugccucuucauuuacagggaagaaaugaaauguacaucugcagaaauugccaaagcccaaauuaacgaguauuauaaaaggauaauaaagcaucccugaagccaaagauccucaaagucauccugauuugagccagaccauugaaauuugagaaggucaaacugaagucaugauagcaggccuugagggguucuaacugugacauuaucugaugauuaaagacuucuaggccugcuguuucuugacucagaagaucugguccaggcaguacuucauggccauagaugccaugucucucucuauuuuuuuuaaaauauaucaacauuuaucaauaauagguauugagucuuacuugagaagccuccuucaaugugacaaugcauuuuauaggaauuaggcccuguuguuuguuuuuaaauccuaaauccaccaacuuggcuaaguagggcuaggguguaagaguuacagaggaaacaaacaugaaaugcggcucaacaguuaaagacagauuuauuuuagagaaaauaaaccugagaggggcuucuggcugauuuccaucaggagugcuuucucuuacagaguaagaguauacguugguuuuagggugagggggcuuaucacaagcuuggaauguuuuugugugagggagaaguuuuauggcagggucggaaugucugggcaaaggggagguuaucuuggggcugaugucuuucuggccagagggggguuaucucgggguuagcaugucuuuggcuggggaggaguuuggaguguugcugguuggagauguuauuugugguuuaugguugugcugaccuuagucauuaggcugaugcccuuuggauuuaggcgguuuuugauuaaggugaauuuuagaaugaggggcuuguccaagauggcgaugcuccugcucugucauaagguaaaugugauuccagagggcucaaggaggguguacuucccacacacauuccuagaccuaaauguacacagauuugguaacuguuuucugaagucauauuuauggggggacaaaaccuuuuuuuuccauaguugggauaagauaaaaaugaaacuucccuuagaugaggcugaacauugauuuaaaguuacccugagguguaggggugaggaaaacaaaaacaauugaggacaaagugugauuguuauaaggaaguuucaccuuugugguuucaccuaagguagguuccauuccuaaagaagaccucagaaauggucuccuaggcccugacaaagaaaaagcaaggacaguugucugcuuacaaaggcaguuguacugauuuccugguugacaguaacugcucuucccagaagggcaccuccacuugaauaaagugaguaauucagagcaagcuugagccuugaccauuccugugccccugaagaucuugaugauuuaauuaagcccauaaauuauuuuuauuggagaaaacugccaaaggaagcgugccucuguccagaacccuuucugccagcacuaaauuaguuuucuuucuauauuuucauugcccccagaauucuuaacaagauugaaggaacacaaaguucuggccuuacucacucauucaacacauuguauugucuuuaucugaggaacuggggauaugaaaggaucccgacaggcaugcgcccugcccuaguggagcuuauauucacaucagggggcuuagaucaagauaaccacaacuggauuaauuccaacuguggaauucacacaggagaauuccaaguaggaauuuguaagcagggccucaucuggaggcgaaggcaguuucccuugaggaagcaauggcauucaaagugagguuugcaggugaugaggagguagcucaguggagagccagugaacagaguugugagaggcagcacaugggaaggccuggagacagggaggagccccagagagcugcuuguuuuaaguuguuaacuagcacucuccugagcuggcaucuacauuagaguuacgucagcccauggcuccaggaggaacagcacuaggcauugggauccucacuugaaaauuguuucagcucauaccuaaagucucuuccacaacuagcccuguccugccagaaauacaggcuucuguaucuucuacacaguagucuguagcuggugacaguauuaaaaguacucggagacaauaaguuuguaacaauuucuaaaauacuuuucuggacauuaucucauuuaauccucugcuguccuuguagagaguuguuagaaaauaagcucugggcugggugcaguggcucacgccuguaaucccaguacuuugggaagcugagguggguggaucaccugaggucaggaguucaggaccagccuggccaacaugaugaaacccugucucuacuaaaaauacaaaaaaauuagcugggcaugguagcgugcgccugaguagguagcuacucaggaggcugaagcagaagaauugcuugaacccaggagguggagguugcagugagccaagaucacaccauugcacuccagccuaggcaacaagagcgaaacuccaucucaaaaaaaaaaaaaaaaaaaaaaggccaggugcaguggcucacaccuguaaucccagcacuuugggaggccaaggcaggcagaucaugaggucaagagauggagaccauuguggccaacauggugaaacccagucucuacuaaaaauacaaaaauuagcugggcgugguggcgcacaccuguaauccaagccauuugggaggcugaggcaggagaaucguuugaauccaggaggcggagguugcagugagccgagauugcaccacugaacuccagccuggcaacagagcgagacuccgucucaaaaaaaaaaaaaaaagaaaacaaguucuaaaggguuaugauacaaacacuaccauuuaucaguggaaauugggaguugaaaccaagucuaauuccaaauucuggauucacuauccuggacaauaugauuuaguauggauucugagucuguagacuuuaaucucuuuuugaucuuaggcagugcuuucauaugugaaauaacuaaaacagcuuugaaaagacaggcaagaacucugggguugagaagagaggacccggccccuucucuggagguggucagagccugcccuuuggaggccucaacuaaauagggguuaucuuuggcauguggucagcagggugucccacuaccguuugggagaagcauucugugccugcauaucuaaacaaggaaugaagaaggagucuaugaaacuacagggucauccccuuagcuuaaaagaauuuuggaaaaugugaguuccuucuggggcagguauaagaaugacugacagaggauccuuuuugugaggcagaggaauuuuaggacccuacaguucacccuaggauaguagguuuauuggaucagaccuuggaaaaacuugccuuucccugacucuugauccuacugcagacaaagaaucguucucuuaugcuguggaguuuggcccuggucuaauuguuuaugcuugucucugaacugguaguuuguacaaccagcagaagcaagcagugcccacagguguccauaacaaacuugagacauuggcuugagaaaagaagaauuacguugaaaggaauaacuucuguuccaucagauuuuccucccauuccagugccaaggagcccucagguaaagcaaaaccccgagacuacgguaugguauuuacuccuuuuuucuuuuuagagucaggauuucucccaggcuggaguacaauggcaugagaaucgcucacugcagccucaaacuccugggccuaaaccaucuuccugccucagccucccaaguagcugggacuacaagugcaucacucagcuaauuuuuuuggggggaggguagaggcagggucucgcuauauugcccaggcuggucuugaacuccuggccucaagugauccuccugccuugaccucccaagugcugggauuacagacgugagucaccgagcccagccuuuauuccauuuuugaugagcuguugcuguacugacacaguacagcagugugggaaguacagagacacugcugugaagcugcuucuuuccuaacuggagauucuacaucaguuaacagauuuuuuauuuuuacucugccaggcaauguacuagucuaguaacccacuuuugugugaauaauuucuuacauuuguauagcacuuucacauauuugaucugcaaaauccuauaaagcaauuacaguaggccguuuuacagauggugaaacugaagcucagauuuauagucaagugacuaacaagcgcucggcccaagagucaauccuugggcuuuggaaugaaaccugccagugguuccacugcacaauacaaguacuagagauaaaagcaccugccugggcacaguggcucacgccuauaaucucaacacuuugggaggccaaggcgggcggaucaccugaggucaggaguccgagaccagccuggccaacauggcaaaaccccaucuacuaaaaauauaaaaauugagccacacgugguggcacaugcauguuaaucccagcuacucaggugacuggggcagaagaauugcuugaacccaggaggcagagguugcagugagcugagaucacaccgcugcacuccagccugggugacagagcaagacuccgucucaaaaaaaaaaaaaaaaaaaagacgaugacauaaugacugugggaauucugaugaguuaaaaauuauucucuggaacuccaaauuccuuacaagcucauagggguuuccauuuugaaaacaaaucuaggucaggcacagugguucacaccuguaauccuagcacuuugggaggacaaggcggggggauugcuugagguaaggaguuugagaccaaccuggccaacagagcucuaauuuugaguuugucaaaguauaacauguuuuuaauguauaugaggauaauguuuuucaggcagggcccuguacucucacugaacagcucuucccuugaacucaguaccacucacacauguauacaucuuaaguccacucuucaacaucucucucauaauccaguuuuaaauuuucaacuggugagcauuaccacauggaucccacccucccaccuccagcaccucaaacuuaagucccaaaccaaauaacuuauuccccacaaauauguucuuauaucuccauccgaauuaauugcaucauuauccugcuaguggucauuuucaacaacuuuuucccacucauuucacuaaauugcaagaagucccacuuuguagugccucauagccaucuccuccuuucuagcccuauuacucacugaccgaauuccagacuuaauuauccuuuuucagacgauuacaguaaccaccuucaugccuuuuacacgcauccuucacacaaucaucagagaaaucuuuauaaacacaaccuucagaaucuuagugucugcuucuugccuagaguugaucugaaauccagugaccuuuugagcuucauugcccucuacacucucucuaaacaaaaagguccugccacaaaaaugauccggucuuuauucuugaauuuaccauguucucgcuuucauugccauccccagucucuuccccuuagccuguaugcucuucccuucuacucauccuucaagacuucaguugaggccgggcacgguggcucaugccuguaauccccgcacuuugggagaccgaggcggguggaucacgaggucaggagauugaggccauccuggcuaacacgguggaacuccgucucuauuaaaaaaaaaacaaaaaaauuagccgggcgugguggugggcgccuguagucccagcugcuucggaggcugaggcaggagaauggcuugaacccgggagguggagcuugcagugagccgagaucgcgccacugcacuccagccugagcgacagagcaagauuccaucucaaaaaaaaaaaaaaaaaaaaaaaaagacuucaguugagaugcccuugccaugaagcccccacuguccccacauucugauuaacccuuccuuugcucugccuugcugcaguguuugggucuccauuggcaugcaguuauauguacaucuguuucuuuucuucacuaaauuguaagccucuuaaagaagagauacacacacuccuaccaccccuagccucccgccgaaccuucuacauaguaggaucuuaaaugcugguugaagaaauagacucaaaggcaauauuucaaauaagggaaaauugcuguggguagacuggcacugaguugucucccuagagucuggauuguugagcugauagaagguugcagacuugucuaaaaggucaagacaggauuuugauuucaucuugaugacuaugaaacggcaucaccaucuaggguaaauaaauacccaagauucguugucucauggccacggaaaacuaggaugcagacacaccaagagugagguucagagcagaaccuuaauaguuggaagaaagagaaaaacucucucugcugcaaagagaggggucccggagaaaaugggaaaugguuugccacuucugcagugaaaugcauaagguuuuauagaugagcuugaggaagaggugucugauuuacauaggguguacaagauugguuggaccagcugugccauuuacauagcacacaaaaagcuggugagaacuguagguguaccauuugcauagcaugcaaagaaggugguugucccacacuaaucuuuuauuaugcagacggguucucuaacuggccugcgccauguuaccugguucuuuacacauggugacaaagggaagcuggagccuccauguugagcaugccuggcccucagguggcccuuuuuuuuuuuuuuuuuuuuuuuuuugagauggagucucacucuguggcccaggcuggagugcaguggcgcaaucucggcucacugcaaacuccgccucccggguucaugucauucuccugccucagccucccaaguagcugggacuacaggcgccugccaccacgcccggcuaauuuuuuguauuuuuaguagagaugggguuucaccguguuagccaggauggucucgaccuccugaccucgugauccgcccacccuggccucccagagugcugggauuaccagcaugagccaccgcugcgcccagcccagguagcccuuuucuauuggcacaacuggcagcauucacccaugcaagcuuccagcuugcuuaucuaugacugcaguuugauuuuucaggcuguucuuuguuagaaaagaaaugauuguggggggggcugcuuuuuguuaaaagggaaaauccgucaaggacucuguugcccucacuaucuaccuaaauaauuucuuucuagcuccuguaucaacuguuuuuuguuuguuuguuuguuuguuuucauaaaaggugagugaauacaagucccuuucacuaggaguuucgaaauucucacacucuaggagccucuacaucguuggagaauuuacagaacauuagcaguuaucugcaauacuucaucaagcucucagcuuuauagaugauauaugcuuggguuaaacccuuuccacuucuccgaaauuacccucucacugaaaaucagcugauugaguugacuaccaucuuaacugagaaaguaggaaaggcagaucggugagacaaucacuuccagucuucccuacaaaaaugaauauauaguauaaaccaaaaagugucugagacagaucucaacugauuuagagguuuacuuugccacaguugagguugugcaugggaaaaagaaauacaaguuacaauaggaucuguggccuguacuguuuucaaagaugguuuugaggacuucaguauuuaaagggcaaagaguggacagaagggguaggaggaaagagaaagggggagguuaggugguaaggcaaaucguuacauucuugugaggcuuugauuagcacucacugaauucacauuuuacguuugaaaagacaggaguaggggaaagucaauuaugcauuuuuccugcacucaauaaaucuuuauuuuuuucuuuucuuuucuuuucuuuucuuuuuuuuuuuuuugagacaggaucucccucugucacccaggcuagagugcaguggcaugaucucagcucacugcaaccuccaccuccugaguucaagcaauucuugggccucagccucuugaguagcugggauuacaggcaugugccaucacaccuggcuaauuuuuuguauuuuuaguagagacgagguuuugcuguguuggccaggcuugucucaaacuucuggccucaagugaucugcuugccuugggauuacaggcgugagccacugugcccagccauuccuuuuacacauaagguaaggucagcaugugaaaucacagcuaucuguuuaagaauaaaaggaaggaaguuuuugugugcuucaguucacaaguuuaacuuucccuuuagcacagugaguuuggggguccccaaauuuuucuuuucuuuucguauguccuauucacucuuuuaccuacaauaaaaugcugcugagaagcaauucauguugaaauuaaacaagaauaagauggcuccuugugaaauuucuaucaguuuggccuuuaaaaccaaugccucuaaaagcugagugacuuaacucagaaagugaacagaagggacacaucaacaaacaggcugaccuuccucuaacaggaacaaaggucuugccuggaguuuccuuccucauuccugaagaagcauuccagcccugcucaguucugcugcuuuuucaaguccaaaguaauuuaucacauaccugccuauacuuaacuuuaggcuacauauuuccugaucaucuuccuuuuugccuugcaaacuucuauuuuuaaaaaagcauaaauuggccgggcacgguagcucaugccuguaaucccagcacuuugagaggccgaggcagguggaucaccugagcucaggaguucgagaccacccagggcaacauggugaaacccuguuucuacuaaaaauacaaaaaaauuaaccgggugugguggugcacaccuguagucccagcuacuugggaggcugaggcaggagaaucacuugacccccugaggcaaagguugcgaugagcugagaucgcgccauugcacuccagcuugggccacagagugagacagugagacuccaucucaaaaaaaauuuuaaaaaaaaagcauaaauuuuaaaaauuagcuuuccauuuuaacauucuucuaauguuagcaauuauacuuuaaauaauaauuacuuagcaagcuagacuuuaagcaaaaccaucuggggaaaagcucccuauagagcacacccuauuuaaagacucgcaugacucugagcuuaggcuuuaaauuuucauccuaccuucaguugaaagcuucuaaauagcuuuuuauuaaggaaauuucuaagugucugugaaaguagaaagaauaguauaaugaaccaguucu

SEQ ID NO: 16968 - RNA, 2332 nt, Homo sapiens
cuuuauugacugaauauuuugugagucuguaucaauuauuauaaaacaaaaaacuauuugaaaaaaagaaugucaaaguuaaaucaauucuugccucaguaacuggaguaauuucaugcacacuagccauauauuuuauagaacuggaaaucuauuaugcucuggagaaaauccaacagguauguucuagauuuugcccguagaacuaggcuguuucuaguccaccaaaggauuauauuaauuuauggaaacaauaggguuuggacuaaaaccaguucuaucugggcuauaagaguuaaauguugucuuacauuuuuauuuauaaauaucuucaaagcauuuucauuuaauuggaguuagucuuccuuguugauuggcauuguauuuugggaguaaauaaauuuuaaauagcuaagguaaauggauuuuagagaggcuacuuguacagucacgaaguaaaucuaaugaaucuuuuggcccuauauuuaggguugcucggguggauuaguaaaaugggccuguuuaguaaaaguagauggagucugagagaaguugaguaugaccagagaaaagauuaccaauuggagacauaaaaggguguuauaacugcuuugacaagugauuaugacuuguagaggaaggagaaaaaagucaaagaguuauuauuuaagaaacauuaccaggcgcaguggcucaugacuguaaucccagcacuuugggaggccgaggcugguggauaaccugaggucaggaguucaagaccagccuggccaacacggcgaaacccugucucuacuaaaaauacaaaaaauuagccgggcgugguggcgggugccuguaaucccagcuacucgggaggcugaggcaggagaaucacuugaacccaggaggcagaggcugcagugagcugagaucgcgccacugcacuccagccugggcgacaagagcgagacucuguuucaacaacaacaaaaaagaaacaguaccauucuagaaaagaacucucucuuuagcauacauggaugguuauggcaauauaaauuaacaccuaaauaauuugucauucaacaaaaucuuagcacugugugucuugaggauauuuuaaaguuaauuacgaccccgggcugcagagugggagauuggaagaaggaaauucaggaguuguuuuguuaacaguugaagcuguggaaauaaacagucaaccgaagccagaggaaaggaaggaaaaaaauaaaaccuugaggauaccaacauuuuuuauggccccguaaaaaaggagcagcccaagaaaagugcaaacgaaggcaaguucagaaaucagguagagagacucauauugaagacaagggaggagaguuucaaaaaggaggaguuagcaguaucacgugcuguagaaaggccacacgacaguaggacugaaguggccacuagauuuggccuucagcacuuacuagagucuaguggagacaggaguaccuugcacaaguggcucauuuguuggcaccagaggcuagaacaaggcacuuucacacagucugcauuggacuagauugggaaguaggcccuacauuaggggacgaaacucaugagugcccggguauuuucagcuauuauuggggauagggacucugcggguggcuagagguacugcuaagccagagcucaggagaugcaccuagggccccaguaguaggucuccgauaagaaucaggggaaugaauauauaaaugaaugaauauaugaaugcauguggggguguggucuagcgauuacuuuaugagcgugacaaggauaggaagaggauggugaaagcauacaguaguaccugccugugaaagaagcugcccgucgacucagagagcugccacggagauugguguuuucaaggcugucagguuccccaguugggagaagggugggaagggcuuaaggauuuacagagauugauuuaggggagaacacacaggaagcgaaacagcaggaaacgccgggagacagcagcagcaggacaggauugaggaaggguaagagugcgaaaugggguaagaauaaaagaaaggaauggacagauguaugcuuuacaaggcacuuccacggcgagugacucauucaugcuuaggacaacccagggagagacauagguauauauugcauugccagccuuuggaaugcgggaugcgguccagauaaggccaucgcagcucagagaggcuguucagccgcuguucgauuccucuggugacaagaacacucuacuuuuggaaguagcacuucuauuagagaaguuaaaaaaaaaaaaaaaagaaaagggagauaagaagaaagguguggg

SEQ ID NO: 16969 - RNA, 1946 nt, Homo sapiens
ucuuauuaauuuauuuuuuuaaucuaaaauagauuuauugcauuucacgcaguuugaaggccauggaaaggggacuagcacaguuuuuaaugcauuuaaaaaauaaaagggaggagggcagcaaacacauaaaguccuaguguccugggucccugggagaaaagaguguggcaaugaacccacccacucuccauggggaauaaaucugucucuuaaaugcaaggaauauuuccauggccucuggaugcaaauacacagagcuuugggguaagagcaagggauggggagaggaccacuagugaaaacgcagcuacacauauugaccuaauucaaucugaggguagaacaacauggcaaaucuugggggcagcagcuguuccaagggucaagaaauaucguacacccacggggagauuugcuucuaaaaagaaguggcggugagaaacaaaacaaaacaaaacaaacaaaaggagaaauauuucuucagccacacucuucaagaaaaugccacaaauaugugauuuaauauuuuaauuucauagcauuggacacacagcucaacauauugaaauauugauuccuuggagaaaaaaggaaacaaaaaauauugcaucuuucuguuggagaaucucggcccccaggcaugaggccuagugcgccauuguccuagccugcaggaggagcugaggucggccggguccucuggggaagaaggcuguguucaugaccuggggcuguacggcaaaaauuguguugaguguccucggccuugccagcuccggcccucagccgccagucacccggggggccugcccaucagagggcugguugacugacuggaaaaacaugggcugggcagguccuggcccgcagguauggauacuugcuggaucugguagagcugcuguccaucugugaacuggcugaacuacugcugucuuugcuggaccucugucuguguaaucgguugagcgcugguggcaagugucuggaucugucccugcagaacgugggugccugauacagacugggcuaagcggauacacugcagcuggccagccuucagcugcaccgggaucugcuggaucucuccuguguuagugaggaucugcuacaucaccugcacgguccauccaguaccacucugggccuacugggcuugacccuguggcugggccuggacaaucugcaccugcugaccuucuccaaccugcgucgucacgggcguggucuggcccugcugaagcugugcgaugaugaucugcccaggcugcaugguggucauggagcuggcgguggucuggccuugcugcugucccuggacuuggacgggcggugggcugcugagccagcgugaaauaguauuggacuggcucagcaggaguuacagacugcagcaccuccuccugacacuuuggagguuucaguucaucucuuagaacaauaucgaugagaaaauccaauugaucaaauuucguaauugccauggcgacauaaguccggcaguuguuauccucugugugaauccaggcucgaagagucaacucugugauaaaaaaucugggcugcccuggcaaagagcacaggggccucugcacugaucaucuucacaucuucauccaguuucauaaucuucuuaauacgagccagugggaguuccugcauucagaaaucuuucacugcuaaauuccagauuucuuccaugacccgaagccagaaggacuuuaggcuuugcugggcaucacugcggcuaguaccaccaaauccuccuucuguggacauuucgacaaacgccucuucagggaguccaggaagagcaggagccgcccuggcgcuccugcggagucgggcacugcauaggcucaggcaccgcggaggugaggggggaagcgggagucucggagaacgcagcacgcgcgaagcuggcgcauaaacgagauggcggc

SEQ ID NO: 16970 - RNA, 4225 nt, Homo sapiens
gcccgcccggcccacggagcccauggaccugagcgccgccgccgcgcugugccuuuggcugcugagcgccugccgcccccgcgacgggcuggaagcggccgccgugcugcgagcggcgggggcugggccgguccggagcccagggggcggcggcggcggcggcggcggcgggcggacucuugcccaggcugcgggcgccgcggcugucccggccgccgcgguuccccgggcccgcgccgcgcgccgcgccgcgggcuccggcuucaggaacggcucgguggugccgcaccacuucaugaugucgcuuuaccggagccuggccgggagggcuccggccggggcagccgcugucuccgccucgggccauggucgcgcggacacgaucaccggcuucacagaccaggcgacccaagguacuuacgccucuucugugcccgcccaucccgucagguccugggcugagaccagccccggagccgugccgcagcuccguuacauuuggagccgcggccccaugcggcccacccucaggugauagaaagaaacuucgccgaggccaacacucuccagcccgcugcaccuggacuguggcgagagucgcggcagcucccggggcccagucccagagggcugacuggucccucucccaggucucccuggccuugcaggccggcugguccccucgaggaggcaggcggaggccaagauucgcuucuuggggaauggucuggaguggccucggagcccucagagaagaaaggagggcaagagcuguguucccgggagucacggcgagagggacugcacgguggugagggugauggcuccuuccuugcagcaauuucugcagcucccagucuccugcgggccacacaaauugggggaagcccagggaaaacuagggcagaggcagguaucagacuaaaguaaauggcccuggagaggcugguggcauaaccagguaugaggagugcccugcucagcagguuggucugggugguggugguuugugugugugugacaugugcagcuaugggugccugugucuggugcugggccccugggagagccagaggucaaggauccuggugguguggggaggagaggccugcuggggacccugcaggaaugcaggccucucuuagacuaagcaccccaccuuguucugcccugggccuuccaaagguaagauguaggugaggcugugguguggcugcuguaugucaucuggauuuuauuaaucuccauugaaaucauuaaagcagacagauagagaaaauuuaccuaauuucaggcggaaaugcaaguaauuucggccuuaauucuauccagccagagacccagcauggagggcaggagggaaagaaaggcgaauagggcugggaagugagcggguggggcugaggcagcccugcuugggagccacugacagucagcauaccucagguccuagccugggaaggcaggcagaggccuugcaagugaccaggucauccaucccugccagcacaugcccagugccuagcacagacugccuuauuuuugguaccuggaaaucuugguacccaauccccaaauggcccugugguucgguuagaacuaucaagccuucucugacggccugacauggccccugggcuggaugcugggauacuuauaggacgcccuaguucuggugcacagggacagggacugaagggucccaggcugcaggagaaggggggugugcugggcucuaagugggcacaggcaccagagucuucuuaagguugagcuaguucuaccauggucucagacaggagauaaauccuuucuggggagcucagcuuggcuggcugagccugagaggccuccucucccuccucccucuugggggaaacagaguggcagggcuggugagcagggagaggcagaggaucugcagggaaucucagagaaagugcuccucgugcagccccagugugccucuccggccucccucuccacccugagucucaacuuggaacagggcugcuugagguccccagaagccauugauagggauagaaccgggaccucaggcaugagggccugaccuucguggcuggugagcaaauccccagugguggggggauucugcauagucucuccgaguuuaggggcaaaacgaaaccauaugacccccuucaaagggagcuccuuaucugcugcgugguggaauuuuaaacuuuuuuuuuuucugagcccaaaaaggaaaaagaaaaaagaguguccacacuggaaauaaaaccccuaagcccgagauaagucacuacagagggaagaaugagcccgcgaagggacagacaggcggcuccuggaagcgagaccucguuugggacgcugcccucacugcagcaaggucauuccgggaugccccgcaccccuccgggagguuccuuguguuccuuuacugccuuucccccuccuucggaggccgcgagagcaccgggaggaggugcauuugggguugcgaucgcgagcagcagcgcccauuguugcaagaccugagaccuugggcgagccuggccccuaccugggccucaguuccccuucggcagagcgaaguuggacuagaaggucucugcggccgugcagacgaauucucccggacgaaucgccgagccccagccugcaugggagaccguggccagcagggauguccaggcuggguugggggaacagagguagcagaagaguuuucaggagaccagaauuuuccguuuucgcacagccaggacuuucggcucucuugggggaucagcagggcaauaacgauaagucuccuuaaggcccaggaccucaggagggggugcacgacuucuuuucaacccagccccggacucugaucucggauucuggcccgcggcucugggucaggccgcggaacuauagcagccugcaguccuggucuuggguguaggggugcgcuccuggucccgcggcucagggauaugcagugaccauggguuguuggccugaugggacuuuuggcuugcuaaaccaaagcucgguucggauaucccgggcgaagacguccgcugcucugggccaggcuggcagcguucaggcuggggcagagacgcggagucgggcgcuggcuccaacaggccuggcucccacaucgaagacagcugggccauuugcuguuaggaggccccgcgcugacagugugcaggauuugcucuuacacagcucuuucucucugucccugccggucccccgcagacgaaucggcagccgaaacaggccagagcuuccuguucgacguguccagccuuaacgacgcagacgagguggugggugccgagcugcgcgugcugcgccggggaucuccagagucgggcccaggcagcuggacuucuccgccguugcugcugcuguccacgugcccgggcgccgcccgagcgccacgccugcuguacucgcgggcagcugagccccuagucggucagcgcugggaggcguucgacguggcggacgccaugaggcgccaccgucgugaaccgcgccccccccgcgcguucugccucuugcugcgcgcaguggcaggcccggugccgagcccguuggcacugcggcggcugggcuucggcuggccgggcggagggggcucugcggcagaggagcgcgcggugcuagucgucuccucccgcacgcagaggaaagagagcuuauuccgggagauccgcgcccaggcccgcgcgcucggggccgcucuggccucagagccgcugcccgacccaggaaccggcaccgcgucgccaagggcagucauuggcggccgcagacggaggaggacggcguuggccgggacgcggacagcgcagggcagcggcgggggcgcgggccggggccacgggcgcaggggccggagccgcugcagccgcaagccguugcacguggacuucaaggagcucggcugggacgacuggaucaucgcgccgcuggacuacgaggcguaccacugcgagggccuuugcgacuucccuuugcguucgcaccucgagcccaccaaccaugccaucauucagacgcugcucaacuccauggcaccagacgcggcgccggccuccugcugugugccagcgcgccucagccccaucagcauccucuacaucgacgccgccaacaacguugucuacaagcaauacgaggacauggugguggaggccugcggcugcagguagcgcgagggccggggagg

SEQ ID NO: 16971 - RNA, 34285 nt, Homo sapiens
cgggucccgugacugcgcgccccgcccggaguccccgccgccgucaugcaguccccggcggugcucgucaccuccaggugagccagacccccgcgccccacaccgcacagcucgcaguccggggcgcccgggcggagaggcggggggaggccgccgccuccuaggccagggaccuggugcaggucuccccagcgcccucgguggcuuauccgggcugggccccugcaccgcccugcaggagagguggcgaccccgauuuacagaugaggaaaccgaggcccucuggaggguagagaacuagccaaggacagcgggagcccugggacugacugguucagugcaggcgggcgcaguggggacucugcucuccuuuccuaccgccuuggguucuucucuuuugagcccgaaaaucuaguuccccauccuuucagagcucccugagucccaggcccggugcugggcacuggggacagaggcgaaucagacaagcucgcccugcagggggcugcagcggagagggggugaugccagcagcggguaguaagcucagguugccaugggaacacaguacagggcaggaacccgguuucugggaggaugaguuugaugagagaccagggagaggucguugcugcuugcgaggcagcucaggagagcgcaaguuacagcaaaagccuuggagggguccaggcggaggaugcagaaugggucggcccugaucgagaccuggaggacccagcccaagguggauccuggcaaggcugggaggcacgugcuuuuacuucuuuccgccuuuaaaacgcuguaaagugauuuacuucaaauauuuucauacacuucacccuugcucucccuacacaaagucuuaggcuaagaugccaauuuaugacauaaaugaacguguuacccagccaacuguugaucuuccaguuguaaucaggaauuccccgugacuucaggucuagaaagguaugauuccuuuuguaaacccugaugucggaggcugcuuggucuuucaugaucaagugugguuacaguuguaucuucaugggcagaagagguuucccuacugccacuuacgucaccuccucucaccaagccucaguuuccuuuucugugaauuggagguuucagauuggcaggcaugagcaacgucaguaguauaugccccucagccaugugcagauggauggggugugacuuuggugcugggugcuugggaugggguggguggcuucccucccugccccgcugcacagccuggacguggcuuguuaacagaugugggggcgcuggcggugguaaggccacaugagucaggcucauuucuugcugagggcaccagcacacccaaggaucuugccugcagggugaguccaaacgccuuagcccagcagcaaggccggcccuucccagucgcaccccagcuccucuuuccagcccgaucuccucccacaugucauugccacaugcacucaagcuugaauucagccagaagguguuuaucgagagccuucucuguaccggguacuggcccuaguucuaggagacaaacaagucccucucguagagcuuuaaugagggcacaggcccagugggcaaaucuacgacaugucagggaugauacaugcuaugaaggaaaacaaaacagugggggcaacagagugguaggaggcaugcaugcuguuuucuauggugugguaaagaggcaucuuucugauggaguggcgccuggacagaucccggacaagcuccaugagggagagagccaugaaaaagaaaucuuggaaaaguguguacugggaggacaggacagcaggagccagggucccgaggcugguaugcuggaguggagugagcccagggagaguguuaggugaugcggugaagaggcaagcuugggagugaaggaugaucaggaaaggccgagaaggcuguggaggggccaucagauuuaauuucaagugcaauagggcccaacuucugguuuauagagauccuuuggcugcuaugcugagcaugggcaguggccgagcugagcauucaggacaggcuuguagguuuccauguagagccggugguggcuuggcccggggugauggcggccgugagggugagaaauguuuggguucucgauauauuuugaagauugagcuuucagguuugcugaugcuuggauauggggugugagaacaagaagagaaguuaagacuaacggcaagucucucagccuaagcugcuggaagaaugaggcugcccuuuagcaggcuuggggagagguagaagcagcauuuguguagacaggugaguuuugagaagcucguugacagcccaguggggaugucaggcagcugcagcuggaaggaggcuggcugugaggggagagugagcuaaagaugggaguuggggagccauuggcucggaaaugguauuuaaagccuggagccuggaugagaucaccuggggagggguacagugagaggaagaaggagggugcucuggaugcuaucaaggggaaccauccaaagcaguuccucuccuccuguuugagcaagaguggccagggugggcagagaagaaccaagagugagggggugcuccagccaccagugaaggcagagcuugaaggaggggaguggcugacugugcccacugcugcugacaagucagaccagaggagaaaugaggauucaccuuuggauuuaaccacauggaggucgcagaugaccugggcgugggcaguuuguugcaugaugaggaccaaagucuggcuggaaaggguucaagaucaaacaggaggagaggaacccaugaauauggggcccucuguugaggaguucugcuggaaagggcaggagggaaacggagcaaggggaaugucgggucaaagcacagcuuuuguuacaugaguggucagagcaugguugcaugcuaauaagcgugggccaguaaggaaggaaaaucgauggugcgaaaaagaggggugagcugcagcagcuauguccuucaguaggugggagggccucggagccgcugcccugguagaagguuggccuuaggagcagccagccaguuugucuacagucccaggagagggcagcuaucagggagcagcugcaggcugaugggcagaugugacagcgaagccuaggauguucuccgauggucucuggagcaguacacagcaguguccacaucacuugggaauuugcuagagauggugagggcacaccccggggccugcagaaccagaaucugcauauuaacaggauccccaggggguugcacgcacauuacaguuggagaagcuuggucuagggcacauccugcccaccacacccccauuuguuuauguacucuccguagcagcugcagcagagaccagauacccuacacagccugaaauauuugcuaucugacccuguagagaaaguuuuccuauggguucagggaagugggagggugauggaguaggcccaggugcaucagacucgucggagggcuuacuaagaaaacaagauggcuggccacccuaggcccgaacaugccuuucuuacaaguucccaggcgaugcugauccugauccagggaccacacuuugagaaccccacaucuagggcaagguaggguugccaagccugguguggugcugugccuucaagucugcagccaugaauuucaaugggaccaggcugcauguuuacaccaugucuguccccagucacguugagccacuugggcacagggugaaggaagcagagaacuggagaagugggcuuugaccaggccagcucagcucuggguaagaagucaggggagcugggccuaaggcagagggauuccagcaauggaaugggacccuggaaaaggggugggguuauggauuguggguucuggcguggucagagaaccauuggauguggggugcugugagggagcuggaucgugggaggugcccaucugggucugcuccaucccuuucccaccccugagaggaccuccccgcagcucaggcacugcccuucuugucacuuucaccccccugugccucguuuucaucaugauccuaaagaaaugaugccuggcuucuuucucaugccugccccauaagaggccaccugggcucuggagcagcugccugggauugaacgcagcuccaccucaugccgggugagaccugggcaggcacuuucccuuuaggggucuguuucccuguauuuuaagugggucuggguagcagagcuccuucgcaggguugcaggaggcggaagugacuucacacaggugcaucccuagagcccagcgcgucuccccucagcauccagccucaccuuccuccuccacacugguggcagugacaccgugggugacaccaggccgcgcgugcacacugcgugaacucggugccguuggcagagggcuggcugugcgugugcaccucccagugcccauucggcccuugcugcacuuuucaccaccugaaggcagguugccuggggugcccuacgccgcgggaggauauuccuuguguguacagcacucagucauugggugucauacauggcauaggagacgcaucacuguaggccucaccaguuggugacagcagcguugugcuggugacagcguggccuagcgugggaugugagggguccgugugggaggagugcuggggcagggggauuugauggauugggguauaauuccagagagggaagggccuugccccagacacagguuaagcuccagaagcuccucccguguuuucaggguccugcccagcacacaggaggucucaccucgauggucagagcugcucagagggugccccacguguccugccagagguguuugcgugagggauguuagucugcacaggucugugucucaccuuauguaggaugagggauguauuuaauaacuuuuuccacuucaagaaaaacaucucaucacuucuuugcucaucauacaauucauuauauucgaauugcauuuuacaaaucuccaagagcggugauguuuugccgaugcauccucucuacaccucgaggggcagcaucgacugcccagaugagggacgggccuaucagugccucucugggccacggugggucacaaggguccugccuccagugcucgucccgugucccccccagggggccuguagcagcccuccugcccauuagccaaagagaggugccugucuccagcugggauuucaaucccuugcugucccugcagccccaggcauguuccuuggucugaguagaggcccuaggaugcugcucccacccauucugcacagaguuugugucgaucccuuucaacaagccccauccuuuccuguuuuccugcagggagcagaccuuugucccugagcaacccaaaggcaggaccagguccgaggccucgaggccugggaagccaggcuuaugagggcugguguggcgggauggguggccuggagcagugaccacugaggacagccagcagagucaccuggcacccaggccugccaggcacccagaggcccugccugcacuuugcucgggaagccuacugccuugacccugaaccccaccugccuucuuuuccccuggcaggcgacuucagaaugcccacacuggccucgaccugacugugccccagcaccaggagguacggggcaagaugaugucuggacacguggaguaccagauccugguggugacccgucuggcugcguucaagucggccaagcacaggcccgaggaugucguccaguucuuggugagccggaggcucuggccaggauguuucgagggugcccgggguccgggcgggcagacacaucugcccaccaggguucaaguagcauccagagcaagugcuucucugucuguugcuugcucagggccuggaguaccagaccaugcuagacagaagggacacagggugaaucagacgcucucaguccguggagaggcagaccucuaaagagacagauacagauggggacaggagcaccuggggggcucuggggguauagagaaggggcaccuaacugacccuggggaaacuucuuggaagaggcgguggcugagcuguguuuugaggaacagauggggcucagcaggagaggugagaagggugucccgggcagacaacacauccuaagcaaaggcacggagguuggaaauaggacauugagugggaacucugcacaguugagugugguccugggaggaagcggggaagaugaaggugagugacaggcaggauccagauuguggagagucugcgggagccuggacuuaaccugcagccaaggagaguuuuaagcaggggagugacguggacccuuuugccuuuaaccagccaaucugcugagagcauggaguuggauuggaaggaacaaaacaggugucagggagcccagauacauggccaauauggucauucccaaaucaagggcuuggagcaggccaguugcacuugguauggaagggaaagggagaguugaaaauguuuacuggguaacaugcaccacauuugcugacuguuuccaccaacugaaauaaagaauaugauggaggagcagaccuagggggcauguggagugugaagugucugcccuguggauggauacaugaggcuggagcucgggacgagcucaggccugagauguaggcuugggagucaucaacuuggaggugauauuaaaaaucugggaguggaucaaguugcccagagaacagaaguggaaggcagagagaagggcugaggaggaaauccugaggaugccagggguucagggacucuuggggagaaggaggagucugcaguugaggcagagaggagagaacuggguggguaucuacggagucagaggagcuaagggaggagagaauuucaagaggguugagaucacacacucauuggcuuauuauuuaccauuuggccucuugugaaaaggaccugcagcuggagaccaagagacacagguccaggauuauuaggacaaaggugaaaugaacuagaccccgaaguacagcagggagugacacggggcuagcuuggagucuccuggcaaccaagauaaaaagggaaacgaugaguugcaucuuucuggugaccuguugaaagagacacuaaauuuuaagagaaauuuacagcacaaauguuuccuuuuuuuaagagauaggaucucccucuguuccccagacuggagugcaguagugugaucauagcucagugcagccuggaacuccugggcucaagcaauccuccugccucagccuccuaaguaucuaggacuacaggcacacaccaccaugcccagcuuuuucuuuuuuaauuuuuuugguagacauagugucuuguuauguuguccaggcuggucucaaacuccucaagcugggcuuaagcaauccuccugccucagccucccaaagugcugggauuacaggugugaacccccacgcccagccacacaauuuuaagggacauucaacaacgucaugagaagcgucuagaauagcaaugcuguuuuucauuugauugcuccuguggccgacucuuggugagaagcaacgugugaugucaggggugauucugggccugcauugcucugagagugaaucugcuuuacagggugcuuugcagcuccugguaauuugacuugauccagguuggagcucaaugcacccacauuuucagagacaggagcagaagaggagaguauuugagcuugauguugcggggcaugaaggagggagcauucugggaagcuugggcuucagccgcccagcccacuugguucugugcagagggccggccuuacaugcaagguguacaugaggguguuuuaacaccuccaugaaucacacuagugccacuuuuuccuaggcagugacgcccacuccucguggagugugugcgugcaggggcuugucagacauuugaaaguacuugcgagggcaaagaacuccuuuacuccccaugggaucucaggauggagccuaaaguuacauacccccaagccugaagucucuuugauguuucaugaauuaacucaaagaauuaaugagcauuuuguaucuacuuaaaagggcauauguguuuuaauauaaacguguacugauuugcugaccauggaguaaaacagccgcaggagggggcaccgcaguggagguugugcaggcucuuggaugugcuagcagugcagacacccacaagcuuacuaacguuacagggcugucugccccgugcucagcagugccuggcacacgggggcaccagauaaaugugaguucucaaccuugagcuuccucugcucagggucucuuacuuggccuccucuuguugcuggugcagaugcccacccaagaagcccugccugaaccccugauggacgugggcccuggguggggugggagcccaggccuacagcuccggaguacucacgaugccagugcccuggagauggagguuccccgagccuggauaugcugggucuguggucugagccugaggggagcagucgggccagcagggggcgcccggcccccaccguggccugcucugcgggccgggcuggagucacagcugcugucggagccuguguuagcaaucgcucugggaagggguccgugugccuuucccugagggcuguuuucaggaaagucuggagccaggcucuugugcugacaacugcaagcagcaccugucccaggugacuccccacuggagguucugaaauccccccagcugccuccugguaucuugacccuucacaggcugggcauucugggugguguugcuggagccaaggauguguguuccagacacacccugcaccaagggaucuccccgagcccgagggcgucagaugcccgcagccccugcacgccagcacuccaguggcacacugugggcacaguccgggccugggagcauaagagugagugacccacacuucagucgggggagacaggcccagucuauggggaaagcacagaggagcgaggagugaggguaggugccaggaugauggugugugcauacagcaggugauagaggagcuaggagugaggguaggugccaggccgaugguguguguauacagcaggugacuucgcugagcacccacaugguuacagacacggcgauggcacugaaaccacugugagacugagagccugcuggggugucucuguacagagugaacaugcagcaagagcuccgugagugaaggggugaaggcuuagcugcccaggagcuguggggagaggccaaggaggcagcgggagucagccgcuggccccacgggaagcugagugcugcccucucugagucagauggugcucaaggcugccuucugaugacagcaagaguccuggccugcuugacucgggugccugcgugcagagagguccugccugacgcagggcagagaacaagccuuggaaauaucugucuccacugcuugcauuggcuggcccgccgaaggccacacugguucacgggagaaugagguuggugcugagaacagaugauucacgguguugcaggaagaugaccugccagccggugagaucacccuccugauaugcagaaagcugggaaugaacacaguggcccugaucacgugcaggcugggcaggggucccuguaucaaaucuuguuaacuggaccugugacaguguccagaauggcaccguuauugcaucuuuccucugggccacuaagauguuuuuauugaaucugcuaucggccaggcguguuaaggacuggagccugaggcugggagacaggcagaggggcagcaggcgggcguaccuggcacacuuccuuuggcugcugggccuugggaaccccuggucggggugagaaaggagcacugccugccacucuucacucaggaaaccacaugcuccucucauuccaggucuccaaaaaguacagcgagauugaggaguuuuaccagaaacugagcagucguuaugcagcagccagccuccccccacuacccaggaagguccuguuuguuggggagucugacauccgggagaggagagccguguucaaugagauccugcgcugugucuccaaggaugccgaguuggcaggcagcccagagcugcuagaguucuuagguacccaaggcucugccccaugucccucaggucuccccggcccagaacuaggccccgcugccgugccccagugggagcauguccacagcugccucugcagccuggaggcuucagccaggcuggugaggcagguggccucgcugacauccuuggcuggauggugggcagaaggaggccuacccuugagggacugaacgucuggcugucaggugggggcucacacagcaggcauucuccauagugugaccccauccauggccuuccuggccagccccauuccuagagcuugcccgacaccccccgacugaccaugcaccacauacaacccccugacacacaccccacacuccccucugccuccuccaaccagcccuagggaccugcaguaucccgggaaagcuguguucucacagccuggcuggugaccugccccuggggacaugugcuucucaccugugcccccacagagagggucauggggacagcuccgggcugaggaauugauccagcaccccugcccccagugguggagacgucaagcccuucccauggguguccuggcccugucuucucuccucaguuuucucaucuguaaggugggaguagccuggcugauaggccguuaugagaauuuacagagcuaacacaugcaaaguccuuagaacagaaacaaccacaguaaauaguggcuacaauuuuaccccacuccucgguuaguccugucaacccagaacccccguggggcaggcccuggucucacagaugcccccaggacaaggcagguucucaccacugcuggugccggacucccaccccuucuccccucuuuacauccgucugcuuaacuccuucccagcuacuguggaucuccuaguuccacaagacagaagggaaguuuucaaaagaaaguugaccguaaauaaaacaaauuauuuaaagugaaagguggggaagagaagcaaaacuggugaaugcgcaggccuaggacuggacaagcugcacagccccgguguccuguggccauguugggccccucacaugggucuggguucucuucugcccuuguuguuccaaggucacaacccuuccuuccuugccugucucuggggcuggguagacugugccaagagguuccagcucagccaucgcuggaagagaugcucaggaugucccagccccucucugguggagaggcaggauagaaacacaagcugcucuaugccucacuuugcucaucugcaagauggauguacaguagggaucucucucauagggcuuuugugauguuuaaauguaagaugcuuaugacaugaaauugaagguuugggagauuuugaauggcuuuucacauuuguccaaguaaaauaacagagcaucacauaauacgauaucgucauuaucacucagugcauccuguaugccagacacucucuaaguucuuuaccuacaaggugauuuuauuaaaagucaguuguuuuaaacuacccaguaagcacuuggauagaaaugaacaaauagucugagcccacgcuucucaaacuaucuguggcaagggcuagcucuuuuauucccagccugucacagauggauacuuucacaaauacaaaagcacacuuggguauugugaugauggcagcaugcuaugaaguuucuggaugcuugcucucccuuucucuacuuaccucauuguggucacacagggggcauucucugucugaagaccacacuucaagaagcgcucaucuaagccaguuuguaauggagugauuaccguuuguucuggaaucuuccacaugcuuacccugggcacccauccaguccacaguccaggugcccagacucucggggcaggucucugucugcagaguuccuugccgugccuccaacuguaaaugguucuggcuguacugguucuuuuugaaucacccugugcccuggcuguuguaucccaccgcucacccgggaggagggugcagccaucccugcggcgcacacaggcucugggccuuggguucaggaaccgcugccccugucuugcucugaagcucccacuugugaccacuccacuccaggcuuccuuggugcccgucagcccuuggggggcugcagcaggcacuuggcugcccccgaaacggaggucaccuuccauccacccagacucgccauccugcuuaggucccaggagggacgaguuuggucccaggaggcugcaggaagcccucggccucagauccuggcaugggagggugcaguguggcaagaugccuccccuggcucuggggugguuaccaaguccauucuuuucugucuuccuccacagguaccagauccccaggggcugcagggcucaccagcagagauuccucuguccuggauggcacagacagucagacagggaaugaugaagaggcuuucgacuuuuuugaggagcaagaccaaguggcagaagaggguccgcccguccagagccugaagggcgaggaugcugaggaauccuuggaggaggaggaggcgcuggacccucugggcauuaugcgguuggucuccuguuguugagagggccccuuugguguauuccaggcuuucuggagaugacgucccccuucccuggaaucugagaaaagcccugagcaucccaggucgcccccucgcagggaucugggccacgaggccuuggccugguguguugggggaaguagcucucugcgugcccuugguggugugcaugucucugggacugggcuuaggugucgccucccuucucgggucacaggauguccuccacuuguggcuccgcacuggggcuugguagaguccuccgugacagcucaguagugcaggcugcgggccuguccggcuagugugggaggacugggugcuccuuccagcugugggacucgcagagguggcugcggcucucugggcugcaucaucugcauagcaggagcauucaccuuggcccugccuccacacagggccauucaccagccauacaucucuggccauuuacaaucucuuuucuucgguuuuccucagugaaaauggacucauggucguaucaaccucuuagggcuccugugacgaugaacugaguuauguaaauuuagcaaucagcuaccaucauggccccaucuuucaguggaaucagaccaggccaggggugcuguccuccccgcucucuaccacaacgaaugucucuuagccguuuaccaaagcccucgggcgccagaugaguguagguccugccgcagaaaggaauuagagcccaguagaaauuaggcagaagcaaguucaacuucaucagcauguagaauucucuccuaaaaucacagcccacucuggaaaggccuucuucguggggaggguuaugggagggugggcugcaggguggccaugagaccagcguccaggggugaggauuugcacugggaaaggguacgcggcgcucagggagcugcagcagaaacaggccugagaucugggguccugcggcaccugggcacagcaagugcccugcagucgcuccuccuggcccuccguggcuggccuugucccugaguggggucagcggcccugagggagaggcagccagaguagugggugauauggggacaagccuguaauagucacuccuuaucagccuggcccaacgcggcaggccuuucuugggcuuuauuuugguaagggugaggcuuuguuugaacucacauucucuguuguucugaguaaccacacguagugccaaaccgagauggacuuugguggucugugccaaccuuuggcugaagaacacacuuagccgagcggcuccuuuuuuggguaggaaaauguucuuuguggcuggcaagugcugccuugaacuuccuacuuacuucauuagcagauugucaggggagaugugucagcuauccugggaccccuuggcggggcggggggggcgggggcagcccccuccccagcucuguacucuggggcccucaccccugaauccugggaaagcuuagcaccuaagaguaauccugccggcuuaagacccuccccugcugggguuucuuuuuaaggacccgugugacaaggugcugaugaaucaacguuaucaccucugucaggaauaauaaguaaauuuuuugagaguuuaugaaaugcugggaacuaaguuagcauuugcuugcaugaucucauuauaucuguaagacagcauuucugaaacuacuugcuacaacccauaguaaaaacuauaugguacgccaugacccaggacacacauguauaaacaucccauaaaacugaagcaaaaguucccagaacucauacaaaaccuuacuaaguguauuguacugggauauuuucuauucuauuucaacguuuggaaaggucaugacucgccaaacugcuuucaggauccacugugggcacaggucaagaaacggagcccuggaggccugcacuggcaucagccucuucuguguggugggaaacucaaguucagggucaggugguucguccacguuccugcagccugcagauggcagagccaggaccccacgccaucuccaguccagucuuuaucagccugggaggugggcagggccccaggauuaucccccuuucacagaugguaaaaucgaggaaggaguugagcaggaucuuggccagagccguguguguuccagagcuguguguguggcagagccguaccuugaaguuggguuuccaccucggccuuucacagacacccaggugggcuuguugaucucucuuggugccacccaccugcccuuuggugggggacuuucuguucuucucgggaggcuguuugugcaccccucucccucccgugcgcuugguuccugugcagaugcagcggcacccguuucccagcuugcccugccccaugucugggcuuagcucugggcucuccuggagcggccaccauuuccaugcaaccagccucgguccuuccccgccguggccgcggcgaggcgcugcugcucugcugaagggcugcuccacggcagggcugcugggagggugggagucgccagcacaaagccggagcccaggccggccuggcuuuucuuugucuuuuaaaccugguuuugauuagggacaagagagcguuauuacaccauuagagagcaauuaaagauagaaaaagcccucaccucggcccaucccaacaccaccgcucucuccaucugcuggggcucucuucugaccccgucccagcagcauccaugcaaccgcaggcacaaugcacgugccuuuucguacucugcuuuuccacccuauggucugucccgauugcugcuccaugucgccccuguuuuguauuuaaguuucuauuuuagaaugucacggugcugagaaaauugacauucuacccuaauaguucugccuuaugcuggaaauccucugcgggaaaccuuuuucauugugacucaaauaacacacaauuaguauagaaaaauugcaaacacagauaaaaguccuuucccugugaauuucugaaugcaccuuugaauauucacaucuuacugccaaaaugagauugucuugugugccguucuggaauuugcuuuuuuccagcuuacauguucuagguccuuccagaucaauagcugcacucucccuccuuccucugcugguuucucagcucgaugggcuguaaguggcauuaccaggcccuugcuugugggcguggcgggguuuucuguagguuuuugcuauuacaggcaauaaccugaggaacuucuacauauacaaagcuuuuauucuauggagccuuccccuauauacgugccccagagcaaggucccugaagcugcuucugggggcuuugggguaccauuccaguaaaagguucucuaagggcugaagccccucuguugggaggccccucugcuuuucuaagcccugcccacccccgcccucagggcccacuccucccaccucuucuuuugcacacagggacccccuccaggcccugggucccugaggacucacagcguccuugggacaggcuggcuccuguaugaacaaaugcaccugccugcaaagcuggucuucccagacucccuggaagggggagcccacacccggguccccgugcuguggccuccguggugaagcuggauguuucucuggaaugccacguuuuaugguuguuuuuuaauauggauuuugcuucaucuuucauaaaacaaccacauguauuuuaguauaaaaauaauaucuuacucuauauuuggaugaaaucacuucucuggaaugauucugugguuuugaaugcuccuggcacauugccaggugcucccagauuugcuaacccaagauuuagcagcaagacagucccuuaaggugagccguggaggggagcucuguggggacagcagggccucagucccaccuccugaggugcccuggagcugcuuccccgagggugccucuugcuaaauaucccgaccacugcgcaugggccuggcaccucuuuguucauuccagccugagccugggcacccagggcuccccugaugccaccagugcaacagagaccaccuagggauucugggccacugaaagcuuggcagagauagagauuccaggccccccucagaucuggguagggcccccagaaucuguguuuuaacaagcucuugaguugguucuuccgcaagcuccuguuugagaauucccagaaaccaaauucuguuaaaguguuggaaaugccagaaaggaaacagguguggagaguggcaggucagccgucaccacagucugccgcccacagggggcugaggacagggcguguccagaaggcacuuccgguacugucugcuccccagcaacuccugcucgggcugggcuuucccucgucugcugacccaccugcuggacgaguucucugcugugccauccugggguucaugugggggccacgagccaggauggcugggcccgaccucacccugcaccugugcagcacuuagcccuggccuggcuggggacccaaagccauaaggaaaggaggaggcaggugccacagcugcccugcagcgucacgcaggcggcacuccacccaggcugucacagugaucacagcagcacagugugcaugccaacugcauuuccccauccagauuacugccguggccggacgcagcagcucacgccuguaaucccagcacucugggcagcugaggugggcagguuacuugagaucaggaguucaagaccagccuggucaacauggugaaacccugucucuacuaaaaauacaaaaauuagcuggguaugauggggcacgccuguaaucccagcuacucaggaggcugaggcaggagaaucgcuugaaccugggaggcggagguugcagugagcugagauugugccacugcacuccagccugggcaacugagacucuaucucaaaaacaaaacaaaacagaaaccaaacaaacaaaaaaacagauuacugcacaaaguccugccugaaugaaugggcuguuaggaacaacagauguaccagugguuucugcuuuuuaaauucaguagcaaaaccuuuggcucaagagaaauaucauccagaaucccaguacauaaaacaggcugaaguaggauuuccccugguugggacaagugaggacuggaucuuugucccuccagccucagccccacuuccugggguagcccugggcagcuuugcagaaggcgagggccccuuagaguaugguuugacagugaguggggcagcuggaaacccccaggauguguggcuacccccagagcaggguuaaagaugggcagucccagguucaaauccccuuucugccacucagcuggcggacgcugagugcguugcuguacuucuccaagccuguuucuuucuuuguagaguagggguaaaguagaggcccaguggcugaaaggauaaaaugagauggagcacuacaggaaaguuccuuuguaaaauguuaucacuauuucagauucacuuugcucuaaagaggucuuuguguauuuaaccaacaguugaaauaugaauauaaaaggcagcuuuuccacuuccuauaguuguuaugcaaauaucagucacugugaugugcacacuaugacuuuaccucccuccaggagcgccgguacaccugucaccuguuacagcuuccuagagcaggcgauucuggagguggggcagccccuggcccuggaggaaggagccugcuuaccugaauccuuagugggauucagugguugcuugguuccuugagagauagaaaucugggaggucacacuugccauuuucccgccucaggcucccccaggacccguuguggcaaguucuggcaaguaacaacacucuuaggaugacagagccuuuacgcucugaggacugcagaucagauccaggcucuguuguuacgacugaggaaccuucccaggaucacacaggagggcaugagagcaagagcugggggucuccugacugcuggcccaggacuuuucccuuuuuccccaggccauguccaacacuugugccaggggacugacuucucagcccucaccuguucacucucgguuuuugaugacaugggugaugggcauuccccacugcaaggacagcuagcugucugcuggucgugucaccauuuggaguggaucaggggcauaggagcgcccaugugagaaccagcaaugguuguuuacucagagcuuacugcgaccagggaggugucggccaccaucaccugcauuuggcaaagaugcaaagagaggcaggggagugggacacuuugaagcagaugaaagggaaggcucagauacacgcugauuggagguuauuggcauggggaauccagaagcagccaaugagaaguggggcauccuuuguccucugugagcaggaaguggggcauguuuggcuuucucuggaugguccuacuaaacuggaaauggggaaaaauuuaggaaagcuggcaguuauugaucaaaucuuggccauuuggggcugacugcugcagaggcuguggucuggcuuccugggcagguuacugcagacugugggucagaguuccaccuuuacauguggccuggccauugucccuuuguguauucaggcucuuggggguacugggcgcuugcuguagaauguaggcugcagagaccugcagcugggacccacgugguucccugguggugcaggagccaggaugggugaggggcagucucuggccccauuguggagaaggaaaaauggcaucacccacaagcucaggugggauugucacugaguccuggccccucaagauagggcucaguggccaggagagugggcucuggcuguugagaaacagguccuuggaaugugacucuggggaccauagcaaaugauaaacguucauggugaccucccuggcuggccccuuuuuuuuuuuuuuuuuuuuuuuuuuuuuuuuuuuuugagacagguucuuacucuuuuaccuaggcuggaguauaguggugugugaucucagcuaacuacagcuucaaccucccagacuuaacugauccucccaccucagccucucaaauagcuggaacuacaggcaugcacuaccaugccuggcuacuuuugucuacuuuuuguagagaugagguuucacuauguugcccaggguggucuugaacuccuggacucaagugauccuccugccucggcuucccaaagugcugggauuacaggcaugagccacugugccuggccuggccccauuugcuuuuuaaggcccagagugaagucugcugaguagaaagcauaagugagccuagacaucaccaggcagcucccaggaccccagaccucugccacggcccugcgcugacuugcauccaggacccacuuggcagcuugcgaagcauuucugugucauuugccuccuucuucccuuugaccuccaguaaggaaacaugguuggggaaguugagugacugguccagauccuauacaaguucuccuacaucccccucugcugcuccucucucagcaaaggccagaaucuccccaggccccacuggagguggccaacaauucccacagacccucccuccaugcaccugcugcccagcuauugggcacuuucacuaugccaggcucugcacaccuuggcauuuucaugggcucuucucucugcccggagcacagcuuuugugacucugcucguuuuuccauccuggccuucucugaagccccuguccagugaggcuggcuuggacucccaggguuagugccuguccucaggugauucucacucuugugauugcuucuccaaggaagcccauugcuguugcaaauaacauuguccuggugugaauuucagaaguccauuuauugguacucugagaauuuucucauugaaaaaauaaaaccagccaggcacaguggcucuugccuauaaucccaggacuuugagaggucaaggcgggaagaccacuugagcccaggagcuugagaucagccugggcaacauagcgagacuccaucucgacaaaaaaauuauuuuuuaauuagccacguguuauggugugugccugugucccaauuacuaggguggcugaggugagaggaucacuugagcccaggaggucgaggcugcagugagcugugaucaugccacugcaccccagccuaggugacagagacccugucucaaaaaaacaaacaaaaacccaaaaaacaaaaagacaccaaacagcugaauuuaagaauaaaguaugaaaagugcauuaguuuaaagcacgcaguuugcaucauuggcaaggagguggauuuccguauuugguuaagcugcacccuggcuuugaagacucaugcuguccaugugucucaguuguggaaagaucagcagucuucuguucagacccaguuaagcuggcugugucuaggagaugccucugccaugcauguacacccggugcugagcagcuggugcccauugguggucugcugugugggugggcacaucugggaauggugccacaggcccccuggguggccagagugguggaugcucuuaugugucaaucacugucaccagaacugccugagccacagggagccaggcugcugcucagccugucugagcauuggagcugucagccgcggcagcugccgccucucaccccguaugcugcacgcccgccugcagaacauggccuggucugcgcgucugucugccgucaggaauacacagcaggaaagcgggugucuguccaugcacacaugugcaugcaacaagaacaugccagcacaugccugcaauccauccaggagcaccccaccuaccucaugcaaccucugugggcccaacucauguuuugguggcccucauggccugcacuaguuccaaugaacccugugcucaccaggaagccaggagcugcaguuccaguccuauucccugcagaccucucuuugaagccccuuuugccccaucccuggugacaagauucuaaucaugaccagcuguccuuccaaugaagggagaagagggcacccuuccuccaugucagugaggggcuuugucuccugucagugcagagggcgggcuggagggcgggcacugcagagccaggcccugcgccugcagacagcuggguggaugcugauauaggaauggaggaggaggaggaccagggaggagaggauugagggggcccccgagugauagcccaugugugcgaccugacccgacuccauguucaugacaacccugagguguuugugcuaggagaagggugaagaaauggcucagagacugagugacgcaccugucauggaauuacugacccccucacugagaucagaaaccugucaucaccuuagacaauucccuucugucagccgaucaccuuaacuguccagauguauaagcacguuugccuucugaaguucccccuagccugucuuccccucgcaccaccgcugcucuccuaguccaggcucuggucauuucuucuauggaccaugagcaaagcuucccuggaaagaacugacucucagccuguucccucauggcacuacgucugcugcaaaccuaagggguccccuuucaccaagaggaaucuggguucccaguuauguccuagucacgcccgcugcagacccucacagugugacucucagguccuguacccaagaugcuauuuaacuccauuccaccaaguucacuuccugucuccacaucaccuccuccaagaaguccucccugagcccucaggcuugguuggcucuguccucugugcucugccgugacagagcggaacacccugugugcuaaugaacaguuuccuuuuuuuuuuuuugagacaaagucucacuuugucacccaggcuggagugcaguggugugaugugagcucacugcaaccuacaucccugggguucaagcgauucuuaugccucagccucccgaguagcugggauuacaggcaugcaccaccaugcuacgcuaauuuuuguauuuuuaguagagaugggauuucaucaucuuugccaggcuggucucaaacuccuggccucccguaaacuuuuugcuuuaaacuaaagcacuuuucauauuuuauucuuaaauucacccaccucagccuccgaaagugcugggauuacaggcauaagccaccucacucggccauaaugaucaguuucuaugugacccugcucugccaugagcuucuggggacagcggcggcucguccucaucuuuguucccucguccccagcacagguucuugcaggugggagguucucagugagugcucgccaucaaaggugcccacgagggaaggaaugaguugcucauagaguggcugagggccugguggcaagcccaguggagucggccaggagaucuucggaggaggggcuuucgcacauagggcgcugucugagacugggguugggagccuaucccucuucccucccugccccucccgccuuggggauuaacagaauccugagauggagaugugcuggcacccugcucccugccuaccuguccuccaccuguccaucccuccuccccuccauccaucgcgcauccucucauccagaguuuaucaaggcaucuguuauggaccaggcacauuacuaagcccccagaggcugaaaguuuugggccgcucaggauaggacccuggggcuuuuaggcaccaaaacuccauauuuccugcuucuuccuugauuccccugaagaugggucuagagaguuggggagguagagaaggcagcccaggcagcauggguggguggggguaggguacagaccaugccugcuggagccgcccgcgugugcuguagauccacuuuauuucaguucaggacaacaaaagggcaaacaugucucuagggagaaaaacaaggacaugauccaguuggaggagaaaacucacauggaaggaaaguuaggccucuugugugcuguccagaccaggugcaggcguaggaaggggcaccacggcuucuccagagagaccuccucgcgccuguucucucucgcuucccuuguuccucagauggcucgcuucccucucugcgcccucugauuucuggucaaugcaaagccucuugcuccccugccccgaggggcccguggcugguuacaugcaaguucaauccccaggagccagggagggccugcuuguuucugagcagacagugugggguguggcauggagcugcugcugggggaggcugcagagcagccucagaccugcccucccugagagcugccaccuggguaggggccgggguggcucuccacccuuccccaccgcagugccugcuggggccaggagcaagggccacgcaaagggcggcagagauggggaaugaaggggagagaagcaucgggcagaacaguggcugcgagccuggcugaccguggaauuccacaggagacugaacacagccuccugggccugcuugggguuuccgacucagugggucuuggcuggggucagcuuugcugucugccccaggaggccauggcccuuguuugguacccacuuccuaggagucaugagagccgagcuggcucugccugauugguaagaauaaaggggagaaugucugaguaagagcaggcgagcccuggcuccuccaggucucagaggagcagaagcugaagauuucuggaaagcacuugcccuuaggguggagaaucgaggcucccuccaccucaccuccagcaccacaagcagggccugaggguggugcacagcagaggaggucccucauggccugagcuggguggagaaagcacaggaccaggcagaugggccuucuuggagcagucccugccacugcgucucugcuccccaucacuacccuugaaacaugccacuuucuccccagagaacagcaggaucaauccuguuaucccugcgccauccuauaucaccuuccucaugggacauuuggaggggacaagaggauaggaccaugaguaugaccauccucaaucuagacccagccugccugucccuucccugcuguguggccuugggcagacacucagcuucucuggaccacuguuuccucauccaacaaacgagcccugcagagauccuuccccugggacugggcucugagcucagaggaugcucuguccugcagccuuccagcagggaaccuuccagcagggagccuuccuggcuuucauaguuucuccucgccucggcugggugccugggauucugccagaccucagacuccagacugugggaauggucaccuugcggggaccugccccuccagcacccagggccauucugcuauuuuuaucugccauugguuaaucuguaucauuguguaggccagccucucggugcaguuuugccgcagcguguuaccaacaugagcucagauggugaccucacauagugaccucaguccaguggaacugcccgccaggcggacaggcacacggaauuucaguuuccaguaaagagcauauucucauuauuuucaggaaccuuaaaauggcuaauagacaucaucagcagggauugaaugccuguuaaaguaauuauuaaaguaaaaucaaguguguuuacuuacuggcgguaucacuuacagugacguacacagauccugagcauucagcuccaugcguguuuacuuauccagcccguaacuaccgccuggaucaaaacuaaaguacuccuacaccccagaagcuuccauccugccccguccugguuucuuacagcagggucuggcccagagcaggaccuccucagccagucggcaagugcacuguaaugggaccugggguggcagagucggagccggggaggugggcaagucccagagaggcuuccugaaagaggggggcugcuccacagaacccaaguguuaacuagaacaauggugguuuuaccaugcaaaggaaacaauaaggcacuuaccaaagcugcuuucugcccuccugaguccuagcccugagguuuguggcucaagaccagguccauccccauuucugaguggcuguggagugugguucucugagccuggcccccaagugcugagacccugagaccaggcagcugucucuaccuuccgaaugggagugugaucucuggccugugaccgcauggcagacucaaggccugaaggcgucuaagagcugggguugucuggcagcuggugcccgguccuggcagccgccugcuccuccugacaguggucauuucuugaacacagggcacagcugcccacaguagcgggggccuuaccacucugucauuggggaaaccugcuucucaaccaccuucgcuggccugcuuuucuccccugggauggaggaccuguccuucccuuggccgugugaccaucuguuagagauuucagaaagacuucagcuccaccugccuggacugcucuggguggcccccuccaggacuucccuggucccucuggccuggucuuuucuggcccauggcauccagccccuccacugcagggcccagcgccugugucggucugaccggaccaccuggacacuugugggaaauccucaccuugugcuuugucugugauucuccagcuccaagaagcccaagaaacaucccaaaguggccgugaaagccaagcccucgccccggcucaccaucuuugacgaggagguggacccugaugaggggcucuuuggcccgggcaggaagcugucuccacaggaccccucggaggacgugucauccguggaccguaaguagagccccauggucugcuccugguguccucucggugcccagccccaucaccaggcagggucuggacucacccggcgugaauaggacccauauaucuccccuguccuguuuagaugugauauagacucagcuuugugcuuccaugacaucugugggcagaugugggcccugggcuuccaggcacuguuugugugguaagcgauagggccugccuagggcacaugugugacuguagguuuggauuuaaugggacucugugucgccugcauggacucugcuggagggcucugugcagaguuggcagagggaaaaccgagcggccuugggacaucuccacucaucccuuggucccuuuccucacaugcccaggucguccuccggugaggggaauugaugccacccacuaauucagcccauacuuggugagcccucacugagggccaggcccaagaacaugcugaggagugagaccuagucccugucccuagucccuaucccgagggccccgggggccccuggggagacaggucauugccugacaguuacaaagcagcaccaguuaugacagguugagcagaggcaucaauuccuguaggacugcccagaagacuuccugggguggggcagagagagagcagccauggcaucccagccuagaggcuuccucugaccccccugcugcugccuucccacagcccugaagcuauuugaugauccugaccucggcggggccaucccccugggugacucccuccugcugccagccgccugugagaguggagggcccacacccagccucagccacagggacgccuccaaggaacuguucagguaccaccuguccccagcggcgcuuggccagcucugagaguguucuggacagagccaagggcccggcucauugcccagucucagccccagccuccucugaggggaggaccccaggccugugaaaaguagaagccugugggugcacauugggugagaggcggugaagggggcugagggggaggauccgcagcccagggcugcucagcuaguuccagaaagagagaacuuugugugcacaaccagucuuucuuuucacaaucauauuuuaacaguuuauguaaagaauaauuaaauuauauaauugcaagagcagguauaacuggcauaagcaaguuugggaacaaauuaaacggacucauggcagcaugcagcccacccagcgagggggcaaagugcagaugucuuggugauggccucucugccggagggcccggucggcagcuuucacagaaggaagggagaaugaggccucagcugucacauggaggucaauuggcagaaccugugccggugacagcuccuauuuccugaguccuugcuguguacgcaguaagccagacuccuuacacgcucucuuauguaaucuucacgacagcccccuaagguggaugcuauuuucuccauauuauaagaaaucaagugugggacgccaccuggcuaagaccccugcucugccccuggccuggccucuccacuucaucagggacugucugagcacuuggcugggugaucugccuccccacccagccccccaguucuccccaggccuuuaccuccacuggccacauucucagcagacucaguguugugcgugucuccagcucccacuccaugcuccaggacacaggacugugccugggauucagaggaagccaggccgccucuuuccaggaacggcuuaugugacaccaaggcaugcaggcccuggaggcugucaucuguaccccucauuagcagccucgggcuauuagacagcccugcaagugcccgccaagccugagucaccgugacggcuucugguauuuacauguccccaaggccccuggcaucuguucacucucauccuguguccucgcuccugacaucccagcgggcuggaagaaaccaggauuguuauuuuauuagagggaaaccgaggcacagggaaaugaaauacuagagucugccugcggagcagcagggccaggccgagcaugucuaggaguccaugugucccagugggguggcucucgugggaccuuucuggccuaguuuauucuaaauccguuacuucccaaccuguguucugcagaacgugguacagugggguggucaaaggcuaucuucaaaggggcucuguggcugaugaauuggggaaaugccacaaaaagcagggcucguagugcgcgggccagcaccacauggcacuucacguucucauucaucccugggccccccacucuguggugccccuuagcaucccgcagagcgcuuggggagucccugcucaaaaagugugggucccgcacccccaccuucacuuuagcagacaucugcuaaugaaaggauuaacugcuuuucuuuuuuuuaaauucagacaaauucaaaaagagccguaacacugggauuagcuucuugagagcaggaaccacauucauucuuugugucugcccugugacuauccagggaguaguuggacuuccucauaauaaagaauguucugauagccauucauucauucaugcuuucaccccuucguucauucugucacuagccucagccacccugaggccgcgugggguguacacugagcgggucgaggcuaagaaggcuuuguuccuucuggcugugcagccacaccagggcagggccucuagucuagauguuuaggugagucuugucuuccgcaggaacccagggagaaggaauggggccagggucuuagagcucccuuaccccccacugguugaccucacaccagcugggccuggaggagaaaagagcuggaccuugcgcuagugagagcuaguccuagucaugacucagaaauagggugcuuggaaaaggggugccuugcagccuccugugucccaagagcagcuaugcugccucccaccguggcugaccacccguguacaccacccaccugggagcaaauccagcugcugauuaguuccaaagagucacugcuuugccaagcaggcuaauccugaaaucugacauaagccucuagcggcugcuuuauuuuccaaagggccccuauuugaggauaauucagucccuuugagcuuuucccagguacccucagccuucaauggaggcugcaucaugccaguggagcuggcaccugcccugggggagucaaggaagggcugccacuuggagggagcuccggaacaucugaccugagguggccaggagcagacuggccaugagugacaccuccugaaaucaccucuaccccaagacagcuggucugucuaugaaggcccggcuugggccagucccucuggguuuguucaagaaggacaccuuuuauucauuucucugccauccaaacagacucugaauucucucucugggguuugugccccaucacaggagguugagccaggaagcaggcaggguguccggagcuccuuccacagcuggcuccaggcaggcauccaccccugggggugcugugcuggacaccuccauacucacacaggcucucugguagugccaggaguuguccugaucagagguaucgccucucuauccccaccccugcccggcccugccccagggcaagaagccgcugcucaugagccugccugguucuuccuguucauucucauucccaccuccagaccucugcugucugcucccuucuucagaauucucuccccuauucaugccaggcucacccuucugaaaagacccaccuucccaggaggccuucccagccugcucuggcccaagggcucacucccuucucuggacuucaacaccuucuuuccaggccuuugcaauuauguggccccugucugacugggcuggggggugucccucauuguagguggaggcacugcuuuucugugucuuaugcccacuugcucagccccuguggcugucaguagacaucaguacauacagccuuccuguacauuuggaaacuacuuuccuuguguugucuuauuugauccuuguaagaaucccugugaggaugguagagcaaguacaaucccacuuuauagaagagacugaggaccagggaggaggaguggccugaggcugccugauggaggaguugcagggugaggaacggaagccaguucuccuccugcagugcugugcuucuguguacaguuccgugcagcagugccagugacacuguuacuccugcuuguagaugaggaagccgaagcuuguagagaccaagugggugcuacaggucuucugccuucacucaccugauuccagcauggcugagcgauagacguagagaugcccguuagcacaagggaaaaccucgccgugacacuggagucuaggugccccagccaggggaacacaccccagagaaccagccacaugcaggccaaguccuguucauccucacacuagcugugggucucagggcaaggcccuuugccucucugcaccucaguauucucagcuguaaaacggggcuaaucucugcgaccacacaguguuuggagauuauugaauggguuaaugaauguggaaaugucuggccaucacggguguucagcacagagcugaguggguggaauggauugaaugagucuuccacugugcaucuggucuccagaaaucaaguucuggagaaucaguggccuggccuguuucuugcccucaguacccagggaugguccugagugaccguaacacugccagggcuuuuugcccacccaccagugggagauuagaggucuggggucaugacagagucuuggugggcccuggccgaggccauccucagcucucacuggguuccgucuggcacccguguggcccacagcggggcacugugggcgggccaagccuguaccaccauggcucagcgccccugguuauucuuucucuggcugaacuugcuuuggaugagggcucagcuucuaagggccgauguccuguuccuuccaacaaaggcacugucacauaccauccccucgaggucacucggccuccugggacuccagcguccucaucugcgugauggaagcacagucaugccuccccagaguggcguuuugaggauaagauaugauaacgugucugaagugcuguacagagcgggaacucuguacauaguagcuggugguuauuucugaagggauuggagggaaagcccccuacagaaggcagcgugugucaaguggggucaccugaagagcaacucucaggaggcugcguggggccugcccugugccugcuuugcugugggugggagggaaggagagcccuggccuucgugucuccucugggcaggauggguggaggggccagaguggaauggggcagagcagggcggggccuugaccuggccgaggcugggcucccugccgcugcccagccccgugugggcacuggcauugccuggggucuuguuccugucacgggguggcaguguuaugcucaggguuccucccugugguucccuagaguugaagaggacuuggaccagauucugaaccugggagcugagcccaaacccaagccccagcuuaagcccaagccaccaguggcagcuaagccggugauacccagaaaaccagcuguuccccccaaagcgggcccggcugaagcuguggcugggcagcagaagccgcaggagcagauccaagccauggacgagauggacaucuugcaguacauccaggaccacgauacaccagcccaggccgcccccagccucuucugacccuuccaugcuggccccuggcccagcaggccugucuguggggacaucggugugaagggaagggacugggcccugcagggucagaaccuccccacccccaggggaggccaggcagaagccugggucacagcacccagaacugcaugguuccauuuucuccggggcuguggggccaaaguagaagccugcgggcugcgggagcggcucucacccuaggagccagagcccaaugugucuuauuccccguggacaugaaggggagggaggguguggggaugccuugccaaccagaagcccagccccaaggaugaagcaagacauguggggccguagcgaggugucacauggggcagggaagcuucaugcccacggguucugccagccccagcacagacccaaacuggggcugggccucuaucccuccucugccucuguucgcauaguaagaaggagugaccgguauccuccccuuccccuacccuaagcuguagccugggugacugacuggccugggccugggguggggacguccccaagccaaauuacuccagggccucugcuccucguggcugccaggggccugcagggucugggugggucucccaggagaggaauacugagugggagaucggcugucuggaguguucugaugcaagucucucucuccugagccuccucuugaugcaagcucuaaagggagaagucaggcccugccucuccaggguauagacggcccugcuaggccccaguucuuccuccuucccccuuucccaggaaaggccagcccaguccauggccuucuugggccucugggcacagagccaauguucgucauugcagcucucagcaaacugggucauagcuuuccccacagcucagccuggggccugggcagggcucccagccugcaccgccucccacugccaguggggcaugauucucucaggcuucugccccgaggccuucgucguccucagggucuggacuuggucaguggccuuucaccaguggagcugccuucccagggagaaggagccgugcgccagggcagggcccgugccuuagacuucucccgacccccagagcgcugguacacaggucuaggcaccacacagugcuuuggaaauucucagugaaugauguuuaauaaagcaaaaaaugucaaggugucuuucuuggauauaauucuucauguucagagcuaguuuuuuguuuuguuuuguuuuguuuuuuaaugaaacaguaguuuuaaaggaaaugcaaccacuauugcuccuuggcccuguccugccuggcagaagcauugagcgggugggacuaggaccucagacccuuuucugauagacaccaaagccagcccugagggagcccccggcugauggugcgggugguuugcagccaucaguguugagugucucagcuccuggcccgugccaggaccugucugcucuguccugcaucugaucacgucccucuccagcuguggcgcccuguccugagcagcuuccccuccaccagugcuagagugagaggaaacaggugguuuuggggucgagagcugacucccuccuccuccgucuuaacccaggcucagagggucagcucccuccccagggcucugagccagcucugggacagcuccagcaccggcuccacccauuugccuucccccuucacacccgccccuccuucccagcacucagccccgggcccugcaucccuugcugacugcagcggaaggucucaguaggaguggggaggggauggggccaggucuuccuccgagagguggcuccagcucuccucugggcuuuguccccucccugcccuuucugcacccugaugcuggcucccugccuccugcuccccaccugcuuugggucaagugacauaggagcagagggcacagcgggguagguggccacaggggcuggugcucugcuuggggucacuggcagaaccuggccugcccguuguguauucauccacuguggacgccaccuccucaguggucuggacucucuggacaccaucacaaagacccccagauauugaugcuccaguaucuguggcuuguucuucacccacaggacugcgacucauggccaaucaaugauccuugucgccugauaaagccugugccugugacccauuccagccugu

SEQ ID NO: 16972 - RNA, 564 nt, Homo sapiens
ccaggcucagagggucagcucccuccccagggcucugagccagcucugggacagcuccagcaccggcuccacccauuugccuucccccuucacacccgccccuccuucccagcacucagccccgggcccugcaucccuugcugacugcagcggaaggucucaguaggaguggggaggggauggggccaggucuuccuccgagagguggcuccagcucuccucugggcuuuguccccucccugcccuuucugcacccugaugcuggcucccugccuccugcuccccaccugcuuugggucaagugacauaggagcagagggcacagcgggguagguggccacaggggcuggugcucugcuuggggucacuggcagaaccuggccugcccguuguguauucauccacuguggacgccaccuccucaguggucuggacucucuggacaccaucacaaagacccccagauauugaugcuccaguaucuguggcuuguucuucacccacaggacugcgacucauggccaaucaaugauccuugucgccugauaaagccugugccuguga

SEQ ID NO: 16973 - RNA, 564 nt, Homo sapiens
ucacaggcacaggcuuuaucaggcgacaaggaucauugauuggccaugagucgcaguccugugggugaagaacaagccacagauacuggagcaucaauaucugggggucuuugugaugguguccagagaguccagaccacugaggagguggcguccacaguggaugaauacacaacgggcaggccagguucugccagugaccccaagcagagcaccagccccuguggccaccuaccccgcugugcccucugcuccuaugucacuugacccaaagcagguggggagcaggaggcagggagccagcaucagggugcagaaagggcagggaggggacaaagcccagaggagagcuggagccaccucucggaggaagaccuggccccauccccuccccacuccuacugagaccuuccgcugcagucagcaagggaugcagggcccggggcugagugcugggaaggaggggcgggugugaagggggaaggcaaauggguggagccggugcuggagcugucccagagcuggcucagagcccuggggagggagcugacccucugagccugg

SEQ ID NO: 16974 - RNA, 2376 nt, Homo sapiens
caucugccaccgcagucugguuggagcuguugucuuguaugcucagcgaggcccggagagacccgggagagagcuaggccgaguccaccgcccgagucugcugcccgagcccgcguuacgcacaaagccgccgauccccggccuggggugagcagagcgaccaccgcccgggagcagcgcggcgagacgcacggugcgcccuaugcccccgcgcccccaccgcccccgccgcggcagccgaagcgcagcgagagaacgcgccaccgcggggcccgggugcagcuagcgacccucucgccaccugcgcgcagcccgaggugagcagugagcggcgagcgggagggcagcgaggcguucgcgggcccccuccugcugcccgggcccggcccgcucauggcggccauccgcaagaagcuggugguggugggcgacggcgcguguggcaagacgugccugcugaucguguucaguaaggacgaguuccccgagguguacgugcccaccgucuucgagaacuauguggccgacauugagguggacggcaagcagguggagcuggcgcugugggacacggcgggccaggaggacuacgaccgccugcggccgcucuccuacccggacaccgacgucauucucaugugcuucucgguggacagcccggacucgcuggagaacauccccgagaaguggguccccgaggugaagcacuucugucccaaugugcccaucauccugguggccaacaaaaaagaccugcgcagcgacgagcauguccgcacagagcuggcccgcaugaagcaggaacccgugcgcacggaugacggccgcgccauggccgugcgcauccaagccuacgacuaccucgagugcucugccaagaccaaggaaggcgugcgcgaggucuucgagacggccacgcgcgccgcgcugcagaagcgcuacggcucccagaacggcugcaucaacugcugcaaggugcuaugagggccgcgcccgucgcgccugccccugccggcacggcucccccuccuggaccagucccccgcgagcccggagaaggggagacccgugucccacaaggaccccaccggccugccuggcaucugucugcugacgccucuggcuugcgccaggacuuggcgugggcaccgggcgcccccaucccagugucugugugcguccagcuguguugcacaggccugggcuccccacugagugccaaggguccccugagcaugcuuuucugaagagccgggccucagaguguguggcugugugucuguucgacuccccucgccccauuuucaccccacccccgccucugauccccgggggcgagauuggcgcgggaguguggccgcgccccaucagauguucgcccuucaccagcgggagcuugauaucccuugucuguaacauagaccccggguacugcgggaggggagggcugcuggggaggauggggggauguuauauaaauauagauauaauuuuauuuucggagcuaagaugguguuauuuaaggguggugaugggugagcgcucuggcccaggcugggccagacucccgcccaagcaugaacaggacuugaccaucuuuccaaccccuggggaagacauuugcaacugacuuggggaggacacagcuucagcacagccucuccugcgggccagcccgcugcgaacccuccaccagcuaccggagggaggagggaggaugcgcugugggguuguuuuugccauaagcgaacuuugugccuguccuagaagugaaaauuguucaguccaagaaacugauguuauuugauuuauuuaaaggcuaaaauuuguuuuuuuauucuuugcacaauuguuucauuguuugacacuuaaugcacucgucauuugcauacgacaguagcauucugaccacacuuguacgcuguaaccucaucuacuucugauguuuuuaaaaaaugacuuuuaacaaggagagggaaaagaaacccacuaaauuuugcuuuguuuccuugaagaauguggcaacacuguuuugugauuuuauuugugcaggucaugcacacaguuuugauaaagggcaguaacaaguauuggggccuauuuuuuuuuuuuccacaaggcauucucuaaagcuaugugaaauuuucucugcaccucuguacagagaauacaccugccccuguauauccuuuuuuccccuccccucccucccagugguacuucuacuaaauuguugucuuguuuuuuauuuuuuaaauaaacugacaaaugacaaaauggugagcuuaugauguuuacauaaaaguucuauaagcuguguauacaguuuuuuauguaaaauauuaaaagacuaugaugaugacauuuauaaaaugg

SEQ ID NO: 16975 - RNA, 5481 nt, Homo sapiens
gaaucaaauuuuaucccugucugaggaaguguauuaugaagggcaagggacagggaggggcuuguccggcauaucaccuaguugggaaaaguuuauccuguguguggggcagucuuggaagcagccagucucugcagagcuugucaaaguauccuggacuaaaaaaaaaaaaauaccaugaaaagaaguuacuaaagaaguuacugcagaacacagaucuauuuguuuacuuuggcauuuuuaccaacugcauaguuuuagaaauuauugcaauauugagauuugagcuuggaacaccucauauaauauuccuggaaaucagaacacgaaggaguucaauccguuuuccggauucuuuguuuuuuaaagaaaaaaacacaugguacaaagcuuuguuucauauuucuugguauuugaaguuuaaggacauagccaaguuucccaagcuauauuaagaccaaggaaagcggcguuaacaauacagcuauaaaagguuuugacuaaaagaagaaaaauuuguguaaauaagacuuuucuaauaggaaaaaaaaaaagcuuccagauugcauccuuaaaucaaugaacagaaaaacuauuuacuugcugacagaucaguuccuuagaucugaaaaacaaacccccgccccccaccgccccggccaacaacaacaaaaaaaagcugguuggccgguuguuguagugaugugaauccagucugagggaagcacagcacuuccagucgucuaaauaagacguucccucuaggaagggcucuaggcuuagcagcacuacugccuuauuugaucugauuucaucuguggagccauauggggaccuagcucuuaacauaugaauuacaugugaaaacaccgggguucagucacaguuggcugcauggguuugcuuaaugauuuucuuuuuaauguuuacuuuuuuuuuuucuuuugagccagggucucauucugucacccaggcuggagugggguguugugaucauagcucacugcagccuugcccuccugggcucaagcaauccucccaccucagccuccugaguaguugagauuauaggugcaggccacucuccuccccacgccaucccauuuuauuuuucucagggacagggacgggguuuugucauguuacccaggcuggucuugaacuccugagcucaaacaauucuccagccugggccucccacgcccagggaucacaggcaugagguacugugcccggccugguuagauaauuguuaaagcgaaguguggaacugagguaagaaacccccagaaaauuccaccugcguuucugagcauucggguuaauuccccacagucauuuacugauccuuguaaaugccaggcauugugcugggucuucaagaugcggagauaagacagaauccuggcccuccaacaacugacagagaccgagacagagacggagacaggaggcaaccaccucccggucauguggugggucccuccuuugcugaaaaaacaguuugcagacauuucccaugcaauggauagacagagcccagcccaugcuguuaauacuuuagcacucaugagccccagcauaugcagcuccuagaguuugccccgcuccuucccaccuuccugcuuguguucaggcuguuucuccugcccgggagcccuccccgacuccccuuucccccuauccccuucuuccucuuuuauccguagaaaucgguugacuugggucuuuccggaucaccgguacugucauuucaugcaggaucuacaggauaaaugaguucaguccuggcgugcaucaggaggcuacgccccaauagaggggacacccccuaacccgcugugccccauuugcuagccccuuacuccuccccucuucuccagccucaagccuuuucgucugcucaggggucuuggggugguuggauucuauugaacccggaauauuguacguucuauuguacaauaguguauauucuauuguacauucuauuguacaauaguguauauucuauuguacauucuauuguacaauaguguauauucuauuguacauucuauuguacaauaguguauauucuauuguacauucuauuguacaauaguguauauucuauuguacauucuauuguacaaguguauauucuauuguacauucuauuguacaauaguguauauucuauuguacauucuauuguacaauaguguauauucuauuguacauucuauuguacaauaguguauauucuauuguacaauuuaucucagacaguucucuguuuuaagaaccgggaucagaguucauagugaaaagaggggccgaaggggcuucuuccuguccgguaacuuccuccaaguguucgagccucgaccuucccuuuccguugucaagcuugggccacuccgcaccucuucccuuaaucuucaccuagagaccuaagcuggggguugggaaggguaggggcggcgggacuuggaagagccaguuugcagccagccggucgccucucggguccaaacccgaggcuggcccacggcgaguacccggguggggcccuaaaccacaggaggggccaccuccaaaagaaaagagaaaacacucuuguuugggaacaaaaguguguguguggggugugugugugugugugugugugugugugucuguuuauuuaaaaacaaaaccacguuaaaagagcugccccucccccacaggcccgaccacccgccgggaguuugccaggaagaggggcaauucugaaugggagucgccaacgccccacugagugaagccugucucggaaccgcucgcccagacccuggaggcuccagacagccagcucccggaccccgcgcgcaaacgcugcggcgaaggaggggacccggguaccgccagagccccgcagcggcagcagcagcgcggacuccccggucgcugccucucccagcccggcggccugggccgucaaucaagcuggcccugccccgcccucgggcugcagggggcggccaaucagagcuaagcuccgcagcgaugagcucagccggcugguuucccauuggacggcuauauuaagaaaguggccggacucuuuaaauagcgggcgcuagggccgcagcccucaucugccaccgcagucugguuggagcuguugucuuguaugcucagcgaggcccggagagacccgggagagagcuaggccgaguccaccgcccgagucugcugcccgagcccgcguuacgcacaaagccgccgauccccggccuggggugagcagagcgaccaccgcccgggagcagcgcggcgagacgcacggugcgcccuaugcccccgcgcccccaccgcccccgccgcggcagccgaagcgcagcgagagaacgcgccaccgcggggcccgggugcagcuagcgacccucucgccaccugcgcgcagcccgaggugagcagugagcggcgagcgggagggcagcgaggcguucgcgggcccccuccugcugcccgggcccggcccgcucauggcggccauccgcaagaagcuggugguggugggcgacggcgcguguggcaagacgugccugcugaucguguucaguaaggacgaguuccccgagguguacgugcccaccgucuucgagaacuauguggccgacauugagguggacggcaagcagguggagcuggcgcugugggacacggcgggccaggaggacuacgaccgccugcggccgcucuccuacccggacaccgacgucauucucaugugcuucucgguggacagcccggacucgcuggagaacauccccgagaaguggguccccgaggugaagcacuucugucccaaugugcccaucauccugguggccaacaaaaaagaccugcgcagcgacgagcauguccgcacagagcuggcccgcaugaagcaggaacccgugcgcacggaugacggccgcgccauggccgugcgcauccaagccuacgacuaccucgagugcucugccaagaccaaggaaggcgugcgcgaggucuucgagacggccacgcgcgccgcgcugcagaagcgcuacggcucccagaacggcugcaucaacugcugcaaggugcuaugagggccgcgcccgucgcgccugccccugccggcacggcucccccuccuggaccagucccccgcgagcccggagaaggggagacccgugucccacaaggaccccaccggccugccuggcaucugucugcugacgccucuggcuugcgccaggacuuggcgugggcaccgggcgcccccaucccagugucugugugcguccagcuguguugcacaggccugggcuccccacugagugccaaggguccccugagcaugcuuuucugaagagccgggccucagaguguguggcugugugucuguucgacuccccucgccccauuuucaccccacccccgccucugauccccgggggcgagauuggcgcgggaguguggccgcgccccaucagauguucgcccuucaccagcgggagcuugauaucccuugucuguaacauagaccccggguacugcgggaggggagggcugcuggggaggauggggggauguuauauaaauauagauauaauuuuauuuucggagcuaagaugguguuauuuaaggguggugaugggugagcgcucuggcccaggcugggccagacucccgcccaagcaugaacaggacuugaccaucuuuccaaccccuggggaagacauuugcaacugacuuggggaggacacagcuucagcacagccucuccugcgggccagcccgcugcgaacccuccaccagcuaccggagggaggagggaggaugcgcugugggguuguuuuugccauaagcgaacuuugugccuguccuagaagugaaaauuguucaguccaagaaacugauguuauuugauuuauuuaaaggcuaaaauuuguuuuuuuauucuuugcacaauuguuucauuguuugacacuuaaugcacucgucauuugcauacgacaguagcauucugaccacacuuguacgcuguaaccucaucuacuucugauguuuuuaaaaaaugacuuuuaacaaggagagggaaaagaaacccacuaaauuuugcuuuguuuccuugaagaauguggcaacacuguuuugugauuuuauuugugcaggucaugcacacaguuuugauaaagggcaguaacaaguauuggggccuauuuuuuuuuuuuccacaaggcauucucuaaagcuaugugaaauuuucucugcaccucuguacagagaauacaccugccccuguauauccuuuuuuccccuccccucccucccagugguacuucuacuaaauuguugucuuguuuuuuauuuuuuaaauaaacugacaaaugacaaaauggugagcuuaugauguuuacauaaaaguucuauaagcuguguauacaguuuuuuauguaaaauauuaaaagacuaugaugauga

SEQ ID NO: 16976 - RNA, 24385 nt, Homo sapiens
cuggggcuggccgggagaccuggcggagcuggggguggggggccaguuuuugcaacggcuaaggaagggccuguggguuuauuauaaggcggagcucggcgggagaggugcgggccgaauccgagccgagcggagaggaauccggcaguagagagcggacuccagccggcggacccugcagcccucgccugggacagcggcgcgcugggcaggcgcccaagagagcaucgagcagcggaacccgcgaagccggcccgcagccgcgacccgcgcagccugccgcucucccgccgccgguccgggcagcaugaggcgcgcggcgcucuggcucuggcugugcgcgcuggcgcugagccugcagccggcccugccggugagugcggccggcggccaggcggggaggcggcgggaagccgggacuggucacccgcggaugccggcgggugcacguggagggggagggggagcgaagacuucccuucuucccgcgcuagcccagcgggucccgggacggugagccccgagaccagggcuccagccccaauuuccuccgcugucggugggugccgcaccggucccgcgcuggggaggguggggggccggggccccgcgcucaauuauguaaaacgucuccacaucugucggagcccgccagcccacagcggcgcccggggucgcccguucccacccuccucgccccggccaccgcggcggccgggcccccgucggugacccggggggaugcagugaccgcggccacaacgcccccccugcagacccuaauucaaaccagacccgcgggcuugcgccccagcgccgccgagcccgggcgccccgccccuugcgccagggcaaguuugggcgcagcgcggccggcgcgggagcgggaggcggccgcguuggcccggggagccgggccagggcugcguggggggcgcgggcgagcgucugcagggcccucgggcuugccgugggcggcucgaggugagcugagccggcccggcagcgggagguuccgggaaguuggccucggaacgcuggagacccggaggagcccaacuucugggcugcugaaguugagcuggccccggagggcgcguucccgugccgggcacggccgaggcgcaggcgccuuccacgcgaggggacccgggaauggccucccgcuccccggcucggcuuugugcugaagccgcgcggagggaaggcgggucccuuggcccgcccagugcagcugggagaaaagaggggcagauguggagcucggggcuguaagaggccuuugggugggaugcagcauccaccuucagcggggcugacgcuccacuaaagagggacguggccgacaaagagcagccugaggguccccagaaaguggcucucccgccccggccaccggccgcuagcccgccuuccccaaugggggcgcuuuguucucggccccuguaacccuuuccugggaacagccccguaacgccggccuugacgggggcugggaccugggccgcagccaggugucagcgcgggccgcccggugcccgagucugccgcccgaguucgccuccccagcccccgcgcccggugcuggcgucccggggucccuccugcgggccggcucggccauccccagggaugcagaggggaggugcggagccaggggcgcuuccccuuccggaaguggcggugucucgccacuacaucuggacaguucgacuuccccagcucuggcaaagggaggcacgugggcagggaaggggcgggggcggggugggcacucggguucuccacugcuaauguggcaucuggacaagucucagcagcgcugacccuccguaagcguugccucguguaguagcugccaguuauugagcgcuuugguuuuuuuuuucuuuacagagucugucucaugggagaugagguagggacagucguuucugagaccgauguguaaagcgcccucccugcuucccaggugacucgugcuuccagacauuuuccgguccaggagaggucccugugccuauugaacugugaaugggcuggacugugagggguaucugggagcacggggagggccaugauuuccgagcugggucucaugcacuccuggcuuucagguccaagaagcugcucucuaggguggugguuucuguggaacugagacugugcuuggagucuucgcuccgaguuuggagaagagaauggagcugggugccuuaccucccuggaccgcugggcaucaccucacugccccauucucgcacaugauggggccucagcaggggcggcugaaguuggguccuccaccuauuuccggcuggauuuaggagggcugcugguucccuugccugccugggguaaagcagacauuccagagcccugggaucccaccgcacccguuaaugcuggggaggcagguggaguuugggcuuccccgugaacugccuuuccuggaguuuucugugggcuggggcagaugcugcagugugaggcauuauuucuugcccagaaacuuggacauagggcccaggaggcaggagagucucaaaaggggaaaggagggagacucccuggagcugcagggagggaaggcuuccuggaggaggugcuugagcugagccugaaagccccaccugagcuuuggggucagacucuggcuugaagcuuagguguucuuuuugcuuuuucugaucuuacaaagauuaguuuguuuucucuuucccaguucugcccucuuccucuuacagugaauguccauguuagguuaaaggugggggcaugcacugccuucccaaagcucugauaccccuuuccuaaaagaaaucaggcagcugggauuugcuuuaagaugggagaagguauuugcaaguggcagagaucugacccucucugaaaguucacucuggccccagugggaagcaggucagaaacccccuggggaccagggaagcaaggagugacugaaugggugaggggaggcugcuaggagaggagguugcucaaaaccacucccaagagacuaaaacagguuugucuaaaaagguuucucucucucuuucucucuguguguguguguguguguguguuuacuguggucuuuuguuucugccauguaagaaaaauggcuuguucuggaauaguuauuugcuauuuuucauucuuucucucuucucuuucuugaaaggcauaaaaucccuuuugcccuaauuaugggggcuaguagagacauuuucccacagccuggcagagaggguauggggggaggcacuagcugccuccgcucaggcucagagccuucuagaagugaugucaucccuggcuucagcucuacagggaggguggagcgguuuaagucucuaccuguggcucaugauggguuccaguaaaaccucauuaacacacauugguagggagacaguaagaaaggagagagccuggaaagaauuaaugaaaagcuugacuucugcaguuuuuuagaggaaucuuuucuguugcagcagaauuuuggauuccugaaaucccuugggaaugagguguccuguguauucauauuuuuucaucaagcuaagaaucccuauuacccucgaguauucuuacucugggcaugacucucugaaguauuuauuucccuuccuuuaucaaccaaaaaaugcuaggcaugauuuaaucucugccugccagggucguccuccucaucauugugcuggguuaggacauugucuccuggauuuacugugcucugaagagcacuuugccccucugccuggugccccagguugcucuguuuugaauucuggucuuucuccuuuuuccagagagcagccagaagugacauuuaugugccugaguguagccagcagcuuuucugaucaguucuaauuuguuacuuuucuccaguggcacuaagaaacuaaucagaugaguuaggcuuauuuccaagcugagaguuuuaggcucuggguaagggccuugccugugagugagacugaugaucugugauauguggauuuuguacccuucaugaacuucagcugggaccuguugcagucuccccucuaccucccugcaccccaccuagaguaacaaagaggugcugccaaggugaggccuuuaggggccucucucaguggagaaaaaugagucaucucuugggggaagugcuugcugacccccauguuccaaguuccucgaccugguuugacuuguaagugacuugcuggucacagguagcuggacugaccagcugagggccauuauucuuuagccuugacuguuacucucagcuucggucaugcccccaacucuucaccacauguuugauuuggauuuuaguuccuguuucuauauaaugugcauccauacugugugacaggccagaaauggcuuuggauuaaguagagccccaggacugagucucaacucugccacuaauuuacuccauaaucuggggugagucacuuuccuuccaagucuuguuguccucaucuguaaagcggacaucaugauaccuguucucccuguccucauucugucauuugcguauucauuucauaauggauaugugaaaguacuuugugaugaaaccgccugaggaaaguuagcugucgauauaauuaagguuaccuuuuuuugagugccuacuguugagugcucaguacuuuucuuucauucuuauuugaacuuuacccaaaaccuuuacaauauauaucauugccccacuuuguggaugaggaagcugaggccuaggguggcgggccccuccauuggcugagacaggauuugugugugugugugcagugugugugugugugcgcauguguauggguauggugugaauacaucgcaagacugucaagucuccccugagaagccuggcauuugggggcuggcugaacccugcaaggcucuacugggcauuugcugguccguccugaagaccauggauaugagcguuuugggcugagggggcugggccaggcugagcuggccugaacagugccaucaggcaaacaacacuggguuggguucaacugauggccccucagggacaggcgagagcuccucacaggaaguaaauugggaccugagagagcagggugggaaccauguggacuggguguggaggggccuguuuggauggcgcccucaggccagaccccagguggugcccagcuugcaccaucuuuuaccuugggcgcuggggaaacauucuuggaauuagcagauucuuuuguaagccugggaggcgggcagcauggcgcgggugguggccagaacccaggacuccuggcucuggugccacagucaccuccugguccccuccaacaccagguccugcuggggguggggacagcccaugaggaacuggucauuaggcgauugccgggcuucaacuguugcccgauugccuucuuuucaccaaccaguuuuggaaucuuggguugaaagggccccugaggcccugagagauucagggaguuuguggaaagagggcuuuggugcugggauccuguacccugucacuucucucucagcuguuccagcagagguuggguuuuggaugggagcauguauucuggaaccuuccacugaaugggacaugcgugcccugacaggcuccaggggaaggcugauguguguaugccccucaccacaaggagguauguuuggggugcagguuguagaggugaggccgcagaggcaagacccugggcuuggggcuacuucagcaacugucuuauccagcugcagguggucauggggcccacgccaucgcuuccccuggaagagugagcuuuaccugugauguuacugcuuuugcccgcccucaggaagcuuucauuuagguggagagacagugugagaaggucccuggcauuccugagacaggugcaccgggucagcuugccuguggucaguacuguggggaucucggggagggguggccugagccuccccuggcaaguguccugcuuuuuggcagggccuguaagggugggggcaagcuuauggggcaaggggggugugccgugggaaaucuugggucuuggggccauugagucaggagagcagaacaggcggcggcuggaccugcuccugcacucagucacuugcccagcgaccucuccugcugcgcucggggcuucccgaggcugccacugguuccucuccccacugggagccccucaagggucucugaccuccuggcuuuuauggcuucguggcugccuaauuuuguguagaggaugggccuccucuggccgucagcccugggaaaaacucucugccuagugauucaccugaggguugcagcaccaugagaugcugugugugugugugucugugugugugugugucugcguguguaugucuguguguauaucugugugucuccaugugucuguguguguguccaugcaucugugugucuuuguccauguacgugugugugucccucuaugugucugucucuuuguguuugugugcguccguguguguguccguguguacgugugucucugugugugugugugucuguguguuuaugugucugugugugucugcguccguguauauuuguaucugugugugucuguguccguguauaugugugucucugugugugugugucugugugugugugugucuguguguguggugggggggugcuuacugcacagguugccacugcauuugggccuugccugggcacuccugacuugccuuccccugucaggcugcagucucaguuuuggggggccuggucacuaccuggcugcagcuuccuuuucagacaccagcuuccuuucugccucccaccucugcugguggccuuuucucuuuuucacuguggcucugacauccaucauggccuuggccuuggaaaucugugggaguuauuccuacagagacgggcagucaggucaccuggccuuccugguucagcugagccccgacuguuuggcuguggcaggccauugccucucugggccucaguuuccuccucugccaaagggucguucuuccuguccucaguucugagagccacaugguuacagagagaccuuauccugggaagggcagagguggcacugaaggacuuguugggggcucacauuucucugccaguauucuuucuugggacucgaaggagaguugguugcccaaggggucaucggugggaugggcaaggccaguggagggcagggcaggcugcuugagggguggauucgagcuccuugugggagcuggaguggacagaggugccugggugacguugggccagggcuggggcuguaugauguucuccgcacacacacccaagaguccuggcaccugcccgagguccgcucagcagcaggaaugaaggcuguggcgggcagguuggggcaguggggaaggcgggcauguugaucaguccacucaucagcugagucauggugccagggccacggguccuccccugagacucacccaaccaaccuugauccacugcaagcccucugggggccggcacgaggcagagagugcagcaagacacagccggggcucaggggccuggcuuucugucuuggcccugccuccucucucucgagugacuguguacagaggccucucuuggucucagugaacccaucugugacauagggggaaggggcugagaggcagaggugaggcaaugcuuuugggugugcauggccucuuguggcugugucgugugacugguggguaucugggggccugccugugcucugcugccucaaguucugagggcuucaugagaccuaucuggcuugaccagaucuaaagcccagauccuggguaccugcugugugcguagcccugugcaguggugagaguuccauaucugguccaggggauuccuguaagagaggguggcuguuacuggaaccagacgagagagguggucucugcagugacaaugaacgggauucgcgauucagcaccugucacgucuccccacaggaaggguuuugucccagagucccacgauacagcaguaucgaacuaggagccugggcuguaaggcaggacauuuuauggagcuccaaaccuguggggcugccuucuggccaugggaagugucagggcagggggucucccugagggagcugcaaaggcugccaguccugcucuaggaccacucgugugcaccauggaucuccaaagguguucagggaacucuuccccacgguggcgugagcuugaguucauagucauuuccacguggggcugccuggcucucucuguggaucuucugugcuacucagcaggcugagagacagaacucuggcgccuggccugggaugcguacggugaggauugcacgucugccagggugggauguggggagguuggaggaacuucuggagggccgaggagcucguggccaacuauggcauuugucaugaacugggucccagaaagcccuuuagaacuugggcccuggcccugcuguucccaugcuaccaauaccagugguggccgcugaugcuccagggaccuuaccugguuggggacuugauugugucagaguggcauugacucuaccuccaguagcuuccugucaucccugcugcccaggaaacuguccgaggccuuggaaggcccaucuuaucuguaguguuccaggcgaauaugauggucagguuugggcuugcagggcccgagguuguggggcguuucaggagccucugagaccuuccuagaggcuggugucauuccagcuucucccagagaaaaccgcagggugcagugcugcugugauggugaccauaucucuuccaggaugggguaucggggaggguccgggcggcaagaccucaaggcuggccagggccugcggggcugagggccaggcugggauugugggccgugcuugggcugcaugagaucuucaggcccugccccccaccuuccucccugaaagggacuuggggccugggggaagagcacaggaggaguuucccuggggucaggccuggaaaguccaggaagcucaccccugagucuccucgggugaaucugcagcagugacugguugucuugggcucagggaauuguagaaagggcauagagcccccugccucccuccccaccucccgugaaugagguucauucuuagagaucuugucuggaggcugggcaugcagugggcacucuggcccaccugucuucccuguguaaggcagucaccugagccugaaggccugggccuuccugccuuuauugaguccugagaccuuggggcuucacagcugaggugggaccgagaacuagcuggcgugguuagucccggcucgggcuggaguggagagguguuguggaggccaggaggagcacaggacacggagucuagcccaccuggaucacauccggacuucauugcuuccucccugugucaucgugagcacgauucuucaccuaccccagccucaguuuccucaucuguaaaauggaguuucucauauccugccccagagggcuuuugcagagguuccaugaaauaccauaugugauaugauuggggccccuuccuugccuagagcacagagaagcaagucuaggggagcacugaggcugaccugugggaaggggugcagucugacccagccugagcguggagucacucugugugaauggccugcuggucugaccccagugcugcugacguuaacagggccugcaaacauggcuuuugcccuucucagaaacaugagccuucacuagcaggcuagacuuugcucucuuccacccgagccucugccaggggcugccuccugaccugagaagguacgggcuggguugccuccugaccugagaagguaugggcugggcuggcagaugggagaggaggccaggcaaagccagacauuggggcacccuggcaggggcucaggccugcugggcaggaccccuagcaauggggcacgguggccuguccccagaacuucagacugauggcuguccuggagaaggagcuggguuuucuauggaugccgacaaagcugggccagacugcagggugccaccaguggaaaugauggcuguugucuuccugagagugagagagcccugugggcuucacugugaugggugguucauggcaugacugccagagcaagacugcuggcuucaguggcugugugccuugggacagaugacauagcuccuuugccucaauuuucucaucuguaaaaugugcaugguacuagaaccuaaggugacugugaagaucaaacuaauuaauucagagaaagugcuuggaaaaaacugauugccagcuccucuggcccagaggacucaauaaacauuagcuaugaucacuuuuucucccuagagccuaauucaguuguuucuauucuucaaguaaucuccaguccagaucagaggcuuagacucuucuuccaccacacccccugcccaccaacuccccugguagucccugagcucugggcaaggcauguggcuacuucccuuuccuagggucaugcugagcuuuucagacuggagcuguguccacagucucccuuucagccaucucaacacccaccgugugcagaggcugagagggcuaggagcucugugcuggggguuggaggcugugcagaucugccagcccaucagagggagggcaagccacuugaccuggggcccugccaguaaucuggaggauccaccuggcuucccagguggcuucucccucuucagagagagccgucacagaaaauucugucucccaucccccaaaccagaagggaccagccccacccuccccugggacuccuucagggacacucugccuucccgugucucugggcuucucagcagccucagugcuuacucaaucugaauuguucuuuaucugagaggcagguucccaggcuagcccauuguucuguacgugggaggagaaaccguguacaucugugacuccaggaagagcaaagagaauuucuuccuccuuuccuggguauggcauuguuggcauccacauuuugacaaagguuaaaaacuuugcccuugacaucuuccagccucucuguuguaauccuguucccucucccagagcucccaccuacccgcaguggccuaguuccagaguuagccccuccccaccuggaagugauuuaugcuguagugugagugcugguacccuuuagccuucccagaggacuuguuuucaaagggauauugugcaaugacagggacacugauaggagagauuuugguaauaaaguuggagcuuguuccccucccccaccuucacacacagcuggagcccuggccggcugcaggugugucaaaagugcaguuucugccucugugaaacuugaggacacuuuauuuagcaaguacaagggggaggaugucccuagaaguccaucuggcagaggugccccgguccccagguccgguggcuacccauuccaggggaccugguggggacugacagggcugggcuucucaguaagggccgacuggggaaaucuuggcugagauucugaccuuggugggcucuuuagggcagacagggcugggggagggacagugcuuuggaggcuuggcugcccccucuguccccauagggugccaguugccccacggucaccuugauuuaggauaucucuggcauccugccuaagccaugacuccccuugggaagcugagggugaugauaccaagucagugugaucgaguguccuugugggucccuaagugggggguguuuggcgagucuugggagacagaucccuuguuuggcucucggagcagaacuaggcacugaggcugcagggccuggguuggguugcuuugcucaucgccugccuggaugaaaccuugcccugccuggccuggcccggguuuugccagggggggaaagcagaggaacuggucuuccagcuccacggcuccacgcccagcccucagcugagccuguucugagaccaguccuggcaugugggcugcugaggcaggcgccagcucuguggaaggguagguaugggggugcugggggcagcacuggcuuggcuugggcaucggagcuggcaugaggcugccaggaucccuccuccuucaauaaacgcccccgguguacugugagcaggcagugcggugcagggcaaaaagcccagggcugggaggcucggcucugcgaccuugaccucaggcuucccaucuguaaagcccugaccucacacuaaauggaaaauauuacccgaaaguagucuugaaggccaaaugugaaugccgucccuccacccuggcccugcccuggaagcccccaggacagugagggguccgucuccaaguggcaggguggggcugugcuugggggugccguccagaguguccccgaaaggugcuccuccucucagaagugcugcuggggacagccuccucuuccugcccauuucugucucccuccugcccugggccgggcccaucacucccugccugucauacccucggcaggccccggcuugccuuguucucaguagagagccagugagcugauaaauugcugugccugucaccggaaaugcugaugcugccuugaggccccagugaggccccuccuccugggaauggcuucagugggggauuucgggucuggaggcccagaccccaucugcagccucagccugccucccuggcgggcuguguuuucccggcuccugaguucggaaaccagccuuaggagaggagugaugugucuagcacuuccuccacaaccccgaggcugggggagcccagugucuccuggccuguggcccugcccugcugccuacucccacgagucccaccauuuuggccaaaccuccguuguacagauggacaaccugaggcaagguguuucuggcaccaccccguaauuuagggacagaggccagacugucaccagacuauccccauguuggaccuggucauuuucccugggccacccucuggugaucagugcugugggucccugaggagggggcauuuggagagucuugggggacagaaccccugucuaguucccagagcagcaccaggugcuaaagccgcggggccagccugucagccguaaagcacuuuagcguuauccaccaagccccuucuggcgucuagguggagaacaggucuagagagaggcugaaagcugcccagguccccagcacgggagccgcauggcggauuccagcccuuucccagagacccuugcuccugggugcucggauaugaccugccugcucagugcuuaggccguuuucaguccaggcugaaggaaagggucacagggcuccccacagagggaaggcagccacagauccacacugcagggcacugaggcguucggaaggcagugggacugggagaggguguugcagcuuuuucucccgugcccucccacugguaccccuggaaaagcaggaccaggcccugcagccugugcugccuuccaggcccagccuucguccccggagcccaccugccugucagcuccagcagcugucuucugcucagcccugcuggguccagccgggccggcuggugggaagccagugggcucagccccaggcacgaaggagccucagcccagcuucagguagacacuucccagucauguaggugcuucuggauguucagugggccuucagcuccugggggagggaggcugggcugccaccguggugugcuaucuaugcgaguggacgugucggaaauguagaggacauugcugagcuuucccugguccuuuggccacuagagcuuguucacagggcucuguugcuacucagugccuugacuuugaacacuggacucaagugaaacgagcucuugccuccuccaggcugggccacucugggggaugccuuuuccuccccucauuguuuucaaagugcagucugaagacccccuacaggaccuggggcuugugaaugacagagucagccucugggcggggaacucgaaagacuucauuuguaguggucuccuggugauucuuggggacccugaagcugagagcccccagucuggaugcaggugaugguuugguuaucacccucagccaguauggugucuugaugcagagguggggguaaaggcuggggcucugcagcucagagauaucagcccccaagaguccugaagucuaggggaggggagagucagccuguuuuccuuguauguguagaucugacugagaaaccaaggggguaaagaagauuucuaaacaacugugacccuguuucaagccuccugaggacauuugccauuguguggaaucucgggauggggaggguggguguccagccugccaugaccaugggcccuccugccucaugaccucgcagccugggcuucuggaacaggucugggucucuccuguccacuggccccagagccagugccauggccccugguccagguugcuugucaaagguggugaccuagcuccuuugauaaggggcagcucuuuaucccugguuuguugggguuuguugauucagugacugggcucccacagaagccggggauuucguggccacacggggcagguacagcugacagaucagcuucccuuuccugcuccaccacgaaugacugcgaaucagaggcccccugcgcugcccaaguuagugccuggggugagcguugucuuauccucuccugaguugguuugggggcuucaaggccuggccuuaguaguccccuuagggaagcccucuguacuucagccucugaagcucccccuuuuuaaaucccccuggagccggacaccuggccauauguucugaggagcugggagcucugccgggccaggaccagacuguuucuucccucuuuucuccaaaagcuccuggcgugaucuuggcucacugcaaccuccaccuccuggguucaagugauucuccugccucagccucccaaguagcugggaguacaggugcacaccgccacgcccagcuaauuuuguauuuuuaguagagacgggguuucaccauguuggccaggcugguuuggaauuccugaccucaggugauccgccuaccucggccucccgaagugcugggaucacaggcgggagccaccgcgccuaguaguaaugcuuuuuaagggguuuguguuuuacccaucacucacuucaagcagcaggugaccaaugucagugauucagggugcgggcuggaaaccaaaggccuucugaccugguggccucaggcugauggcgggggguagaugggcaaccucucggguuagcgacugggcccgcugccccccgucgaaccugucugagaugcccacuggacauccuggcuucugaggcagccaaggcacuucugagcugucuugcagaggagcugcagcgcagcugccccuuagccccagggcuggccaggacaaggggcucugcugagacggagguugccaaggagaguggcccucuuuaccucuguuacgggagcgaaagcuggcaguuggcuugaggcugccuucuggaagcuucucugccagcucucugcccacagacuucagaugugcucuuuguaauggcuggcagccggugaugaugacuccccaucccugguggcacaggucccguucuggucuacgccauuuccucuccaccucucaaaugugggcuggucccuggguagcgucaccacuggggcaggcucagcgacuccagcucagugaaacuccaucccacugaggagccuuagacagguuuuccuuaaaacugauugggucaacugguagggcuggggagagagaaggggauggcaggugaggagagcagugcugcugcacggggaguuguagugucugggcggccuugggcaagucccucaccuuucagagucucuaguccuuaucugcuagagacagugaucucagccccgcugccucaucugcaggggaguuguagggaagaaagaggaauggguggaaaguguuuccagccuuagagaaggccgcacuccuucacacucucuuucuugcugggucagagcccugaccccaggauucucuccaggguccccaggguauggccaggagaccagcauggcugagauggagaugggcugaccugacccuuacucccuuacucccuguccccagacuccaggcaguugccucuugaucccccagccccuaggcgagccaaaccuugggcuuucuaaucagugagcuucuagggucugcgcuguggguggggaaggggcaaggcaucccuugcuuugaacaacagaaugaguggaagccuagaucuuaccuagcacaaaguuguugauucguucuaugaacaguugguuuuccugggacuuacagagguuaaaggcugguuagccuguugccuuccugggcagggcauuagguagucuccaagcugaggccaccuguuccugagcagccuugagccguggccaggcagccucggaagcacccagguuggagaugaugcuggggagagcuacccaggaggccuagagggaguuugcugccggcugucagcacagcaggccugcuaaaggaaaucgaaagucucaccagaaacuccgggagucagcuggcaccuugguaauccaaguucaaacucagcaguuucugcuaauuuccuccucagggggcugaaaucucaccuucucaucugaggggcugucccagaagauucaagcuggagaagauuugggaggucucucuagccuguccccuuaguggagacugaaggcccagggaggggagaggcccccggaggccagggagcugguuucaguggagaaaacauuugcuuaagagcuuguuguguaaacaagauugcagagggauaagccagccgaacugagggaacaaauuguuuuuagggacagggcagacugaaaugcuuaucuagucaggaggaaagcccugcucuugggaaacugcuaacguguuggggccucccuggcguuccugggucucacugggcggugucucccagguuguacaugggccccagugugugugucuucccugugggcuucgguugccucauuguugaauggagcauggauccaaugguucuagcuucugcugaaagauucggcacucuacaaugcagcagaggcucguggggucgaagugccagugccuugccccaucccugccccaucuugagcuuucucuugggggaggcggugcagcaggagagggcagggcagaguccuuggaugagagugaagccaugaucccagugaguaugggugggggugcccacucugugaucccccggugggcaguauucuuugaugaugaaggagacagguugagggaggccagggcagcuucagagcucugggaaggcagcacagguguuugaagcaccacauggagauguuguagaucggauguggccuuguguggaggcggggggagcauggaccaugacuguuuguuuuuauugauugauugauugagacggagucuugcugugucacgcaggcuggagugcaguggcacaaucucagcucacugcaaccucuugccucccggauucaggggauucuccugccucagccucccaaguagcugggacuauaggcccgcaccaccaugccuggcuaauuuuuguauuuuuaguagagauggggguuucaccauguuggccaggcuggucuggaacuccugagcucaagugauccucccaaagugcugggauuacaggcgugagccacugcaccagucaagucaaugacuguuuauuguagaugggccaugguggacugugacuguucauugcaggugagccuuggcggaaugugacuuguuacuguagaugggcuaugaauugcccuucuagggucaaaaccuuucucuugggggaaggaagauacaguuuagcuuuuguccuuucaaaggaaguucaguguuauuucugaccuugugguuucuacacgugucugacgcuucccucugaccuaggccccuggacguggagccuccaccuggucuggcucugccccagggcugccucaggaggcaggaggucuugucugucccucucugcuuugcacuacccagaagugagacccgugggccuguggccagggccuggcaaggccucuugggcugaggaggcccuuuuccuuuggagcccagccucaggugggcccccucugacaagucagugcagaggcuucuggugaacagacuucuuccugcccccgucuucucaugaaacuuuaucuaccucccuuucacccucuuucuagacaggccugcuggcauuugaggcuccccuaguuagacaguggccacuguuugugggugcccacugggugccaggcuguguuaggcauagcuucauugaauuuuggcagcaguccuggaauguagauguuauuauuuccccauuuuacagauggagagacagaagccauaagcaguuuaaugacaucccaggaccacgcaucuagugaguggcaggauccggaguuccuaaagcuagugcucuggacugugcuguucugcauauuuuuucauucuuuguucuggucccagacauuggggcccucucaagauagacuguguagugagugggguccuugggucuaagucucgcaggugaauagggcucucaaagccacacuucucgccaccuggcugcuggguucucucuuccuuaccugaggucuuggggccagugugaagggcagaggcaguccugacuuucugcccucccugccgaccaggguucugcacaggccugcucacuguguguggcgugauccugccuccccgcccccgcccccgguccugccagucagccccggccucaggaacuggagagauguguauauguuugcccucuggccccuuugccucuuggagcugggcaggcgggcagcauuccugggacugcuguuugccagcagggcccgucccaggcccacagcccacuucuuggaggcuugucagugcagggccccuuccagauuagccuuauauguccccagccugauggacacccuguccuuccuuccccaaggaggaugauacucugaccaaagggccugcacccagucuuuacuauagacaggaacugggccaagugugggaagguguaucagggccaggccugggguugcccugugugggcagaccugccucagaacagacaguuccuugugcccagcccugccccugccccuugugccguccucgguauccacaccugggggccagcaugccuggaggcugccucugcacccagguuguccugagauuguucuuggggguuuuugaaagccucucaguggggcugggucggcaaucuuuggccccaaagcucccuggcugauggcccccaagagcugguucacaguguagggugggcugauggggucccauggggaccacagccucuguucccaauaacagcucccugucugcccuucugagaggucuggagcucccucaccagacugagcuucucagggugagggcccugccuacucuguugugccccugcagcccugcacccaguaccaggcuguguuguagcaucaggggauggggccuggggaccaaagugcugcccagagcugaggguccuggagccacaugagaaggcuucucccuguguaccugugcagcacaggguagggugaguccacucagcugucuaggagaggacccaggagcagcagagacccggccaagccuuuacucauaccauauucugauccuuuuccagcaaauuguggcuacuaauuugcccccugaagaucaagauggcucuggggaugacucugacaacuucuccggcucaggugcaggugagguugucaugggggccccccccacccaagacggcaacaggucaugccugugggcaguggucaggcagucuccuguguuuacugagcauguacugagugcacccugccugcccugucuccacccagcuggcuccaaagggcaaugcugaggagaggaaugggguccgugagcugccugguuaaggagagcucaugcucggaggugaggugaaggcugugagcuccagaaggccccagggccgccugcugcacgcaggcucauauucacuaggaauagcuuuacucacuaagaaaccucuggaacccccuucagaagguuauuugacuccugagccucuguuuucucaucugcaaaaugggaauaauaccuugaccugauaagcuuguggagcuguaaggcagcacagagccagcugggguguagcucuuccauccaagcucccuuccuuacuuccccuuucccugugggggacugggggagagaagucccugagcuggagguggucagggaagcuucacagaggagguggcucuugaguggaccucagaagaggggugagagagcuaaggaaggaggcugaggucaucccuggggaagugaccuagcggaggccugagagcugcaagguaggauaucuguuguuggaagugucuguuguuggaagugggggccuuuuuuucagggaggguggggccagagaagugugugcccugggauaaguaggauaaccacaguaguuaugccccuaagggaugcccaccccaccccuguggucacagaaaagcuuucccagguggccuaggcaccugucucguggcuccagagaccaggcugcaccuggacacacacaaugggaagggacagcucuccuuguccauuuuccaaggagcuuagccucagcugccuuguccagguacuagccucccucauagccugagcuuggccagcccaggugcucuggagccucccccgacccacccaacacacucugcuucugguccuccccaccccccaccuccccaacacacucugcuucugguccugcaggugcuuugcaagauaucaccuugucacagcagacccccuccacuuggaaggacacgcagcuccugacggcuauucccacgucuccagaacccaccggccuggaggcuacagcugccuccaccuccacccugccggcuggagaggggcccaaggagggagaggcuguaguccugccagaaguggagccuggccucaccgcccgggagcaggaggccaccccccgacccagggagaccacacagcucccgaccacucaucuggccucaacgaccacagccaccacggcccaggagcccgccaccucccacccccacagggacaugcagccuggccaccaugagaccucaaccccugcaggacccagccaagcugaccuucacacuccccacacagaggauggagguccuucugccaccgagagggcugcugaggauggagccuccagucagcucccagcagcagagggcucuggggagcaggugaguggccucugcauuccuugggaaauugaguggguugguccuaaugccuggcacuuggcaggcccuacaccugugcccugcgggcaucucguauuccucaccaggaagacagggcacaggggcccgccuuccccuacccccagggccucgcccagagcaggacagacuaacuaugagaucagagcagaagcacccuuaaagaucacccaagagagggcuccccaaacucacaauccaaacuugcagccccugcugcaagagugaacguuauaccaaguccaauuuuuuauuuuauagcuucgugggaauuuuacgcuuuacacuaaaauaagucugcuuauuuccauacaaaaaugugugcuuuguaucacuuuuugugauauccaugccaugguccagccaggguccggaguugauguggcaagaaggccuggcuuucgggcccugugcgauccugguuugggugcaucugagugggugguggcaaagaucagggaggcaggagcugcuucugggucuuguaguggagcugguugcugcugcuggcggugaccuggccaacccaaucugccccugcccucccacaggacuucaccuuugaaaccucgggggagaauacggcuguaguggccguggagccugaccgccggaaccaguccccaguggaucagggggccacgggggccucacagggccuccuggacaggaaagaggugcugggaggugaguuuucuuucagggggguaguuuggggugaauugcugcuguggggucaggguggggcugaccacagccaaggccacugcuuuggggagggucugcagcagagcccaaggagccgcugagcugagcuggccccgucuaccugcccuaggggucauugccggaggccucguggggcucaucuuugcugugugccugguggguuucaugcuguaccgcaugaagaagaaggacgaaggcagcuacuccuuggaggagccgaaacaagccaacggcggggccuaccagaagcccaccaaacaggaggaauucuaugccugacgcgggagccaugcgcccccuccgcccugccacucacuaggcccccacuugccucuuccuugaagaacugcaggcccuggccuccccugccaccaggccaccuccccagcauuccagccccucuggucgcuccugcccacggagucguggggugugcugggagcuccacucugcuucucugacuucugccuggagacuuagggcaccagggguuucucgcauaggaccuuuccaccacagccagcaccuggcaucgcaccauucugacucgguuucuccaaacugaagcagccucuccccagguccagcucuggaggggagggggauccgacugcuuuggaccuaaauggccucauguggcuggaagauccugcggguggggcuuggggcucacacaccuguagcacuuacugguaggaccaagcaucuuggggggguggccgcugaguggcaggggacaggaguccacuuuguuucguggggaggucuaaucuagauaucgacuuguuuuugcacauguuuccucuaguucuuuguucauagcccaguagaccuuguuacuucugagguaaguuaaguaaguugauucgguauccccccaucuugcuucccuaaucuauggucgggagacagcaucaggguuaagaagacuuuuuuuuuuuuuuuuuaaacuaggagaaccaaaucuggaagccaaaauguaggcuuaguuuguguguugucucuugaguuugucgcucaugugugcaacaggguauggacuaucugucugguggccccguuucugguggucuguuggcaggcuggccaguccaggcugccguggggccgccgccucuuucaagcagucgugccuguguccaugcgcucagggccaugcugaggccugggccgcugccacguuggagaagcccgugugagaagugaaugcugggacucagccuucagacagagaggacuguagggagggcggcaggggccuggagauccuccugcagaccacgcccguccugccuguggcgccgucuccaggggcugcuuccuccuggaaauugacgaggggugucuugggcagagcuggcucugagcgccuccauccaaggccagguucuccguuagcuccuguggccccacccugggcccugggcuggaaucaggaauauuuuccaaagagugauagucuuuugcuuuuggcaaaacucuacuuaauccaauggguuuuucccuguacaguagauuuuccaaauguaauaaacuuuaauauaaaguaguccugugaaugccacugccuucgcuucuugccucugugcugugugugacgugaccggacuuuucugcaaacaccaacauguugggaaacuuggcucgaaucucugugccuucgucuuucccauggggagggauucugguuccagggucccucuguguauuugcuuuuuuguuuuggcugaaauucuccuggaggucgguagguucagccaagguuuuauaaggcugaugucaauuucuguguugccaagcuccaagccccaucuucuaaauggcaaaggaagguggauggccccagcacagcuugaccugaggcuguggucacagcggagguguggagccgaggccuaccccgcagacaccuuggacauccuccucccacccggcugcagaggccagaggcccccagcccagggcuccugcacuuacuugcuuauuugacaacguuucagcgacuccguuggccacuccgagaggugggccagucuguggaucagagaugcaccaccaagccaagggaaccuguguccgguauucgauacugcgacuuucugccuggaguguaugacugcacaugacucggggguggggaaaggggucggcugaccaugcucaucugcugguccgugggacggugcccaagccagaggcuggguucauuuguguaacgacaauaaacgguacuugucauuucgggcaacagcugc

SEQ ID NO: 16977 - RNA, 4948 nt, Homo sapiens
gacauuaaaggagagagaagaaggcagagagaagaucccaaggauauuagggagagugccgugaagugagaaagccggcgugguguguaucuguccacacauggguguggacacagaggagguggacaguuaagacaagugguuccugaguaacccagaacuugggccugaucaagaggaugagucuguccuguggaaauaugggacucaggccuugggccagggugucccuguuucugggcugggagcaucaacacaucugcuggucuuugcugaucuuggacucacccacagagaugucugugccaccccugcuggcuccugguguguucggugcucaagaaacccuuucaguggcagaggagcuaccugaggugggauaccugcauguggacuaauugcaugggauucucaguucuugcgugcucagcucucuucacaucccucccaccccagcaugagguagaggaaccacaugguggacccaggaacacaaagauaacacagcauggggcugggccucgucccaaacauacuuggaagccaaacaggcuguccugggacccagcacaggcacaaagagcugcucagauggaguuuuauugggguguaugugugucucucucccacaucaucuggcacccacuugccuccagagaaagggcuucuucaucucucacguuagucauccaugccugcacgaacaacuggcucuuuccacagcuuccucacccaucccggggcaaagccagcacggugccuggcacagaaaguugcuucauacuuuccuaucgaauaaacagaugaaugcacacuuugaacaagcacccacccacaggcgaaaacacccacuuccucuccagcccggcagggaccccucagaggcaugagcauccccguggcccagugcucguucccaccacagugaugaggcucuggaccuugggcugagcuccuuguuccccaguggaaaggccaccuuggggacugcugggccaggaggucagccagucagcggccaugcugagcagggacagcuguuuccagcagggcucccaguucugggauugggccgaagggauguggcccaggccaggccugaggagagaugagccaccccacccuccuccugaucuuccagcugcuccugaccuccaccuccgggcuccuccugcuccuccagcugcuccugaccuccaccuccgggcucccccugcuccuccagcugcuccugaccuccaccuccgggcuccuccugcuccuccagcugcuccugaccuccaccucugggcuccuccugcucuuccagcugcuccugaccuccaccuccgggauccuccugcucuuccagcugcuccugaccuccaccucugggcuccuccugcucuuccagcugcuccugaccuccaccuccgggcuccuccugcucuuccagcugcuccugaccuccaccuccgggcuccuccucagugccuggucagcuggacgaggaauggaaaccccagucagauuucuaaaagaaaucugagaagccagccucgggagcacuugccaagcccugcugaaguuguucuccaucuggucaugagccaggaggaagaccgaggucaagugacagagggcccacaagugacaccgaugaggggagcccacgcuggccccagcccugcugggcaggagaaggcagccacugcgggcugcagagcagagugaggcugcagugccagggaaaugagagggcuggagacaaugagggugaccccauuucaaaagucaaggcugggagaggagcacgacccugcccagcagagcaaggguccaaggaaggcuugccuguggggaugccuugaggagaagccaagacaaguggggagacccgggggcugaacuggacuccucugagugacuguguuagcccucgccauaaugaaguaccgcaggcugggcagcuugaacgaaggaguuuauuuucucacaguuugaaggcuagaaguccgagaucaagguguuucggguuuggucccuucugaggccucucuccuuugccuccagauggccacagccgccuccucgcugugcccuccuauggccuuucccuuucuuauaagaccaccaguuccauuggauuagggccucagccuaacaggcucauuugaacuucaccaccucucuaaagaccccaucuccaaaugcagucacauucugagguacgaggagguuagggcuacaacauacaauuuuugggggacacgauucaguaaauaacaguggcuauggaaacauuaucuugauagugacugugcauguuauacaacaauugacuucugggcccaaauaauauaccaacaauagggugagaguuccuccggugugugucugugucugugugugcaugcgugugucuauguauguauguauaugugcgugcaugcacauguguauguguauguauguguguauguguaugcauguauaugugugcaugcaugugucuauguauguauguauaugugcaugcaugcacguguguauauguaugcgcguaugcauguauaugugugugcaugcacgucugucuauguguaugugugcaugcaugugcguauguauauaugugcguaugugugugugugcauguauguguauguaugcguguauauauguauacaugcauguauauuuguguguguccaugcauguauguguaugcauguguguguguauguauguauacauguaugugugugugcaugcauggguaugcauauguauuguguguguaugcguguguguauaugcaugcacacacacacguacacagcagccugcuguucacccacuagaucuacuuccuuuggccuaccugauuuuccccucagccugggaggaggaugggcaucauggacccguuuuauggauuagcuggaggaacuugcccaggucacacagcaggcaagggucagcccuggcacugcuacccagcugccucaguguccuggacacuccccaccuacugccacaugcuuucuaacaaggucacucugcgaggaccucucacccccagcugaagagcccccagcagucacccgggcuccucugccuauguggugcaggaggaaacugagugaagugagucacgaggcuguuagguuugcagcuuaaugcagcuucuuaucugccuguggcuuaucucucaagcuuuugaugaucagguucugugcuggcucacagcaggucccucaggcagggcacacccagccuuggccccacccugacagccucagcccuccuuuugggggccuuugccucucccaugccugagaaaccuguggccauuccuguuccucacucucaucccucugcuugugugcagaagagcggagguccccagaagccuucucuggagggaugagagcaguggcaggcagggugggugcagagggcagccuggaggccagaggcccagucuccaggacacccgagauucucauggggaccacagaagcuaugcugugcauuggcccuaccuggucccaccuagcaggauggccuugaccugugguccuugccccacugauugaggcacuggauuuccgguuggaaggcuucauccagaugcuucuaaagugcugaaacucuaaagucccuggcuccauggcaauggcaggaugggggaccugagggcaaguccuuccuuauucuggccacaccaagugagggaaucccuggggcagggcugcggucuggagguuucaucuuaggcuguuggguucuuccagccaagcaauugcuuaaguaucauaaagcaggggcccuagagugucaccaucuacaaauguggguuuaaugcagacacugugaccuuuccucccugaccacaguggccugugaguggacugacaacuauguugucacugaccccaugacagccagguggcuugggcuauuuggggucucuuuuccuaaguagccccaacauucaggccuacccuagucgaaccuccagcagaggccagaaaaugauggccaaaaaccacauacugccagagcugucaaggacgcccucucccuuacugugcagaccguggggcccacagcucgcuugcucauaucgguucuaggcuguguucaauugcuaccauacccugggccaaccgugcacccagaaggugguagacacucagacaugcuuguauuugugaaugaauagcuagguccagucccugguuaggucauaccucuuuggcccauccccacucccaguugggguuauggccugaaggucuugagagcaagcucaucagugcgggugguggggacaccucucuguuuucaccaggaccccacgguggguugccugguuggaaaggacugcaggucugucccuggccauugcuguaagugugaggcuuccuaggaaauaaagaggcauugacugcgugagccacagcagguaacugaaccugacugauuccccucagaccaaacccugaggcacucuaggcugggcugugaaaggcgcuggcggggccuggccaaccuccaggagcagugugagaacguggccuuuagcccugccaguccgcacuggggagcugggguggagggggcuacugaggaccagacaccagcgcagccucugacggacacuucaggaagaaccucagcggccccacaguggccacuucuccuguguucucccucacuccaugggcuuccagacuucugucuuuugaugguugagggggucucgggaaccccuuauucucauaagcagacaugcagggcuccugaccugugccacugccuccccuccucagaacaaccuuccgccucuggagaaggaugauggugaguggaggaagccccuuggaggagggcgucagaaccugcauccgacaaucccaucauucuuuccaccacaucuuugggagaagguggcuucuau

SEQ ID NO: 16978 - RNA, 19750 nt, Homo sapiens
guccauuucaauguguuucauaauuucucccuacaaaaaaaaaucacucaucuccaaaaacccagcagcuaaguaguucuucuacauuaucuugcuuucauuuauccuuaauccuuuugccuuuggcaggguuggauggucuuucuucgcccccaccaaggaggcuucggagggaaaagaggguguaaauccaaucccuccacuccuccaggcacccucccauuuccgccacaggggcgaggauggcucaaggcugggcuuggcucugucccuuccccgcaggccccgcccccagcccgcgcaauaauugagcugcgcgcaaaggucacguuaucagccugugacgcuucccauccaguacguggcacacauugcucagaaaagccccuugugcccgcuuucugccauccgcgcugucucgugucucccuuuuuccauuaaaugccucuuuucuugcgggucucaucucgggaauagugcacuacggggacauaccuauccccaacuauccuaggcccgagaaccagcccuugccuucgcguaacaggcggagacucgcugaggcgaguugcacuucuaauugggcgugaggucuugucaauccccaaguucuuccaaucagaaguccgguccauccagccuuccgcuccccauuggccuguguggaggaagagggguggguaagccgaagucgcugcgcucagugcgcaggcgcgaagaagcuggcaggggcacgagccgggggcggguuugaagacgcgucguuggguuuuggaggccgugaaacagccguuugaguuuggcugcggguggagaacguuugucaggggcccggccaagaaggaggcccgccuguuacgaugguguccaugaguuucaagcggaaccgcagugaccgguucuacagcacccggugcugcggcuguugccauguccgcaccgggacgaucauccuggggaccugguacaugguaaggcgggcaggcguggcgcguauguccggggggccuggggagcggggccuggugcggagggggugagacuggaaacgggguguuggguggggcggggacuuggaggggcgcugcuuuuuaaggcgcgccaacucuggaugaaguccaaggacuuugggaaaguaaccuuguucaggaaucggagucgggggagcggggggcggugguaagcauggggagauuguucuuuggcaagaauuugaggagagaagcgggcuugggagagcagaggcuuugcaggcgaagggacgagggugguaggauuuggugggaauuccucuguuuugguucuuguuguauuucuacgaucugaaaggcagcaucucccuuccuccuauccagugcucccuggaauuuuuuccucuaaugaaauaauuaggagcggaccuugguaaacgcagucuaguuucgacauuggucuucccguugggaaagcgaaagauccagcgguaacccgguuguccgcguuucuuggacuuuguuuuguuucaugccucucuugcaucuccagaaucgcuugggggcgauagcuuuugccugaguugacgccugaccagcuuuuguccuggugcagccuccucccugcgcaguaggugcuuuucguagccgaccggcuguuuuuacagagaccuuuauugagagcccucuccauccuggccaccuaccccgguaucuccuggguuccaagaucugugugauucuguccuaaccaaguugacacuguuguugccuggugauucacuaguaauaaguuugugauuuuuucuuuuguaauucaccauuuauaguauccaugcacauuaaaccuaacuugucuaugacuuccaaauaugggauucaguuuagguaguuuuagguuauuaugauuuugccgaagccgugacaaacuuccuacauggucgacuuggccacuuuaaugacuucgcgaaugugguugugugggugacguuggugauacugugcaguuuuugauacuuaacugcaaaagaggaagagaguuaucccagacacaaucuguuuucucuguacuugcugcuucuccccacucauugacuugaaaucauuaguaagcauuuggacaaacgccagaugagaaucaucuuaaaugaggcagauacuguuucauggcccacccccgggggacuaccugacuccacaugacugcuaccugcccuguuguuuuuuaccgucuuguuucugauguacauuuaaaaaacaacacgaauguguagguuugcuugugcugaguuuauuuucauguuuccuguacuuuuauauucggaaauaccgccuuauugacagaacuauaucacauuuucccucagagacucuuucguucuguauuuuaacugauuuggaauacuaaacauagaguuaaugaccaucagcugcauuauguuucuaacuuccuuuuauagcuucuccauuuugcugaggggcugggucucauuucuuuuguuuguccuuagcucugucuucuauuucccuaaaugaauaauucaaaccuugaggauccucaaggcuauuacucaauuccgucuuccucacccccagaagaugacuuucuuuccuauuuaacuaagagaauccaucgaccuggcucucuccugcagucuuagucuuccuguuucuucucagauccuucccuccacucacagaacaaaggauuccuaacuccucaagaagagaauaccaccauuucuauuucaaccauccgaauguaauuggcuguauuucuuuucaguuuuucucaggcagauuuuuugaugcugugggcucagcuagaaaaugaauagaauagcaggauaaagugggaacuacaaacaggaaacucaaaaugcagagagaaaaacuucauuacgggcgcuuauucuuacaaaauagggagugaggaguuuacaucuguucccuacuuuaagcccuuguugugagaaggguucacauaccucugaagaccaugcuuuaguuucacaauuuuaaaaagaugccauagcuguucuuacuuugcauagacuucucagauuaguguaaaacauuuuauuguaaacuucuuaaaucguuugaccugucuuaaauugauuaagagauuuacugaccaccugcaguguaaaaggcuuugguggacaaacaaaaggaauaaaucacaggggccaugugucauuugccuuguuuuccuauuaccugcuaagugcuagacucucaaauguuucuugucuaacacagcaucugcccuuaagauauuuaugguaucacaaacuuggagcacagauaugaaaaacauaugguacagugaugaggaggaggagaaggugaucaguaauaucagauucuaaucagaauaaguacuggaaaaaggccauugguuuuguuuauuauaguuuuguugaugacuuucaaaagaguagcuugaauaccauagcaguguaaagacagucucuaccaacuuggggagacauguaacacuuaugaugcaagaccaccuaagccaaacuguaguauaauacuucgaagcaaagaaggcuuguccaaguagugcauuuuauucucagaagcugcuuuacuaagacagagaaacaauauggggaugagugaguauuaaaugucacuucccucccuaccuaccuugucaagguacucucuugcuugauuccuggugaggcaauaauucagucugcaugggagaauauuuauguuucuuuuuacauuacgugggacagacuucugagaugaugauucccccugugucauuuggaacuugggggagccccucucccucgcuaucagugacuguaucugauacagucucauugcuuucuagccacggcuucuacuggucuaguguuaaaguaucguaacaccauauacuaaaauauucauuguaugguacaaaauagugcugugggacauagagaaagccagaaccaguuauuauaugcaccggagguaccagcccugaagugugagccuuucguauuuuagcuagaaaagaagcauaccugguuaaguaacaggaaauuucagaaugagcucauguuuaaauucuggcauuccugaaaugguuuucucuaucauuuauugaagaauuugaagccaguugauuuuaaacaaguuucuuaugagguauaaacucaaauguuuauugaauaauugaaaauggacuuaaaagugugcuguaguagauauacuuugugauuaauggugugcacuacaagacuacauuuugagcauuuguaauaauuuuaucucuuagacuuaauauauggcuaauuuuucaugagugucucaaccauaaacaguuugaaguucuguaucugggagagaaguaaaaacagguuuccuuaagcucuauuccuuucuagcccucaccucugacuucaaguaagcauagcuuguuuauauuuguuaguuuccuuccuuaaacuaaggaaguuuugugccucugccuuugcauaugcuauuccuucucccugaaauguugcuguccucccaagucacuuucuaaaaauuuuauuaaggaaauuuucauacauacaaaaguagugaaguaguacgaaaaccucccauuuauucaucacccagcuucaaccauuaacaacauuuugccaaguccagauaauuuaaugguuagcucacauguuuucgugguaaaacuuuccuuuuuuuuuuuuuuugagacggagucucgcucugucgcccaggccggacugcggaccgcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuuuuuuuuuuuuuuucuuuuuugagacagagucuugcucugucaccaggcuggagugcaguggugcgaucucggcucacugcaaccuccgccucccagguucaagcgauuccucugccccagccucccaaauagcugggacuacaggcacccgccaccaugucgggcuaauuuuuuguauuuuaguagagacgggguuucaccguguuggccgggauugucucgaucuccugaccucaugaucugccugccuuggccucccaaagugcugggauuacaggcgugagcuaccaugcccagccaagcuuucuuuacuuccuagccagggggaucuguuuuucucacggugcaccugcaaaaguuucuggauccuucuuguauguacuuauuaaauaguacucaguacacauugguaggauuguccuuuucucuuauuuuucucucuacagcaagauguucuccuggagggaagagggugaugucuuuauaagggcaguggcucacgccuguaaucccagcauuuugggaggccaaggcagguggauugcccaggaguucgagaccagccugagcaacaugacgaaacccccucucuaccaaaaaaaaauauauauuauauuauauauauauuuauauauuauauuauauauauauuuauauaauauauauuuauauauagauauauaauauauaaauauauauaaaacauauaaaaauauauauacacacacacauacauacauauauauauuagcggggcauggugugguggugcaugccuguagucccagcuacaggggaggcugaagugggaggaucacuugagccggggaggcagagguugcagugagccuagaucgcaguaacuacucuccauccugggugacagaaugagacccugucucaaaauaaaaugugugugauggcuaacuuauuaauuaaaacauuugagguguucauuacacauuuguugaaugaaugucuccuccaaaaaauauugugaauacucaguuguaucugcauguaacaguaaacaacaacaaaaaacuuuuuuuuuuuaaauuauacuguaaguucuaggguacauguccacagcgugcagguuuguugcauagguauacaugugccauguugguuugcugcacccaucaacucaucauuuacauuaguuauuucuccuaaugcuaucccucccccagcccgccacccgcugacaggcccugguguaggugugugauguuccccacccuguguccaaguguucucauuguucaguucccaccuaugagugagaacaugcgguguuugguuuucuguccuuguaauaguuugcugagaaugaugguuuccagcuucauccaugucccugcaaaggacaugaacuaauccuuuuuuauggcuaaaaaacguuuuaaagauagucaauuuugaucuuuaucagauaacaggcuuugcuuaguucuguagauugacccuccugugggugcuuucucugcaugggaagcccuuaucuggaugccuccuuaaaccagacacacuguuuuaauuauuaucucaguagauacuggcucugggcaaauuacugugggaaaacugaaaaaugauuuuuuuuuuaaagucuccagagaaucuucuggaauagguguggcagugaaagaagaaaacaaagaauuccucucuucaggcccugugcuuccauggaucugauacaguuauuuuguaacaagucaaaucuaacagauuucuuauuguacacacuuacauaagauguagaagcuuucaaaaacaaugcacaccaccugauuugacugauuaaauuuacaguacuguuaacacauugaguggugaauccgcagcccaugcugcuaaaauauugcugcauucuauaccucuccauauugccaaguuuagaaguuaauaauuuaaucuuuuuuuuuuuuuuuuaaagagauggggucuugcuauguugccugugcuggugugcaauggcaugauuauagcacacugcagccuugaacugggcucaaacaauccucccaccucaggcaccugaccagcugggacuacaggcacacaccacuguccccagcuuaaucauucuuuuuaaauuacauuuuuauuaacuuucuuuccugaauacagugaaaggaaaaagugaaucaggaauaaauauuuguaauaguuaguacauaguuggauauuuucagagaaauuuuguauuguaagauuacaguuaauuuuauguauuuuuugaaaagcuaaacauguaauuuagaaauaucaacuuuaaucagagauaaguugccagggcuuacaugugagcacaagguaggcguucguuggugaauaucuuuaagaucaaaggaugccaggagcgguggcucgugccugucauccuagcacuuuaggaggccaaugcaguaggaucacuugaggccaggaguucaagaccagacuggacaacauagugagacuccaucucuacaaaaaaaauuuuuuuaagucacaaggauggguuuuccaguguaauacuuuaagauguaaguugggguucuaaugaaaugaugugaucuaauggaauauaauuaacucaaagaagauuuggaaaaagcuuuuaaugaaguagcauugaaauuuauuucacuguuucuugguccuucugauuggcccuacgauuuauuuuguuuaauauuuagugguaugacccacagugaaauuaaacuugaagugucucuaguacuaaaagaagauaauaguggaugagcgugugacuuauccauggaagagaagaaaagugaagaguucuuuuguuuuuuaagagacagacuuaguauuguugccuaggcuggucuccagagcucaggcgauccuucccaccucagccucccaaguagcugggacuauaggugugagauuuuuagaaauccuucauguaauaaaaauauuuaagaagggaaaauagaacuccuaaauguuuuuggcaugucauucccuucauuuaguaauuggguuugcaugcuuuucuugacaaaggaauuucuguaccgcagagagcuuuuucacugugacuaugcuguguuuagcaaagaagaguuugccuaauugauuucaaacugauuuccauacacagaacauauaacguuuuaguagauauaucugauaguucaguaauuaauucaccuaguuguauuagcucauacucauacaccacacacgcuggccaaaacccauugcagcaaaugugggcaacaaaaaaaaucagcuuucaacuggggagagccaccuugcaaaagugauuguuccugguaaguccucucaagaauugaaagauaucaugccuugccucugaacaaugcaaggaaagaggcuugcugcugaacauagacaguaaagucuaaacauuuuauagccuuagauaaugguuucuuugggaaagaccuuaaaauaggaguuacuggggaauguuuauuaauaaucacguagugcugagaaggaggaugucuuaaaaaccagacuuguguccugauucucccaucugucagcucagcaagcuuaacacaaguuauauagcuuuacugaaucuuaaguuuccccaucuacacauaggcuuugguaauacuuacuucacggguuguugugaggaauaagugaaguaauacacguaaauacacaugucauaaagcauauccucaauaaauauugguugauuccaaauuucauauuguggcauuguuuagaucaccuacccuaaaauaaaacuugaucugcuuaucuagcggauguuagugaaaugacuucagcugauaaaaggaaaaugcauuuccuguguguuuaucauucaaggugaaacaggagagaaguauauaauaguuuguuuaaaauacuaucgauagcuggccgacacaguggcucacaccuguaaucccagcacuuugggaggccaaggcugguggaucacuugaggucaggaguuugagaccagccuggccaacguggcgaaaccccaccucuacuaaaaauacaaaaauuagccaggcuugaauggugcacgccuguagucccagcuacucgggaggcugaggugugagaauggccugaacccaagagguggaagcugcaguaagccgagaucgugccacugcacuccagccugggugacagagcgaggcuuggucucaaaaaaaaaaaaaaaaaaaaaggucccagcuacuugggaggcugaggugugagaauugcuugaacccaagagguggaagcugcagugagcugagauugcgccacugcacuccagcuugggugacagagcaaggcuuggucucaaaaaaaaaaaaagucccagcuaccccggggacugaggcaggagaaucgcuugaacccaggagguggaggcugcagugagccgagauugcgcuacugcacuccagccugggcgacagagcgagacuccaucucaaaaacuaaauaaauuaaaauacuacugauaggaacuuaacccuugaaaauuccagauguucacauuuucacaaagggaaggagggcaaauucugugaacuuuacuaugcuagauaaggaagccuaacuccaauccuacgugagauuucugucuugagucguuaacaauacucuuucugaguacuuaaaugcagugaagccuccugggauaccacagggauuggccaacaacuacaggcacaacucauuuccuuuuaaaauggauuuacaacccugggagacuaggaaaauucagauauuauaaugggauuucagcaggcuguuccucuaaagagcuaaacaauuuuauucagaaguugcuaguuaaugggaaggggcagccucuggcagcuuuguccucaccucuguucucuuuuguuaguaacuuagauggaaauacugauuacaugcugauccuaaauucaggaaguugagacaguaaaucuguagugugucagaauccacauccagaaaaucuucauaggcaagaauguaauaagaugaaacucaauuacagguauauuaaggccuaugcuugggccucugaauccaacuguacaggugggagcuuagcacaaucaagugugaaaaagaacuugguguuuuagggaguuacucucaugugauauucagaaaauuuguaaagccaaugcaggcugggugcgguggcucaugccuguaaucacagcauguugggaggcuaaagcaggaggaucacuugaggccaagaguucaagaccagccuaggcaauauggugagaccuuguuucuaacaaaaacaaaaaaccucaguacaacuucagguugcauuaauugaaauucguuagccagaauaugagaacugagaucccauuauguucugaccagggugacuuuaccucauuuuaauauauguccaucaaacuggagcauguguaaagaggaagacaaaagggaaauagguagcuaggaaacaugcuagucagaggaauggcuuaaagaucugcaugucuauucuagagaacacaguauuuggaggcuguuuucagguauuggagcacuuauuuagaagggagagcacauuaucucaaaagguagauuuaaggccgggcgugguggcucacgccuguaauaccaacacuuugggaggcuagggcuggguguaucacuugaggucaggaauuagagaccagccuggccaacauagugaaaccccgucucuacuaaaaauacaaaaaucacccgcguauggucgugggcaccuguaaucccagcuaccagguggcugaggugggaggaucacaugagccuaggaaggggaggcuucagugagcugagauugcaccacugcacuccacccugggcaauagagugagacuccauaucacacacacgcacacauacacauacacacacacacacaaaaguaagacuaguagauaagugacuuucaguaucuugguaagucucuuaagcauuugagucuagcucuagaggaaauagugaguucucugucaccugaugagagaugcuguggagggguuucgggcaucugaugaauaaauauaacagaugaacaguaacuucuucaaauccagaaauucugagauugguauaugaauaaauagguagcuucgaacaugaaccauuuguaaugauucuuuaguuuuaauuuuuuucugguguauugguuaagcaucuuaucucucaaaugguuaauauuacuuauacuuuauaaaauauuuauuuuuaaauuauucucauagugguaauugcguauuguuuuaucucacagguagucucccacuauuuuauaucuuuguuacuucaaguaagacaaucuuaaauaugagaggacaucuagagauugugcuaagauugcgucgugaugguaauuaauguaacugauagaauguuaucuuuuccagguaguaaaccuauugauggcaauuuugcugacuguggaagugacucauccaaacuccaugccagcugucaacauucaguaugaagucaucgguaauuacuauucgucugagagaauggcugguauguguuuaauagaaaaacaaaaaaaucuccccugcuaauuuuuauauacaguccuguguuguuuaaugauggggacacauucugagaaaugucacugggugauauuguugugugaacaucauaggguguacuuacacaaaccuagauagcguagccuacuauacaccuaggcgaugugguagagacuccuaggcuaaaaccuguacagcagguuacuguaccgaauacuguaggcaguuaucauacaguggcaaauagguguguaucuaaagauggaaaaauauaguaauacuguaaauacacuauuacaguguuauggaacccucaugauauaugcaguccauuguugaccaaaauguuguuggcccaugucugucugucuccacacacacugguuauuuaggggauugauuagauuaugcuuaaguuacauuucagaaaguuaaaaugguuacauaauaaggguaacaaguuaaauuauauuuaagucauucuugcugaggcaggaaaguauuuugauggguuuuucagagagauucagugaggauuacaauagagcauuucuagccagaaaauguaauggacuauuaaguuuuugagaaauguguaaaauguaccuugaaaucaaaauaagcaugcaggcuucauaagacuuuuuuuuuaauguagcuacuaguagaaaggagaaguugcuaugguuacaauauaugugucccuccaaaauucacaugcuggagcuuaaccuccaaggugaugauauuaagagguaggacccuuggguggugauuaggccaugagggcucuacccuuaugaaugggauaaaugccuuucuuuuuuuuugagacagaguuuugcgcuuguugcccaggcuggagugcaguggugcgaucucggcucagggcaaccucugccuccuggguucaagcgauucuccugccucagccuccugaguagcugggauuacaggcacacaccaccacacccggcuaauuuuuuguauuuuuagaguuacuccauguuggucagguuggucucgaacucccgaccuuaggugauccacccgccucagccucccaaagugcugggauuacaggcgugccacagcgcccagccagcgcccuucauuuuuaaaaucacauuuauauuauuuauuuguuuaaaaaaaguuuuuuagagaaaaggucuuacuuuguugucccaacuggagugcagugguacaguaauagcucacuguaacccagaauuccugagcucaagugauccucccaccucagcugccugaguagcuaaauuuuuguggagaucgggucucccugucuuuaccaggcuggucuugagcucccggcuucaagggacccucccacuucagccucccaaagugcugagauuacaggcaugagccacugugcccagcccauagcagacucuugaaagccgauuauuugaauuacaaauuuugcuuucaaguuugauaauaccuguuuaauuucauauuuuguuuuuaccugaauucuucuaaguggaaguuugcauguuguagcagggaaguccuuuaaauucuuaacauuuaucaauccuguauccucuaagaaaaaaguaaagaggacuauuccuaguuuagugccaaauauugaugagguuuuacugcccagugauaaauuauauauacaugcugugcaugguggcucaugccuguaaucccaucacuuugggaggccgaggcaggugaaucacuugaggucaggaguuugagacuagccuggcuaacauggugaaauccugucucuauuaaaaauacaaaaauuagcugggcuugguggcgcaggccugcaauccuagcuacucuggaggcugaggcaaaagaaucucaugaaccugggaggcagagguugcagugagcugagauugugccacugcacuccagccugggugacagugagauugucucaaagaaaaaaaaaaaguuguauauacauuuacccaauagggaauauucagcaguuguucuagucauucaucauuauuagugcccucaguauuuuuuuucuuuuuucauuuuuaaaacaucuuuugugcauacagggucuugcuauauugcccagguuggucuugaacuccuggccucaaguaauuuucccaccuuagucucucagaguacugagauuacagguguggguugccgugcccaucccccccaguuucuuaaucucugcccagacggaucaccugauguugggaguuuagaccagccuggccaacauggugaaaccucgucucuacuagaaauacagaaauuagcuggaugugguggugcuugccuauaauuccagcuacuugggaggcugaggcaagagaaucacaugaaccugggagguugagguugcagugagccgagaucgcgccacugcacucuagccugggcgacagagcaagacucugucucaggaaaagaaagaaaaaacuguccagagucacagaaucaacuacagauuugugcuaagaaauucaguaagucaggcacgguuuagaauugcuugagauuacuuggcuguuuugugaaaaaauuagugaacauggauuaauggagaguuggaacaaccugaggaagaguugagaaacgaagaagaaaguaguguguguuaacauagauaccagggugcaggaagcaaugaauuuugguguuugggagguuggguggggaagugagguuaauggcgaaauuugaauuucagguuauauuuaucuagagcaaaggguaauguauguagcauucugaguuuaauacacuugucuuuuaagcaauugccagccauuccuuccagcuaaacccuacucauaagacccaucuugugucauuucuucauauuuuuuccugaugcuucaggcaaagcaaauuguuucugccucuguuguagcacuugacacauuggauuauaaugaucuguuugcacaucuucagauuccugggcucauaagggcacagggaccuguuucucuagcagagaaugugguucaugugccauccuacacccaugucagugagucguuggagcgauuuaacaaauaagugcuuugugugaaugucucaagguuccuuacuucaugcugagacuuugauuuuuuuuuuuuuuuuuuacccucuuggccuuagaucuuuuuauagccaauuuugaaaauauuuaaauuuaauauuuuaaagcuagcuuuaagugaaguuuuguucuuuuuguuguguaaguagcuuaauuagauuuuuguuuuuguuuucuuagauaaugccuguguucuuuuugccgucucuguucuuauguuuauaaucaguucaaugcugguuuauggagcaauuucuguaaguauacuguauuuucaucuuuuagaguuugaccuuaggggagcuuaguaauuuccuauaugugauacaauguuaugguuguuauuuuuucuccaguaucaaguggguuggcugauuccauucuucuguuaccgacuuuuugacuucguccucaguugccugguugcuauuaguucucucaccuauuugccaagaaucaaagaauaucuggaucaacuaguaaguguguaugcucauuaaacuuauuuuuuuuucauuuugaguaaaauguuuacauuuaaauucugaaucagccuuagguauuauuuuuaacuacuccgcuugcuuuugaaagugucuuaaaauaauuauuucugcucucuuagcuacugugacaaaacuggcaagaugaaaguagaguaauuucuuaccauccauuuggauaaugcaguauuaagaguuccuagaaauggauauuauggaacuaguaguucagcuuuuguuuuugagcauccaaagguacaguaauuugacuguguauggcacucuuuaagugacuagcuuauugucuuuacagacaucuguagcaaguauuccagugccuacuauguuuuuagcccuuugcuaggcacuguuggugaaugguguggauauaaagauaacugcgaauauuacaguuuagcgagcaaacuguaauauuuggggagucaagauacaugaagauguuaccugugauaacaagcgggagcugucacagcagcagcaaauaaggaacuucgauuaaugucauauggaggggggcagggaaaacucugggcuggguggccaaggagggcgucguggagguggucagaaggagauaugggaucuagguagaugaaaauuggcaggaguauccucaguucauuuccaaagugcugucuuucagaacuuuucuucccacuaccagauuuccugccuagcccauuuuccacaccaccaaauucaucauucauuuauucagaaaacauucgcugguugcucuuaugugcaaggcacucugcuaggucauagagaugcaucaguggagcuuacuuccuggugaaggaaucaggaaguugacaguuaacugauacaccauuguagguuacugugggaguggauaucacauggguacuaaaccugggcugggaagugagauuugaauuguacucaggaguuugaacaggaauuaagauagagaaaguauagaagacaauguuccagauaaaagagagaccuugaggcaagaagcagcauagugagggcacuagaagcuggccaugguggcuggcacacagagggaggguggggaagccuggagaaagguggccaggggcagggcuguuggccuggucagccacggucagcggcuucuguguggcucucugcucaugucaucuccgggggagaaauuucaaguggugccucccugccuucugaguaaaacccuuagcauagcauucccucaugagcuccaccuucuguguuuuucuuuuuguuuauagaugaagaucaaaaaaacagcuuuuuucccaaggagacaaccuggcugggguuuggggaguaguguguucuuaaaauuuuuuuuuucuauuuuuuucaguccuuugggauuucuguuuauguugcuuuuuaaaugaaaauguaauuaggccuucuuguugacauuuccauuaaaaacaagcauaacuuaaaaaaauuaaaucagcuuuauagaaaagaagauaaaaauuuauuauuccuuuuagagacccugguguuuucucuccucuguuuuguucacuuagugccucagacuggaagguauuuccucuguugguuaguuuuuaaaucugaaauucuucuuuuauaacaccuuucucccugaacuuagcucauugccuuguacacagucagggcugauuaaguauuuaaaugaauauagcugaugcuuuucaguagaacagaguaugucugcaguaaaacuuaugucuugccugacauuguaaccaguggguguauuuuugccccugucugaugagaguugagacaaacgauugacauuuagaaaaauaauuuuccccuuguagcauuaaaauggcccaguuuaucuguagaacuuacacagaacugagcaucuccugaguuaaugaugcaagugacacagggacugaucuccagugccauauaggcgauaguguuuuuccaaaggccagaaagauggaaaauagugaaaaguaaagagaaaacgagcuaaauuuagacuuuuuggagcauuguggguuaucaaauguacucuaagugauuguuagcaugcauuaauggugauaaggcuuaaaauuuaaaagcacuuugaauuaaauucugcuuauacauuuuuauuaaauaucacuuuugacuuuggugccuuuguauucuucagaugcucuucagguuaucagcaagugcuagugcgauggcugacuuguaaauguguguguguuucuuuaauagccugauuuucccuacaaagaugaccuccuggccuuggacuccagcugccuccuguucauuguucuuguguucuuugccuuauucaucauuuuuaagguacguugcugacuaaaucuuuaggggugacugagauugacacugugaaucuaaaccuuuuugcugccuuucaccuuacaagucacaggagauugaggauuuguggggacaguguuuauucuggcacaugagcagagauagcuucuagggaaugguuucuguuguguuuccaaggaaugguuguaacugucaggauccuucucugagugaaaggaccuacuuuuuauguuuuugaaaagggguucaugauuuguauugaaaaucuguuaaaauucccaagguucacaaacccagaauuucuucugcagcacaguggguugaccugaauugaagcuccaucucugguuucucucugaaauguuggcgaugaaacucaugacacuuaaaugagagcaaguagggaaagggccuggccugugcuggguccacacagaggucagcucccuucuacacagaggauguguggggaaagcauucuaagucacuggcauuuuagagcagguagucuguugaguuucuagcagaugucaacuuuguuuuuauucuuccaggcuuaucuaauuaacuguguuuggaacugcuauaaauacaucaacaaccgaaacgugccggagauugcuguguacccugccuuugaagcaccuccucagguuagcuacuguuggauagaguaaaaggucaccagucacuauugacuguuccaggagaagaaccuggagcuugacuuucucuuucaugcuguaaccuaugguuugggcaugaacccuggguacuuuuaugaacagcuuaaaauccacaggauucaacauuuuccacuuggaauccugaguaccugggucgcuugucucauccaguuuggcuguuagauuuacucauuagagguccucauuagugucauguuuguaggggagaugacaggaaacagcuguguuaggcccauguagccuggggcuucuaaggauggggaguuccauugacugaaacuuguguuguuuucagaaaacauccauaugauccaacgggggagcugaccugucuggggagaugaauacagugguuucaugggucuuuuggggaagccuaccuuucacagcccucuaauugcugcugugcuaccuucccagguuuucagcauauaaaauauauguggcccaucuagggccaggcuuucagacuuggagucacuucgauuagaaugucacuccuccacugcauaggugugccuguuacccucgaagacaugauauaaguucaugaucuucugacuacaaacugauucugaugaaagucaggauccaggagcuagcgucuuauuggguguuuccuauugcaugguuuaacccaacuccucaacaccugaaguguaauuggcacuggcacuucaucggucacacuggaaugagggcagagcaauggcacccacugccugccugucuaggaauccuuguccagaagcaggacucucucuccccaccucccucucuccacccuccccuucgcuagcaaucuugguaaaauuccagguuauugaggcaucuacuugggaacauuuuagcuaacaguuucuucagcucuucuuuaugguuuuguauaacccuauuuagggcauaaagucugaaagcugaauuaucucacaaaggauuuuaaaggagaauuaaaucugauacaauuuuuuuucucucuuuaguacguuuugccaaccuaugaaauggccgugaaaaugccugaaaaagaaccaccaccuccuuacuuaccugccugaagaaauucugccuuugacaauaaauccuauaccagcuuuuuguuuguuuauguuacagaaugcugcaauucagggcucuucaaacuuguuugauauaaaauauguugucuuuuguuuaagcauuuauuuucaaacacuaaggagcuuuuugacaucuguuaaacgucuuuuuguuuuuuuguuaagucuuuuacauuuuaauaguuuuugaagacaaucuagguuaagcaagagcaaagugccauuguuugccuuuaauuggggggugggaagggaaagaggguacuugccacauaguuuccuuuuuaacugcacuuucuuuauauaaucguuugcauuuuguuacuugcuacccugaguacuuucaggaagacugacuuaaauauucggggugaguaaguaguuggguauaagaucugaacuuuucaucugcagaggcaagaaaaauauuugacauugugacuugacuguggaagaugaugguugcauguuucuaguuuguauauguuuccaucuuugugauaagaugauuuaauaaaucucuuuaaauacuuaggguugucauuguuuuuaa

SEQ ID NO: 16979 - RNA, 12304 nt, Homo sapiens
accuagcgccaagguuggcugucaagguagauuccaggguguggaaguggcuuuguggugccaccucuaaccgcucggaggucaacccccauucuacaccgaaaacuaggccuuggcugcuauggaaggacagcggcaagaaagccacgcaacccuaacacucgcccaggcucauuucaacaauggagaguacgcggaggccgaggcacuguacuccgcuuacauucgccggugcgcuugcgcggccuccagcgacgagagucccgggagguaacuaucgcgagaccuggggccgcggcgaccccggguggaggcgacguugggguuguuugggcuccuaucuuugccucuggagcucacggucggcgcuugucauaacccagcacuaggacugagcgggcggacguucgucuuucuagaaaggccuaggcgaggccuaggacgagggcggcggagaacgcggggagaagcccacccgugaggagccagcugccgcgacggugcggagagauuuccgggaaccaagcccucugcgcgauccucgggcgcgggccgccgccucucaccccgccgucucuccuuccacguuccucauucgcacccagagacuuaggacagauaggaauuuuccacucgugauuuuagcuggcgggaaauccgcgaccugggaagggaaggggucacggcugcguagggccacaguaccgcgacucccaucucagugucacggcgcaggcucuuggugguguuuuucacuugugaaaaacguuuaaauauguggaagagagcauaacgaacgucuagguguuuaucacuuggcuuaagcauuaucaguuuaccuauuguauucauccauggauguuucagaaggaaccaccaugucaucaucacauaguuacuuaauaucaagucgucaguguuggaaccauucugaucgacuaauaagguguuuuguucuuugguucccuuuucgcaguuaguucaagucaggauacacaucaagucuuuuuaagucucuucuccaccuuccccucuuuauuuguugaggaaaccgauucuuguguccuuugaauuuccguguuuuggacuugcugacugaaucucuucugucguuuaauguggucaucugucucauauugcugugaauuggugguuaaaccuugagguuugauccaauugaauucagauucaauaucauggcaagaauacuuuuuagguggguguguguacuuucaccaggaagcacauaacgauucgcugacuuucucuuugugaugugagcggcuucaccuguuacugucugcuugcccaaagcaucuuuucggcuugugccuggauguguagcauuuguuuuuacuccaagucuugccucgacugggcuuguugaugguauggaguggaucaggaugagaaaagaacagagggguugguugaacagcuuuuugaauaguugugaguugucuguuguggauuugaguuuucuggacaggaugccagcuugucuuuuguaugaggcuuaacuaaacacuaaggacuugauucuuacccuguuuguuacgcuacauggaauuaaaccagaaagaaaauugccuucucauuucaauaacacacaagaauaauaauagaaguuucugaacaggcaauaagaugauaccaucuacuuuccucagugcaccucccccauaaaaaagauaaguaaacauagaaagcgaaacuauucauguuucaagcucuaagaguagacuuaccuaguagauuuuaaaaaguauuuaucagcaucagguaugcuguugcugucuagucuuguuauucuuccuucuuugcaccucucagccuaagaacacaagugucuguagcauauauaauagcuaugccuuaccagcacaggaaagacaguuugucauagcgcaguagaagggaguucaucaugccugaauuccagucuuggcacugccacauggcuaaugucucagccucaguuuuucaucuguaaaauaagcuuuugauaaaauucuaggaacucaaggauugaaacugaauucugucauuucaacuuuuucccuucaauuuaucuuuuggagcuuacauuuauuuucuaaguauugggucacuaaaucauuuugaaacaauauuugcaauuuuugaaugccuuucauucugaaugguuugugacguuuucuuuuaauaucuaaaguauagcuuuagucauaaaccuaauuuccaaaguguguguguauauauauacacacacuuuauauauaaaaaauauauauacacacacuuuauauauauauaaaaaauauuuuuuuuugcgaaaguuagcaaauccuaaaaauucacauuuggguuagguaacuugaaugaauuccauuauaauaaauacuaucauuacaaaaauuuuaauauuacagaaaauuucggcuucaacuguuaguccauuucuuuaaaauaugaaacaaaauuuccacaugaaaacgauuuuagaauuugauuuaaugagaucuaauucuaagucuaacauuuuaugauucucuauauuacgaauauauaauuaguauuaaaaacuuauaacaauaauuuugaaacuucgauuuaaugacuaaaaccuuacuggcauccugagauugcuuuuuucuuuaaacucucuacugggagcaguucaacuagugucaugucacacauaggugaaggggagugguaccgucuuguaaucuagguuuuaacgggggugcuuaguggcauccagaaguaucccuacauccagucuccaucacagcucauagaauagacguuuucuaaaauugcgacaguuccucuccaucguuagcaaacuugguuugaaggaggcccuugggcugugagugccucuuaggguagcaguaguuacagucccugucugaaaucucaaggaucaagauauuaagagaaguagcuuuuauuuacacuaacugccuucacagauacuuucggaggacuauacuuuuuacuacgggguauuacaaagaagugacagaugaauucucuguuugguucuaauuugagaauugcuuugggaaaaaagaaagggaaacagaaucaucccugacucagagcagaggcacuaauguucucugugcagacuauuuguccugugcagagaaagguucaaggcagccaggggcugugaccuguugagcugguggcuggucagagcuaccuggcuguacagcccaggaauggcugcuaauuuaaagcucuuugggcaaccucuaguucccucaggugcagagccaguucugcacaaaggacaucaaaauugacuggagcccugagggggucuaaaggagcccacccuccuagcaggaagccagccuggcauuggggaggaugccagcugaggcuggagggagggcaacucuguccccagagauaacuuccuggggaucguagcauguugaauuuucacuuagcguuaacuuuaguuuuuuauugguggaaaaugauuucaaaucuuauuguuuuaagaucacuuaaaaauuugagaaugaaauugauucacauugugacauauccauagcaaacucgggcuuugggcuggcuuucccucuuugcuuaguauuuaucuguucugucuucuuugcccugcuggugugugcuuagaaaaaugaacaaucauuuuaauguuauauucagcagaacaaauuggcagugaacacacuguaaaguuaguaugcuuuucagguugacauugcagugguauaacccuacaaaaguagauaacaggguuaaacaaaaauugauuuuagcucuuuauuuguacguuuuuucuucagcuuggauuuucaguguugaugcugcauguuauaggcugugaaguuugacaauacccaaaagagaaugaaaguggaaaugagaggaauuugguaacacgguguuuuuaaugugaacuuuuuguuuaaagcaaaugcagcccugaggauuuggcuacugcauauaacaacagggggcaaaucaaguacuucaggguugauuuuuaugaagccauggaugacuacacaucugccauagaaguccaacccaauuuugaaguuccauauuacaacagaggguugauacuguauaggcuggguaagaauuuuuuuucuuuuugaguuuugucauugacuguauucuguuauuucagagcuuucaaauguuguaaaacuaacgugguaaucaaauuuuaaaguucugugaaauuuagguuuagagcuuggaacaaaggaagugucccugaguuuauuuuaggcuuuugauaggcguuauagaucacagcagagcacuggggugggaauuggaccugggcgcaggagcaggggugaccccauuacuuugugcuugugcauucccagcugugaaaugagggcaauucagauguucaccugugaaacuuuucugaguuaaaaucuuugaagacacacaagacaauagaaagugaaguuuagauucuuggauuaaagggaccauagguaguguuucuucauuuaaagugucaaaaagaaaauuaguucccguuucuuaauuuuacugcaauuauguaaaacaggugauacaguuuuauuaaaauuuuaagaugauugauaauauuuaccuguuaaaucucaauaaauaaacccauagcuaauuuuagguguauuauucccuaagggcacacaaaauuacuuugauauacacaucucuauauuauuaagauaaaaagauuccuuuacuagaagugacugaaagcucauaaauauaaaagcaaaaguacauguaucaaagcuuuuccaugaauaauauauagaaauacucgguuucuuuucucuuuuccauuuuuuggguucugguacaggauauuuugaugaugcuuuggaagauuucaagaaggucuuagacuuaaauccuggauuucaagaugcuacuuugagcuuaaaacagacuauucuagacaaagaagaaaaacaaagaagaaauguugcaaaaaauuauugauauuuuuaacuuaauggaaguauugauucaugauccuuacaucugcaucuaguuaucaguaauuuagauauugagcuauuuugauuuauauuuaagaaauuaauacauuagcacugaaaguuaaauaguguguuuaagguaguuaauuucagguugaauggguuuuuuuuaaugaaguguaaauaauaccaauguauaaguguauauuauuauauuaaauauuauaguaaaaaggaaugugugguauuuucuucagcaaaacuauuuuugugauuuuuuuauucucaacuuuuuauuuaaaaaauguuacaucugcagaaaaguugaaaguauaauaaacucuucaguuaaauucaugaguuguuaauauugugccacauuugcuuuuucuauuuaaauauauaacuuuuugcugaaacauuugaaaauaaggugacgaggucacaguacuucgccccuaaauauuucagccuacauuuucuaagauugaggacauccuccuuuauaaccacaauaccauuauaauaccuaauaaaaugaauaauucuguaaugucagccauauccagcccauauuccaaaguguguagauuuuuauuuggaucuagagccaaucagguuucaauugcauuuuuuuuuuuuauguuucucucaguucuuuuaaucuaguccccuguccauuuucuugcccuagcauuggcuuugagagaaaggcuauuuuauauagcuaggcuagagagacauaacauuuaggcuuaaaaauaaacauguccuacaauuugaaagaguucagcuugaauuacacuugauuuucucaaguaaucauugauaaaaauagguuaagauuuaaauauugaacauauuuucugucucuggauaaugacaauuguuaucaacauuuacugaauacuauaagccaagcacuguucaaaucuccauaauaauuuggugaucagguaggaauguauagagaggugaggaaaugacaaaaagcacuuaguaaguauaaaguuuaaaaaucuuuuauuuuggugcugccaacaauuaggcccuuaugaagcuaucaaaaaccgggaagaacuugaagggaaaacagacuaacaccagccauaugccaucuacauuuuuuguauuuuauuguuguuuggcuuccaaagauucccaaacuaguuuauuacugcuauggaaaagcuguucugugguggaaauuacccgaaucaggagaaaggaaaguuugcuuugugucuucagaggaaggcgcaggguaacuucuguggccucagaugcaaucagcagcagcagccuuaaaaugcuuuuuuuguguguguaugaguaaucucaugaagcagaaaaaguaauugcccuguuuguagcucauaaguaauaucuggcaaaauacauggagaguuugggcuguagguaagugaauauuaagaggaaauuaaguuucauggccuagaaacaaagucucuguuucuggaauuauucauacuuuccaaaacgguuuaucuuauauuuguuggaaaucuaaaaaaauuucuaaaauugcauuaaaauguagaaaaauccuuaggaaaacuuuuuuuuuaaaaaagcaaguuuccuagaccuugggagggaaagcuuuaagccauuccacccagagaagcaaaugcuuaauguuuaauuuuauuuucucuugacucauauucucuuuacucuugacugggaucagauggaauaugaaaaggaaaaauuguuuaacauuuucaugugguuuguuagauuauauucaaaauuucuucauccuuuaucagaaaaaaaaaaaaaaaagucacuuaaguucagaaucagcaguugcugauuguagacccaggcacucauuuucucuugucuuguuacuggaaauaaagaauaauucauuuaccuuguuuagcguugaaacuuuaggcauuauucagauucuaaguuucugauugaccaaauaauaccuuggauauuuaccuuaaaauauauucauuaccguucauauuucccacauuucaguauucguuauuuccuuuuucuacuagaaaaguaacuuauguuuucuaauuuuuuccuuuguaaaaacaaaagaauugugguuuguuauaagguuucucuuucacaaagugagguaagauaggauaaaauggauuuaaguuacuuuugaguuuagaauauuacuccuaacaguaguugaaaaguguggagcuauuuguuuuuuucugaaauuuggaacugaauaaaacccuuuacuuuaugauagcaaagcaaauauccaaguuagucuuuagucauuaucuauuugcucuuuugcucugucauuugcucuuuugcucugucuuuuuugguuuucuguuuuucacuggcuucucuacccucugaauccuaaauguagccuuggcucccugucauuuuguaggucuuaaaucuuucuccgugggcaugauauauuucaaccccaccuaccacucagcguuuacacugauucuugucucaaugucucccuuucugcuaagucuagcccccuuaaaaauuuaacucagaaguaaacaguuuguauauaaaccguaauagcauguuuuuuuuuuuucuuuuuugagacagggucucacucuguugcccaggcuggauugcaguagcuugaugacagcucacugcagccuugaccucccugggcucaggugauccucccaccucagccuccuaaguagcuuggacuauaggcaugcgccaucaugcccagcuaauuuuuguauauuuuguagagauaggguuucaccacauugucuaggcugagcaugaauguuuacugugcuaguuuuuuguuuuauugagaauaauucauauaucauauaguuuacccauuuaaaguguacaguucaaugguuugaagguauauucagaguugcugcaccauuuuuucaagguuuuuggguauacuggucuugcaugcaaacugcacuuaaaguuacaacacagaaaaaauuuuaugcaaauuaaugacuaaacaugagaguguuucaaaaacaacagcucaugcacaaaacagaucuaagaguccuaaaaagugcugcuucuggcuucauucaaauauguggcacgauuccacuuugucucaugugaugcucucuaacuagaaauguguugaguaaaucagacggcucaucucugccugaaauggaugcugaauuuaguguguuuagguuaacauauugcuacgcuaaacaaauuguugacaaauguguaauagcuuuucaagagcauagugaaaaguugacugaauauuugcuauuuacgcuagguguguaauuuuaacaauuucuauauaaauucacauuuugguguuuucuguguuucuaaaaaaugugacaguaaauugugagaacagaaugcccauaauuuaaaauggcaguugguaaaagagggagagugagauuuguuaaauuucaaaucuaauguuaagggacuucaaaugacaccauuucacucuacagaaaggaaagaaggaugaguauagucuaauuucuguuuuugaaaaaacaaagcaauugauacaauuaaaacacauaguuuauccuuuuuaaaaucacaagaagguaaaagaacacgucauguagcaagacaaauuauaaaacaagcaaccuguaaggaagccccgaaacugaaauuaugaauguggauauaaaaguaaaauaggaacacaacaguguaaucccagguuuauaugugucaucacaaaaucauaaauauagcaguuuagugaaggucuuauucugcauagaggaugaagcuaagaaauugaguaacuugugcaagguuguguccaaaauccauauaaauauuugaaacugcaaugaguaucaauguuuuugcuguuggcaucaacucacagcagauauguggacuuuuuuuuuuuuuuuugguccugauaaaaaauuuaaauugcucauaaaauguuuuaguacccagcaaagugaguaucagaauaauauuaaaguauguuuuuaaauaauggaauguuauugcaaugcccacauugcuugguggucauuuuucuuauuaaaaacagacacaaaagauggugaaaagcagauuaauuuuaagagcaaacuccauuuggaaacuagauagcuacagcugccaauauguaaauuuuuaucuuaugucaaaaaaagcauccaauacguagaaauaaggcaaaaggauuugcauggcauuucaauaucauaccagcagacccacucaacgacuguuuaauucuuuuggggagccaugugugugccuuucuuugauuuucuauuuacucuugauuagggcccagacucugggagguugcauguaacuugcagauuuuuguccagaggagaugcaaaugaacucugguagaaaagauaaccccaaaaguuuuggcuguauugcccugaagaacguuaaccaguuuuguauuuaaccuagcaacuuuauucccaaauucuuucuucauggaccauaaguacucaguuauucuaaugcucuuuuaccacucuggcgguucucuauuaaugaguuaaacauuuuucacauuuucauucuauauucuuauaagaaucgugcuuaacuucaaaaaacauuuuggcccuacuacugaagaaacaacaaaaaacccuugguaugguuuggcuguguccccacccaaaaucucaucuugaauuguaauccccauaauccccacaugucaagggagagaccagguggagguaauugaaucauggagcuguuuccccgaugcuguucucgugauagugagugaauucucacgagaucugaugguuuuuaaggguuuggcaaguuccuccuucugucauucuuccuacugccuugugaggaaggugccuugcuuccccuuuugccgugauugcaaguuuccuguggccuucccacccaugcugaacugugagucaauuaaaccuguuuccuuuauaaauuacccagacuggggcaguuccuuauagcagugugaaaacagacugauacaacccuuaaguagaauuuauuauuacauagucacauuauuucuagcaggaauaagagccaagggggacugaaaagcuucaguuuuuuuuucuguugcuuauuuauuuuuuuuuuuugagacagagucucgcucuguugcccaggcuagagugcaguggcgugaucucagcucacugcaaccuccaccuccuggguuucaagggauucuccugccucagccuccugaguagcugggauuacaggcaugugccaccaagcccaacucauuuuuguauuuuuaguagauaccggguuucaccacguuggucaggcuggucucaaacuccugaccucaugaucugccugccucguccuuccaaagugcugggauuacaggcgugagcuaccgugcccagcccgccuauuucuuuaaacuauucaacaauucuuguuuggaguguguggaggcuugagcucuggcugaagcgaaguagagggaaggccaucacauucaauuuaaacacaugcaaaaaguacuccuuuuaaaaguggcaaaccugcagaauauaagguaaaaagcaguuccugucuauccuucuaggccuuuuucuuuguacaaauacaugggcacagguaugcagauacaugcgcagaauuaugguauacauauuauuugguaacuuaaaucacuuauuauuuugaacauucuuuuguguaagaacuuagaagucuaccuuauucugcuuugacacauaauuuuuaaagccgcaugaaaagugcuugccaauuucuugauauacaauuaauacauggcuaugguaauaaaaauuaaaacaguacaggagguauaaauaaaaagaccccccgccuuucauauuuuucucuacagcuaaccauuuuuagccagaauaacuagaaacaaaggguuaaaaggcucccuuuccuauggcugcuagucaccucuugaaaaaauuacuauuaguuguguucaccaccugagugccucuuuucccucuaggcaauuuugacuccuguguaccaagaauaccuuugaauguauucuuuuggcaccacguuauuugaaccuauuuccacuuuauuggaaagcucuuuuuaagaucacagaguugauguugugcaaacuuaaagcaucccaaacggaguuccugguccucccccagcacagcuaauggcagcuguacugucccgccucucaugccagacuuggucccagugcuccccagcggcaaacacuguggguuccuaccuugaaacagaucccgauuccagcaauuuucaucucauccgcuaccacccaaagccaagacaucagccccucuguauugcaaguauccugcuuugucaguuuuaccuccaaagucaguuucaacacagccaccagagugaagguuugggagugugccauggcuucucucagugagaagcagagucuucacaaagacucacguugaggaacuuacaugugcuguuuucucccugccuuaccccauggccuuauccuggcccuucucugaccgcucucuuuaaaauagcaaauccucaucauacucaucuuuuuucuguuuacccaaaccauguucuuauuuauuuugucuuucccacacuggaaggcaagcucugagagggcagggacuuuugucucuuuuguuuacuguuguguccucagcaccacggccuggcaugcagaagggccuuacauguguugaauggauaagugaauucauuaucauaaucugcucaguaacuugcuauuuagagcuuacagauucaucacuggcuaauagguaugggguggauaaguguuugagcccuucucagcugaccuugagaauagggccugauuuauaguucagcaucgauuuuauuuaaaacaggucacuauucuaguuuagaggaaaaagccccucuaaaagacaaggucaaauucagcagguaauauaauguuauaaacuauaaaguuaccuguuaggaguugaauugggccccccaaaaagauauguuggaguuuuaacuaccaguaccucagaaugugaccuuauuugggaauaaaguuaugacagaucuaauuaguuaagaagaugcagguggaguaggguggguccuuacagauaccuugugugacugauguccuuacaaggaaaaggaaauuuggacacagacacuggggagaacggcuugugaagacagagguggagacuggagugguucugccacaagccaaggaacacccagggauacccgaaacuggaaaaagcaaggaaggguuuccagcuccccaggggugagguccaugcccu

SEQ ID NO: 16980 - RNA, 1401 nt, Homo sapiens
ggggugcccaggguaaaggcaggaguagcgcugacaccuguaagcaaacugaagugcgaugacagucucgaagggucugggacgucagccauagcauccggccccagucagaggguucugugagagacaaguugauuguuaaagagguugcagagcuugagcuuauuuaccuuguacaugucaagaguauuuccugaucuaaaaagcuucauugcuuucugcugacuguaaccccagacgaggguuacuacuaggguggaaaauuucagcucgaaacuggacuuccugaugcauacaauguggugccuuccaaagugaaaugccugaccaggaucugguacccuaacaucagagauaggggaaauaugucuaaaguuuacugaggacauucgauugacagcacuggcugggcucccacgagaucauuaaaggauguuauuuggagauuaaauuauuuguuuacuaaucuucugaauuuugacgauccacugaauguugaagcugcagaacaucauuuguaggacaaggaggacuucuugaauaaagucgaugacuacaucaaguguuaaugccagaugauaaaaggagaagauugcaggcccauggacuguguguuacaguuugucucuaaugugaaaaagcagcaagaggcauugccuucucuccccuguccccugacucucccucucauuccccuggauugucccaguccugugaccauguuguccugacgaagaccaucuucaugacugcccguuguagauggagaauucaacauaaagacagcaagaaaacguauuuagguuucuaaagaguuaucugcuugucuuauguuuuaggcuguucuugcauugcuauaaaugcccaagacugggugauuuauaaagaaaagagguuuaauuggcuuaugguuuggcaggcuguagaagcauggcacuggcaucuacuuggcuucuggggaggccucagggagcuuuuacucaugguggaaggugaagcaggagcaggcacaucauauggcgagaguggaaacgagagcgcaagggggacagccagaucucacgagaacuuacuguuguguugaaagcaccacgucgugagggauccaccccgaugacccaaauaccucccaccaggccucaccuccaacacuggggauuacaucucaacaugauauuuggaagagacaucuaaacuauaucaccuuaacauguuuacuuuuuugaacucguacuguuuaggcuguuggugauacucuugagaaguuguaaugaacucaaaauugaggcuggagcuuucuuauucuuuuccccaacaaaauugguuuucucccgaagugaugcucaugauguguucaguguaacuugcagauuggaauaagaaaccugcuacaaauuguga

SEQ ID NO: 16981 - RNA, 3633 nt, Homo sapiens
uggaaaaccuuuugaacccucaaguuaccaucaaacuacuucucuuugaacuaccaauacuguugaaugccauuacaccuaucucuguguaagucauaaugaugacucuuuaggauaaguuuagaacuugaauauuugcaugcuuaaggcacuguuuuagaagcuuacuuaguuuuauaaacacugcucauuuuuggauguuuguagauaacaaugaauuguuacccaucagcauuguagaauagugucuucaaagguagaaggaguaugguuaagcacacucuugaaaacuggagcuuuguauucugugacugcuauggcuagcuuuguaaccaaagcaaaaugagaauuucacucuaccugcaugaguauaacaauuuugauacugcucauuuagaaauaaaucaucugguuguuccuccaggguacuuucuaagauaagccuuaaacagaaaccccuaagaaagguucucugaaaauuauuugguggguuaaaugccucugauccacagaguuucauauuugaagucuccggcuuugggccuggcaggcuggcacauccauauuuguauggaaaaaaaaaaaaaagacccuacgcuaccacuucaaaaagugacaugaaguguaguauccuggcccuucauugucauucucucaugauuuuuguuuuguuuucaacaaaaauugguuggucauuaaauauaucauauguuaggcacagugaccugguuauuuucacauguuacuucauuuucuuaucaaauuaaauguuugugacauaguauuauuauuaccuuccuuuuuaucaaugaggagccuaagauucaaaaagauuagacagcuuguuuaaggauauggagcuaauaaguguuaagacuaauuagauucaaauucaaaucuuacuucauaaguuauaaugaggucucuuuccucccuuccaaauagaguuauuaauuucauggccuuuggacccaucugguacagauuaaucauuucauuaaguuccaugcauaaacuacacagcaguuacacugcaggucuaaggauuccucccuccucuuuuccuccuacccucuccugcucucucuaccuccaccuucaucucuacuccaccuguacauauguauuccaccccuggcucuagaugagagaagaccacagcugaaacacaucuucugaugcucccuaauuuuauguaaaccaguccaaaauauaucaguugugacaugugacacugaguaccuaccauuuuguagguguccucccaugcaaagaccacaagagguacgcagacacaauccuauccucuaggaaacuugaaaccuuaacaaucuggucaaggaagucaaaugugcaaacucaaacagccaauacuagaaggcuguuugucuucagugccagugagggucacacaugacccugagggucacacaugaagggagcagagaucuuuauaggcuggaaguggucaggaaagaaagacuugagguagccugugauuuugauggaugggcaagauguggauggguagaaaggacaauaaaguggaaacauaugcugggggaucaaugaguuugaguagcagcuucaaauuggggauagggugguguaggaccaccucucaugauuccuguuccuggugccuuguauaauccccaguaagagugcucuuucccaccucugagcuccauucucauuacucauaagaaaccuccuggaauccaucccuuuuucuuuguauucugacuauuaguugcauguuacauccuucccaaauguaagggaguggaagauggauuaucacaauuauuggggaguuugucucaaacgacacaagcugugguucuuuuuccuugucuggagaaccugcaauggguggagggugggaagugggagaucacaguuccagaaaguaagcacccugagagcagaaauggugucccauuucucuguggcucuaacagggaacaggcagggccaggcacauauuggauggagaggcagacgaacgaaugagucuuuaaaaguagcuuggucuacagcuaugaaguuuguagcuugaagaagggucccugugacacuaacccugauauuaaugaggcauuuuacagugagccaagcacuuugccuuccaucguuguguguaauaguccuauggagagggcagggaggcauuuguaaauggccugcucagaagccuauauuuacaauaaguccaagcuuuucccacuguaccucugccagugugaagaucauuugaagauggcuuucuuuuuuuuaauagggaccaaugacauaaugucuuguucagugguucucaaagugugguucccagaucugcagcagcagcagcaccuggaaacuuguuaaaagugcaaauuaucaggccccauccuguaccuauugaauuagaaacucuaauacuggggcccugguuuuuuguuuucguuuuguuucauucccccaccccgaacccccaccccaaguccuccaggugauucugaugugcauuuaaguuugagaacuacucgaccauucuauuuccaacugauucauguugcuuaauucuuugucucaucuaugaaaaacaguccuaccucagacuucagcuugucagggcccauuccucagaaggugaauugaacugaauuuacaagucccaagagcccucaaaggaaaacacacgaaaugcccugaggaguggcauuuguaacagggccuguacagagaucugugauucaaaguacucaucagacauucccauggggaaguccgccacuacucugggauuucaauacguaugaaccccagcacccugaacacugugcugguugcccagccuccaucauuaggcugggaggagcuuccacggagggcgcaggacccagggcgcugaacucucacaaccaaucaggcgacccccccagagggaaacuacaagucccagcaugccccacgcgcaccgucaggggccgacccgccgcgccccagcguucuccgcguacagguggucucuuggguuccgguaaggcggcggcugcggaacucccguggaggggccggugggcccucgggccugacgauggcaguggccacugcggcggcaguacuggccgcucugggcggggcgcuguggcuggcggcccgccgguucguggggcccaggguccagcggcugcgcagaggcggggaccccggccucaugcacgggaagacugugcugaucaccggggcgaacagcggccugggccgcgccacggccgccgagcuacugcgccugggagcgcgggugaucaugggcugccgggaccgcgcgcgcgccgaggaggcggcgggucagcuccgccgcgagcuccgccaggccgcggagugcggcccagagccuggcgucagcggggugggcgagcucauaguccgggagcuggaccucgccucgcugcgcucggugcgcgccuucugccaggaaaugcuccaggugugggccucggggggccgggcugguggggagggccugggcacggugugggaggggacugcgggcuggggcugagccgcgagggaccgcccugggguucagggugucaccuugggaaccgcugaggcugagaggaguccaaaaagccacuuugaggc

SEQ ID NO: 16982 - RNA, 9107 nt, Homo sapiens
uggaaaaccuuuugaacccucaaguuaccaucaaacuacuucucuuugaacuaccaauacuguugaaugccauuacaccuaucucuguguaagucauaaugaugacucuuuaggauaaguuuagaacuugaauauuugcaugcuuaaggcacuguuuuagaagcuuacuuaguuuuauaaacacugcucauuuuuggauguuuguagauaacaaugaauuguuacccaucagcauuguagaauagugucuucaaagguagaaggaguaugguuaagcacacucuugaaaacuggagcuuuguauucugugacugcuauggcuagcuuuguaaccaaagcaaaaugagaauuucacucuaccugcaugaguauaacaauuuugauacugcucauuuagaaauaaaucaucugguuguuccuccaggguacuuucuaagauaagccuuaaacagaaaccccuaagaaagguucucugaaaauuauuugguggguuaaaugccucugauccacagaguuucauauuugaagucuccggcuuugggccuggcaggcuggcacauccauauuuguauggaaaaaaaaaaaaaagacccuacgcuaccacuucaaaaagugacaugaaguguaguauccuggcccuucauugucauucucucaugauuuuuguuuuguuuucaacaaaaauugguuggucauuaaauauaucauauguuaggcacagugaccugguuauuuucacauguuacuucauuuucuuaucaaauuaaauguuugugacauaguauuauuauuaccuuccuuuuuaucaaugaggagccuaagauucaaaaagauuagacagcuuguuuaaggauauggagcuaauaaguguuaagacuaauuagauucaaauucaaaucuuacuucauaaguuauaaugaggucucuuuccucccuuccaaauagaguuauuaauuucauggccuuuggacccaucugguacagauuaaucauuucauuaaguuccaugcauaaacuacacagcaguuacacugcaggucuaaggauuccucccuccucuuuuccuccuacccucuccugcucucucuaccuccaccuucaucucuacuccaccuguacauauguauuccaccccuggcucuagaugagagaagaccacagcugaaacacaucuucugaugcucccuaauuuuauguaaaccaguccaaaauauaucaguugugacaugugacacugaguaccuaccauuuuguagguguccucccaugcaaagaccacaagagguacgcagacacaauccuauccucuaggaaacuugaaaccuuaacaaucuggucaaggaagucaaaugugcaaacucaaacagccaauacuagaaggcuguuugucuucagugccagugagggucacacaugacccugagggucacacaugaagggagcagagaucuuuauaggcuggaaguggucaggaaagaaagacuugagguagccugugauuuugauggaugggcaagauguggauggguagaaaggacaauaaaguggaaacauaugcugggggaucaaugaguuugaguagcagcuucaaauuggggauagggugguguaggaccaccucucaugauuccuguuccuggugccuuguauaauccccaguaagagugcucuuucccaccucugagcuccauucucauuacucauaagaaaccuccuggaauccaucccuuuuucuuuguauucugacuauuaguugcauguuacauccuucccaaauguaagggaguggaagauggauuaucacaauuauuggggaguuugucucaaacgacacaagcugugguucuuuuuccuugucuggagaaccugcaauggguggagggugggaagugggagaucacaguuccagaaaguaagcacccugagagcagaaauggugucccauuucucuguggcucuaacagggaacaggcagggccaggcacauauuggauggagaggcagacgaacgaaugagucuuuaaaaguagcuuggucuacagcuaugaaguuuguagcuugaagaagggucccugugacacuaacccugauauuaaugaggcauuuuacagugagccaagcacuuugccuuccaucguuguguguaauaguccuauggagagggcagggaggcauuuguaaauggccugcucagaagccuauauuuacaauaaguccaagcuuuucccacuguaccucugccagugugaagaucauuugaagauggcuuucuuuuuuuuaauagggaccaaugacauaaugucuuguucagugguucucaaagugugguucccagaucugcagcagcagcagcaccuggaaacuuguuaaaagugcaaauuaucaggccccauccuguaccuauugaauuagaaacucuaauacuggggcccugguuuuuuguuuucguuuuguuucauucccccaccccgaacccccaccccaaguccuccaggugauucugaugugcauuuaaguuugagaacuacucgaccauucuauuuccaacugauucauguugcuuaauucuuugucucaucuaugaaaaacaguccuaccucagacuucagcuugucagggcccauuccucagaaggugaauugaacugaauuuacaagucccaagagcccucaaaggaaaacacacgaaaugcccugaggaguggcauuuguaacagggccuguacagagaucugugauucaaaguacucaucagacauucccauggggaaguccgccacuacucugggauuucaauacguaugaaccccagcacccugaacacugugcugguugcccagccuccaucauuaggcugggaggagcuuccacggagggcgcaggacccagggcgcugaacucucacaaccaaucaggcgacccccccagagggaaacuacaagucccagcaugccccacgcgcaccgucaggggccgacccgccgcgccccagcguucuccgcguacagguggucucuuggguuccgguaaggcggcggcugcggaacucccguggaggggccggugggcccucgggccugacgauggcaguggccacugcggcggcaguacuggccgcucugggcggggcgcuguggcuggcggcccgccgguucguggggcccaggguccagcggcugcgcagaggcggggaccccggccucaugcacgggaagacugugcugaucaccggggcgaacagcggccugggccgcgccacggccgccgagcuacugcgccugggagcgcgggugaucaugggcugccgggaccgcgcgcgcgccgaggaggcggcgggucagcuccgccgcgagcuccgccaggccgcggagugcggcccagagccuggcgucagcggggugggcgagcucauaguccgggagcuggaccucgccucgcugcgcucggugcgcgccuucugccaggaaaugcuccaggugugggccucggggggccgggcugguggggagggccugggcacggugugggaggggacugcgggcuggggcugagccgcgagggaccgcccugggguucagggugucaccuugggaaccgcugaggcugagaggaguccaaaaagccacuuugaggcggccgggaagcugcaggguugagagggaaagagaaacuaacugggagggcugccuucuguccucuaaggaugucgaaaaagaaaugggcccaagagaaaaauaaauaaaccaguuucugaacguuucauuucguuacgugaggaccgccccgaaguagauccauggccucugaauuguuuuuccugugucagaagugaauuugcaccaagcugugucuucagaaccccugagcacugggggaaguugcuagcuaaggaccucauaucaguccuuuaaaaaaaguucuccuucccccggccucugccccuuuucugcugggguaaggagcucgcugccaccaguaaacucagcaccauccuuaacgggacuguggccugauuuccaaguagaauacauuuuggaacccaguggucaugcuccauacagagacaggaauaaaaauaacacccagcauuauugaagaucuguaugccaggagcugugccaagcauuucagauuuuccuuuuugucuuaaaugaaaaugaaguguccuugccuauaacugucauugaagcuacacaguaacccuguggaguaggcauuauuaucaucccuguuuuacaacgcgaggaaacugaggcauaggaaggcuaagaaacuugcuuguggucugucuccagaacacuugcuuuuaacccuuguucuuuccuccugcugccuggcagugaggugugaggauuucuuugugcaaaugguaaguaauuccacauaaguggauguucuccguugagauugagguagaagaguuucuugcagggauaacuggcauucagagggcauuuguucagaagagugaaauuuaaaauuagcugggacaagaaaggugccuauaugacguagagucucuugagucuagagaagagguucccaaauuuucucaguaauuuuuucaugaugcccuuaggccagaaauauuucccaguucauuuauuuagaaaguuuauuuugccaagguuaaggaugcacccguggcagaaccucaggcgguccugaggacaugugcccaagguggucggggcacagcuugguuuuauacauuuuagggagacaugagacaucaaucacauauguaagguauacauugguucuccuggaaaagugggacaacucgaagugggggcuuccaggucauagguagaugggagacaaaagguugcauucuuuugggucuuugauuagccuuuuacugaauacaauuuacaugugcaggagggauagaggaauaaucacuuaugucuuagacuggcucagugagucugcauuuucacauaaacaauacggcagagucagcaaucagauaagcauuuaucucaggugagcagaaggaugacuuuagaguucugucuuuuguuuggcacuugugaagaugagcuaucaauuuaugaauacauugccagggugaaauucaacagaaguguuuuaggguaaagaucuugaggcccaugugggcaaauuaugagggugauauguagcuucuuuuucuuuguagcuaucuuauuuaggaauaaaaugggaggcagguuugucugaggcaguucccagcuugacuuuaaccuuugacuuagugauuuuggguucugagauuuauuuuccuuugacacaaccuaauaaguaguuauguccuaacaacuuaguagcuauuugagaagauaacauaauugaaagaaaaaaauaauauguuuauuuuguucuuaaacagccauaacuacuaaugggaaauguaucucuguuggucauuacaccagugucugaaaccuuggaaucagauuggacacuuccacccucauuuccuguucuagguagauuuuuagcauuguucuuguuuuuuauuacagcaacugcuaacagcugcuuaaaagucagcuccacaaagaaauaaugucauugaaaggaauauagcacaauguaauguucaagcugugaaccaccuggagcuaguaguuuugagguauugagcaaauaucacuguguuucccucgaaaauuuaaaauauuccacaacacccugagaguuugcugcaaugcuguaggccacaguucgggagcuguugcagaacuagagaguugguuuuuuguuuauugcuaguauuuaauuauguguaacacagguuaagaaauaauacucaucagugagauuuuggaagcauuaaagauggaucuuucuguuccucuuuaaaauauagauggggcuggguuugcuucuuuggcacuugaggcagaacuaauuaaaaagugaggacacaaagagauaauuaaguuguccuugcuucuaaguaaguauuucuguuccugccuggcucugaaguuaagugacuauaauuagaaggaaaaaaaaauggaaauguagauuucccacagguugguauucuugguauuuauuucauuuaucucguagaauuuaaaaaaauaguaaaugacaaaauuuuaaaauaacacaagcccagcaaagaaugcuggauaacaaaugauuaauucaggaaaaucuuccaaaggauuugugaaaaagaauacuccuuucuuucccccaugagugaacucuugccuucuuuuugaaguugacuauuggaaaacccaaagaugcuuagacagggcagaaugagaaauaguuaauccucugacaggugggcuucgauaacaguugugaaauguaacacauuuuucuuuucacuuauaguuggcagaagggccagugaaauuugaaaguugaccucauauuaaucaugggucaucacagugucuuuacacuuggaacaugugcauuucuuuguccaucaaaagaaacagaacaaccgagaaaaggcuagagaagaccaucuuacaugauuuaaggaauaaaaagacuucccuaugagaacagucuaaauuuuaggacuuuaauuuggaaagauacagaagcauaaguucagaguauaaaauguugacuguacagaucuccuagaguccccuuuacgcuggauauuuuuauauuaccugauuauuuuuuucuuaaucuuugauuauucuuuaugaaucucgauuuauucaugauguucucuccaguguuaaguuugcauuucugaccuuuucuauugcuuguuucacuuuuaaggaaaugacuugaaguuguuccacccccauggugccauuuacccugagagaacuacagaauaaagcaaccauaaguuugcccuugguguugauaaccaguagcucugggaauaaacuaugcuuaccuguuuucuacagcauauggucugucuagcuuucauugccucucuagcuguuuugaaaaucccaauuagaaagccaugccagcuuacuaauuaagaaaauaggccuuggugucaaagacuucaucuucagaucugaucuuauuuugcuacuuaggaguucugauacugggcaagucaccuagccugugagcuucauuugcuuauacaguuguuggaauuagauguggugacaugcgaaaagcacaaagccuggcuccuaucaagcuucugcaucuauuuuuuuuucuauuuuucucucaauuauuggaagcucauagaagcauuuugggauagaauuuuaguaguuugcaaguauuuuuaaacauuuuaucauagguacacuuauaauuuugauaugaucucaguauuaaccugauaacucccaaauugauauuuuccuaguucaacugaaauuaaagggagaaauaugggauuguaggagugccuuguccucaaauugacuguauuucuguuuugagaaagaucuugguacugaucacguagucaacuuucuaaugcaauguuaaaguuuauauauuuguaaauguuauuguuauaaaagcauaaaaccagaaauuaagucuuagauuuaguuucuacaucuuuuauuggaagaugacuguagauaaauaucuuucuguauaucauuuuaauaaaugagaaaaaagagcuguugaaugaaagaucaugaacaucaguauuuaucugaggaacauccugcggaggaaucccuuuccccauuuauuaaacacaaaauugccaguguuucaaguaguucucugaucgauagaccaacaacugaaauuaaaugcuuuuagucucaagugcccauuuuuauuaaaauguaauuaucaugaacagaaaaagcaauacaaggcguguguucuuaauaauucugccauucucuuuuugacauuuaaaggaagagccuaggcuggaugucuugaucaauaacgcagggaucuuccagugcccuuacaugaagacugaagauggguuugagaugcaguucggagugaaccaucuggggcacuuucuacucaccaaucuucuccuuggacuccucaaaaguucagcucccagcaggauugugguaguuucuuccaaacuuuauaaauacggagacaucaauuuugaugacuugaacagugaacaaagcuauaauaaaagcuuuuguuauagccggagcaaacuggcuaacauucuuuuuaccagggaacuagcccgccgcuuagaaggcacaaaugucaccgucaauguguugcauccugguauuguacggacaaaucuggggaggcacauacacauuccacuguuggucaaaccacucuucaauuuggugucaugggcuuuuuucaaaacuccaguagaaggugcccagacuuccauuuauuuggccucuucaccugagguagaaggagugucaggaagauacuuuggggauuguaaagaggaagaacuguugcccaaagcuauggaugaaucuguugcaagaaaacucugggauaucagugaagugaugguuggccugcuaaaauaggaacaaggaguaaaagagcuguuuauaaaacugcauaucaguuauaucugugaucaggaaugguguggauugagaacuuguuacuugaagaaaaagaauuuugauauuggaauagccugcuaagagguacauguggguauuuuggaguuacugaaaaauuauuuuugggauaagagaauuucagcaaagauguuuuaaauauauauaguaaguauaaugaauaauaaguacaaugaaaaauacaauuauauuguaaaauuauaacugggcaagcauggaugacauauuaauauuugucagaauuaagugacucaaagugcuaucgagagguuuuucaaguaucuuugaguuucauggccaaaguguuaacuaguuuuacuacaauguuugguguuuguguggaaauuaucugccuggugugugcacacaagucuuacuuggaauaaauuuacugguacaaauucuuaacugugcauuucuuuggaggcuucacugaauacaguccuuuaucaugucaccauuagccuaugcugaucuuggucugcccagucucuucuugccacguaucuuguacacugcucugagagauaauauuccuaaaacccaaaucuaucacauuccugcuuaaaaaacaguggguuuu

SEQ ID NO: 16983 - RNA, 881 nt, Homo sapiens
gucacucaugcugcuccauuuuuacuuucgguggucucaggaagguccgauuuuucuucucuuucuuccccuuuguauugacuuggaaguuucgccagcuguccacacgaccaucucgaccuuccucaaaguuuuucugccacucucuuucucguuuggcuuuuucuugagcuucaaucucuucuucccuuugccguuuccuuucaugcaucucuuuggcuucucucucuuuccuuuuaauuuccagcugagcaaagaguuucauuuucuguuuauauacagcuuguuugaacagcucaggaucauccuccucuacaaucguagguuuuccuuccuucuuugauuguuuuuuuuuuuucucucuuucacaguguguuccacguauucuuuuccugccuaaauuacauccaggacccucuucuuuugcuccugaucaguagcaacuuguaagcuuuguccacaguuucaaaagccuuuugugcucugucagcaucaucuucauuuuugucaggaugcaccaagauggauaacugccgaaaccucuuuuuuauuucuucaucuguaacuucaggaucuaucugaagaaacucaaauggguucaaauugaaguaagaggaaccaggacgggucagucuuucaaugugguuuuuggauguuagaaccaagucucccuucucuauuuguuuccccugaagacaaggcccgggagaacaagcaccaggcagucccaggaaaacauucuuggugucacugucaggguuggaaugaauaugagguaugcuguaugccaucuuuauuccucacuguaggaggucauaaaugcuuccucugugccgccuccgccgcccaaagucccgcucucuccugaagccgccauuucc

SEQ ID NO: 16984 - RNA, 1758 nt, Homo sapiens
uuuuuucaugguuucaauggacacuuuuauugucuauuuaauggaucaucaauuucgucucccuaccuacaaauggaauuucaucuuguuuccacgcugaguagugaaacagugacaaagcuaaucaggauaagcuacaucaaaagagaacuaagcuaacacagcucacuuuuuuuuuaacaggcaaaauaugcauauaugcauucuagaaugcacaaugguuuagucacuaagaaauucaaaugggaucuugaagaauguaggcaaauccagggugcaguaaagaugagcugagaugcugugcaacuguuuaaggguuccuggcacugcaucucuuggccacuagcugaaucuugacauggaagguuuuagcuaaugccaaguggagaugcagaaaaugcuaaguugacuuaggggcugugcacaggaacuaaaaggcagaaaaguacuaaauauugccgagagcauccaccccaggaaggacuuuacuguccaggagcucuaaacuggcaccacccguagugcucacaugucugauuuuauccucuguguuccauuuggcacagcaaguggcaguguuuccaccaccuaugaugguaaugcagccccuagaaguggcuuucaccaccucauccaugagggcuuugguucccugggcaaaagcuucccauucaaauaccccccacaggaccauuccacacaaucugcuuagcccaagugacagucucagcauacuucuugcugcuuucaggaccacaguccaagcccauucagccagcagguaugccagaagccacaguggcuuggccagucuuggcauucucaucaaauuucucagcagugacaaagucaauaggcaagguaaucuucacaccauucuucucagcuugggacauuaggucuuugacaaucuuggcucccucuucaucaaacagagaagugccagucuccauguuguugagcaccuuaaggaagguaaaagccguuccaccaccaauaaucaucucauugacuuuguccagcauauuauugaucagguggaucuugucugcaaauuuagcuccacccagaauggccaggaagggucgcuaugggcucuccaagaccuucacaaaguaguucagcuccuucuucaucaaaaaaccaccagccuucuguggcagacugacuccuaccauggagcugugggcucugugagcagugccaaaagcaccauugacaugcacauucccuagcuuggaaagugaagcucggaaagcuucuauuuuggcgggcucacuuuaaccuuguucccagaguuuucccuucccuucuucuuccacaugaaaguggagguucuccagcaggaugacagacccagcagcuggguuggcacaggcuuucuccacuucugggccuacacagucuuucaagaacagaacauccuugcccagcagagauuugaauucuacagcaaauggcucuaaggaguauugucaggcauagggacaccaucaggcuggccuagguggcucauaaggacuacugacuuggcuccauuguccaagcagaauuugaugcuuaagacaguagccuuaauccucugguuguuuguuaucugguuauucuacacaggaacauugaaguccacucucauaaugacccgcugcccuuugacgucugguuuguccaaugucagcuuguuagaaagcgacauuuuggaaauggagagaggucgaugauucagacaguaagggagccggcugcugaugugugcuu

SEQ ID NO: 16985 - RNA, 1758 nt, Homo sapiens
aagcacacaucagcagccggcucccuuacugucugaaucaucgaccucucuccauuuccaaaaugucgcuuucuaacaagcugacauuggacaaaccagacgucaaagggcagcgggucauuaugagaguggacuucaauguuccuguguagaauaaccagauaacaaacaaccagaggauuaaggcuacugucuuaagcaucaaauucugcuuggacaauggagccaagucaguaguccuuaugagccaccuaggccagccugauggugucccuaugccugacaauacuccuuagagccauuugcuguagaauucaaaucucugcugggcaaggauguucuguucuugaaagacuguguaggcccagaaguggagaaagccugugccaacccagcugcugggucugucauccugcuggagaaccuccacuuucauguggaagaagaagggaagggaaaacucugggaacaagguuaaagugagcccgccaaaauagaagcuuuccgagcuucacuuuccaagcuagggaaugugcaugucaauggugcuuuuggcacugcucacagagcccacagcuccaugguaggagucagucugccacagaaggcuggugguuuuuugaugaagaaggagcugaacuacuuugugaaggucuuggagagcccauagcgacccuuccuggccauucuggguggagcuaaauuugcagacaagauccaccugaucaauaauaugcuggacaaagucaaugagaugauuauuggugguggaacggcuuuuaccuuccuuaaggugcucaacaacauggagacuggcacuucucuguuugaugaagagggagccaagauugucaaagaccuaaugucccaagcugagaagaauggugugaagauuaccuugccuauugacuuugucacugcugagaaauuugaugagaaugccaagacuggccaagccacuguggcuucuggcauaccugcuggcugaaugggcuuggacugugguccugaaagcagcaagaaguaugcugagacugucacuugggcuaagcagauuguguggaaugguccugugggggguauuugaaugggaagcuuuugcccagggaaccaaagcccucauggaugagguggugaaagccacuucuaggggcugcauuaccaucauaggugguggaaacacugccacuugcugugccaaauggaacacagaggauaaaaucagacaugugagcacuacggguggugccaguuuagagcuccuggacaguaaaguccuuccugggguggaugcucucggcaauauuuaguacuuuucugccuuuuaguuccugugcacagccccuaagucaacuuagcauuuucugcaucuccacuuggcauuagcuaaaaccuuccaugucaagauucagcuaguggccaagagaugcagugccaggaacccuuaaacaguugcacagcaucucagcucaucuuuacugcacccuggauuugccuacauucuucaagaucccauuugaauuucuuagugacuaaaccauugugcauucuagaaugcauauaugcauauuuugccuguuaaaaaaaaagugagcuguguuagcuuaguucucuuuugauguagcuuauccugauuagcuuugucacuguuucacuacucagcguggaaacaagaugaaauuccauuuguagguagggagacgaaauugaugauccauuaaauagacaauaaaaguguccauugaaaccaugaaaaaa

SEQ ID NO: 16986 - RNA, 631 nt, Homo sapiens
ucaguuuccccggauggagcucacgcgcucugggcucugggcucucugccgcgguuaaggaggucugugaguuccccgauguacuugaugguguacuugagugucuggaucuuggugagaggcuggccucucuggcuguagacagguggcagguaauuccggagggugugcagggcaucugccaagguccucauccugagcuucucccucucgcuggcuuuccgccuccgcuggacagacauccugacuuuggugcccuucugggccuuggggccaccaccgcccugaaggugggugggcuggaaagcuaacauauuguaguccaccucuaccaggccacuggccccaccgacacugcagccuucgcugcccccacugcuggccccgccgugcucacagggcagcccagccacagcuggacagggagaagaagaauaggauuccagcgauggagccggggaaaggcucugagagggggaggccugauucagcucaaagggcccugcccuguccuuccagucccaggaagacagcaggccagggcugucagaggagcccaagccauccucgaggcugaggaaagucucgcgcagguuguccaugccugcgagacagcugcagaaggaauggc

SEQ ID NO: 16987 - RNA, 8114 nt, Homo sapiens
cuccuguuuccugggacuggcagggggagucaguccugaauaagucacuuuuucuuuuuagcuagaaaaacgacuuucaaaaggcuuucaaaaucucgucuuuggucgauuuccccuacuacagcauuuuacgcugaguucuaguuucucucucgagaacagccuccgcacuguaaucugcaucaacccaaagggucaugaugccauuucuccacuucaacgagauauaccuauuuauugcacccuggaggucucuuucguggcgguguucgauuuuagauaacuuacuugcaacuuguguuuaggaaaaaauguacacugauacuuuaaaccaugcucuguuguaggguacgauugauaucgacgcgugcgcuuuuguaaaguagcuuugucuacgugggcgggcagauuuuuuaaaguuccauuugcacugcagcgcuguuugcguccuaaaugcgauauuguaauguuuaauauccagcuauuauguagcuuuaucuuuuucagcuucuaauauuuuguugcuguuuaauuuuuuuggcaugccuuuuagucgaguuguauauacgaagucacaguaagaaagccaauucuaagacuccuaaggaauauuaucguuuaaauuacagaaggcaaauccccucuuuaggaugggagaauguacuugaagggaggaauguggcagggucccucagaagugagggagcccgcuguuccuccuucaggcauuugcggauggcacuggugaucacaaaaaagcggagauuacgcugccgggcgcuccugugguagagggacuggaacacugucccauguugagugaagaaugccaucagcuuuaccaguugucccguuaccuaaagccacguccccaacucuacaacuuucacacccuggauuuuuuuugggggguggggggguauagaggaggaggaggaaggugcuguagguaggggcuuguuucuuccuuccuguguaucugguagaauccucaauuaaccagaaacaacugaagagcuauuuuucuuccuucaguugcaaauuauguucuuuauagaaauuucuagccuuacuuccaccuuauuucuucccagauucaaacaaacaaacaauaccaacaguagauuuucagguguaaaauacuccauguaauauucucacucgcuuugugacguggacgaauugaaaacggagaaugacaguaaaagugugaaauuccaguaguguaacaggucuaagcucauaguccugggaacuccugguaauauuauuuauuagaaaauuuguguguaaaauauaugagccaagaaggguggaacuuaaggcauggggauauuuuuuaaaaauuggaagaaaacuugaaagucauuauuagaaaaugaaaagagaccggaauugaagaauggauuuauacucguuuauucuuaaagaauaaugauaguaauuuacuucuauggauagcauaccuuuauuccaaaagcaaaggguauuaaucauuacagaaaagguguguuacguaagauaauuauauuacguaagauuuuuuuuuguuuuucugagagagacaggggucucgcucuguugcccaggcuggagugcaguggcaggaucauagcuuauuguggccucaaacuccugggcucaagugauccucccgccucagcuucccaaguggcugguacuacagacacacaccaccacgcuuggcuaauuuuauuauauuuuuguagaaacaggugucuugccauguugcccaggcuggucugaaacuccuggucuuaagcaauccuccugcuuuggccucccaaagugcugagauuauaggcaugagccaucuuuuccaguccuauucugacuuuuuaaaucuuuuuuuaaaagaugcagauagaccaacaaaauaaaauaacuucccuauagucaaauaggaaguaucucuuagaauacagcccuacaacaguuuuucugacucauagacugucucauuguauaugucugugccccuucuacauguuuuucuaaaauacugaaaaaaaugcaagaccaugaagcagugauucccaugcaguuaaugggugaguuuuaggccuccuucugcagagaagggaauaaaaauucuaguuuuaaugaacuugauugaucaugucucccaguccuccucugauuucacucuguaauccaugacuggaucuaaauucagucugaaagaucacucugucuguagacacuaauuuccucaaaauuugaacaauccacaauaaaaguuucauaaggcccugccagaugaaucaccgugaaagauuugaguuuccuggaaguuucuuggggccucagaaauagucauagcaaauacagguagugugcagccucaagaauagagaauacuuuauuccauuuucucuucuacuauuuggccugacauauagauucauagcagugcucugaagcuggaaauuuuuaccauuaucguuaguggcaacacuccauaaaugaugauaacagaauugcacugugcauggcccuguuucuuuucauucaugacuuuguaggugucuuuauugcuaggcuguacucuuuuucaguugugugaaucgccauugcagauaauaucacggauccauuuugggggaccucgguaguuggaaaucauugaguccagaagggucuucaaaaacccuucuugccuaaagcagaucuuacugacuuguuucucccuuuaaucuguguuuucuuuaaucuagaguuuuuaauuaaacucucaaccucaacagagauucuuagcauagaaguuaagagaaaauacgaacagugauuucuaugcccccucagagacaaccaacuaaaacaaaacccacuuuuuuuuuuuuaaccaaacaguuuaaaaauuuuauccugccugaaggaggaaagaaacagugggaucccucuuuuuuuuuuuuuuuuuuuuuuuugguguucuuaccacauauauccuuuagaguucaucuuaucauuccuaaggggguguucaagaagagaaagaaugaucacugguguucuuaaauccaaacauucaccuuacucucgacuuccuccuuuuaaaacuaccuauagagcaucuucauguuaauuuguuacagauggcucaaacucaacaucuccaaaugauuuucuccccugccccucugccuccuuggaucuguucuucccccugugcugccuagcacuuugacgaugcccacuaucaacccaguccucuaaauuagaagcuuggauguuaucuucagcuucuccauuucucuaauuccucaucacgucguuaacugaaucccgugaauuccauuuucugaaugucuugcaaauucauuccucacugccacuguauuaguucagccucucaucaucucacucuuggaacacguguucuuucucauucuccuaacuguugcaaguaaaaucgcgucacuuccuugaauaaaaucauuaacugguuucucacuuuaaacaacauaaauuaaaauuccuuagcacagcaugcaagaucauuuucuggcucuugagagccccaucucuugccaugucuuuuuagugcucuaugcucaaccguucuguguuaccugcaguauaccaaauagguaauaauguuucacuucuccgcacuuauccauauacucuuucccuuuuccuggaaacucauccuucccuugucuugccuuuaagggucuuauuaauccuucaaauucagccaaaaaauuauuucccagcagaagaaucuuuuccuaccacauagcagacaguuuacagaauuguuuugaagauuaacugagauaguauauaugaaaauacuuaacuaggaagcucuauuuaaacauaagauacuauauaaugacaauacaucuauuaauuauuaaauaaaagccaaagucugcuuuucauuucaaaaggcaaaaugaaugcuacguugauaugagaaaaaacucucgaaucauuuugauugaauuuaagguucuuugauaugaagaaacuuuauaacuuuuaagcaugagugucuuccaccuugauuaaauuauuaucaugcaaauaauccacaaaguauuuaaaagcauuuauuaacugauuuuucaaggacuuuuacucaauuauucuuguuuguuuauuuuucuggacauuaggcauaaauuacaaguguagaacuauauuaaaguaucuucuguuuuauagcuuuuaaaugauuuuacuauucuuauguuauuugauucacaaacagagagcauuacccccauuucauaggugagaucaacuccuuaggaaggccauauuacugaacauuaugaacuugauuaaaaaaaaaagaagaagaagagaaaggccauauuguaaugcuuucuaaaaguaaagugguauaaugugacaaaacuagguaggggcaacccaguaauguaauacuaguuauucagcaacugcuacucuccgaugcugaaaaaaaaugagcuacuaguuucuaucuuuccgaguuucagguucuugcuugggaugacaagaauaugcaguaauagauuauaauuuaggaagaagaugaauuaccauuacauacacuacuagaagagaaaaccaaaaauauuuggcucacuuuguuuuucuugauuaggaaaccagaguauauaaaaacaaaaagucaaagaguauuggguauuccacuaauaguucauagucuaaaauaccauggaaaauuuugcacuaaaauuaaaaauuauauacuuacuaaagcauuuuuaaaauuuauacauuuugccucaaaacucagaggcaucaaggaauucauuuuuauucaaguugcuugaaauauaacaaagaaggaagaaauucuauuggaaaauccuauggaguaauaguucugaggcuaucuacucauauuuggugauagagauguaguuuacugugucauuucagacugguuuguuguauuuuugauuuuaaugaaagaaaauuaaaacgaaaucaguaaaacaucauccagauggcuggagugcaaugguacaaucauagcucacugcagccucaaacuucuggccucaagugauccuccugcuucagccucccaaguagcuagcacuacaggcaugcaccccuaugccuaacuaauuuuuuaaauuuuuuguagagauggaaucuggccagguugaccagguuauucuugaacuccuggccucaagcaauccuccugcuuucaccucccagugugcuuggauuacacauauaugauuuuauuugaaaacaaaauuucacugcuaauuuuuaauguuuaaaucacggagggacuagaagagucauaacuagagguaaagagaauuggaagaaaaguuuuuacaaucacauuagaagaaauaaacacuugaaccagaaaaguggcaguggaaauggaaaguguaugaauuugauauuguuagaguagaaucaacaaaauuugauacuugauuauguauauuggagaagguaaagucaaaugcaaucauaagauuuggaacuggaucauugggacaaugguauugauuuuaguaaaaacagaaaugcaaguuuggagaagaggagagcaagaggauugacuuaacugcuggacauguuucuugcauuugaaaggcuauuggcacauauagguggagagguccagcagacaucaagaaauugcagggauggaacuugggugggaagucugugcuagaaauauagaauuggugguuauucauguacagguaauggcuguagccagagaauagguuugauugacaaaggaggaguauaaagagaagagacaagaagaguaaaacuuaaccaccaaaguuuagaaaaaaggaauuuggaagaguugcuuuugcacuuguuauucucccuacauauuuguuugcaaauuccuagaaaguaguaacaguuuuacugauuuuaguauugucaaacagcacuuggaauauugucuguaagaaaguauuugcaggauuaaaaugacgauguguauuuaacccagcuaaaguagaacauggucuguuaauaacaaaaauaauaauuuguuucaaauauaugcaugcuggcuaaauuguuuuagaaaaauguuaauauuuaauuaacuugauuaauaacuuuucauaugcacaugcaugcauaugaacauauauguguuuaucaucuaucuaucuauccaucuaucuaucuaguuuuuuguuuucauauuuggagucuguaguagauauuuuuggaggaguaugccuagcccacaagucaaugguucccuugccuccaaaagggucuaaagaaacagguuccugacugcuguuuguucuggacacuaaaaccucgcuagaccaauuggauuuuuuucuuauaauuuuuuuuucuuuuuugaggugggggucucguuauguugcccaggcuagucucaaacucauacaaaauuccugauauccuuauaagagaaaaaacacagacacagaaagacacaggcagggagaaugcugcgugacuacaggggcaaagauuggaauuaugcacaagccagagaacaccagagauuuccagcaacaacaagaagcuagaaguggcauggaacagauucucucucagaacccccuaaagaaaucuccugaugauacuuugauuuuagauuuccagcccccagaacugugggagaauacauuuuuguuguuuuaagcuuccaagacugugguauuuguuacagcagcccuaggaaacugguguagaggacaacugcauuuaaauacagcauguggguguuagguuuaugauaaagaauauucuggcagugcgauaauagaaagaguuuucuuuucugcaaauaugcuuccccccccaccccggcuuuuuuuacugugaaaauugccgagguuugaauuaagagauguggauucaaaaaccaacucugcuucuuauuagauguggucuugggcaaauuacuuaaguucccuucaugcccugauuuccuuauuuauaaauugggaaagaauaaaaaguagagaucuaugguucacaaauucaagauauugggcaucuaagaaauucuggauaauaaguuaauagugcuaauuugcaucuaagaugauauugagccaguuucuuccaaugcaaagcuaaauuaaauucacaguuuuaguuuuauuuaaaauaacuuccuuagagaccuuucauuauuguugcucauggaaaucggauuagguauacugaucacaguaccacugcuggaaguaauucaaauucugcuuaagauuugcuaggcuaguuuauggauauuugaauaaaauucaguauuaauagcacuguaauguuaaacaauauucugaaauuagacuuauauaacaccuugccaaugauccauauaaugucauuuuuaauagacuauuuuuuagagcagguuuagguucacagcacauaugauguuuuuagaaacauucauugacugaauucugguuguguagauuguaguacaguauuagaaguucaaacauguugauuguggauugguugaaaaauaagacuaaauaacauuauuuaauauguuauauaucuuaauauucauaagggacauguccuaaggcuuucccgacuccccaguaugugaauauuacucuaggaaaaaauuacuuuguugguaaauggccauauuauugccuaugaguauaaaaugagaugauaaauaacaacagcaaagcuacauucagcugcacauaccacaugaucagcugacuaaacuuacuaauuuaauuaacugcaagcaacagcuuuauaguuccauaaaauucacauuugugcuuuagcaaaaugacauauuacuaccugucaugauaaccuucagggucauuuacaaauagauacagcccaaagauuaaaucuguaaugguuacauucuaugaaaauccugcuaccugaaaacuuuaugaaaauuuucauacaucauuguacaauuugaaaaauaaguaguugaaacuugagagcaugagcauuuugaaagcaguuugaaucugauggauuaaggaccauuuuaaaugaacuaaaauuuacucuuugguuuuuaugccuucaacacucacuuuuaaaaauaggccuuuauuaagacuucuaaauagauugaaguu

SEQ ID NO: 16988 - RNA, 3247 nt, Homo sapiens
uugguucaauuuuaccauaccgaaagaauaaauucauuugagcuuuuaccuacgccuuugcuuuuuguuaaaggaagaauucaaugcaauguguucagaaaguuacauuuaaaucguuaauaaagagaaaaaggaagagaaagagaggacaccauuccgacacaaacguuuaugugauuuuagccauuacaacaguaauucagaaauaucucaaauguuacauugaugucaucaauauuacaaaaaaggaaaaaaaaagugacaggcaacagugaagagcaccagagacccagcgcacaccuaaaguagaccaugcuucuuuccuuccacugccagguuaucgucccgggaagccccccacccccucgcuuuccuccuccgcuuucccuaacccgucucgcgggggcaucuacgccucguccucgcccuccuccuccucgaacuccccuuguucgucggccguggcguccugguacugcugguacucggacaccaggucguucauguugcucucggccucggugaacuccaucucguccaugcccucgcccguguaccagugcaggaaggccuugcgccggaacauggccgugaacugcucggagaugcgcuugaacagcuccuggauggccgugcuguugccgaugaagguggccgacaucuucaggccgcggggcgggaugucgcacacggccgucuucacguuguuggggauccacuccacgaaguagcugcuguucuuguucugcacguugagcaucugcucguccaccuccuucauggacaugcggccccggaagauggcagccaccgucagguagcggccguggcgcgggucgcaggcggccaucauguucuuggagucgaacaucugcugggugagcucgggcaccgugagcgcccgguacugcuggcugccccggcuggucaggggcgcgaagccgggcaugaagaagugcaggcgagggaagggcaccauguucaccgccagcuugcgcaggucugcguucagcuggcccgggaagcgcaggcagguggugaccccgcucaugguggccgacaccaggugguugagguccccguagguggggguggucagcuucagggugcggaagcagaugucauacagggccucguugucaaugcaguagguuucaucuguguuuuccaccagcugguggaccgagaggguggcguuguagggcuccaccaccgugucugacaccuugggugagggcaugacgcugaagguguucaugaugcggucuggguacucuucccggaucuugcugaugagcagggugcccaucccggaccccgugccgccccccagagagugggucagcuggaagcccuggagacagucacagcucucugacuccuuccucaccacauccaggaccgagucgaccagcucggcucccucuguguaguggcccuuggcccaguuauucccggcuccacucuggccugccagagggaaagagaaaucuuaagucaccggugauuguacuaaauaccuuaccucaaaccccucaauauagaucagugagucaaugcucagauaagacuauuucagauuaucaccaaaauggccaaacguuaaaauauuuguucaugaauauaauuauaaauaaggaaggccaggacaccaagcucuuagcagcugaaaggcaaacaauuuuacacuauauuaaagcuaaguuggcacaccgcggauguucuucaugcuuucccucuggcaaucacaccucuucagccuccacugcccagcguaaaaugaaucccucaugcucucagccacaccaggcacucaccaaacacgaaauugucuggucugaagaucuggccgaaugguccagaccuaaccgaauccaucgugccuggcuccagauccacgaggauggcccgaggaacauauuuguuaccugcaaggaacaacagugacuuagacccucaggcaaggaccucugcagagaagggcuuggcgccugcugccaucaugcagauguugccccaaacaaagggagacccaccaucagguucucaaagggcucuguuggcauaaggaagcccaaugaaauacugcagggaaagagcggggauccuaaacugaauaguccacccucucccagggccacaccccuggggucccacgcaagggaaaggggagaagguggaaaaacugaagggaguggggguggggcaagggugauuaccaguggcuucauuguaguaaacauugauucucuccagcugcaaaucacugucuccaugguaacugccaguggggucaaucccaugcucaucacugaugaccucccaaaacugagacagaaaggcugcauuuagccaugaacgaugcccccagaaacgccaaggcucacaaugaaauguccccgacucaguuccgacaacccaacauuucaggagcuugaagcuuuaaagggcgucgugacccgggcacagccgcggggcuuguauuuugcagguucagaaaguugaaacugggcguuucccaggcaaacagcugccgcucgcggggggagguaggggucgaggggguaaggaccagccaaagccgggcaguggcggagcuuggcgcacuggucgcagccccaggcugcggcaggaggcgagggcacagggacugcagcccgccaggagcgggugggcggggaaagaggaacgcaaaggagcuaaaggaccgcgguuuuagauucaaagcacguccugagaccgcaagacaaucgcucuccuccccucccccggcagcucgacuccgguucaagcgaguacaauuaauccuccuggugucccagccccucgcgcggagcgccgcgcacagccucgcggacacacccucgucuucuccaggcacgcgugccugccaagcagccagcgcggagggaggccgagggggugacggggacuccaaaugaguuacagcagaaagaaagagaggugcccccuccguccgcgaaagucaccuccuagcccaggccacacucggcggcacaaagcggccaggaaggucugcauuuggcgauccccaggccuucccaggaccgcgccuggggaccccgaggggcucucggcccagguucgcgcccccauuggacccccuccgcugcggcgcgcccaccuuggcgccgaucugguugccgcacuggcccgccuggaugugcacgaucucacgcauggugccucgucagcguccuccugguccggcggcgucugggucugu

SEQ ID NO: 16989 - RNA, 3247 nt, Homo sapiens
acagacccagacgccgccggaccaggaggacgcugacgaggcaccaugcgugagaucgugcacauccaggcgggccagugcggcaaccagaucggcgccaaggugggcgcgccgcagcggaggggguccaaugggggcgcgaaccugggccgagagccccucgggguccccaggcgcgguccugggaaggccuggggaucgccaaaugcagaccuuccuggccgcuuugugccgccgaguguggccugggcuaggaggugacuuucgcggacggagggggcaccucucuuucuuucugcuguaacucauuuggaguccccgucacccccucggccucccuccgcgcuggcugcuuggcaggcacgcgugccuggagaagacgaggguguguccgcgaggcugugcgcggcgcuccgcgcgaggggcugggacaccaggaggauuaauuguacucgcuugaaccggagucgagcugccgggggaggggaggagagcgauugucuugcggucucaggacgugcuuugaaucuaaaaccgcgguccuuuagcuccuuugcguuccucuuuccccgcccacccgcuccuggcgggcugcagucccugugcccucgccuccugccgcagccuggggcugcgaccagugcgccaagcuccgccacugcccggcuuuggcugguccuuacccccucgaccccuaccuccccccgcgagcggcagcuguuugccugggaaacgcccaguuucaacuuucugaaccugcaaaauacaagccccgcggcugugcccgggucacgacgcccuuuaaagcuucaagcuccugaaauguuggguugucggaacugagucggggacauuucauugugagccuuggcguuucugggggcaucguucauggcuaaaugcagccuuucugucucaguuuugggaggucaucagugaugagcaugggauugaccccacuggcaguuaccauggagacagugauuugcagcuggagagaaucaauguuuacuacaaugaagccacugguaaucacccuugccccacccccacucccuucaguuuuuccaccuucuccccuuucccuugcgugggaccccagggguguggcccugggagaggguggacuauucaguuuaggauccccgcucuuucccugcaguauuucauugggcuuccuuaugccaacagagcccuuugagaaccugauggugggucucccuuuguuuggggcaacaucugcaugauggcagcaggcgccaagcccuucucugcagagguccuugccugagggucuaagucacuguuguuccuugcagguaacaaauauguuccucgggccauccucguggaucuggagccaggcacgauggauucgguuaggucuggaccauucggccagaucuucagaccagacaauuucguguuuggugagugccugguguggcugagagcaugagggauucauuuuacgcugggcaguggaggcugaagaggugugauugccagagggaaagcaugaagaacauccgcggugugccaacuuagcuuuaauauaguguaaaauuguuugccuuucagcugcuaagagcuugguguccuggccuuccuuauuuauaauuauauucaugaacaaauauuuuaacguuuggccauuuuggugauaaucugaaauagucuuaucugagcauugacucacugaucuauauugagggguuugagguaagguauuuaguacaaucaccggugacuuaagauuucucuuucccucuggcaggccagaguggagccgggaauaacugggccaagggccacuacacagagggagccgagcuggucgacucgguccuggauguggugaggaaggagucagagagcugugacugucuccagggcuuccagcugacccacucucuggggggcggcacgggguccgggaugggcacccugcucaucagcaagauccgggaagaguacccagaccgcaucaugaacaccuucagcgucaugcccucacccaaggugucagacacggugguggagcccuacaacgccacccucucgguccaccagcugguggaaaacacagaugaaaccuacugcauugacaacgaggcccuguaugacaucugcuuccgcacccugaagcugaccacccccaccuacggggaccucaaccaccuggugucggccaccaugagcggggucaccaccugccugcgcuucccgggccagcugaacgcagaccugcgcaagcuggcggugaacauggugcccuucccucgccugcacuucuucaugcccggcuucgcgccccugaccagccggggcagccagcaguaccgggcgcucacggugcccgagcucacccagcagauguucgacuccaagaacaugauggccgccugcgacccgcgccacggccgcuaccugacgguggcugccaucuuccggggccgcauguccaugaaggagguggacgagcagaugcucaacgugcagaacaagaacagcagcuacuucguggaguggauccccaacaacgugaagacggccgugugcgacaucccgccccgcggccugaagaugucggccaccuucaucggcaacagcacggccauccaggagcuguucaagcgcaucuccgagcaguucacggccauguuccggcgcaaggccuuccugcacugguacacgggcgagggcauggacgagauggaguucaccgaggccgagagcaacaugaacgaccugguguccgaguaccagcaguaccaggacgccacggccgacgaacaaggggaguucgaggaggaggagggcgaggacgaggcguagaugcccccgcgagacggguuagggaaagcggaggaggaaagcgaggggguggggggcuucccgggacgauaaccuggcaguggaaggaaagaagcauggucuacuuuaggugugcgcugggucucuggugcucuucacuguugccugucacuuuuuuuuuccuuuuuuguaauauugaugacaucaauguaacauuugagauauuucugaauuacuguuguaauggcuaaaaucacauaaacguuugugucggaaugguguccucucuuucucuuccuuuuucucuuuauuaacgauuuaaauguaacuuucugaacacauugcauugaauucuuccuuuaacaaaaagcaaaggcguagguaaaagcucaaaugaauuuauucuuucgguaugguaaaauugaaccaa

SEQ ID NO: 16990 - RNA, 726 nt, Homo sapiens
gacaggcuuuccuuuccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccagcuccaccguuaccgcuaauauaaguaaagucuguaaaauucauacuuaauaaacaauuuaggacagucaaaaaaaaaaaaaaa

SEQ ID NO: 16991 - RNA, 6550 nt, Homo sapiens
ggaaaagguugaguugcaucauuuaauuuuaagcuauuuauuuucauaaacaugagguauuucaaagugcuauaagaugcagcacuaaauauauacauuuugaagaaauuaaacacagaacuuugcauuuacccaguucuaugcaccaaacaugaacaaauacauuaacaggaagaaacaggcuaggaaaaaggcauauauauauaguaaauuucuuuacaaaaguuucuuaguucaaaaagugauaaaguaauaucuacucaaaacuuucacaacucauuuucauacgaaaauauaaguaucaaauuuaguuauguaucagcgucauacuaaaguauacaggcaguguaagaauuaguacaguacauaacagagauuaacaauauauuuguauacaaaacaugcuccucaaacauugagguauuauuacaguacuuagguaugaacuuccagucuaauacuggccgcaaaagccaccucucauuacccaggauguauacaaaaggcggaugugucaaugguauuuacagaaauguuccccagggguaucaaauggcaaaccccuuauguggcaucugcuggaacuuaagcaccauuuuaaaaagaaggaaugacuuucuguuguuuggaaacuuggaacacacaaggugacuucaacagccccagaggcucccaaccgucaccaacguuuagcgcugucauggaggugagguggaggaggcugcagggccacccagcauccugggaugcaggcucuccaaggucccagcagaaccccacacuggugguccuacugcccacccagagccgaacucgacaggggaccgauuugaaaguaaaccaacauucuuaaugucaacacaauguuuguuuaaaaaaaaaaucaaaaugugcaaaguggcagugacuguccaguuuugagaagcgucuagcaaguccgagcguguucaauuuucuuuagcaacugcugcugucuugccugcaauuuuuccuuuuccagcaaaagcuggugcuccucggccuggagggaguggacauacucaguggccuuuuucaaaaugaccaccuuggcggccuucucauucuuuaccaacuccggcacguggucccugagcgugagaaagcuggaccgaaggucguugcggcgcuggcgcuccaggauguugugguuucugcgacgcucacuguccuccgagucagaguuucgggggcucaagcucuuagccuuuggggggaugacacucuugagcggacguggggacgccucgcucuuuaucuucuucugugggggugcauccucacucuccacguagggagagggggcggcauaguugugcugcugguggaugggaaggcaucguuugaggaucagcucgcuggacugagcccucccgggacccagggcugcguucuugggacgcacagugauggugaauguggugacagccuugguguuggaggaggaacgccgcuucuccacagugaccacgucgauuucuuccucuucaucuuccucuucaucaucuucaucaucugagagaaagaugcuaguuacucucaugugagaaccauuugaaugaaauucacauauauauccauguuaauauguaugcuuaucugucucuuccggcagacccuggcagacugcuauuuuuauggguccaucaacauagauguggacaguuuuguauuuguuuuagaucucuuuaaauuaaauauaucuguaggccggacgcggugacucacaccuguaaucccagcacuuugggaagcggaggcgggcagaucaccugagaugaggaguucaagaucagccuggccaacauggugaaacccugucucuacuaaaaauacaaaacuuugcugggugugguggcaugcuccgguaaucccagcuacucgggaggcugaggcaggagaaugacuugaacccgggaggcggagguugcagugagcccagaucauaccacugcacuccagccugggcaacaagagcaaaacuccuuaucaaaaacaaaaacaaaacaaccccccauacauacauacauacauauacauauauguauguauauauauuuuucuuccccauaccccaacugugcuuucagccuccauucaagacuuuagcaggugguagaaauaaauauaaagaacuuggccuuuagggucagacagaauccuggcuccaccgcagacuaguugcaugacccuggucaaguuacccagccuuucuaagccucuguuuccucagcuauuaaauggggaugauaccacuuugacagauaacauguagacuuagcauagagcugagccuaguagacagaugcucaguaaaugguagcuuuuaucauaaucaccagucugcccuguggacuuauuuacauuucuagcuccacacuuaaagaguugaggccucucauuuuaggagccucauuuagcaguuuacacaugguuguguuugauuuuaaguccuuaaacaaacuugaggaacaauuuaauuaacugaagaaaaaaaacaacuuuucguccacaaaccugaguuuuauacaauaaacaguuuuucauuuaacaaagaucaaaucuuaaugacaaagccauaauccacaguugguauaaacccccaaaugggagcagcucuccucaaagccaccaauaauaacagcaacaacagaaacguguagcaucaugugcgcauucuuccccucucuccucauugacuaccacgcugggguagaaaauuauuguuuaaaauacaagcaugaaaaucaaaacauaucuucugcuugaucugaaggggaccggaaagcugaacaauugugggauuuguucuaaagccgaaaugugaggcuguuccagucugugggucccuuuaagccaauguuuugguuuucugccaagaagacagcuguuggaaggaagugcuuccucaccaaaagcugucaaggcacagacauuaaagggacagagccguuucaaacuggaggcuuaucaccaaguuuccuuccaggagccucaaagaucucuccucagcccagaaguaaauuuaggcuuguuauccaccugcauucugaaaacacugguuuucaaaguccaaggggggucccagcucccugcuccaaggacaaggcaaugccacucuuuggguugaguucuguucauccagacccccagggaaaggcuugguuuuaacucuucccuucagcuuaagacacagacaaaugaacacaauagaacuaaucagugaguccucccaggaugugagccuuccuggagaggcugcugagugccugcccucaccuucaagggcacuggguuacagauacaacucacaucucaaauuaggccuggaauucaggcuggaagacaaaacuacagccaguuuccacugcacacuggaaagaggaggcccccugagaauguacacaacugcuguugcacuugcagccagcugcugaauggagggagggagggugcccccaccacccccagccuuucagaucccgggcccgccugcuggccucgcauaucgccgccugcuggccacgcaccaggagcaaauagcccaccacccaccgaggaugggggaagggaaagguaccgacauuugaaaaaaaaaaaaaaagaaaaagaaaaagaauagaaaaucggcucuagccaucugugcaacccuccuauaaguuccugcgccuuaaacagggcuuugcacagcccuugaaucuucucgggaugucuuucccuccccugaccugggccagagagucccuuucaccccugcgcuaacagguuucuguccaggcagugcacccagcaacccccuaaacccccacccgguuuagccaccaacuuucuccaauuuuauuccucagacugcgcugcaaaagagaggugggggaccgggugagggcccgugauggccuagaggagggcuccccaggagaggguggaaggaacuuuagugaaggcgagaauuggagagcaccccuuuugcaacggcauucucucagccccuucucuuuaccccgaggagagacuugggggaaacaggaccucucugccccuagcacugccuccaaaaugcuccccaggccaagacauacgagcacuaacaaaggggacgcgacccgggguccagugccccagggaggcagccggacccgaguucggucuuuaccugaaucgcucaggguguccucuccggagguacugagggccuuguggucgccgccgcuggucuggcggccgccugggcgcggaggggcgacccccggggccccggcuggggcggcaauacccgcccccgaggcgaccgcagggcccgccgccggggcacuggccggggcugcgggcacgggcgcuggcucgcgcuuguucacgggaaaggggaagaccacggcgggauccacgcacucggcggccgggugggcgagcucggcgggcagggcggccccggcgcggccggcucccgcagccccgccgugcccgcgacccgcagggcuggcggcgccggcucccggggacugggcgguggaaccggcgguuggcggcccgcggccgugcugcagcuucucgcucacggcgcgcuccagcuucucgcgggcggagaagccgcuccacaugcaguccuggaggaugaccggguugggggugaggccacccaguccccccaggccgaacgcguccuccucggccgggcugccccacagcucguucucaagcagcaucuccgugacccagcucgggggcucggagcugugcuccgcgaagccacggcugggcgacagcgggggcgugggcagcagcucaaacuucuuccagauguccucccccgggggggucgagucggggccgccgaaguagaagucaucuucguccggguagaagcagggcuguagcgagucaaacucgaggucuggguucuugcagaucaugcccggcaugguggacguggagcagcucggcaucggcucgccucccggccggcgacugagggcuucuuuccgccccguucguuuuaauaccgggggugcuuccuucccguggggggcgcggaaggcgggggccggcgccgaccuccaacacugcaaccgacagacacaccggagagggugggcaaacggggcagaccgaggggauaggcaaugggcgcccccucuaaccagguuccccaaucuucccuccaagccccccacucugcccacugcucccgaagguggaggaaguugugccucucgcucccucccucccgcccuccuuuuguguacaagcugucuacgacagggggugggagggggcaugcagaugcagggggugguggcgaggcuccgcaacuuuggaaacugccauuucauucacacaaggcacugccugggggagggggcuguuccuggcugcagaauucuagcucucacgagcacgcagacaaccgcacucgcagcgguguggggccggcugcucaggggaagccccaggcucuccgacccagcuaccgggaaugguauuuggaguaccuucuacccccuuuguaaaaaugcaaccucaggagugcaaaugauagcaggggauuuagaaaacuuugcaaauaaaaaaaagccuuucucuagacagagaccaacaacagacacccauauccacaaauccuuccccuccccaaauuugagcaaacgccccucggcauucacccgcugcagggauacuccugccaauagcuuaauuggaagcucucuaagcccaccccugcucuuccaaacccacgacaacguccucuuccagggagggagaggcugagccccuguucccgggaauggcaggggcgcccgcgcgaggagggucgccgggagagccgccucuccuccaagcuggagcagccgugacccagauugcgaccgcggcggccucgcccugccuaaucccccccucuucuuccuccaggggcacccuuuggagaagaaccccagccugggguggggacgcaccggcucuccgacagcucaaacacagacagaucuucuagagccgagggaauuucuuuucgcagaagccauuacuccccccgguaagggcugcaaaaggauuagggcgggucuccucuagccaggaugccuucggggcuggaacuggcuuuucugggaaaacccagagaugguuuuguuucggaagcagaaacagucccccgggcauauuagggcgcccggugcgcacgucgcaaucccguccagggcuugccuugccccggcgcucgucgcuucccugggcgccgggcgguuugcaagcccugcuccuuaccucccgccgacugcaggggauccggaggcgauucugcgcgggugucuccgggugggccgggggggcggggguguccucggauggcuacagucugugcgcgcuugcgccuggcuagcgcuugcucggcuccaacacaguucccaggagccccccgcauccacccagcgcguccagacagaugacugucacagccugcgcuuugaagcucgggggauauuauuaacugaaaaaucugacacacccggggggcggggagagaagggggcug

SEQ ID NO: 16992 - RNA, 45573 nt, Homo sapiens
ccaugcauuugcguuauuuuguaaguaaguauucucuuggugcuggguuaacaacagugggaaaaugaauaauaauuuaugggcagaagcacacgauagaguuuauuacaaccaauagaauuaacaucaauauuuuaagugaacagaauuuuaugauauggguauaagcaagccaaugucuccaaauugcuagccuuuaagagccaaacaaaauaccucaagcuuucagccugugugucuguaaguuagccaauucucuccccaaugcaccuaaggauucuugagaaugcuuacaaagccugauugccacuaagccugauugucacucuucugagcuuuagacuacuacuccagagaaguugcuuguccccucuuaccauuagggaccaauuucccacagaacaggauccuaaucaguucccacacccuguuccuagcauuacuuugucuaaacacagaagagcuuucucuuucauacgcaagucauacugacagaccuacuugccgaccuagguagcaaacaucugaagguauuaagagaaucacaauguagaaaaggaaaaucaaaacucauuaucaaacaacauugcuccaauauucaacugacccugucccuaccggccucuccucucucucgacuccuguucugaucaggauuuucuaucucagagugucuuccccgagacucuaauccaccacaaaaaacuggaaacccuucacacccaauuauugcccugcagagaaacauccucuggcugccucuucaaaguccuacuuuggcagcagcaaauauuuauccuuaaauugggauucaauucaaggaaacacaaaacuagcaaccaaucacagucuuuucuggugaacagaaugaguuacccagcuggagaacaagaugugagguaaaguauuggguuaaaccagugauuuuuagaguauaaacugguccuaucuaaagcaauggcaauguuuuaaauaaaaacaaaguagcaacgucuaaaacagagaaaaggccaaauggguuuugaaaaauugaagcauccuuaaaaagacuugccucaauccccaaagugacuauuuugaagggaauuaaacucacuuggcuacaggugaguagccucugaguagacuacggguggugaauaaucuuaucaguuucuugaaaaauuacauauguuacaauuucuaucaaaguguuucucuacaauaauccccacuacauaauauuucaacaagggcuccagcuugagucugacuauauguaaccuuaagacacauuggcuuggaugggugcaaaggacacaaggauuugcaauaggaccaagaaacaucuagggucagacucaguuuaaggcagcugcucccaagccuggcagcacauuaacaucacugaggccaucuaggccccacuccagagcaauuaaaucagaauuucuggaggugaagugcagacaccgguauuuucuuuuaaaguauccuaggggaccuuaaugugcagcugggguuaagaaccacuaagcuaaggaaacagaacucaagguggacaucuuggguccaaaggcagugaacuaggagacaugauucuaacacagcaagcaucugucuuucagacgucauuuuagaucuuaaccaaauccucaaguaaaagauugcagugagaauaaaagcucuaagaguuguuucucuguaacagugugucuugaauugugguucaagguccaucugcaugaacacaauuauuucaggaauuuguuaaaaugcagauuccugguucccaccuuauaucuaaugaucucugcaugugauuuagcucuagaagucaguaacuauuguugggaucaaauccaggccuaccugaugacuugucuuucaaauuccccucaauacuuuugaccagaaagaguggaauccaucagaaaaaaguagacauuuaaaugaguuuaaaugaaagguaaugauuuaaagcaguagaauggaaaacaacugcaaaaauucccucuccacuccucccuccaaaggaauccucuaucaauuacuuuggaguagcaaaauaguaucccucccuuuccuuccuguuccacuacauuuuuucccuucugacacauauuccuuuuuccucccaaauaaggucacuuagaaaaaaugccugguaggacuuuagaaacugucaacaucuauagagaaaugauaaaauuacugcaagagaaccuaucagggaccucauuuuauauuuaucuauacuuuuuugauauuuuacaaaucucauucaaauugaaauagugugucguucccuuuuaagucagaacaaggagaggaaugugauuaaauagcuuuacccauuuggaauuggccaggaaccaacauuuuuuuuuuuaaucugggcaguucccagucauugccacaugcacuucuaccuuuaaagacaaaaauuaggaaaucaaaaaaaaaaaaaaaaagccugcaccuuauuuaaaacaagucuaggucccuguuuaucugaugauggugggaccaggagugggagcccaugggaggcaagaaguugcauguaagaugugagacuaccucuacucaccagcacuaauucacacaccauaugaagagacaucaggaaagcauacuuugagcgcaacaaacuauacuucaguuuguaaaauaaauuguacagacuucuuccuauauuguuaguguuaacgucaaccagcucaacucuuucagaaagcaaucugaugacucugaaaaauguucauaacauucaggcucuuuaauucaauaacucaauuucuaggaaucuaguuuaaaauaauucaaaagacagaagauguucacugcagcauucuguguaacacaaaaaauguaacuacuauaaauacaguacacaugccuccucaucuacuagacauuuugcugaaugcuuaacaugauccugaauaaugugaauuuucaccauuuucauaaagaaaucaaagcuuaacggaccuugccuucugucauauuuauagugugaguuagagccagauucaaauccaagacuaauauuauaaaguucacauccuuuccaacuccccucaaugcaccugagcaguaagagugcaaugguuacacaaacaauaguacauucaauguauuauguagccacuauaguauuuauaagaaaaaugcuuauguuaaauaaaaauacagaaucguauauagaccaaaacauuuacagaaaaaagaaaugaaccaaaauguuagcgaugacuuucucuggaagugggacuauaaauaaaaaguaaggaggaguggggauuacucuagucugaaauuuccauguaacuaacaggaaaagauaugcuaagaaugagguauaaauuagccacacgugguggugcaugccuguagucacagcuacucaggaggcugaagugggaggacagcuugaggccaggaggcaggaauuggggugagccgagauuaugccacugcauuccagucugggcaacagagugagacccugucucaaaaaacaaaacaacaaccaaaaaaauaaaauaaaauaaaaaaaggaggugcagaaauguuuuagcaaucucauaacaaagaccacuaguuagaacccuuuagaaucaauucucuuaaggcaaauauccuaaggcaauagcauuuggucccuuuauuugguuuucuaugcucucuuaaaugaaauauaacuuguugcacuuaaaugagccuguccuaguaagggacucaaauuagcaauacaguaaagacauaaaccugaguuagagcagaacacuuaaguuuauuaagauaugaaacagccuuuccccuaaaccacuucagucacuaugaaagucaaguucuagcaaucaaagcuugaagguagcuuugacgagaaugaacagucaaagacuagauugugaguaagaaggaaugcaccgaggcuccuaagaucucaggccaugucuaucauguguuaaaguuggggcaagucuugacauuucuguuuacagagguucuaagacugacauauaacuacagacaccagaucugugaguacauuuaaaaauuccugcacuaaagaauggacaaguggaagcuuugaaucacaaauacuaucauaugaagguuaauauuuagcauuuucuggacuuugaagggccucuaguguuuuauauauuaguugggguagaggcuaaaguucuguaacaaagagcccuaaacaugagcagcucagauaacaucaaguuauuauaacaggcaguucggagagggugggcagcucucuuucccaaggccaccagguuccucugccuuguucugccacuccccaaguauuacacuuuucuaaugguggcaauaggcucacuaauaccacauccaaguucuagccugagagaagagggacagggugggcaggacaaggcccggaaguuguacacaucacuuugacucguaccccguugaccagaaccugggaaaggcaaucccgaaggaggcaggcaauuagcaucccucaggcccagugaccacaucuuaacccgacuuuuaacaguuacuugcauucuuggcauuaauacgauggccugaaggaaucagcaucuggaagcaagacugagaauaaaggaaagaauuaauggugauaugagcaggaaaaaagagcaagucaggucuccaaacaacuccucggcuagucugguuacauguggcuucuuccuuugaaaacucuuguucccuggguaauuccaguuggucaguaaguaauuaaagaggaaaaaaacaucuccaccauugcugagcucuauccaggauuccucucuggccuugcaauuuggaccugagagucauccuccaaagguagccagcccaaagaguaaaagcugaaacugaagaaacccgaguucuauuuccaguucuaaccaccaggccaugugaaugugcauuccucuaaacucagcuuucucucucauaaaacaagggcaugaacaaggugauuagaaagauccccuccauucuaauauuuacaugucugaaauucagucuugucuuugcugucacaucaauuaaaaguucguuucuaaacgagugauuaaugugcgugaagacugcacagagcugucaucacauagcuuugagauugguuauaguaguuccaggacaucuccaaagcaaguggucuagagauaagugaaagaaugguauccucauaaucauuucacacaaacccuaaacucaaauauacaagacaaugauuuucucacuacagcuuuuaucuguuuauauauuguuucacucaagguuuuucauugcuaaaagguuugaaaaccaucauauaagaaauuauaacacccugugcucuuaaggaaacucuuggacaagaauaauuucccccaaaaaacuaccuuauagacuaagagucaaaaggcacaaagcaacaauucaauuauauguauuuacauuuucccuuuccuucugauauuuuaggcaagagccaguguuuaagaaaauauauuccagggccaggcaugguggcugacgccuauaauccccgcacuuucagaggccaaggugaguagaucacuugagcucaggaguuggagaccacccugggcaacauggugaaacccugucucuaaaaaagaaauacaaaaaaauuagccaggcaugguggcgugagccuguagucccagguaccuggggggcugaggugagaggacugacgcgagaggauugcuugagccuaggagguugagguugcagugagcuguguucacgccacuggacuccaggcugggugacaaagcaagacccugucucaaaaacaaaaacaaacaaacaaacaaacaaacaaaaaaauaaccaacaaaaaaaacccugaguuuaaguuugauuuuaagaccuguagggacagcagauuaguucuacuuugauggguaugcaucaucuggaaagcaagguucauaaaaagaagauacaucuucacuggcaccaucacaucagucaucaguccuuagauacagaaccuuuacugacucccucaaaacuuccaugcuuccaaacuaaccaagcaguucuucuacauugggaucaucgaauuucccuucauguuccaacucuccucuagcuucaauauacacauagacaaccuuagccaucugaaaaccuacuuuuagaauauucccgagugguuccacguaaguccucugccagauucacauacccauaaauucuacuucauaagcccauacuguucuuaaaaaagaaauagaaaaaauauaucaauauaacuuuaaaauaagacacaaaccuucaugaaaauauagucaucaaauuuauuuucauugggaugccauuuuuugaagaauuccuaagacuaauguuucuugacaugcaagaguuagcauuaauagcuuacguuacuauaaauacugcugcuuggaagcaguacaacuguuuuagaguuuuaagacuacagacuuucauuacucaaaucuuauucaguaaauguaaaaaucagaagguucugaacagcugguuaggaagguagccaagaugcaggaaagaugucugcgccuccuuuucaagggcagccaacucuugaacaguaggugccaaaauauccacauggccuuuauagcuuccaccugcaucacacacaaauaacaaaguaauguaaaugacaugcuugaaauaacuugucagcaauacuuuggcucaauuauaucacuuuaaacuuugcuugcagcaauaaaauguacuacugggcaaguuaucuccagaacuuugacuuuaaaaaauguuaaaucaauuauuucaauauaaauaaauaauuaggccucacuaacagcugucccaacaccucuacccacccuuggcucggaaacaacuaguuaggccugagucuuacaauuuuucaggaacaagcuaacaaaagggcaucccaggcagaggaaauaauaugcugaauuaccaccugaguuaagucaaaggcuucugauuccuuguucaaaaucaccuauuaugcucuuguuuccuacuaauuccacaaaauguucaacuacucuuaugacauuaacacuucaagagaaagagcuaagcugaagucuuucauucacauaaagaugacacaauuuaaaaaugcuacaaggcagguauggacaaaguacuaugaggguaauaaggagggaaugauuaacacgcuaaaaauauacucuuaaccuaaugaaaugaaaguacugccuucccaaaccgaaguucaaaacagguauauuuacauuuaaaauuguauuuaaaauaauucaaagcuuaccaccagcagcccuuuucugaccguagguaacuuucccaucaaauucauccacugguaccuuuauauccggcucaaccugagaaaugguacaguucagguguucuucuaucucagauaguaacuaaguaauggagagaaaauuuccaaauaaaaauuucauuuagaaagaguugcauuuuaucaucauuaaauaaagcuggaaaggccagaaugcuugguauaaauggaagucagauuucugaagagagaaauucacaacuuacaauuagcaaagugcagauaacauuauaaccaacuacgacuuucccuuauaagugacaaacagauaaaagccaagauauaauuuuugaagauaaaugcuuucuauucuaccauuuuaauacauuauuugugagccuaacucgaagucuuaccugcaucucguuguaccauaugguacagccuccaucuuccuugagucuuguguuauaacacccuuuuccacggcugcuacauacaugguaccaaaccuaaauuuaaaaaggaaaaaauauuaacaugcauggagauagagacaugcuaaauaucuuauucuaaauuuguuuuuaauuguuuucuguccucaaggcacuagaaaaauagauuauagguaugauauaucauccaauuaccacuacuauucaguagcucauugaauaaauaggucuucugaaaaaguucuuuuugagaauaauccaaaaguuuuccuaaaaugggugucagauaucaaaaggaauucucagauaaaaguaggaugaaaaaguaaauauugaagcauacuaugucaauauuaacauaaaaaaguucaaaagaaaaauaaguucaaaucuuuuguauaagagaauaauaaagcaaauaaugcaaaauguacaacuacugaauuuggcaaugaguauaugggagcucuuuaugaauacaacuuuucuauaaauuuguaauuauaucaaaauaaaucuccccucaccaugaaaggucuuccauggcaccaugccagaaaauguuuaaauauuuuuugguggaaaugaguacaauaaagcuaguuggaaaaauuauauuuugcauuuuuccuuucuaaauuucacccuauuauuuguccauucaaugaauauaggaaaaaagaugacauuaaaaaguucauuuguauuccauacgcagcugaauuaaauuuaaaugggaaaaucaaacugcuuuuauuuccaacaucuaaaaucacaacacacacaaugaauauaauagagcccuacaaagauuaccuuuucuuuuucuguugccaccagggaaauugccagacccauccugaaagaugguuaaaagccuucuauuagacuuuauuccuaaagcauacaagcuuaaaaaugggggaaaaaaaauugcagaaguaccuuucagcucuuccuacucugccaauucgauguacguaguuuugcuuuucaucgggcagagugacauuuauaacuauaaauaaaaaccauuauuaacaauugccaguaguuucuaaauuuuucaaacauauuagaaggcuuuacuuuagauuccguaacaaucacacuacaggcauaaaaaguugcuuuuuaccauaaggaacaccguggauaucaauuccucuagcagcuacaucugugcaaaucaagaaucuuacaucuccuuucuaaagagaacagugaagagagaaaggaguuuguuagcacauauacuaaacaauaaaaacaaaugcuauccuuccacuaaaugagaccucuaaaaacucaaguguuacuaucagauuagaggucgacauacuccuaauuuacuggaccaagucuugaaguuuuaugucaugaucugcugaaacaugacauuuaaggugauuaaaucagagauuggguucauuuuugcuuuucuuuuucuacucaaagauauuaaacuauugcuaaaacuuggcuuaaucuuuauaaauaucuuuagaaauugaagagaaagacaaaacagaauacaauguacagacauaagcauuaucuuuacucuuaaauucaaauaaacucagaauacuagauauuuuaccuggaggcuacauuuuuuguaacagacaaaauucucaaggggaggaaaaugaggguaggccccuggugcucaccaagaaauacaaauuagccuuucaaugucauuugugccucaaggcacagcaaaauuagagaucugggggagggaagaaggguauacugacuuaugguccagaaaaaugccuacgguugagaaggguagcacacauucaaacgaggccaugcgauguguuuucacaucugcaucaauuaugcccagcauggaaacguaagccaaaguucuucaacccaauacuucccaucuuuuuucuuagaaaaugauacuuaugcuauacacuggggccuauuaaauuaaugagacugcuugcagguagacagguuaccgaucuuuaguucuaaauggcucaagccauuuacuuacccacccacuuacaccaagagcuauaugacccguucaugugcugcaagcauauaacuggaaaggucugccccaaacaguaucaaaauaccuuuaauucuacauagccauauucugauaccugucuuaauuaaucuacaaauuaaguuccuuauggcuauugcuggagacuguuuuuaaggcacauagacauggcuuaacuauccaaugauacuucuccuaaaaauaucuaccugaaauaauuuaacuaaaauuucugaaauugaaaauuccuguuauaguaguguuaugcugauagagaauguauaauuuaccauuugagugucaacaaugacuaauuccugucaugaugaugacacauuaguuaggguagaaacauuuugaaauuucuaggacaauaauugcuuuaauaauauuaauuaaaacugcuuaaaacuagauauaaugccccucuuaaguauuaaggaaacaaucaacuauguaucaguaccuuaaaucuuuccaaguuuugcuuucucucaugaggcuuucugucaccaugaagacaaacacaugagaacugguguccuuuuuuaucagguccuagugaaaagcacauuaagcauuuaaccuuggaaaaucuucugccuaagacuauguaaaaaagccaauaaaauucagacuacaauagugccacacaauuccauaaaaaucuaugccccaacuugcuauaaaccaugguuaacacaauuuaugucacaaacgaaguaccauuaaaaugaacucuacggagcauuaaaguuguccugcuuuuaagggcauuuuaagucacccuucccaaucuguaggaggaguggaucaagcaguguaccaacuaaaaugccuauguguacaccaggaaccucacuauccuccauaaagcuaagacucaaaaaguaggcaaaagagaucauucuuggaggaaccaaaauuaagcaucaucaaguuaaugugcuuccuaaaaggccaugcccauaagccugcucucuucucaagguauuuuaagcaacauaguuaucuaguuucauggccacagaagauucaaagcagcaaacuguaaagauggagagguguuauuuuagaggcaagugcagugguagccaaccccccaaaagaaaacucuucaaguagacacaguaacaaaaagaguaaccacugggauguaacaaaauaacaauuauggcacuuaacuauucuccaagguaaauuaaguucaguaaguauacuugaaaauucaaggaaacaauacauuuugacagauaucuauucaaaaugaauaacacaaaaauuaauuaugcagaggugaaauaacagcuaaccagaacuucuagagguauacagcugagauuuuauugcauccugcauucaagugguuuagggaaguaucaaauacacacuauaacucucugguuaggguauguguggaggggagagggauccuuugaucccuucuuuuaaaccccuguaaucugguauauauuguguuugaguguuaguaaugguguaauaaacuuguuuucuaggcagaaguaacaucuacauccagaauauuuagggaaggagcaucaaaguaacuaaagggauauuacuacuuaaucaacaguacuccuuacuacauaaucaacuccuccauucaaaacauagacaggaagaaaauuaaguacuacaaaacagucacuauaacaaccaagcaagucuguuugccaggacuugaaaaaaaaaauguguuacuuaagcacucacuguaaugaacaguguaauguauucuuuauaugaccauuaguucaaauauucuauauccuucuugaguuuucuauuuccuugacguacaucaguuauaacaaaauguguuagucuuuccucaguacaauaaugggauuuguauguuaccuucuauaucugccaauuuuuacuuuuuauauuuuuccaauauuuauauuuucaaacacguagcaacacugaaauaauuuuaaggaugaacaguuguauauccaccaccuagauucaacaauuaacauuuuauuauacuugcuuuaaccacauaucuaccuauaccuguauccauccaucaacucaucuucauauuuuuguacauuucaauguaaauugcagacaucaguacagaguucggcaugcauauaauuaacuagaauucaauauuuguuuaguuuuuucuuuugagguaaaaguuguauucaagaaaucuacaaaucuuaaguagauuugcugagaaagucccauuaggauacagaacaucauuaucacaccaaaaaauacccucauauccuuucccagccuaucccuacugccacccuuguggggacuacuacuguucugacauuuuuuccaucacagauuaguucugacuuuuuaaaaaugucauauaaauagauugauacaguguauauucuugaguaagaauucuuucauuuggcauaagguuucugagauucauccaucauugcuguguuuacucagcaaggaaaagucuguuccuuuucacugcugaguaguauuccacuguauuucacacuuuauuuauccauucuccuacugauggacacuuaguguguuuucaguuuuagaauauuauaaauaaagcugcuauggccauucuagcaucuuuuugucaauauguguuuucauuuauccuggguaaacaucuagcaguuuaauugcuaggccauaagacagcauuuuuagcuuuauaaaagacugcaagacccuuugcuaaagugcucauaccauuuuauauucucaccaacaaucuauucucaacaacuguaugcaguugcuccacagccaaaauucgguguuguauuuuuaguuuagcauguacaacgguauuauacugucauuuuauuuugcauuuccauaacaacugauugagaauuuuuccauguugguuuaugauauaauuuggcugggucuccauccaaaucucaucuugaauuguaguucccauaauccccacaugugggagggaccugguaggagauaauagaaucaugugggugguuauccucaugcuguucucgugauagugacggaguccucaugagaucugaugguuuuauaaggggcuuuuccuacuuugcuuggcacuucuccuuccugcugccauguaaagaaggacguguuugcuuccccagcucugaagaacugugagucaauuaaaccucuuuccuuuauaaauuacccagccucaggcaguucuucauagcagcauaagaacagacuaauacaguuuacauucucgaaguuauaagaagcauaaaaucugaacccuuauacuuccauuguagcuuggauauuuuauuacauagugacucuuuauuucuaguaauauuugucuuaaagucuacugcaacucuuauuaauauagcuagacuggcuuucuuuugguuaauauuuuagcugacacaugcauaauauuuuuucauuccuuuuccaucuuucuauguccucagauuuuggguaugcuccauguaaacagcguauugcuagauuucauccaguccaacaauccaugcuuuauaacagaagaccguguccacugauacuuacaguguuuacucauacauucagauuuuuccaacauugaucuuauucuauaauuucuaaccauaauuuuucucauuuuauuccccuuccuuucuugcucuuguuuagguuuuuuuuccucauuccccuuuccccaucuacugguuuaaaagacauacauucuauuauuucagugaucauauuuuaaauuuuaagacuaauaaauuacuuuauccuucuuccauauaauauaaaacucuuaggaugcugugauucaaguuuacuguaaugaaaauguaccuacguggaaaauucucucuuguuuuuccuagggcuuaucauauggaaaaguacugaauaagcauagauacuuaaaauaugccaucaacugcuuuaaauucugugcauguguucuagauugcaucaacaugagauuaauaaucuauuacaagaggauauaaacacaauuuauuucaagugagaaaaaauuaccuccuccuuguuguauaaaguacugcuccaaguuaucacagucaauuuugguucuacagaagauaauugcuugauccaucuuauguuccuugauugcccggacagcauacuccccuuucaggauuuuaauagcuucagaccacaucucuugaauaucauaacaacaacaaaaaccaacagaauuucaaucugaacuugucaugaauacacauaauuauagucacagacugacugcuuaauuuuccuaaaaaagaauacuuguuuuaauaaaaguauuauauauagauaaggacaagaaguaaagauagaguaaaacagugaguuaaaccauucauucauuuauuuuuguuucuguuaauauuuuuuaugcuacuuuaugggguauauaaacacccauaaccguaccccuuaugagggaacacacacauacacacguacaaauuaacagaaauacauacagcaaaacuguuaucucucaugaagaacaaaucauauucugccuugcaugaacuucccuaaaugcucaauaaaugcuuuauacaauuauuuuaacuccuuuuaaaaauaauuaauguacuuucuaaaucaaucuaaauaccagaaaguucauacuucacucuacgcaguaaaaaccuuaacacaaaacucuaguaauuuuuuagucaccauccuccaacucucuauuuuucagugugaagcugugcuauaauuguuauuccucaaccacugaauguaagacuuuaauucugugacccaacauauuucuaaggucucucugaucaucucuaauuguuagucuaaacuaagcaaaacuuaugcaagaaaaauauaagaagcaauaaaaacuggaauuuuauaaaaugcauuugggaugacagauuuucaaacagugucucugcucuucuccaacaauaaggauaacuaaguaugugucuuguuaauuuagaccuacauauaaaacugaguucaaaucuuuaaucaagauuucagauaauucaccauuuugauauaguugaaauucaaccaugaagcaagcagaguccgacccucaccaaugaaugauccaccugaaacaucucaugucagacaugcagccuaauggguuuaagauccauucuucuagguuuucuaagcaccaaccuuguaucaugauguaccuuccuauauuuucaaaacacuauuuaaccugaaacaaagagucucagcucugcaaagaagaaucuucauugaggcggaauuuaauguuaggcuuuuuaaaaauugauaaauauuuaaugauacagauuuucaguuuaagaagaugaaaaaguucuggagauggacaguggugaugauuguacaacaauaugaauguacuuaaugccaaugaacuguacacuaauaguuaaaaugcuaaguuuuauguuauguauauucuaccacacacaaaaaagucaacaacuauuucaaaacaauuucaguaucuuuugcaaagcuauagcuaaagaaaguuuucuuucuuaugcaauauuccugauaugagaaacuuacaugauauuucuuauggaauucagggucaauauaaaauaaucucucuagaaaaauucgcuguuuuccuaugaugagaauuagauaaucaaaaauauuuguggcugggugcaguggcucacgccuauaaucccagcacuuugugaagccaaggcggguggaucauuugaggucaggaguucaagaccagccuggcccacauggugaaaccucaucucuacugaaaacacaaaaauuagccaggugguaguggcacgugccuguaaucccagcuacccgggaggcugaggcaggagaacugcuugagccugggaggcagagguuguggugagccaaaaucgcaccagugcacucuagucugggugacagagugagaccgugucucaaaaaaacaaaaaaaaaaaaagugauuuagaugccaggagacuaacaucuaaauucaaugauuaaggccaggcaugguggcucaugccuguaaucccagaacuuugggaggucgaggugggaggaucaccugaggucaggaguuuaagaccagccuggccaacauggugaaaccccaucucuacuaaaaauauaaaaaaauuagccaggcaugguggcgggcgaucccagcuacuugggaggcugaggcaagaagagaacugcuugaacccggguggccgagguugccuugagcugagacugugccauugcacuccagcuugggugacaagaacaugacucugucucaaaaaauuaaaaauaaauucaaugauucauauuccucuaaguugacuaguaucagcuuuuccccauuucuuuuuuauuauuuuuguugccuuuauuuccaaauuuccuguuuuaauuuugcaggucaccucacauccuucaugagaauagguaagguauaaauuucauuuucaaaaucuuucaacacauuugacucuuuuaacucaccuggacuauuagcaccaggucuuguguuaucuuuugcauguacaucaucagucuaucaaaagcaaggaauaaaaacaggauagaggagugguuaaauaaugauucagaauauaugucauguuuuaaaagggagauuuauauuugucuuuagacuguauuucagauauaugucuucauaauauaaucuguaggcaaaaucauucuucagauucagaaaaaccuuucauuaacuauaggucuaagaccacuuuuaaagguaauaauaauaaugaaaaugugguuucuaaaauauuguauauuuauaauaaauauaaccuuacuauauaaaggcaaaucuaaucacagugaagaaagugacaagaugaccacaugaaauugauuuuuagaacaaaguacaucaagaggacacagaugagggcuccuacuaaaauacuacuaaaaauggaaaucauuguaucugaaauuagauaaauauauguuauuuacuuauaaagacuguaucaaggaagcugaucacaaaaguaauauuacgaagacagaaaaacaaaagauggaguccaucacuuauucagugcuuuuuaaaggucuaaggguuuacgauguauuggacuuuucuuugauacaauaacugauugccuuaagcaucacuaagagcccaaggcugaccuaguuuauaaauugcuuuauucuacauaaauguuaauauuauaaaccacuuacucuaauguggcucuuuccaagccuuucccagagucugucaguuuugggauuuacugggacaacaacaugguguacaguaucuggaacagagucuucuccuuuuaagucaacccauguaggaaaaugcauuaucuucucggacaguuucuuuacaucgaaagaaugcaaaguggcagagcaaacaaucaccuaagaagaggaaaccccaaauugagaugaacuuuuauaauaauaauuaauaaaucacacaaacacugauaugaaacacaaagugugcuagccuagacuccaaagauaaguucaacaccuuacucuauguagcgacaacuagaguuaugacuuugggcagguuaaccucucugagguucaguucccucacugucacauagaaaucaugccaucucuuccucacgucccuacaaaaacuaaguaaaaugagucauuuuuguaagccaaaaauccuguauuacugucuguccccuucucucaaaagcuuguccuucuuaaaugcuuccuaagaaagaaggauauaacuacagagaagacaacaauuuuucaauagcugaaguuauuuuuccuucgaacaggcaacaguacuaauaaucuggaauacacacccuaaacggucuacaggacaaaguaacuaagaauuuuuacuuguaguuuucugcaacacccaaguaauuuccucaaauuuccuucuauuucuaaaagcagcuuuuaagacuguuaccuuugaguauacuauuucguccaguaacguaaagcaaacauuuuacauaguaauaaauuuaaugagaggggaccaaacaaaaacccuuugacccugcucauaagcauuaaugauggcagcaacaggccgucaggagcagcugcugccaucaagcuggcugcagcggggagacaugagcagcggcagcaagagaggcugcaggagcugcagugguggugguggguucccugugccccgcauccccaaggcagcugacugggccaccccaaccuucgcgaagcugggcaggacccgcucccaggcccagagucuccaccacucuggacccuggccccguguugccgcucuugcccgccacugcugcggggagggcacagagaggaggcggacagucucuagaguccaccccugggaggacccuggagcccacugcccugggagccaccucaauggggcugggccgagucgccugccagagggggagcagugagguugggcacagaggggcagagagagaggagcccugagauggagcugggcccagggugguggugggagccagggcaggcaggagcuccaccaucccaggcauggcugcagcugcccaaguuauggcugcggacccagacaucucugcacucggggggcccuaaaaggcccucccuugcccccacagguucggagaugucugcuuccacugccuggccucucccugcugucaacacccacucugaucacagaacaaaguuaaggccgagguugggcacugucucaagcuugggccagcugggugugcacacuugagguagcauugauacaccaacccacugccacuuuggccccuuccagccuuugggcgccagcgaacacggaaggagggccaaggcaggcugaggacggcccagugcuggccugcacgugucccuuggcaugaacagucugggcaccaugaacagcagcaggaggcagacaggcuccugggcggaagggggcuaguccccggugaagccccaccuucaacuggggaagaccugaagccucggggccuggccaccagccucacagagagccggugcccaugccagugccuggagcuacccgcccugccgcagccaaugugccuggcugugugccauggccagaccccacguucgcucauacacgccucaccacuccgcgccuggcucacccuugggaggcaugggguccaggcugguagugagagcugagcacagccugccaggccaaguggguggaacugagcaaaacccgggcaagggcaucacuagccgcagagguuuccagccagaaaagcaacacccccugggaucccguaacauuauacauaacaauuguuuacaugcauuuuaagaugcauugauaaauuuuauaccugaagucuuuuuccaucagagguaaccugaggaaucugauugugcauccuauuuauaaaaucagaauaaccuugagaaagaagcccauccugcaugagaaacaaagaauaaauuaaguuuuuaaucaguauggaaaaaaacguaaguuuuaaucaguaucaaaaaucuuuuuucuaaaucaaacaaaauauaaggaaacuaauucaugcauauacauaguccuauauuuucaaaauuauuuuguuggauaaagauaauuuauaaauucaauuuuaaguuucuugugacuaaaauaugaaaaagugacaauaagcaauccaaaaccauaaucuaauaaucuagaaugaaaauuucagucaacagcuucuaacauauauccuucaacagacuuuucauauaaaaaauuaaaaacccucagugcugaggaacuagguaacccaaccugaaaaugauuuggaaguaugucuaagagacucaaacacauuuauguccuuccagauggucuacauuuuguaucucugacacaaggaacaaauuuauaguauguagaaaauguauguacaaacaaagcugguuauuuggagcaaaaaucaaaucugccuacauaccuagaaauaagaguaauuaaauauaccaugaaguagccauauaauagaccacuagacagcauuuauaaauuauguacaauuacaggaaauacuuaugacauuacauuuuuaaaauuuuucccagauuccucauaucuugauuucaacuacauaaaauaauauauaaauaaaaaguauaugaaaauauaccaaacugauaacaaugauuaucucuagguaguaggaucaugacugaauuauauuucuucuucauuuuauauauuuuaucucaaaaaauauaaguaaacuuuuuaaaaaguaugauuauauuucaacauacagcuucauccaggaccaggaaucuaacuugagauaaguucagcuuuccaguugacaccaagucaucuagucuucccggaguaccuacaacuauaucuaccugaaaaaaagcaaaccaaccacuuaaugaaaacuaaagaaacaguauaauuacguuaaaauagcaaccaauaacugucuuuuuaauaaaaacaugcauauugaaguagucagucaacucuaaauuuauaaaaaaaaaaaaggaguuacagauaaugccauauguucaacugauacuugguuugaaauuaaugugaagauuuugaccaaaauugauuuugacauccuuaacugauauacauucuaaugcauaaaauuuauauuuuccaagcaaaaaucugaugaauucacuggaacucaacggaaccuagaguucaagucccaguuccaccacuacucugcucugugaccuuaauuuauuuaaucuccucuaguaccaauuuucccauuuuugaauugggggaauaccuucucuuuuucaagaugguugugauaauuaagagauaagaugcguaaagcacuagacgcagagugucccaggugcucaauaaauuugguuauaguuaauaguaauggugaucagacuguccaggaaaacaguaauaguuacuauuugucaaguacuuauaaugaacaggcacucugcaaaauguuuuacaaguacauguuuuauuucauguuaccacuaagguaaauacuacuauaaucaucccuauucaaugagaaaacggaaguuuagaauacuaaauaaaacuuuucaaacauacauagaagagaacagugagccucggugccaguacaaacaguuaacauuuugcauucucccacacauaucuuguagucaaguccauagguauggugauuagacacacagguuucagaguaaaguucuaccuaugaguuguaugaucuuagguaaguuacuuaauauuugauauaagcccucuucuuaaucuguaaaaauggggaagaguaccaucucagaggauuauuguaaguacugaguaagaacauguuauguuuuuaguacagugccugacccauuucuagaaagcagucaauaaagaugagguauuuuuaaaguguguauaugggccggcgcgguggcucacgccuguaauccuagcacuuugggaggccgaggcaggcagauugccugagcucaggaguucaagaccagccugggcaaaauggugaaaccccgucucuacuaaaauacacacacacacacacacacacacaaaauuagccgggcauggcggcgugcacaucuagucccagcuacucaggaggcugagggaggagaacugcuugaaccugggaggcagacguugcagugagcugagaucacaccacugcacuccagccugggcaacagaacgagacuccaucuccaaaaauaaauaaauaaauaaauaaaaauauauaaaguguguauaugauguauuuaugugagcacaaauaagguauuacauaagaucauucaguaaaucagacaauucaaaaccucuacuccuuaauuggcaggcauuaaaaaacaacacuuccauucuuuuuuaccuguuuucuccacccuguacuaaaaauauaguuuucuauuagcaaaguuauuccucuaguuccauuacuucaauaucucaccccucgaauaaacagaacuuuuaacuugauccaauaugaggcacuuauuaucccaugaaaaauaaagcagacauuucugaagcuauuguuucaucugcacugauaauuacagcaaguucaaccuagaaaauauugucugaaaaugugaagauaaaaucuguccaauguauuaagaaucuacuaugugccaaacacugagacaggugcuguacacagcagugaacaaaauaccaucugguucuaugacaucaguuuaguacaguauucuaaccacgugaguuuccuccuuccgaauuucagcagguaaagugggcaugaagacagacacaaggccucucaggguuuuguuuuguuuuuuuaagucaguuagaucagaaaagccugugagacaucuuuauuuauaugaccucaguggcacauguugcauaauaccguaagacuaaaagauuagaaaacuaaaauucuucuacucucauugccaagcugacuucugccccagcauaagacccaacacagggcuaaggcugaaccagagugugguggaagauaacagaagcagagaauguaagacagagagaagaacagauaaagaucauauuagauccccuaagaaguagaguagaauugaauucugcaaagaaugcucugguauaacacuaccuuuccaauugcuucaaguuaguaccaaauuuugagacauccugaugaaagcagauuuaauucccuaaaagcucuauaagcuuuaggaaaauaggaauugagaaacauauuaucuuaugggaaaaauggguuugaggaagcaagauugggaauaaacuuauuaaaucucucuuacaaccacuaaaauaaaauaaaacacacuaaauguuucagcucauuuucugcuguuuuaacagaauaucacaaaguagauaauuuauaaagaaaagaauauuugucacauuucuggagguuuggggaaguucaagagcauagugccagcagcaacuagugagggucaucucauggcagaaaggagcaacaaagagaggaaaacgggccgaaacuccugcaauaacuaacccgcuccuacagcaaaggcauuaacccauucaugaggacaaagcccucgcgaucuaaucaucuguuaaaagcccccgccuuccaauaccauuauaugggcaauuaaauuucaacaugaguuuugguggggacauuaaaaccauagcacuaaauaaaaacauaucaaagcaauauuacucaucuuagaauaguauuaacaaguaugguaauaugauuccuugcucuuaauauggcauaccaggucaaauguaaagucuguguggcacaaaauuuaguuugacaagagcaccaauggaauuggagaaaggacacaauugcuugucaugacucaauaucggaugguuuagcuuuaaugauuaaauauuuaggaaaggaaauaaaagagaaauuuauaagcuguaaguuauuucacacacgaaaaauauuucaugaaguccuaccuucacagaacugauaaacaguuaaaaauuuccuaaacuucggccaggcgcaguaguucacuccuguaaucccagcacuuugggaggccagggcggguggaucaccugaggucaggaguucaagaccagccuggccaacauggugaaaauacaaaaaaaucagccaacaugguggcgggugccuguaaucccagcuacugaggaggcugaggcaggagaacugcuugaacccaagaggcagagguugcaaugagccgagaacaugucauggcacuccagccugggcgacaagagugaaacuccuucucaaaaaaaaaaaaaaaaaaaauuccuaaacuucuucuccaacaguggagaucagauccucuuagcuuuguccuucguaauggcauggcugagcacagccuuugcgacuuccccuuacacauaauugaacucaugucucuccucacuggaacuauuacccacugucuuaucauuauucauccuucccaagagucacugcaggaacuucuauccuucucugcaaucuauuuuaccucuacuuuuguucuuaacuccaguuucuucuuuuucacuuaucuccccaaaaagaaugacucuuuacccaugaaggccagaaggaaauucucaaauguucagaggguaaacaacaaaaaaucauguaugcuggaauuuugcuugagaggucugggagagacuuuguauacuuccaggagaagaaaaggcgcacuugcaagaugucuuugaacaaacauacuccucugaccuugcucuaauuucagccucacuuaaauuuucuugaaacaaaacagagcuguauugcuaaaacgacagcccaugacauuauguuuuaaaaauuaaaacuacaacuuacuccauuuuccaaaacagagagcugaucccgggcugcaacaccuccaauuaucagaagcucccugaaauaaauaucaagaugauaauauaaaaaaaaaaaaauuaaagucugcuuuacauuguuugaucugcauccauuuauuuuagguggaaauuaagguugagaaaguaauugaggaaaaaagccuacaauaaaacaagucugggggaaguuacaaagguuacacgcugcccucucccucccccucccccucucccucuccccacggucucccucucccucucuuuccacggucucccucugauaccgagccgaagcuggacuguacugcugccaucucggcucacugcaaccucccagccugauucuccugccucagcuugccgagugccugcgauugcaggcacgcgccaccacgccugacugguuuucguauuuuuuugguggagacgggguuucgcuguguuggccgggcuggucuccagcuccuaaccgcgagugauccgccagccucggccucccgaggugccgggauugcagacggagucucccucacucagugcucaauguugcccaggcuggagugcaguggcgugaucucggcucgcuacaaccuccaccucccagccgccugccuuggccucccaaagugccgagauugcagccucugcccggccgccaccccgucugggaagugaggagcgucucugccuggccgcccaucaucugggacgugaggagccccucugccuggcugcccagucuggaaagugaggagcgucucugcccggccgccaucccaucuaggaagugaggagcaccucuucccggccaccaucccaucuaggaagugaggagcgccucuucccggccgccaucccaucuaggaagugaggagcgucucugcccagcugcccaucgucugagauguggggggcgccucugccccgccgccccgucugggaugugaggagcgccucuacccggccgcgaccccgucugggaggugaggagcgucucugcccggccgccccgucugagaagugaggagcgucaccgcccggcagccaccccguccaggaaggaggugggggucacccaccgccaggccagccgccccguccaggagggagguggggggggucagccccccgcccggccagccgccccguccgggagggaggugggggggucaggccccgccagccagccgcccccuccgggaggagaggggagccucuacccagccgccccuacugggaagugaggagccccucugcccggccagccgcccuguccgggagggaggugguggggucagccccccgcccggccagccgccucguccgggaggaaggugggggggucagcuccccgcccggccagccgccccguccgggaggugaggggcgccucugcccagccgccccuacugggaagugaggagccccucugcccggccagccgccccguccgggagggaggugggggggucagccccccgcccggccagccaccccguccgggagggaggugggggggucagccccccgcccggccagucgccccguccgggagggaggugggggggucagccccccgcccggccagccgccccguccgggagguggggggugccucugcccggccaccccuacugggaagugaggagccccucugcccggccagccgccccguccgggagggaggucggggggucagccccccgcccggccagccgccccguccgggagggaggugggggggucagcccccugcccggccagccgccccguccgggagguggggggagccucugcccggccgucccuacugggaggugaggagccccucugcccggccaccaccccgucugggaggugugcccggcagcucauugagaacgggccaugaugacaauggcgguuuuguggaguagaaaguggggagagguggggaaaagagugggaaaucggaugguugccguguuuguguaguaggagguagacaugggagacuuuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccugugacccugccaaaucccccucugugagaaacacccaagaaugaucaauaaaaaauaaauaaauuaaaaaauaaaaaauaaaaaaaaaaacaagucuggggaaggugggaaacaaagcaguuaaauccccguagcuguaucuauugcugaagugcgguaaagucacgaaagagaaugcgugagcuuguaacauggaaaaaauuauucucaucuacauauucuucuacauuaggauaauucaagguucuuuaaaaccugguuucaaucuauguuuucagacauauauacuuguauguauauaaaaugcccugaaggaauauacaaaaaucaauuuaaaacguugccuccagaaaggauaacuagaaauuggggaaaggagugaaagaagacucacuuuucacaguacccuuuuguguuugaauguuucucauuucaaugacuggccaacuggcacugggacacauggauaugcacaugcaaaagacugaaguuaaaacccuuucucaugccauacacagaaauuaacucuaaauguaucacagaccuaaauguagaaccuaaacauaaaacucagaagacaacacaaauaaaauuuucaugaccuuggguuaggcauagucuaucuuaacuacaacaucaaaacaccaugacaaaagagaaaaacagauaaauuggauuucaucaaaauuaagacuuccaaaggacaguaucaggagaguaaaggccagaugcaguagcucacaccuauaauccagcacuuucggaggcggagacacaaggauugcuugaggccaggaguucgagaccagccugcacaacauagcaagaccaugucuccacaaaaaauaaaauuagccaagcacuguggcacuugcuugcagucccagcuacucuggaggcuuaggugggaggauugcuugagcccuagaguuugagacugcagugagcuaugaggcaccacuguacuccagccuaggugacagagugagaccucaucucaaaaauaaaaccaaaaccaaaaagaaucaccuggaggagcugcuuuucuuaaaaaacaaacaaauaaaaaaagauucuaauuccuauucucuggaaauucugauucaguauauccaggggagggaaccaauacauuuuauauuuuuaaaugagguccucaaguuccuagguuuggacuauuguccuaaacuaucauuuuuuuuuccaacaauacuuuuacuuuuauccacauuuauaaucagauauauuuaucccuauaaacuuggcagaagguaaacacacauacacaugauaauugaugcuuauacgcaaagcacuguaggguugaagaauauaaaagaaccaccccugcacuaaggaauguaaaacugaguuagauaaaagcuuugcauauucaaagcaagaaacuuaaagcaaguauagcucuaaaaaggaaauaaaaauuaagaaaauuaaaaaguaaggaaaaguaacacaugacaguauguaaggaucagggaaaggcauguacagucaguguaucagaggaggggcagauggcugggcugggacagccagcuuagcuucauucaaagaucaugacuucagcuggguuuuaagaaagaaaauguccauuuguaccgaauaccaaacaaguggcccaugacuuuaccaucuuaaccaauaaauugauuuuauuauucaucuuccccucuaacuuuugucuauaaucauguucauuuuuauacauaaucacagcacaaaaaucaauucacacuagcauuuuacauucuucccaaauccuuuuauaaagacgucccugaguuucuuacacuaagcagaugcccugguuacaugguaugcucaaggcauuuauuguauuuguuuuguuucucuccccuccacacuauccccacacuuucacacuuaauucugugaaaggaagauuaauuuucauuguugaagcccuggcucccagccuaaaacuucacauauggaagguagaugaacauuugcugaauaaggaacaugcaucaaucuucaaaacaaaauuaguaauuauuuuacauaauuuaucccuaaauaaguuuguucaaccuguaaauaagaucaauauuaaaaagacaggccugccugaaacaguggcaugugccuguauucucagcuacucgggaggcugaggcaagagagagaauuccuugagucuaggaguucaaggcuacaguguaggaagacugaaccugugaacagccacuuacuucagccugggcaacauagcgagacuucauaaaaaaaaaaaaaaaaaaaaaaccuaaaaaaaaacacaggcuuuugugaugucaaaauauucaaagcuucugaaauuugauaguggugacaguuacacaccuugugaauauacuaaaaaccaaugaaccaagaaacacuugcuuuuuuuuuuuuuuuugagacggagucuuacucuguugcccaggcuggagugcaauggcgcaaucuuggccucaaugcaaccuccaccuccuggguucaagcaauucucaugccuuggccucccgaguagcugggauuacaggucucugccacgaagcccagcuaauuuuuguauuuuaguagagaugggguuucaccguguuggcugggcuggucuugaacuccugaccucaggugaccgcccaccucggccccccaaaguacugggaauacaggcgugagucaccacaccuggcugaauugugcacuuucaaauaaugaguuuuauggugugugaauguuucaaguuuaaaaaguaauuaaagacaaaauuaacaaaaaucaagugucaaauugacuaacagaguguauuacuuauaugguauagccuucuucaaagucaaagggauugcuacugagcaaggucacuuuaauuuaugguauccuuccaaugguggaaagagucuuauaacuagacagugaccaaucugaauguccaaauggaagaaagccaccaccgugaugcagucuagaauaaaccucgccaaguuuacuaacaugcuagaaauagaguggcacauuuucuauagagauuuagggaagaaauaaauuuaacagugaaugaaaugcucucuucaaaaaauuguuagggccaggcacaguggcucaugccuguaauuccagcacucugggaggcugaagcaggaggaucauuugcacccaggaguuugagacuagccuaagcaacauagugaaacccuaucucuacuaagguggcaugugccugcagucccaacuacucaagugggaggacugcuugaguccaggaggucaagguugcagugagcuacaaucauaucacuacacuccagccugggcgacagauugagaucccggucucagaaaaaaaaccaaaaauuagauuuuuacuccaaugcuguuugacuaaccaugacuuuucauguaagagacacaggaaaaaaaaaaucucaauuuuaaaaaaaucauacuuaccauuuagcaaacaaacaggaguuguauauggaaauuauuaaaguauauuuacauacucacacacguguauuauguauacacacugaauuucuacuucauuuuucucuaccuuauucuucuuccaaaaaacuucaaaccaaaagacaauaagcauuucagcacaaaaggaagauuuaccuuaauuuaggauuaucaauguauuucuuaaacugcuugauguuguucaaaguuuguucagcuaacucccgggaagguucaacaaugagagcuuucggagcauuggggagaaacuuuguuugugucaccugugcauuaccuuagggaauaaaaaagaugagaacacauucaaagcacacuuuauaauacuguuacuuauaaaacauuaggacaaauauucuaauaucaacauuuuacauaauaauugucaaaaaguagagaagacagucaaacagaauaaaccuuagauuucuaaaacaaaggcuacuuuaaauuaaaacuauuugggcugguggggugacugacaccugcaauccuagcacuuugggcggcccaaggugggacgaucacuugaguccagguauucaaggcugcagugagcuaugauggcgccacugcacuccagcagccugggugacacagugagauccccucucuuaaaacaacaauaaaaaucuacuuggaauaauucuaauugauugauaugucuacaaaaaugacucacuuguuuugugacaaacaaguuaugaaauauacuuuaaauauuagauauacaauggauaagaguauaaacuuggaagucagacugcuuagauuugaauucaguucuaccacuuauuugcucugugaccuugggcaaaucacuuaaagucccuauucguuagguugucuguaaaaugggaaaacuacuaccuuauaggguuguugugaagacuaaaccauguaaagcacuuaauguggugcccuggcacugaauaagcacacauucuauaaauauuagauaucauuaccguuaugauugcgaucccaaaaugccuacacugaaaccaaauacuuaagaguuuaugaauuagguuuuaaaaaugaauuuuacugcuguguuaaaaaaagaugugugacuaaaccagcaaggaaaguauauguaacucacuaugagacgccuuacuuacuggaguucucaucaauuauucucacuauucuagaaauccuuacccuugcagguauaauaccugagugcugugauuugacaauguaaccauccggugccuuggaaagagcaacaaagccaucuuuugguggaaacuuaaauuccucuucaccgaaguuaaauuucaguucagcauucuagcauugaauaaaacagaaaauuaaaauuccuacccuaauugaaaaccaucguauacaaaauaaugaagaguaagcagcuuacaaccacagcaaauuuuuucuaacuagauuccuaauuaccuucaaaacacaggcaggaaagagggcuugguuuuucauauguggugguauuucaaaugccagaccaagaucuuuuccuuaaaaaacaagagagagagagagauuaaaacaaucagaaaagaccuuccucaugcugacaaugucaaaucuaccagcuuaccugcauucaugccucucuccugucacuauggauaaacugugcugccuaaggccagcuucuucauuuuuuuacuuuacuccugaaacugucacuucuaccccucuacauuuuucauuacucccugucuacaaguucauuuccauuagacauuucaaagcauauaaacauacucucacaguaaaacacacaagaaaaccucccuugaacucaccucucccuccauuuaccuuccauuuuucuccucccuuuuguagugaaacuccgauuuccauuuacacuguauccacuuucuuucaucucauucucuauugaacuggcuccuuauuaggaggcuccccacccucaccccuuugcuccaccaaaacagcucucuaaugcuuuccacuugucaaaugcagcaguuaaugcacauucuucaucuugcuagacuagacccauccgcagcacugaacagugauugcucccugauccuucaaacacuuccuucaccaggacuguaggacccaugcuuucuugguucuccuccuggccuuccuccucauuccccucugcuggauucuccucaauuugcugaccccuaaccacaggaacccaggccucagaucucuucuucucuuuaacuacccucaaucccuaggcaaucucaccccacccuccaaugugucuucaacaaagcagccagaaugguacuguuaaacuaaagacagaugaugccaccccucugcucaaaacccucauggcuuuccauuucacucaaaauaaaaaccaaaguuuagaucauggcccauauggcucuccauggccuggccucaccaccucacucaucuaacauucuaccaccguccuuuauccccagagcacuccagaucuaguggcuuccucgcugugacucagacaccucaagcacgcuuccaucucagggcauccacauuuacuauucccuuugcagaaaucugcauggccuaccacccaacucauuuggaucucuaccuaaaugucccuuaucaagccuuuugacugcccuacacaaaagcacaaacccccaaaccgcuaugacucuccacuuccuuccccugcuuuauacccuccuucacagcacuuacuaccaccuaacaugguauuauaugucugucuuucaccacuaguguguaagccccaaaugucuauuccauuuucuucugugccuccaguacuuaccaggguaccuuacacauagucaaugcucaauaaauauuaguucaaguaaaggcagggagggagggacggggauuugaaaaacaggguggggggauuuuuaaaaaccacaauuauugaauaucauguaucuuuucacuacuaagauccauauagagcuuaccauuuuuggagaacuugacaugucccuuaucuauauccagguaacauccaaugguaucaugcauagugaauuccuagaacaccagaaagucaaaugcuauuaauagaaaguaaauucuuaaauaaaguuaaaauauagcugcaucaaaaguauguguuucaaaauaauuauuuaaaucaaaaaugccuauuagagcauaugacauauacaauaguacaagcauuugacaggcuuguuagaaucaacauauuuaggcucauucacacuacuguagauuucagcucaccagacgaacuauauuuagacucaucaugaucaauaauaagaaaugagaauaacauguaucaaagccaaaaucaaaaugaggugaaaagagaagacaacguaauguauuuuggaggggaugacaaauggcauaaaagaaaaauuauaacuacuacauauuuaucuagcuugacaauauuucuucacuaaaguccaaauccaaacuuucuguggaaaauauacagaaaaucugcucauuuugagaaucauuuguauacccucauucugucaugagugauuaaguaugcaagaaaacuuacuuaugcuauguugaagucauaacauaaucgcuuaccucuccauaauuaucaaauuguuuguuaugggauuucuuuccuguuccaccaaagccaaauccaaacuugucaguaccuagauuuaaaaaauauuuuacuuuucugguaagagaaaauauaaaauuaaaagaccucuaaaagaaguaauuuuauucacauaguauguccauuucauaaacccacaggaaaacuauucccuaaguuucugaauccugcaaaaaacuaaacagugcuuaggccacagagcgugugugagacuagggacaccagugauacugcaucccucucugcuuuguccacuaagaaauucagaugcaaguuuacaauaacaugaagcaucuauaugguacugugugguacagauucacacacacuaacuuuacccugacuccauucauauucuuaucccucauuucauacugcuauaauaucuguacuuuuuguaaguuccuucaaauccuuuuuggaacagggugggguacagauaaauauuguuuccaugucuuuaaaauaaaaccuuuuuaugguuaaauuuauuauuuugcuuccccaaauaauaaaauguuaucccccaaauguaaaucaaucaauucaguuauuuuagaaacacuuaccuagguccaaagaggccugcaugguagaccacccgacccugcauaacccuuggucaugacaggauacuucauaguaguguuucccuacaaggguaaaauacauugagauuuauauaaaucacacacacgauucauuuaccaugaagucaucuucccauuguuucugaauuacacagguauguaccaaaugaagaauuauagguauauuuguaccaucaaacaccuucccagauccucgacuuaaagcuauuuuuaaaaacucaugggccaggcauaguggcucacgccugcaggcagcacuuuaggaggcuaaggcaagcagaucaccugagguuaggaguucaaaaccagccuggccaacauggugaaacccaucucuacuaaaaguacaaaaauuagccaggcaugguggugggcgccuguaaucccagcuacucgggaagcugcgguaggagaauugcuugaacccgggagguggagguugcagugagccgagauggcaccacugcccuccagcccgggcccuccagcccgggcgacgugcgagacuccaucucaaaaacaaacaaacaacaacaaaaaaacccucacguauuaauaccuugccucaaaaguuuauacaagugcagaugcuguucaaauaccuuucauuaauccuuuaguagcucuacacccaugccauuccuuuacuucucugcuuugacaacaaagaccaucugacccaauugcuggauuugagaagaaaacacagaaaaacacgucaguacagguuuuauaaaucauacauucccacccccuaccaccaaaaaaaaucauucagucucacuaacaagauaauuccuucauuuguugcaauguuccagagacugagacuuacugauuccugagugauaguaguauuucccaaguguaauuaaccauuucauucccuggguguccuuggcuauguugggggcuauuuucuaugcugccaucuguuaacuaagguaagauuuuacagcaacaagucuagaaaggauucaacacagcucuuaaccugacuugcacuaauaguaguugcaccaucaauacaaauguguuuagauaacuauucucuggagcccuuuaaagaaacguacucaaggaugaugcacaacucgcucaucaauauucguccugauuuuauacuuaaauuagagcuugagugacuauauaacuaaaagauaacagaacugucucuagcuuguuccucaauccauggaagaaaccauaugggaaacuaggagaaagcaugaauaaauaagcauguauuuguuacuugcuaauauuauaagggcucuaaaagaugagguauauucuauacuauacaucaugaucagucucagugauguccacauacuaaaugguuuuaaguaaagauucagcuuuuugucuguacuggaaaaaaacuauaauuucuguccugguucaucuuuccaacucguauucuguacuugaaaguagaacaaacuguuaagcaccucaacacacaucuuccuacacuuuucagaaauuuaauuauucaaaguaugaauucuuacccauauggguacugaauuauguagaacugaacuuuuaaaaaguuaucuaggagcuuccaggauagcugaacacaugacgguuccugaagggugucaugcccagggaggggagaagcuccaagccccuuccuguacuucagcuuaugcaucucuucaucaguauucuuuauaauagcuuuaaaaauaaaccaguaaacauauuuccccgaguucugugagccacucuagcaaauuaauugaaccugaggaaggaauuguaggaacccugauuuauagccaauagguuagaagcauaagccacaaccugggcaucagaugugggggacagucuugugugauugaacccucaaccugugggauaugaugcuaucuucaugaagacggugucagaauugaauugaauuacaguucucagcuggaagaaaccauaaugggaaaguaugggaaaccaagaauaaacaaacaugugucuguuacuuacuccaucaguucucaacucguaaaugcugagaacugacugcuugcuugacuugugggaaaaaaccccacacaucugcugucagaagcaugcugagagaguauacagggaaaauggaguuuauuuauuucucuauauucucagaauuggugucagaaucaggguuugcuagaacugccuuggcucacagaacugugguuuggaaagaaaaaggauaaaaggguaggggaugaggaacuuuagguuucuugguggccacaagaucaccuaugguacagagccacagcugugcuacacacaguuacuaaugauaaaaauuaucaguggaauuuagaguuggauccaacuccuggggagcugguucacuggaugcauaagaaaacacaaauaagaacccgugagguggagcuugcagugagcugagaucgcgccacugcacuccagccugggcaacagagcgagacucugucucaaaaaaaaaaaaaaaaaaaaaaaaaagaaaaugcaaauaagaaaaaaaguauacaguccuuugguuacuauuaucuguaauagcuaaaaugaaguaaaagagugcugggucagcccuugaugugagacuacauucagauuucaguccaucugagcuuuggucaccagcuucaaagcugacccccaagggaaaaauuaugcagggccaacaaaaaguacuucuaagaccuguggucuccaagaaggcaguaaauguggggaagagcaaaaccaaaacacucugaaacuggaggguauagugugaaggaacuguuacauuuuguagaucaguaucauaagcuuccugaggagucuuuacuaaaaugcauucugagaguaacugcuuuaggaaaguauccuuaguuuuaaaugcagcagaauagaagggcauauuugaguugaugcaggucucgcugcucacuauggaacaaucacagauggcucuaugcaugauggagguuauucccaagugaacagccagccuggugaauuggauaaaagccacuguaaggucuguuaaccccaagaaggaggacuguccaacuccaccuauaaauacuuucuuuuauaauuucugcauuuucuauuuggguuaggaaaguuuugccacugcuaaauuauacauguaguuuucuguauucaaauucauacauauauauuuaaguccuaaauacacauggaauuuauuucuaauuaugauaugagauagaagucaauuuuauauugcuccagauggaucgugucagcacccuuuacuuaauaaaccauccuuuugucucacugaaaugaaauauaauuauuuuuccugcauauaacuucucauaugugcugagauuuauuuccauuauguuccacugucuauuccuaugucaguucuauacuguuuaaugauagugacuaaauucuaauaucugguaaauuaaaucuuaaucuuauuuacuugguguucucauguauuauuuuuuaaaguuucugaauuacaaaugagcugauggaaagucuauccacuuaccaaaagcagauccucugucauauggguucaucugccauuuguucagcacuaaacaaauuaaaauaagaaaaguuacccacagauauauaaaauuuaaaaugcuuggccgggugcggugacucacgacuguaaucucagcacuuugggaagcugacgugggugguucacuugaggucaggaguucaagaccagccuggccaacguggugaaaccucaucucuacuaaaaaaaaaaauacaaaaauuagccaggcaugguggcgugugacuguaaucccagcuacucgggaggcugaggcaggagaaucgcuugagcccaggagguggagacugcagugagcagagaucgagccacugcacuccagccugggcgacagagcgagacuccaucucaaaaauaaauaaauaaauaaauaaauaaaauaaaacgcucuauuaaaaaaaaaaacaaguauuuuauguaccuuaauuccucuagauucaauaugguuuuauauauuauuuagaauacacaaguaaaacuuguuuuuauuaaaagcaaaaacgcaacugaaaaaucagacauguugaagauaaucaucacuggucuaucuggaccuaaaaccuuuucuccucacuugcuugcuucagugugcucucuaucagaugauacugaucucuguccuuacuccuaggucacuauuaaaaagaaguuuaaguaaccaaacaaguugacuucaauuauaaaggaaauaacugaucaacauuucagagucuaauuaucuuguaacuaucaaaaaaaaagcaaguccuuuaucuuaauucaauaccacauucaaaagucacacauuuuuuucauccgccuuuuuauaagauuggcauuuuccuuuucugacacaucuugauaguuuguuaagauguauguauacguauaaacuaagaauuguaauaaagagagcucuacgugcuuucuagaccaacuuuccacucacgguagaaauccuuucuagauuauuucuggucaaaagauauccaucaucagcuuaaacacuuugaacauuguagaaauaacuuugagguuuucccuugcauuguggcucaauguagcuauuaggaaguacuuuaaguuaaacagaaaucuucaucuaaacuauuucuaauugguccugguccuacuuucuagaauaauuacuuucucucuaguucucuucaauaauuuaacaauuaucccaucuccauuuuuacuucuucuccauguuuaaauuucuacuuucuuuauuccucauaggaugugacuuucagaaccauuaucacuaugguuauucuccuuuaggaguguuuucuuuuaccaccauuucucauaaaugacggcacaguuguuacaaauucugaaacuauuuuagaauaggccaauaguguaaauaguuacaucaauuaucuaucucuaauuuacaugaguucacagauucuacauuauacauuuuauguauaacauuacuuucaaacaacugaaaagaauauguuaauaugacagguucacuggucuucaacuugcuguuuuguaacaauccuguuuuguauaaugaaacaagagugacuuaaaauguggaaaaaauauuauuaaaauauaacaaaacaaaagauuaauuaagauagaaugaaauuuagaaaacauucaacagaagcaacacaauuuaaagaugaagaaacugcgguaagauugauuacgguagagacaguaucagaaaccuaauaaaaagaccaauuuccauguagauaggacugcacauaagaaacaacuuuaaaauuuauauuuuaacuuccuaggugguucccuucuuaucuuagaggaaaaaaaaugccucuguucccuguaaggcaauacuucccaccagcauggguuuuuacuccauaaauuauuuguaaaauccuuccuuaauauuuuuguaaaauguaccuauuuuccuuuagcauuaagcauagaaaguuauaagguuaagaaaaacacuauaauauugaaauguaaucuccaaaaugcuaguguuuucucaaagggaacacuauuaguauuuuaggagggacaaccuugcaguguuuaggcucucaacaacauuuagcaucccugguuuccaggguuccagaucccaauaccaccccccagauacugacaagauuuuaaaaaugcauacccaaaucucacuuuccuaacugucagugaugagaaccaaugauuuauauaaaaggaaauaucaauuuacaaaaauuaccugaagcaccaguuuuaauuguuguuuuuccuuuuuugccuuccuguuggucuuucagaguuucauaaacuaucuggauaacuggaauacuaaaagccuaucaaagaaacaaaagguaucuauauuaguauucacauauuaacgacaauuuaauaaccaauauaaaugacaaaaguuaugcacacacaucaacuaaucauacauauuccagauugcuacuacaauuucauuuacccaaaccaaaaauacccaucagacaacacagaguggacugaaugaaggaaauaggacgcagcuaacaucacaaaaagauagaacaauggagacugguagaaugaaccuacacuaaagaggaaaaauaccauccaguccgacaaauuauuucucuaguccaggccaguaggagaucaacuucuguauguaaccuuuuuauuuuaagagucaucauauuaaaauucagaagugaguauaaacacuaaagcuauuguaacucucuaacgcccauuuaaaacuauguucuuaaggucauacuuuuuuuagcucuucauaauuagcuggcaacaaaaauaucauuuucaguagcaaguaauuaauuccuuaccuuuuggagguugcuauuuuauuaaauauuucaaaguaaaaacuacuguucaaaguuauuuuaaaauucaacuuuuagagagaaaguaaauauaauuuauuacuuacaccaguuuugccacuuccuguuucugcagccugaaugaggggaaaaaaguugauuuuacagauuaaguugucuauuaaagaaaucaaacuaacaccauaguauguagaaaucuuuaacauuugacuggcuaccuuuauuuucacagugccuccagauauccaggguuccucugucaacuccaacuacagcccaucuuguuaccuuucccauacccuuaagaaucuucucuucccuuucccauugcuaccauucaaacggaagcucucaucauucuaaucuagauuauuauaaaaguauccgaacaacaucuaaucccagagcuauacuacaaucugcuacucagauuagucuucauagaagacuaacacucaaauucuuuaacaagacacuugagaaagagcccaaauaaucugacccauuaucucucuacaauuuuauuucaaguuuauccccccucagacacauauuuuaugcuaccaaccaacugaaauauuccagggucauauccuacauucuacuauucgcuguuuugcugauauucucucuaccuaaaaagcauuucucuuuuaucuucccuugcgaaaaaucuggcccacacuuauaacuccagcacuuugggaggccaagacaggaggaucgcuugaggcugggaguuggagaccagacugggcagcauagugagacccugucucuacaaaaaaauacaauaaauuagcuggauguggugguguguaccuguagucccaccuaauugggaggcugaaauaggaagauugcuugaaccgaggaguuugaggcugcagugaacuauaaacacaccacugcacuccagcuugggcaacagagcuuggccuuuuccaaaaaacaaaaacaaaaaaaaagaaaucuacuuccuuuaagcagucccuaugauccuucaagcaaaaggacaacuggauucccacuugaauucuauacuacucugcaucucuuacgaagaagccacauucucucugauacgagauucauucuuauacaugucuuauugcccuaguggguuuaagcuucucaggaguaaauacuuaccuguuugaagcuuuuaccuaauagucugaauacaguauauguaucauaaauguuugugaauaaagguaaaguagcauuuguaagccuaugcaauucuuagaguguguccccagcuaccaaucaccucaccaaauuuaaacuuaccauaaguacaucaccuccuccuaagaucaaugggauagauucagccuggauaucaguugggaggcuaaaagaaucauauuugaagaauuuuaguuacuggggaaaaaaaucgccuaagcaaauuaagucacguuaauuugccuaaaagaaaauuuuacgugguaaauacgauccaucuuauuccacuagaaauaugucaagguuaaaaaaaggaaacuuuccauaauuuagaaaaucacaaaaaaaaccugauuuucacuuacccaacuagacacaaaaauauuugauaaaaucacuaacaacuguuuaaauuauaaaacauccucucccagguacauuuaggcuuuauguacuuacagccaauccaucucuuccacagcuugugcaaucucaggcauuacacccaucucugaaaguaaaaauuaauuuuaaaaaccacauaaacugaaaugauaaauugcauugcucucaaaauuacuauucauaaaacaggguaaagauuuugaaggauagcucaguuacaucaaaucuacugagcguggcacuguugaaagagcacaaguucuggagaaagaccugaguucaaaucuaaguucucacuuauuagcaagugaccuuaggcaaagcuauaaaucuguuuucuccacacaaaauggggcugauauugccuaccuugcagggcuauaugaagaccagagauaaucauguaaugcaacuggagcaugguugucaccuaauaaacuguagccacuacagugccuguuuaccucucaugacucgugaaaagucugccaagaauagacaggguuguugcauuuagagacaauguggcaguuaugugccuuggcuauucuaggaccaugugaauacccucagcaauuggaaaaaaaugaauagacaaguggcgagcacccacauuuauuggcagccauaaucaaaauucugaauaacugaagagggaggggucaguggugaaaacgugggcaccuggaaaugucagcugaagaacugcugaguucuuaacuguauacauaucucaauaauucuacuucaaggcccauccuaaaugaauagagaugaguugcuccuaaccggguuuugucauuuuaucauuucucauaugaacuguagaggguaauuauauauggaguaguuaguuggauuacuuaaacuuuccuuccaaaagacaagugauuuuuauuuuaagucuguauuuauaaaauauagcuuuaucauaaaaauauauauuccuauaaaaaaaagaacaagaaucaaacauucccaagccccagaaauaaccaauucugaaauucuguauuucuugccauugugaaaaggcauaaagcaaacauacaaacugaaaauauucuucauaaaauuauguagcuuuuucuuugcaucagaugagaaggaucaucauuuucaaagaaggcucuccuaacucuuuuucuuuuuuuucuuuucuuuuguuuuuuuuugagacagucucacucugucacccaggcuggaguguaggggcaugaucuccacucacugcaaacuccgucucccagauucaagcaauucuccugccucagccucccgaggagcuggggcuacaggcgcaugccaccacgcccgcuaauuuuuuuucauauuuuuaguagagacgggguuucacuguguuagccaggauggucucaaucuccugaccucgugaucugcccaccuuggacucccaaagugcugggauuacaggcauaagccacugcaccuggcgacuuuccuagcucuuaaucucaggaaaaaaaaaagccacagauaaacuaaugaagaucuaaaguugaauauccaggcagaccuuccuaagaauuaaccuguauuacagucuauguucucucuccuaaaaugcaaacugcuugaaacaaaggagugguguguucuuacugcauacggaauacugcaagcugaagcucuuugcaaaauuguuauacaagaaacaacauaucauuuucaguaaauuccagacaaucucuuguaccauucuggucauguucccugcaaguuuucuuugaaagcggaccuuaaguauaauacuuuuaacaguuaaggaaaaauuagaaacauucgugaaauuccaguuuugucuuauuucauaucacagacuuuuuccaguccuuuaccucuaacauucaugaaauuuguguaugacucccaaagaugugaaccuauaaaaugacuaccuagaacuauccuacagaccuuggcucuaaaaucguuuuaggagaauguugggaaaagaaaaacagcaacaacucugagcaguuuccaauugaauccuauuagaagauguaacugaaacagucagaaaucuuacaugacuguugcacuuugggaagccgaggugagcggaucaccugaggucaggaguucgagaccagccuggccaacauggugaaacccccgucucuacuaauaauacaaaaaugagcagggcauggugguaggcgccuguaaucccagcuacucaggaggcugaggcaggagaauugcuugaaccugggagguggaggcugcagugagccaagaucacaccauugcacuccagcuggggcgacagaaggagacuacauccccccacccccccauucucccccccaaaaaagaaaaaaaauaucuuacaugacuggagauauggaauuccuaauauucuuacagaagaaaacuaaaaaauauaaaauacuacaucugaagucaucuuaaaaaguuaauaacauuaaaggacauuaggccuaacgugauacauuuauauagcaauaaacguuacauaagugcuacauaaauguaucacguuuagcgcauuuaaggcugauuacagcuuccuaaaacuggaugccuaacaggaggaugauaaagcaagaggcgaaaauaucaacuguaggguucgauaagccauaucaaaucauauuuggaauaaaggaggguagcagacggcaaauaaauaugaauuuuccaaacuuauguuggacuggugcguacguuaaugaaaaugcuuucccuuuagcuucaacacugaacauuaauguugauauaacaacguuuaagaacaaauaaagaucagguuuaugccugggacguuuuggaagggccugaaaaaacuggacagaggcaggaucgucauuuuuccccaaugacuccuccccacgccgucucgccucucugccuggccaagcccagaugagccgcgggcagaaaaggguucccaaagggucacugccacguuaagaggcaggaggcccaggcgucugggagccgccagagcaacgccgccgccuagauuuugcagccgaaggugcacuggcaggaaagccaaguggagacugguagaagggaaagggcagggggagggacguuccggcccgcuccugggaagaaucguccuccgaacccgagccgcggccgccccugaucccgcaacgcggguccaucagggacugcagcggacagcgcccuucugucucccugaccccuguccgcucccgccccuuuagcucuccgcgggcggccccagggcugaggcgugcaacaagccgccccaccacccccagaguuuccacaaacgcaccggagaaggccgccaucuucaccccguccuccgcggcuucgccugcucgcucccucccucccgacugacacggcguggcaguggcggcgcgcgcuuccggccccuggucuucggcguucggagu

SEQ ID NO: 16993 - RNA, 10906 nt, Homo sapiens
uggccuucaaaaaacuuuauuugguuaugagccaagcucugauaggaaaagcccaccuacgaaaaaaagguguggguauuuaagcuggucugauucacagagcuuguacauucaugacucaaaauaacacacccucaaacccaaaugauucuaaagccauuucaaccuuaaaucauguuauucccuuagaugugcuuacauuagcuuuaaaaaaugaucuacgugcagagaggagcugcgccuuccucacaauuaauugaaacaugaccaaaaaacgggggauaggcaaaaaagugacauuuaaauagcguaugagggucucuccuccuuuacucaaugaacacauauccagaaugagauugaaauggaaucaaugcccaggagccucucaaagagagcaucucccuguagccaacaugaucuggauccuccuaacacaaagcaacccaacuacuccagcuacacaaagccaguaggccuacauaugaaacgcaaagggguugcaucccccaugguuuaaaccuaacccauguuagcugcaacuccacuacagucuugaucacuuagcucaggaaacaaacacccagcaacaacccucguaucucauuaauaccaaucuguggcccucacugacucagugguacuuuuuuauaaaaauaucugaagaaguggcaaacgguuacaacggaugucaggucgaagcaauuccaaaagcugagaaaacgcuucauccgcugcuugucuucucccccuauugcuacaguucugccaccaaagggggaaaauuacgugaauaugauuguugugaccaagccuuggcaaaagucaauaaauaacagaaccugucaagggcagagcaauuuuaugggcaaccucuucuaguugcaaauguggggguugggaaaagugggagagaggcaugugugcaagaaagagauaaggguccuuuugggaaggguuuggugacccagccccagcucaaugccagcagacuaggacccgcuaaaacccauuauucagacggaaaggggagaagagaagacaccaaaaaauguagucaguuuugcaauuugcacaguugguauuuguucuucacagcaguaaggacuugaaugagaaucgugaaacuuguggaacacuuauauuuuucuucgggauuuaagaaacuuugucucguacugaaagacuacauucagugugggucagguccaacaguguuagccagaacgcaguuguuaagugcacccagcacugggaggaaauguggcuugagaggagcggcugcccgaggccgccccuucacuggucuccaagucgaaagcccuggccccaguugugucucccgccuccgccauucugaucagcagcucgccucaugcuagcagggggcacaccaaauccugauacuccuccucuccuacugggcagccagcgguaccuggugcagaaagacggggacacaaacggagagaagagaacaaagucacuuccacauaguuaucugaccuccgagaacaccucccucuccugcuguucccauggcacuugucauguugaaggcagcgagggacgucuuauuuaacuuugucuuuucuguacucagccccaugaccugaccacagacggcauucguuuuucauguuucuuaaauguauucagauuucagcuaaauucacacucugaacguuuuuuucucugcuuauaaaaguaauccaugcagaacaguauggaaacaaaaauauuacacccacaagcccagcaaccaaagaaugacugauagcaucuugguauaucuaaauauggcucaaacuggaucaaaggauacaaaauacauucacuuucaaaggccaaauccacagccugcauguuugagccuugcacagcauuucuaaaaggcucucagcugagcccaucaaaggagacaggggaagaaggcuuucuauguuggaaguauggguauguuuuaaaauuuauucagaaucugccuuccagguacauucuucccuucucacagauggugggagagcuggggccccagacgguuagaugauuucccaccuuaaaauuaauaaacuaagaguucacagaacagcuaagagaacuuaaacccaagccuacacucucaauaguauuuuccaacuauuucccaucuuugacucuuuuauuaguaaacugagaauguguuuaaaccuauuccacuuagcagauccuaauguuuaaaauuuugcuugaaggcagagagcaugaucugauaccuccgcuuaaacccuucuuggcagcaagaguaagucaugacaggugacuuguccacagcagaaacccugaagaggacaggcuuuauacuugaccuuauacuagagcaguuacuaugugaauuuacucagugauuauugccuuacacuaggugcugccugcuuauaaauucaucugaucuucacaauaaccccaugagguaggcauuacuauuacuccuguuuuauaaacaagaaaauugagccaacacugagugaagcgcuucgaaagugacaggauuccaaccuagucagccugguuccagagccugcgcccugcacuacuuguuauacuacaugcauccugccugggaagggacagcagucagugacuggagucuguuuacaucauacucgauaccuucaugccucuucccaaaacagacaacaacucggguuuuuguuuuuuuguuuuuuuuugagacggagucucacucugucaccaggcuggagugcaguagcaugaucucagcucacugcaaccuccaccucccggguucaagcaauucuccugccucagccucccgaguagcugggacaacaggcgcccgcuaccauguccagcuaauuuuuguauuuuuaguggagccaggguuucaccauguuagccaggauggucucgaucuccugaccucgugauccacccgucggccucccaaaaugcugggauuaccgacgugagcaaccacgccuggccaaaaaccccuuuuaaacacaaaauuuaguguguacagagaagauauaacuacucuaaauggaauggaaaauggugauacaaauguaucagcauuccauuuagaaaagcaguuauaccuuccuauacucaccuccuccauuuuaaacaaauacagcuuuaccauuaaaucaaaauguauuuuccaagugcugguuucucaacauccaugccuucugguacaauaauauuccuccaaaguacauaauaaaauagaacacuugcuggagaaaaugcuagggcugucuugcuuugcuacucacucuaagacaauauggaagccaucuccacugcuuaaguagauagugaaauuaaaugcaaauaauuaguauaaaaagauacccaauuauacauaaucaacaaaaauuuaugguaauuucaaagcaguuacugcuuuugcaaggagcuguauuuugucaucugaucuuuaugcaaaauuuagcagaaggacuucccccaacagagaaaguucaaguggaaggcaggcuccagggcucgcugauuuugccacuagaaucuuguauccuguguugcccacaacugagaaguagcuacaagccguuaaguuagaauauggccauuuaaaguaaaguaacuguuggcugccccccaaaagcaccaagcuuuuuuuaauugaugcaucugccauccuacuugauaaaccuagaucagaaagccaaaccugcuguuauuauguccuuugauaauuagaaaccagauuggucauuuguuuuuuuagccugaaggcaauucaaggcucagaagagaaacaaguuucuuuuuauucucuuaaagaaaaacacacacaccacaaccaccaauaugguauaucucuguauauuacaguucacaauuugaaaagucuuugaaaaacauaccccuacccuauaaaaggaaggggagaaagaggaggccugcucaaguuuuacugcccucacugaucccuuagaggaaugacagaacugcaaaacauuaaaauuagcaagauguggaaggguuugguuuguuuguuuuuuuaaagcuuucaaaugcaagcuauuacugcauaucccugauaugagauuaggcaugauugucaggcaggcugugacacccagauggugauuuaacuggcccguucuucgacagccuuuugccucacugacagaacggucacacgacuauuacaugcuucugggugugugcgcgucuccucucagaucgucaaaauccugcucuccuacccccaccuuuaggaauauggcagcuagcuuuacuuaccgagaacccgcuacugugcuucccaacaguguaucuuaccucaugcaguccugugagacaggggcuucucccacaauuuacaggcuugcaaacugaagcuuggagguuugauuaaguaacuuucccaguauaaaaacugcuaucugaggggacugggauucaaauccaaguuugucucaaaaaucaaagcuguugcccuuaccagcccacuucaguaaacccuaaaagcagauaaagagcacaaacucccaggggguugggccuauacaaaccucaagucucucauuuuaacucugaacaguccuguaaaaugucuacuccauaguauuuaauauaaaaauguuuaaaauugcugaccaacacgcuaacuuacccuuccuugggcaaaaucauggguaaaaacugaugggccaagaaaagacaccccacuaaccugugacucugcccauucaccagccuacuguuucgcacucuggaguugcaucaggucccucagcaggcucagagagcugagaugccuccuguaauguuggaaucuaguugucaguggucccuggcuaaaagaguaacaggaaggcaacugagccuaagcuuuaaucccuaacuuccugugacugugugacuaggguaagucacuuguugccucagguuucuccagcagauggggcauagggguaaaucauacuccucauggagcucucauuaggaugcacuaagaacacaggcaguaaaauguuagaugagacaggacaaaaacacuuacaaaaacugagguguggauagaaaauuucuuccucccaaguccauuggguaucugaacauuaggaaaaaauaaagauguccaaccagauuuccaauaagcucauugauuacccugcaaagagagccaaaugaguuuaaagacauucaagcaauagagaugcaccaaguuuuaacuaauagcauaaggaagagagccuucaaggcagcccauuuagucccugggagucugugagagcugacaaugagcacuuuuguagucugaguggcaaaugcauucugagggagacgggaaaucaguccugcugaaccaaugaggccugccacucuucaaggccagcagccccucugaccucucuuucaagcaccagcccauccucaaaauauuguuuuugcuacuuccugccucaagaguuggggaaguugcaaagcaugcuucugaaugcuuucagucaugaauauuguauuuauaaaaugugggcaaacaugaaggcuaccaagagagaagcgugggaguaaggaaaagaggaacaauaaaugccuguucccccuuuccuggagccauuaagcacuucucccuugccucuuguauccuugaguguaagacaccacagagaucacuuaggaaagccgacuugcacccugaaaucaacgcugaccuucuucaguuuucccuuggcuuacauacaggucaccucaagaguguauagaucuacuguuacuauuacaaauccucuuugucuucaccugcaacaugauucccgucaggggcaaaucaacaccugcaacuacuucagacuucaccuuccuggguggaagagcagcuuugccaaguucagaacaugcuuugcucuaaacagucugcuccauccauucacuucuccccagcaauaugcagaagaaguuaggaucacacagagcaaauaugucagacacaugaagaaccagcaauauaaaaauggauugaaauauuaaaaguaguuuguaguauaagaaaugggaguucuggcugggugcaguggcucaugccugcaaucccagcacuuugggaggccaaggugagcggaucauuugaggucagaaguuugagaccagccugggcaacacagcgaaaccucaucucuacaaaaaauacaaaaauuagcugggugugguggugcacaccuguaaucccaucuacucgggaagcugaggcaugagaauugcuugaaccugggaagcagagguugcagugagccaagaucacgccacugcacuccaaccucggugacagagccagaccccaucuugaaaaaauaaauaaguaaauaaauaaacagaaaaaaugaagaaaugggaguucuuagagaaguugcaucuugguauccucccuuuaaaauucugacuggauaaauuaaagcuauuccuaugucuagcucuaauuccugaccaauagacuagauauuugacccugguuggccaaaaguucuguauuaucauccaggcaugguggcucaugccugaaaucccagcacuuuaggaggccaaggcaggcagaucauuugaggucaggaguuugagaccagccuggcaaacauggcaaaaccccaucucuacuaaaaaucccaaaaaaaaaaaaaaaaaaaaauagccgggcauggaggcgggcgccuguaaucccagcuacucgggaggcugagguaggagaauugcuugaacccaugaggcagagguuacaaugagccaagaucgcaccauugcacuccagccugggcaacaaaagugaaacuucgucucaaaaaaaaaaaaaaaaaaguucuguaucaucaaaccacuugcaaaauuauauccuaucuaagaaucuggauuucuaugaccgauaggcaguuuccaaggcauucuggaaaugccuuaagaauauaagacauaguaauuuuauacauagcucuuagaggagccaacucagacaaaaauuaggucucuguuugcccaaucagaauagugaauccagaaauacauauuuauuccuguacuauacacauaggaacauacuguguguaacaauaaguuaacaaaaucacaaccauucaagguuaaauaugcuuaaagcccugcaaucuaaucaauucaaucgaagugaaauuauuccauaaauauaggguucuaaugcgucaauguugagauucuuuaaaguuguauaaagguuagagaaagauaaaaacuaauggaaauuuuccaaggauuaguuuccaauuaaauaaaucuaauaucacuuacgagccuccgaugauauaguugaauccaaggauaacccaggguaaauagcaggccuaggauggaaugaauauaugcaaaugugaguagccacaccugacgaggacacagcuacuacggggacuaaaguggguaaggauacacugacaagggcuuuauauaaauccucuggaaggucacugcaaaauuucuaggaucaaucuagcauuauucccacuauacuuaaaccuuccuaucuaaaacuagacuuaauuguguauuuguaacuggaaggacacaguacuuugcccacaggucugaugcaauacaggcccugcugaacugcuauaaacagacagcuucaaaaagcagaugaguguccuacagaugcuacuaaaagcaaggcccaugagagaaucacacuaagauuccagccaacaaauugcuacaaauaaaauaaacauaccccaucuuuuuagguucuucuuuuacauaucuugcaaaauuccucugaauuuuuaucucauuaugcauugauaucuuaaacuaauacucucccaaauaagaaagcucuccagaugaacucaacauuugagccccuuaccaaauccaagacaucauaccaagagcuaaaggaguugcaagaaacuucacaaacuaggaaagagaggguuauacucaaauaacuuuacagcuacaugugcuaaguacuaaagagaaacacaaaguauugaaaaagcccaaacguaagacuaauucuaggcaggagauucaggaaauauguucaguuccaacucaaauuaagaauggguaggauuuauacaaagaagagaaucaagauguuacagguggaaaauugugaaagaauguacaaagagaaguguuugggggcaaaaacaaucuguuucagcuacaguauaaagcaaauaacagggaacgagggagggauaagaacagauuuuuaaagcaggguuucacaugaguuaucucuccuucucucuaacacagacacauaagaucacucagggacauaaccuugaggggcccgagguacagagggagugaagaaacaaaggccagcaacggacuccaggcuggcuaauuaaauagagcugggauugaggagggcagaaaggggcuugccuaugguacacugcucugcagugaccccuucuggaugagucagaaaguacaucucuggacugaagagggauuucugcagacaaaugaaaaggacacuuuuccaaccaaggcaaaguaccuuaaaucguguuccaaaccaaaaugauacaaucaugucucuguucagcugggcccagacauaaaguacugacaugaucagaggaaucaucagcaacugcaaaagaagucgacauguaaaaaccaggcuccagaggcacuuaaaaaagguguacaucuacuaugcuuuuuaccccuccucuucacaacaauccucaccuggguaaagggaaacucaacugaucagaauuauaaauugauccuauuauuuaucauacaauaaauauuacaaaauccuauaauaaaauacaacaaaacuauauuauuuuagauggauucagaaauguaagagucaagcucuguuauuuacaaaaaguaagcaacaaagcauuaccauauaaucucaauuuuuaaaaaacauccauauacaugccuagaaaauacuagacaaccacuguugucacaugccuagaaaauacuagacaaccauuauugucaauguucaaacaccaaaaagaggccagaaaugagcaaggaaagcaaugauuuagauagcucauguaagaucuucaaagauuuagcugacuuaagauccucaaaauaaaacagcuauaggccaggcacgguggcucaugccuguaaucccagcacuuugggaggccgaggcaggcggaucaugaggucaggaguucaagaccagccuggugacauggugaaaccccaucucuacuaaaaauacaaaaauuagccgggugugguggcgugcaucuauaaucccagcuacacgggaagcugaggcaggaaaaucacuugaacccgggaggcggagguugcagugagccaagaucaagccacugcacuccagccugagcaacacagcaagacuccaucucauaaauaaauaaauaaauaaaacagcuguaauuccauaauuucaaaauaccacauaauuaaccccauaguuaaugcaauuucaacuucugacaaaggccacuaauaguauauuugaaacaaauaaaagggcaaauagauaguuuaaauggacacuuaccugcauauccauugcuaagccaguaaucuugguuuguaaaguuaaagaucagacauaaaaaagcauucuguaccuagucaagacugaugugguuauuuuccucccauuuaaaaguucacuuggccagguguaauuuggcucaugcuuguaaucucuguacuuuggaaggccaagaugggaggacugcuugaggccaggagcuccagaccagccugggcaacauagcaagaccccaucucuaauuuauauacauauuuuuuuaauuaaaaaaauuuuuaaguuaauuccaguguucugaaggaaaauacuuuucuauaguucagauugcuuaaaacauucuacaacacaaagguaucuaaucuucauuaugcauauuccauuagacgauaccaugacaaggacauaguagaaaucaacagcuuccgcauaugacuuagucuggucaucuggcauccuuuuucucugcuauugcauuuuaacaucucuccuucaaauaaaggaugaagaugccuguagccuuugaaggaaauaaucauucuacuuacauucucaggacucuauagcaugguuaaaguccaaaauauuuuuuccuucccucaaaggaggggggaaagggcauccacagugccacauuuucuggcccucagccaaguuuaaauggcagcugagcccaaaggcaauuuugagcucaccaauuuugcacaggaccugagacaucgagagcugcugcugcucucaccaucuguaagaguccugcaguuggagggcugcugacaacugcuauugauacaaagcagagaaacguacugugucccuucccagagcuggguacuucacagagggacugaauuacuauguaggaccccaagagaaggacagcaaugaagucagaaaaggaugcugguuguaaauuaauuuucugauaaggaccacagauuucaaaagcugucucauggcacggacucucuuugugccucagucaacaagcugucacacaugagaacacagagaacugggaacaagaagagggaacagucauaaaacuacucaaccaaagguggaaaaaaaucccacaaaugguaagagaaugcaucacucaagggcuauaugauuuacuacaguuuuuuuuaaaaaacuauaauuauucuuauuaacgguagucaaccaagaugcaaauauuguaauuugaaacguuuacagaauauggucuauuuccccaaaccuggaaaaaaacugguuuauuucuggcccaaaaucacagacugaaggauaccacgaugcaaauccaguuaaagaggagcaugaauaaauagucugcuggccucccaucaaaagcuccug

SEQ ID NO: 16994 - RNA, 10906 nt, Homo sapiens
caggagcuuuugaugggaggccagcagacuauuuauucaugcuccucuuuaacuggauuugcaucgugguauccuucagucugugauuuugggccagaaauaaaccaguuuuuuuccagguuuggggaaauagaccauauucuguaaacguuucaaauuacaauauuugcaucuugguugacuaccguuaauaagaauaauuauaguuuuuuaaaaaaaacuguaguaaaucauauagcccuugagugaugcauucucuuaccauuugugggauuuuuuuccaccuuugguugaguaguuuuaugacuguucccucuucuuguucccaguucucuguguucucaugugugacagcuuguugacugaggcacaaagagaguccgugccaugagacagcuuuugaaaucugugguccuuaucagaaaauuaauuuacaaccagcauccuuuucugacuucauugcuguccuucucuugggguccuacauaguaauucagucccucugugaaguacccagcucugggaagggacacaguacguuucucugcuuuguaucaauagcaguugucagcagcccuccaacugcaggacucuuacagauggugagagcagcagcagcucucgaugucucagguccugugcaaaauuggugagcucaaaauugccuuugggcucagcugccauuuaaacuuggcugagggccagaaaauguggcacuguggaugcccuuuccccccuccuuugagggaaggaaaaaauauuuuggacuuuaaccaugcuauagaguccugagaauguaaguagaaugauuauuuccuucaaaggcuacaggcaucuucauccuuuauuugaaggagagauguuaaaaugcaauagcagagaaaaaggaugccagaugaccagacuaagucauaugcggaagcuguugauuucuacuauguccuugucaugguaucgucuaauggaauaugcauaaugaagauuagauaccuuuguguuguagaauguuuuaagcaaucugaacuauagaaaaguauuuuccuucagaacacuggaauuaacuuaaaaauuuuuuuaauuaaaaaaauauguauauaaauuagagauggggucuugcuauguugcccaggcuggucuggagcuccuggccucaagcaguccucccaucuuggccuuccaaaguacagagauuacaagcaugagccaaauuacaccuggccaagugaacuuuuaaaugggaggaaaauaaccacaucagucuugacuagguacagaaugcuuuuuuaugucugaucuuuaacuuuacaaaccaagauuacuggcuuagcaauggauaugcagguaaguguccauuuaaacuaucuauuugcccuuuuauuuguuucaaauauacuauuaguggccuuugucagaaguugaaauugcauuaacuaugggguuaauuaugugguauuuugaaauuauggaauuacagcuguuuuauuuauuuauuuauuuaugagauggagucuugcuguguugcucaggcuggagugcaguggcuugaucuuggcucacugcaaccuccgccucccggguucaagugauuuuccugccucagcuucccguguagcugggauuauagaugcacgccaccacacccggcuaauuuuuguauuuuuaguagagaugggguuucaccaugucaccaggcuggucuugaacuccugaccucaugauccgccugccucggccucccaaagugcugggauuacaggcaugagccaccgugccuggccuauagcuguuuuauuuugaggaucuuaagucagcuaaaucuuugaagaucuuacaugagcuaucuaaaucauugcuuuccuugcucauuucuggccucuuuuugguguuugaacauugacaauaaugguugucuaguauuuucuaggcaugugacaacagugguugucuaguauuuucuaggcauguauauggauguuuuuuaaaaauugagauuauaugguaaugcuuuguugcuuacuuuuuguaaauaacagagcuugacucuuacauuucugaauccaucuaaaauaauauaguuuuguuguauuuuauuauaggauuuuguaauauuuauuguaugauaaauaauaggaucaauuuauaauucugaucaguugaguuucccuuuacccaggugaggauuguugugaagaggagggguaaaaagcauaguagauguacaccuuuuuuaagugccucuggagccugguuuuuacaugucgacuucuuuugcaguugcugaugauuccucugaucaugucaguacuuuaugucugggcccagcugaacagagacaugauuguaucauuuugguuuggaacacgauuuaagguacuuugccuugguuggaaaaguguccuuuucauuugucugcagaaaucccucuucaguccagagauguacuuucugacucauccagaaggggucacugcagagcaguguaccauaggcaagccccuuucugcccuccucaaucccagcucuauuuaauuagccagccuggaguccguugcuggccuuuguuucuucacucccucuguaccucgggccccucaagguuaugucccugagugaucuuaugugucuguguuagagagaaggagagauaacucaugugaaacccugcuuuaaaaaucuguucuuaucccucccucguucccuguuauuugcuuuauacuguagcugaaacagauuguuuuugcccccaaacacuucucuuuguacauucuuucacaauuuuccaccuguaacaucuugauucucuucuuuguauaaauccuacccauucuuaauuugaguuggaacugaacauauuuccugaaucuccugccuagaauuagucuuacguuugggcuuuuucaauacuuuguguuucucuuuaguacuuagcacauguagcuguaaaguuauuugaguauaacccucucuuuccuaguuugugaaguuucuugcaacuccuuuagcucuugguaugaugucuuggauuugguaaggggcucaaauguugaguucaucuggagagcuuucuuauuugggagaguauuaguuuaagauaucaaugcauaaugagauaaaaauucagaggaauuuugcaagauauguaaaagaagaaccuaaaaagaugggguauguuuauuuuauuuguagcaauuuguuggcuggaaucuuagugugauucucucaugggccuugcuuuuaguagcaucuguaggacacucaucugcuuuuugaagcugucuguuuauagcaguucagcagggccuguauugcaucagaccugugggcaaaguacuguguccuuccaguuacaaauacacaauuaagucuaguuuuagauaggaagguuuaaguauagugggaauaaugcuagauugauccuagaaauuuugcagugaccuuccagaggauuuauauaaagcccuugucaguguauccuuacccacuuuaguccccguaguagcuguguccucgucagguguggcuacucacauuugcauauauucauuccauccuaggccugcuauuuacccuggguuauccuuggauucaacuauaucaucggaggcucguaagugauauuagauuuauuuaauuggaaacuaauccuuggaaaauuuccauuaguuuuuaucuuucucuaaccuuuauacaacuuuaaagaaucucaacauugacgcauuagaacccuauauuuauggaauaauuucacuucgauugaauugauuagauugcagggcuuuaagcauauuuaaccuugaaugguugugauuuuguuaacuuauuguuacacacaguauguuccuauguguauaguacaggaauaaauauguauuucuggauucacuauucugauugggcaaacagagaccuaauuuuugucugaguuggcuccucuaagagcuauguauaaaauuacuaugucuuauauucuuaaggcauuuccagaaugccuuggaaacugccuaucggucauagaaauccagauucuuagauaggauauaauuuugcaagugguuugaugauacagaacuuuuuuuuuuuuuuuuuugagacgaaguuucacuuuuguugcccaggcuggagugcaauggugcgaucuuggcucauuguaaccucugccucauggguucaagcaauucuccuaccucagccucccgaguagcugggauuacaggcgcccgccuccaugcccggcuauuuuuuuuuuuuuuuuuuuuugggauuuuuaguagagaugggguuuugccauguuugccaggcuggucucaaacuccugaccucaaaugaucugccugccuuggccuccuaaagugcugggauuucaggcaugagccaccaugccuggaugauaauacagaacuuuuggccaaccagggucaaauaucuagucuauuggucaggaauuagagcuagacauaggaauagcuuuaauuuauccagucagaauuuuaaagggaggauaccaagaugcaacuucucuaagaacucccauuucuucauuuuuucuguuuauuuauuuacuuauuuauuuuuucaagauggggucuggcucugucaccgagguuggagugcaguggcgugaucuuggcucacugcaaccucugcuucccagguucaagcaauucucaugccucagcuucccgaguagaugggauuacaggugugcaccaccacacccagcuaauuuuuguauuuuuuguagagaugagguuucgcuguguugcccaggcuggucucaaacuucugaccucaaaugauccgcucaccuuggccucccaaagugcugggauugcaggcaugagccacugcacccagccagaacucccauuucuuauacuacaaacuacuuuuaauauuucaauccauuuuuauauugcugguucuucaugugucugacauauuugcucugugugauccuaacuucuucugcauauugcuggggagaagugaauggauggagcagacuguuuagagcaaagcauguucugaacuuggcaaagcugcucuuccacccaggaaggugaagucugaaguaguugcagguguugauuugccccugacgggaaucauguugcaggugaagacaaagaggauuuguaauaguaacaguagaucuauacacucuugaggugaccuguauguaagccaagggaaaacugaagaaggucagcguugauuucagggugcaagucggcuuuccuaagugaucucuguggugucuuacacucaaggauacaagaggcaagggagaagugcuuaauggcuccaggaaagggggaacaggcauuuauuguuccucuuuuccuuacucccacgcuucucucuugguagccuucauguuugcccacauuuuauaaauacaauauucaugacugaaagcauucagaagcaugcuuugcaacuuccccaacucuugaggcaggaaguagcaaaaacaauauuuugaggaugggcuggugcuugaaagagaggucagaggggcugcuggccuugaagaguggcaggccucauugguucagcaggacugauuucccgucucccucagaaugcauuugccacucagacuacaaaagugcucauugucagcucucacagacucccagggacuaaaugggcugccuugaaggcucucuuccuuaugcuauuaguuaaaacuuggugcaucucuauugcuugaaugucuuuaaacucauuuggcucucuuugcaggguaaucaaugagcuuauuggaaaucugguuggacaucuuuauuuuuuccuaauguucagauacccaauggacuugggaggaagaaauuuucuauccacaccucaguuuuuguaaguguuuuuguccugucucaucuaacauuuuacugccuguguucuuagugcauccuaaugagagcuccaugaggaguaugauuuaccccuaugccccaucugcuggagaaaccugaggcaacaagugacuuacccuagucacacagucacaggaaguuagggauuaaagcuuaggcucaguugccuuccuguuacucuuuuagccagggaccacugacaacuagauuccaacauuacaggaggcaucucagcucucugagccugcugagggaccugaugcaacuccagagugcgaaacaguaggcuggugaaugggcagagucacagguuaguggggugucuuuucuuggcccaucaguuuuuacccaugauuuugcccaaggaaggguaaguuagcguguuggucagcaauuuuaaacauuuuuauauuaaauacuauggaguagacauuuuacaggacuguucagaguuaaaaugagagacuugagguuuguauaggcccaacccccugggaguuugugcucuuuaucugcuuuuaggguuuacugaagugggcugguaagggcaacagcuuugauuuuugagacaaacuuggauuugaaucccaguccccucagauagcaguuuuuauacugggaaaguuacuuaaucaaaccuccaagcuucaguuugcaagccuguaaauugugggagaagccccugucucacaggacugcaugagguaagauacacuguugggaagcacaguagcggguucucgguaaguaaagcuagcugccauauuccuaaagguggggguaggagagcaggauuuugacgaucugagaggagacgcgcacacacccagaagcauguaauagucgugugaccguucugucagugaggcaaaaggcugucgaagaacgggccaguuaaaucaccaucugggugucacagccugccugacaaucaugccuaaucucauaucagggauaugcaguaauagcuugcauuugaaagcuuuaaaaaaacaaacaaaccaaacccuuccacaucuugcuaauuuuaauguuuugcaguucugucauuccucuaagggaucagugagggcaguaaaacuugagcaggccuccucuuucuccccuuccuuuuauaggguagggguauguuuuucaaagacuuuucaaauugugaacuguaauauacagagauauaccauauuggugguugugguguguguguuuuucuuuaagagaauaaaaagaaacuuguuucucuucugagccuugaauugccuucaggcuaaaaaaacaaaugaccaaucugguuucuaauuaucaaaggacauaauaacagcagguuuggcuuucugaucuagguuuaucaaguaggauggcagaugcaucaauuaaaaaaagcuuggugcuuuuggggggcagccaacaguuacuuuacuuuaaauggccauauucuaacuuaacggcuuguagcuacuucucaguugugggcaacacaggauacaagauucuaguggcaaaaucagcgagcccuggagccugccuuccacuugaacuuucucuguugggggaaguccuucugcuaaauuuugcauaaagaucagaugacaaaauacagcuccuugcaaaagcaguaacugcuuugaaauuaccauaaauuuuuguugauuauguauaauuggguaucuuuuuauacuaauuauuugcauuuaauuucacuaucuacuuaagcaguggagauggcuuccauauugucuuagagugaguagcaaagcaagacagcccuagcauuuucuccagcaaguguucuauuuuauuauguacuuuggaggaauauuauuguaccagaaggcauggauguugagaaaccagcacuuggaaaauacauuuugauuuaaugguaaagcuguauuuguuuaaaauggaggaggugaguauaggaagguauaacugcuuuucuaaauggaaugcugauacauuuguaucaccauuuuccauuccauuuagaguaguuauaucuucucuguacacacuaaauuuuguguuuaaaagggguuuuuggccaggcgugguugcucacgucgguaaucccagcauuuugggaggccgacggguggaucacgaggucaggagaucgagaccauccuggcuaacauggugaaacccuggcuccacuaaaaauacaaaaauuagcuggacaugguagcgggcgccuguugucccagcuacucgggaggcugaggcaggagaauugcuugaacccgggagguggagguugcagugagcugagaucaugcuacugcacuccagccuggugacagagugagacuccgucucaaaaaaaaacaaaaaaacaaaaacccgaguuguugucuguuuugggaagaggcaugaagguaucgaguaugauguaaacagacuccagucacugacugcugucccuucccaggcaggaugcauguaguauaacaaguagugcagggcgcaggcucuggaaccaggcugacuagguuggaauccugucacuuucgaagcgcuucacucaguguuggcucaauuuucuuguuuauaaaacaggaguaauaguaaugccuaccucaugggguuauugugaagaucagaugaauuuauaagcaggcagcaccuaguguaaggcaauaaucacugaguaaauucacauaguaacugcucuaguauaaggucaaguauaaagccuguccucuucaggguuucugcuguggacaagucaccugucaugacuuacucuugcugccaagaaggguuuaagcggagguaucagaucaugcucucugccuucaagcaaaauuuuaaacauuaggaucugcuaaguggaauagguuuaaacacauucucaguuuacuaauaaaagagucaaagaugggaaauaguuggaaaauacuauugagaguguaggcuuggguuuaaguucucuuagcuguucugugaacucuuaguuuauuaauuuuaaggugggaaaucaucuaaccgucuggggccccagcucucccaccaucugugagaagggaagaauguaccuggaaggcagauucugaauaaauuuuaaaacauacccauacuuccaacauagaaagccuucuuccccugucuccuuugaugggcucagcugagagccuuuuagaaaugcugugcaaggcucaaacaugcaggcuguggauuuggccuuugaaagugaauguauuuuguauccuuugauccaguuugagccauauuuagauauaccaagaugcuaucagucauucuuugguugcugggcuuguggguguaauauuuuuguuuccauacuguucugcauggauuacuuuuauaagcagagaaaaaaacguucagagugugaauuuagcugaaaucugaauacauuuaagaaacaugaaaaacgaaugccgucuguggucaggucauggggcugaguacagaaaagacaaaguuaaauaagacgucccucgcugccuucaacaugacaagugccaugggaacagcaggagagggagguguucucggaggucagauaacuauguggaagugacuuuguucucuucucuccguuuguguccccgucuuucugcaccagguaccgcuggcugcccaguaggagaggaggaguaucaggauuuggugugcccccugcuagcaugaggcgagcugcugaucagaauggcggaggcgggagacacaacuggggccagggcuuucgacuuggagaccagugaaggggcggccucgggcagccgcuccucucaagccacauuuccucccagugcugggugcacuuaacaacugcguucuggcuaacacuguuggaccugacccacacugaauguagucuuucaguacgagacaaaguuucuuaaaucccgaagaaaaauauaaguguuccacaaguuucacgauucucauucaaguccuuacugcugugaagaacaaauaccaacugugcaaauugcaaaacugacuacauuuuuuggugucuucucuucuccccuuuccgucugaauaauggguuuuagcggguccuagucugcuggcauugagcuggggcugggucaccaaacccuucccaaaaggacccuuaucucuuucuugcacacaugccucucucccacuuuucccaacccccacauuugcaacuagaagagguugcccauaaaauugcucugcccuugacagguucuguuauuuauugacuuuugccaaggcuuggucacaacaaucauauucacguaauuuucccccuuugguggcagaacuguagcaauagggggagaagacaagcagcggaugaagcguuuucucagcuuuuggaauugcuucgaccugacauccguuguaaccguuugccacuucuucagauauuuuuauaaaaaaguaccacugagucagugagggccacagauugguauuaaugagauacgaggguuguugcuggguguuuguuuccugagcuaagugaucaagacuguaguggaguugcagcuaacauggguuagguuuaaaccaugggggaugcaaccccuuugcguuucauauguaggccuacuggcuuuguguagcuggaguaguuggguugcuuuguguuaggaggauccagaucauguuggcuacagggagaugcucucuuugagaggcuccugggcauugauuccauuucaaucucauucuggauauguguucauugaguaaaggaggagagacccucauacgcuauuuaaaugucacuuuuuugccuaucccccguuuuuuggucauguuucaauuaauugugaggaaggcgcagcuccucucugcacguagaucauuuuuuaaagcuaauguaagcacaucuaagggaauaacaugauuuaagguugaaauggcuuuagaaucauuuggguuugaggguguguuauuuugagucaugaauguacaagcucugugaaucagaccagcuuaaauacccacaccuuuuuuucguaggugggcuuuuccuaucagagcuuggcucauaaccaaauaaaguuuuuugaaggcca

SEQ ID NO: 16995 - RNA, 1335 nt, Homo sapiens
gcgcagcagccauggccagccaccuugugcucaacaauggcaccaagaugcccauccuggggcugggcaccuggaaguccccuccaggccgggugacugaggccgugaauguggccaucaaugucggguacugccacauugacugugcccacguguacuagcaugagaaugagguggggguggccauucaggagaagcucagggagcaggugguaaagcgugaggagcucuucaucguuaguaagcuguggugcacauaccaugggaagggccuggugaagggagccugccagaagacccucagcagccugaagcuggacuaccuggaccucuaccuuauucauuggccgacuggcuuuaagccugggagggaauuuuuccauugaaugaguuggguaaugugguucccagugacaccaacauucuggacacaugggcagccauggaagagcugguggaugaauggcugaugaaagcuauuggcaucuccaacuucaaccaccuccaaguggagaggcucuuaaacaaaccuggcuuaaaguauaagccugugguuaaccagauugagugccacccuuaccucacucaggagaaguuaauccaguacugccaguccaaaggcaucguggugaccgccuauagccccguuggcacucccagcaggcccugggucaaccccgaggacccuucccuccugagggaucccaggaucaaggcgauugcagccaagcacaauaaaacuacagcccagguccugauccgguuccccaugcagaggaauuugggugugauccccaagucugugacaccagaacucauugcugacaacuuuaagguuuuugacuuugaacugaacagccaggauaugaccgccuuacucagcuacaacaggaauuggagagucugugccuuggugagcugugccucccacaaggauuaccccuuccaugaagaguuuugaagcuguggaugccugcucaucccuaagugaccuauaccuguguuuccugucucauuuuuuuccuugcaaauguagcauggccugugucacucagcagugggacagcaaccuguagaguggccagcaagggcaugucuagcuugauguuggaucugaagagcccugucaauagaguagaagucucuuccaguuugcuuugcccuccuuuuugccccacuggggaaaguacaaccugaauacccuuuucugaccaaagagaagcaacaucuaccaggucaaaauagugccacuaacaguugaguuuuggcugcuuggaacuguaaucccuucagcaagacuucucuuugccucaaauaaaaaguguuuuuguggag

SEQ ID NO: 16996 - RNA, 2416 nt, Homo sapiens
gcgaacccuucucugaccccagcucgggcggccaccugucuuugccgcggugacccuucucucaugacccugcggugccuugagcccuccgggaauggcggggaagggacgcggagccagugggggaccgcggggucggcggaggagccauccccgcaggcggcgcgucuggcgaaggcccugcgggagcucggucagacagguagggagccgaucggccgcgacgcgugcgggagggagcgccuccccaaggaagcagcuaggaagcggggucgaggugggaagcaaagaauaagauggaaauacgucccuugcuuccaagggaccgcggagagcacgcucgcaggguccuggguccuugggaaugcguaaggaaagugguucuccagggacucaggccuggcggagcgcagagcgcgggaagagcuucuuggaaauagcuucuuagcacgcuggaagauuuacuguuuuccgcagcugcucaggguuaggcucccgggcucgaaccccggccggggaaagcgucgggcgccucccuuugcacggggugcaaucagcaagucggugccgcgggccccgcaggcccagcagcaucuggcucccgggcggagcugcggcugcagcccaggaucuuggcggccaaguucagggacugacacugccgcgagggcggcugcccgggcgucgagaguaggcugcgaagcccccgccgagcgcggcuuccauggucggcgcgcccaggguacugccgcuuucaaguacagucaggcaauucgcgcggcacgcugucucuaggcaucugaaaaaagaaaaaagaaaaaaaguaaaguaucuggcaaaucauucuggcuuuccaaauccguauccuaaaagcuuacaguuguggcacaguugaaauuuugguagcaacagggggagggagagggaaaaguucucucgcuugcgauuccggucuuuccgugugggccacgggcuuucccucccggggaggcaccggcagauugcaaguaucccgguaauuguggggguggggggagcacaaauguucagacuucuuaaauacggacggucucugagccuucuuagaaagcagagugggccggggagauggugcaggcagaugaaaucaagaaugcaggggagauggaugguugugauuggguuuggauuagggcaaaguucaaaagaguuuagggaagauuguaaacuugaaguaguaauuaucacuugggaauucccauuucuuagugacugguaagguagucauaaagcagcgaacagaagcuauuguacuagagcugugcuuuuacaacaaguacauagcagugcuuucuacauagaaggcuguucauagcaggcuuugcagauucuuuuuuuuuuuuuuuuuuuuuuuuugguggggggcacaccaaccauccaaaaaaguugcuucuguuuuuacuguaguucaauuacaggaguuggguuuuccacuuuuuaaagggcauggcuuuuauuucuaacuucugauuuuuuucuaauuuaccuaaaucuuuauuuuacuuaaauaauguuaaaagugucaugcuucaucagccagugugucaugcugcagauguucuuuugguucauuagaagaaaaucuuaagaagagcuucagaaaguugauuuuuuaaaaaagaaagaaaacuggcucgccguuuguguucauaaaauggacccaaauuuuuauuaaauuccuacugaaaguauuugugguggcccgguaaacuuucgcucacacaccaccuuuuuuuuuuuucuuuuuuagagcuaaaaaaauuauugccaauuacuugcucuguucuaagaauucuuauaauaacuguuuuacccucuuuucuuuuucuuuuugaacaaaaaccccaggaugguacuggggaaguaugacuguuaaugaagccaaagagaaauuaaaagaggcaccagaaggaacuuucuugauuagagauagcucgcauucagacuaccuacuaacaauaucuguuaaaacaucagcuggaccaacuaaucuucgaaucgaauaccaagacggaaaauucagauuggacucuaucauaugugucaaauccaagcuuaaacaauuugacagugugguucaucugaucgacuacuauguucagaugugcaaggauaagcggacagguccagaagccccccggaacggcacuguucaccuuuaucugaccaaaccgcucuacacgucagcaccaucucugcagcaucucuguaggcucaccauuaacaaauguaccggugccaucuggggacugccuuuaccaacaagacuaaaagauuacuuggaagaauauaaauuccagguauaaauguuucucuuuuuuuaaacaugucucacauagaguaucuccgaaugcagcuauguaaaagagaaccaaaa

SEQ ID NO: 16997 - RNA, 1076 nt, Homo sapiens
uuuaaucacuaaguucuuccucaucacggaaauaugugcuguucuuuauccuugggggucuugacucaccugauguugaggggccuccugaacuggguuuccauuuuuuuuguucuucaauuuuggcuugcuggaaugcuauggccugacugaggcugucaagagcaggauucuccccuucaucuucacuuucuacuacuuccucaauuucuucugguucaggagcuuucuuuuuuuuucuuuuuuucuuucuucuuuggaggcucacguucuccaagcauauuuuucggacaggcauaacuuaaguguccauuuuccccacauucauaacacuuggauuuaucaaaguaguuucgccuucagaugaacacagcugcucuuccauugucaauagcaaugcuuccucuuuuuuuguuuuuuguuuuguuuuguuuuguuuuuuuugagacggagucuugcucugucgcccaggcuggagugcaguggcaugaucuccgcucacugcaaccucugccuuccagguucaagugauucuccugucucaccucccuaguagcugggauuacaggcgugccaccacacccaacuaguuuuuguauuuuuaguagagauggagucucaucauguuggccaggcuggucuugaacuccugggcucaagugauccguccgccucggccucccaaagugcugggauuacaggccugagccaccgcacccagccaaugcuugcuuuuaucacucuaccaaauaacuguuuguuguuuauugcccugguacaguuuuguucagucuuuauccaaaaauacaauaaaugcaaccccuuuacucuuccugauaucuuuaucuuucauuaugguaaccuuuacaacuuugccauaguuggaaaauauccgguacaagucauugucagggaaaagggcaagcuggauacauacacugugcucuuacuuggagccaauccaccacucauuucuucaggugugacgguccugggagaccagaagagugcgagcccucggcucagcuggggcucaaccccgacucuucauagcugcucgcagcggccuuggcauc

SEQ ID NO: 16998 - RNA, 25839 nt, Homo sapiens
ggaaaugugucggugacauugaauggggagaccgagcgcgagcgaggcgcgcgcgcgcacacgcgcacucacggccccgcucgcuccgagauccccggccacguaaguaacuauuaauaccgccucgccgggggaugcgggcgugcugagcgcggggauuggccucgggcaccgucggccguccccuuuaauuuuuaaauacacgguccccucuuuucucuggggggggcaagcaagaaaucaaagaaggaggagacaagccgucaauuuucuccaaaacaaaccccaccgggcaauuuggucucgggguagggggagacggggugauugcaaauuauuccaggacgagauccaguucuccagcgggaaaggggcaaaggaacgccgcgcguuggaagggccagggacgcagcuccccuugcagcgcccgcaggacccccgcaagcucgugccggcgaaaucggagaccgccgaucuguccucguucucuccugcacgucuggcugcauucggaggaagaccuggggcgcgagcgagcggcgacagcaugagccugugcugaccuccgcgcggcgggccgagcccagggcuuugucgcgguaccugcgcccagcccgcgccgcaacucugugcccagcuuuugcaaucuuuuguuggcagcgcugaccgcaccaaguuaaaugcucccuugcaauuuuucuuuuuuuuguuuguuuguuuaauuuuuggagagcucgcgaucuuggaaaagccucagacgccaucuacaguuaaaacguagguaacugcccucucccgcaccccccccuuacacgccccccacccuuuccaccaaaaaaagggggugcagcgcggauucuggcugccgugcgucgccagccgguagacccgugcuuguuuccuuucucuuuuuguuuggcuucuaacgcguugggacugagucgccgccgugagcuccccgaagacugcacaaacuaccgcgggcuccuccgccccgucugcgauucggaagccggccugggggucgcgucgggagcccuggcgcugcagcuccgcaccuuagcagcccggguacucauccagauccacgccggggacacacacacagaguaacuaaaagugcggcgauucugcacaucgccgacugcuuugggguaacaaaaagacccgaguugccugccgaccgaggacccccgggagccgggcucggagcagacgagguauccggcggcgcccauuugggggcuucuaacucuuucuccacgcagccccucuucuguccccuccccucucgcucccuuuuaaaaucaguggcaccgaggcgccugcagccgcacucgccagcgacucaucucuccagcggguuuuuuuuuguuugucgugugcgauccucacacucaugaacauacacaggucuacccccaucacaauagcgagauaugggagaucgcggaacaaaacccaggauuucgaagaguugucgucuauaagguccgcggagcccagccagaguuucagcccgaaccucggcuccccgagcccgcccgagacuccgaacuugucgcauugcguuucuuguaucgggaaauacuuauuguuggaaccucuggagggagaccacguuuuucgugccgugcaucugcacagcggagaggagcuggugugcaagguaaagggccaguggguugcuuuuugucuuuggaaggggcccgagggagcgggagggcgccaggcccucgagucugggagagggagauucgcgggauaauuaccguggccuuauuaaauggguuuauuuauuuauuugcucagguucgguaaguugcgaaguuuuuagaccguuucagacaauggggcgggcggcagugggggcguuucggggagagcccggggaggagagggcggcgggacugcgcgggggccacggacacgcgugcaccgaaggcuccaggagcucucugcgcgaggccgggucccgcugcccgggggggauuucuuccugugucuagcccccuccccuuccaacaaggauuagggaaucccccgguaauuuuaagacugaugacuucguucuuuucgcagccauuguucuuagcagcgggcagguguuaaaccuuuguuccgaaggugcccuuuaaaacagacacacaaaggugcccccuucggcugagcccaggggcccagcgcagggaaggaguuuacaaagaccuuucuucugccuggagccuugaaaggaggguugggguggaaaucaaagccugagcacuuucuggugaauagugaaugcuuugggucuuucucucuggucuuggucucucuccccaucucuagacuucccugucugcucauccccucucuuccgugccccccugaacaacaccuuugccuguaagguuaagaggcucccguuuggagcccuagggauccgcagugguaauaccacugcgauggacacuucgguuuccuuuuuugucuuuaacccugaacagugacugguuuauguauaugugugucuguguaucuuugugugcacccaccgggccccagacaaguggaugaggggcgaaauaguugcgaaaaagaaaauaacuauaauagagcauacuacuacccagaauuggaccuagaucaaggauucuuugucacuuaauuuuagauuugcugacuguuuuuuuuuuuuuuugaggggguaaggggagagugggggacccauucugccuuugaaauggucacugggcacgguugugcugcaaauaacacaucgcgcuuuugccauucaccacagacuacuuugcggacuugccuuauuuccuaguggacuggaguauuucauugcaaaauuuggguuuaguggagaucuccagucaguuuugcgauuguucaguucagcccuuagggggaaaucggagacucuuuaaauguugcccuuugcuuguacugagcauuugguauuuugcaucuucucuaaguuauugagacccagagcaacugugcccaguuaaccaaaauucaguagcuggauugaauucucagaagucugcaagguugcacaauaggauagucauccuuugaaaugaaugaauuccacagaacugccacucuuguaugaaauaugcacaaucacccagcagugaauauuuucauuccuuuugcucaacuucaguacagcauuuuaauauuuuucaaaggcuggagaugcuuuuaaguauagggacucugcagccaaauucugcaggggcaucuggcuguuacuucuuuguuuaaaaucagaggugacucuggccucugcucauucuuucuccagauuuugcaagacauauuucacuuugggcugaccuuacagugucauuugcagacuugugcucuggccucaaauuggacuuaaucugcugguuuaguuauugcaaagauugaaucagccccucaccaauuacaguguggcugcaaguggauuuaagugcaguaucauuguucugcuugacagaggucaucccuuuaagacacagcagcuucuguuuuccugacuuuuuaccauagaugaugugggugacuucuuaugcaagcauaguuguguaucuccgaagaagcuccaagagaguuuuauaaggcugcuucucugaacugcccugagagauauauaugcuguggucucuuagcuuacuuuaaggcucagugaaaucuacacauugaaucuaguuccuuuugaugucuuagaauagaaggcucauguuuccuagcuguguguugaccaaugaaaaaauucuuugcaaaaacagaucaaauguaaagaugcuauuuauuauaggggacugcguagagaauuccauaggacacuauuuggaggaauagagauuccagagucauuuaaacaaaauaaucaaggcugcuuauugucuccauguaccuacuuuugcuagaugaaugaaggcacuuuaaggagucuuuaacuguauguuuucauggagauacugguagcuacugugcagauugacauaauuacuaucuuggcagaauggguacuuuuuuuuugcaaauguuauuaaugauggccuaaucuuacugccuuaucugaacugucacauuacauaaccaaggcuccaaauuaaacauguaaagaagcuggcaccaggcuuguggcuugauuuugcacgugaagaugaugguuuaaauaccaguccaagccccuaaaugccccugauagcuacuaauaaaaguuuggcuccuucucgugugggaaaacauaaguacuuauuuuauuuuucauacucuguccaccaucuuggaauuuggucucuucuacaaaagguauggcuacauuugaagcugccacaaauauguuaguuuuuuaaaaauucugucuccaguuuuucagcaguggagcaggauaauaggcuaaaagugcugagcaaaagucaccuuuuauguuuuuguaaaugcaccuggaaacaggaaguagauuauaaauaaucauaacucugugagcacuggcgacagaagcugcaaccugguauuucagaacacagcaucuucauuauaugaugcaguguuuacguuagccacugcaaagcuuauuacuccucgaaauuuuugaggcuucccuggguuucuguugccugcauucaggguguuaaaguugauucaagcauuucagauuccuaauugaacaggccucuuaggucacugcucuugggucaucauuugacaguaucagugugugauuuguggucucuggagauguugaaguauucuuucuuaaauucuagguuauaguggcagcagcugugccgcuuuucugagaugccucguuaugguucauucacaacauuacuguuaacuuugcuuccuuggccguguuagcagcaacucuugagguuuuacaucccuguuugacucacagauuuuguuucaauuuuuugaagcuuagagcaacuuaacucauggauucuuaaauagcagucuguggcuuuggaugggcuucagaaagcccgugaauccccuuaaaaugaauccgguaucgugcaugcauuugagaacgggcauugucagcuaagagggaacagagcuuuuaucagauuuuaugugacaucaggacccaaaaaagguuaacacuguucuaaaucaacaucuucauuuuaugaagaggagggagguccaguaacccuaagcucuuuauccaucucauccagauuauugguggcagggccaggauuagugccucaagguugccgacuuccaguccagcauauuuccuaccacacugcaaaaugaugaugaaagaaaguaugucuaacuagugaaaaagcgauuuaggcagcuaaaucauugugaacugauagcaugcaguguauuguuagggcguuccugccucagaugcuuuccagcgaagcucacccacgcaugccccuggcucacgcacacacugaauagauucaucuuacccacaucccaggcagauagaaaaaccacauuccagacccagggacuuguauuccugauuuaguggaggucuugaaaugaaugaaagcgccuuuuauauaaccucaaaaauucucuguaguguuaauugcuguuaggucuguuucaaaagguauugauggugccuuuucuuuuuaagcaaccgcacaaugaguuggcauuuugcaggcuaauuuugauucauagaaaaucauugcauaacugguucauugaguuagauaucuguggagggaagagaggaagaagcaaggcugcuucccuauucagaaggauucuaucauauuccuaccucugccacugggggcuugaguuuuggcucauucucugagccucaguuuccauaucuguaaaaugaaaguauugaauuagagaccacugggcaaaagcuagcuguuuauucucuuaguugcucauguguuguauaaugccuguuuaugugcauuucuuuuuuuuuauuuuugaaggcaaauaaaguguuguugaugucauugagguggaucacuuucucuccaauuuugccuuaguucuauaaacacgcaauugggcuagagacaaaaguaaugaaaauuauuauuucuguacugcauuacguuuugcaaagcacuaucaccuucauuuucucauauaauccuccuaacacugugagucaaguaucaguuucccauguuguacguaaagauuuggaggcuccgagagguuaagugacuuguuuagugccacacagcugguaggaggcagggccaauguggucuggguccaaguucagcauauuuucugucaucucaaaagcccauaccugugggaggugcagcauuauguguuuugguuguacaagaggcaccucugacuuuggucuuacuguuaauccugucguagguguuugauaucagcugcuaccaggaaucccuggcaccgugcuuuugccugucugcucauaguaacaucaaccaaaucacugaaauuauccugggugagaccaaagccuauguguucuuugagcgaagcuauggggacaugcauuccuucguccgcaccugcaagaagcugagagaggaggaggcagccagacuguucuaccagauugccucggcaguggcccacugccaugacggggggcuggugcugcgggaccucaagcugcggaaauucaucuuuaaggacgaagagagguaggucucauccuguccagaccuggguacugugauggacugcuccuaacaacagcuuccuagaaaagucuugaauggacguuuuuuugccgucugugguccagaugaggggaaggaaucuuaggagggcaaaaggaagugaauauugcaauuuucaaguguuugggaaaacaaauagcuacuauucuaaaggugucaucuggugcucaaaggacagguaccaggauauucugugacccaaugaauauguaugauuaggugucuugaauuccgaagguggcugcaaaccucuuugacauuuucaaugccaguaaaggcagggccuugaaaauucuacccgcagaacacucagcagccagaaucagucauuuauaauucauucauccaugcacucauucaguagcucuuaccuaagcuuauauuagguauuagucacaauucucaguacuauuaauaucuagaugaauuagauagccaacggaccuauaaaggaaaugcuaccagcucagaauagagguccgugcugggugggaugagaacuggggugguggggacaugucaguucucccuaggacuuggagagucaaggaagguuuuacaggaggggugauuuuggagccaagacucgaaagaugacuggauuucaggaaaugugggaaagaccgcauuccaggugaggaaacugcugaugcaaaugcauggcagugcagaggucuugguuauuggaggagacagcuggacaggaugcaggcaacuggcuuaugccguuaacucauuaccuucuauuuagcagacucugcuggggcccugcuuucucucccagccgauuuugauuacaagaacuccuucaagcccuuuuuguucuuuuuaagaauaugaguuuagagggacagaggcaacaaaucuguauucauugcucaccguaguuccugaaugaggccccacauaauguggagaccagcucauaucuugaucuuugcuugugaaugccuuuaccuuuauuaacaaacugagaaggggcagcuguuggaagauuuagaguguggaaccacauuuaccuuuucucuuccgcucagaugccucugccccuggagccuggagauguuuccccugguuuugccuucgauacccucugugaucuuggauugguccuucgucuguuuccacccucccccuaccagccucauauuucuccuucuguuaccuucuguaugcuguauuggcucuaaggucuuuucaauuaauaauaaauugguguaugugcuucuuugaauauucucauuuagaagaugaauauauguugacccccaacgauacugacaaagguauucucucuacccuuguauguuccaccuuucuuggagauuuaauaacugcaccuacaaaaauaagaggucauauuuguuuaccucuuaccauaagguuaaaguuuaauucucucucccuauugaagugaaugucaucauguccauuguauagacgagagcuccaaagugcaacguggugaagucccaaaguuacggacaggaaagagcagaaguaaggccacauucacuaguaagucagcucucaagaaauucauuugucugccagagggcauggggacagcaaaugcccucucucgcagggaucuguguuuuuaagugucgucuuugauuguguuuccauagggaggaacucucgggcaccaacgaguagaaggaauggccuauucagggauaggacccccauagugaauacauguuugugcaaaugaguagagcaggguggagguccccaagucauagaacaugggaacaaaaguggacccggagguugcauagucuguguggcacucucuugguuugcugccaggaggcagaacuccagaggugagagcacgccccagugcacacagcuagcuaggagccagugaagcacagccaggccucaccugggcuguggagggcuuuuacucccacccagccuuugcuucuccuuuaugagugugucaucacacgccaaaauccuugaugucccaggauccagggaagaagcuuccaaccucaggagugugugccucugacauuccgucuggaaguuacguuugacuuucgcgaaagagcaugacccuguccagagauaaccagaaaggaguauccagugugaaugugaaaccgaaacaauugccuggaguaaacaugucaaagcaaaauccuuuuucauuuucaagagcauuuuccaagguaaaaagagaauguaaaggacuguagggagcuggccuauauagucccuacagcaugguggcaugugugauagccccuuuggccaugcagccguguugccccaggggccagccuugaggcugaugcccuguaggaccuuggagaaaaugagaacuccuccaucugaucagugagguuacuuggccucauggcagggucaccuagcuggcuuaauguuacacagccagucugagggugcagccagccuggaaauccugucauuccaucgagagcucuucuuccagcccaagucacauggaggucccagugggcuugcuuuucaggaacaugacaagugucugucugggcagcucugagaaggucaccucuguuuucaaggacauuuugaauguucucagcaguagcugauugauaaagagcuuuuuuguuuuucuaaaauccaacuaucaacuuuuugugaaaggggaaucaugccuagucaccuuuuucuucuuguuguuuuguauuuuaaccucucgauuccagaaugugaaacuucugcuuuuuguuccacaauguauuucuccuucucugccuccuggcagcauugaguuucauggcagauucucuuuuauuuggccugcaugguggccuacauggagcacauugccagcacuuccugagggaagagugugaggccaagugucaggggcccaggaccucauuggcuccaugcuugcugcugggaacucucaucuuccacccuaauugcaucacuuuuaguggagcuaaagcuuccuucucccucaacaacaucgaaaguguaaggaagcaauggguuaaauuuuaaaggcuuuuggaaagcuaaaccacagaguuaaugucuguuuucucaccuuuugggcauuggucccacggugaaaaagcaaagaagcaaauuugggaagugcugcuuuauucaucuucugaccaucacacaccucuuuugcgcaucagucuucuucucagugaugugcuucuugaacucuggugaucuggaaagcaaucgaaagugcaggcuuuacgugugaaauuggcugaggcccaccuggugcagaagaagaccugccuaugggcugacuccuugugccuaaaguuucgauugugugccaucugggacucugcauccauggccauccauggaaacguuguuaguggaacugccagcgccuucaguccggucccccacuggugguuuugcaggcagacacagaugacacccagcguuauguuuggaccuaaugccagcaagccuugugcugcuggguagaaauggcagcagcucagagucuucuguuuccauuuuacuuugauuugaguuuuagguuuaacuucuggcucuucuuagcuaccugaucuuggauaagucauugaauguuucuaagcugcgguuccucaaagcagaaauaauaauggcauuccugucgggcaguugugaggguuaaaugagaugauucugugacucaccgggcagggcaggcacucaugaagggacagcuguuccuagagucauugacgaaauaguaccauuaugggagagcaguucccaggacucaguggguucuugaagaauuaagucgcucgccugggcagccuauucagugaagaguggcacccuugugacauagggguucagauuuaggccacauucuccucucuguuugguuuaauuauaaucauuaaguuagugccaaaggucaagugcaccuggucuggaaccugaggcucagaaaggccagauugaccauaugugcacuggaguaggcggccacaggcacauguagggaguggaggaucauaccccaccgugccugaaucagcuucuguguugcaggccuuggacugcugcuucuccuucguucccagggauguuugugcagggcagagccugguucuuuuuguuuauacugcugaaaaggaaaaccucagggcccagaggcauugagcagcauuuugaggaaguuaaucuccaaucccaguugaacucaccuggccacacccugugcauccacaguucguguaguaaaaucucagacagucuguguguaguagcggccacccugcugguuauggcucagaaucugauagaaggcagcacccacauccccaaagugcgugcccugugcacuccgccucccccucucugcuguggcauuggggugaccugcuugaucagucuauucuuagaagccccauguuucaggccccuccaauuccauuuuaauucaugggaaggccugagcuugggagaaguccuguuacuucuauguagagucacagcugccgucuggauuccaaucccuguucuugcacuuuuuaggaauggaccuugaaaaauuaccuaagcuuugugcccagacugccucaucugcaaaguggaaauaacaacauggcuuccaucauggaauuaaauguauuaauacaagggagcccaaugccuagcacacagucagccaucagcagacgggagcuccuaccuagcacacagucagccaucagcagacgggagcuccugcugauggaagccuccucugcacucagugucacucuguggucacagggccaguucccuggcucacucaagaugcgaagagcccuuugagcaggugcacccuuaugcugcucaaggaagguggguggggccuuguuaccacagcacuuccuguuugcuuuugcccauuggauuucucucuggguucaaggcuuccugccaucccucugccacucucugccucaguuucaguucaguguugacauuuccuugcacagaaggaccccaugugaacugagaaacaugccucuuuacauguuucuucuuuggguagaagaucuuuaucucuugacgugacagguuucauuuccuccgcuuuguggaagccggucaguacccacuucagcaggguggaagcugcgacuguuugcaggaacucaguggccugggggcuuucgguauaauaaacgccaccugcccagauucacagaccugugccucccugugggguggaggcguuucuccuucccccaccaacagaggucaaggcacucuuucucagcucuuaguaucuuuauuggcuuuuccuucagaucuucaaguugcacccgccuccauugaggucucaguaucuaacagaguacagagggcaggcauggaaacccuggagaccagacucagcuuuucuuucauuaaaagcuguguacauuuuuucaaguuguaggcgcuuuguauuuugggaaaauaccuuucguuuuugcuuugaaggaaauggagcuccuggaauucccuuauuuaugagaaaccccuuuauguacuugagguauugccaaccuuuggggaaggcuggcgagccuccuguuccccaggguggaucagugaucucucucccauagcacucccuuuccucaucagagcucaucuccugcuguauucugauggcccgugugugcaucuguagacuguccuuguccccugcugggggcuuccuggggacauaggcugucucauguucacugcuucuggaacagguugggccuugcuauuuguugacggaaugucuccuuuuuugagugggagcagcucagauuggauucuaaugacagaaagagagaggcagggguaaguagaguauuggugucuaggucauugccuggaaucagugggagcccagaaaacguauacauccccuauggagacaccuuuucaaagagagcuauuuccaaaguuucccaucaagugagaaauuuacccaucauuucccuuuuaauuuaaugauuuaugcagaagugacauuuauuuaagacauuguuuucagugucuauggcaggcuguaauuuuauucaugaagggcuuuucuaaucacgguuagaaaggggagagcuuccuccagguuccaugcuuauaaguagacuaaauaguagguauucuucagcaggauuucuugcugggcugcuuacugcuuguacuuaguaacuaguugaugggcuaguguggguccucaagcaaaccaagcagaggcacaguggucagauuuuuuuauuacuccauuuagcccuauggucuuagccugccuucucugaaaucaugagaagagacaauauauuaauauguuaagugcccagcacagugccuggugcacugcagcuacuugaauacauagccgucauuauugcuauugggcauccucugaugucauugagccucauaacccaacagcccggagauucaauuauuuauuuaacaaauaccuauugagcaucuauuaugugccaggcacuauucuuggugcuggggacacuacagagcccagugagagagaaacccuguucucaugagaccuacauuucaaugaaauaauaucuagggcccaccauguguuuuacucauaacaugugauucaccaauuuaauucuaauuagcuacuguauuuaaauuaaucaauuuaaacccagugaguaagauacucuuauuuucaccauuuuacagauaagaaaauugauccucagagucuaauggccaaccaguggcagaccugggguugguacccaggccccuggcuccagagcccaagcuuucaaauacuagguugucuccaggaaauagacaacagguaaaauaccgucucuuaugcccaacccugagaaagaauuuucucacgcaguuaggcaacaggugugcaccaggaggaccugacuagccagggucaaaacucagcucacgacucaguuuuccugagcagucauggauugggccaccaaugagccaacccugcgggcaguccuacguccuguuguuccauucuguggguuuuuuuuguuuuguuuuguuuuuguuuuuccccagggaacuauacaaugggcuucauuucuuuuucuauccuccaugccuagcacuggacuuagcaguacuuaggaaugugugaccauugaugccauggauauacaaauagccccuuaugucccguggcgugaauaucauaagaaaaaucaacuagccauauugacaguggaaugcaguggauggaaacucauuuucaauguuguuuucuacucaauacucuugggaguuucucuaaaucaugaaaccgaguccaggcuauuugaaauuucuuuggacucuagacauugccaugcauaagaagagucuugccuagaugccgugaacuccagauagaauguuggaguuggggagucuuagauaugggggucauucuaucucgcaaacauuuauuaagcaccuacucuguccuacggugcuagguguugaugguacaggaaucaguacaagagaguccuugccuaauggauguaaucauuauucaauaguuauuuagcuguaagcauuauuuaacaguuccaacaguggaguacgguguggagaauggucaccuccgggaggugaugaccuccugcacgagguuggcuugagugcuguaguagggauggggaggucccagaaggcaugagucaagccagaggcacaaagagccguguguagggagggcugugcugcuggaggguccccugugccaggacagagaugaggcugaguccagggccugaaagacacaccccucaccuccaacuugaccugaagcccagaaggaaccauugaaagguuuuucuggauggcagggauggguuugugauuccggaaguacaugugaaagaugaacuggguaaagcagccgggcauggguucuaggaagaaguggcucaaacugagacuguggcagugggauugaagaauugggggcaacaaguggggguuuaaacccgacacuuuuaucuuuacaaacaaugaggaggagagugggcuuacucaagguuucaaauguguucauggcacagccaagugcaggacccagguuuuucgacuugaucucauucauuacgugccuacgcgcacaucuccacaagccuguguggggcucccugucaagugcagcgucccugucuggcccugcgagugggugcagagaugcacucacaggccucccugaacucugugaacucccaccccacaccuggaacaagacugggaaaauucuggaccccgaagcacuccuaagccaccgggcagggcagcaacaccaucgcugggugccccuggccagcacugagccugcggaagcuuugcggagaggccaauccacugauaugggggaggagggauucuucaggagccauggcugaaagucucaaugcagggagugaauggagcauugaugaggaauuccugucagcauggcuuccucuuucuuggguuucccuuucuguuccuauggcgacaggauggacuuccucugugaagcccuggcggccugcaggcugugcuuguguggugucugcaugggggcgugggaagguguucggguacaaugagacuccccuguucauccaggcaccauggaugggagucgggcaggaaugugcaccugcaugcggacagggcagggauuccgucguggccggguagauggcacugcagaaaaccccugaguauuugagucagauuggguuucccaucccaacugugcuauuuccaagcaaguuccuucaucugucucuaagcugcuguagucuccugcaucaaaucggugugggcacacccaccuuccagauugugugguguuguaaggucacaagaggcauauucucucccuauagacaucucucccuccaccacgaugcccugagaugcuucccccguggcucaccuguugcucucccugcuaauuugugggccauuugagguaggaguuggggugguucacugacucuccaagacuuggugcagagguggcucucagaggugacuguuggaaaagucugugcauacaugaaccagaauuaagugaacgacaauuuauuuggcaucguuuaguggccugugacguucuaaugcagcugccaggccggcaugauggugccaauggugccaggugguccuucccaggcccuugguagcagccgccccgggcgggacccuggcuuucacagcuggacuggcugcccagaggacuuuuucaguaacagucagggcaaggucagaucuggcagcagcugaccuuuucacuugacccuuaagccuaucuggaccgccugacuggacggccuucagugacuucucuggauuucacugaccuuaggccaccggacuucccaucccugccaggcccacuuugucuggcugaacucccagcucagccccacccuggcccacccuguccugaucucuuccugccaagggcccacagugcuguuuaaagauuggaaaauacggcaugauuugcuuguggauacuauuuuugaucuuguggauugagcacuaaacuuggaguuaaaaaccgggguuugaaucccagcucugucacuggcuugcgagguggccuuggacaagucacaucuacuuucuguuaccucaguuucuucauccgguaaaugggcaggucuagucaccuguaucuaccucaugagcuauagcaguuagcugugaaugggaugguuuuguaccagaucuagugcugaauaaacugcaccagauuugccuccaucaucucagggucucccuuuaaaaguuuuucuuucuuuggcccuaaguaaaucagugauuuuaguaccagaauguauuuuggaaaggacaauggcguuagaguccagauguagauucagagcucagcuuguucaguuucucuguguauggccuagggcauuuaauucccugugccucagcuuccuuauauauuagguagcaugcauauaucauacuugucuuuuacuuuguuuugagaaauaaggaugcaagcuguaguaaucucagcaucuuauagaugcuucacacauaguuucuauuauuguuacuauaauuauuauuaggauaucauaugguguguuguaaucacuagagcuuaagaauuaaaggaaacuuuaaaaucuggaauucugaagcuagacgagcccuuuucaggcccuguagcuauuuguucuuauuuuacagaagggaaacugaggccaaaagaaccaggggccacacugguaguucaacuuaguggcgcaagggagcucuggagccugugcugagaguggauggggguggggggagaaucggggcuuucagugccgaccugugcuguuccacagaugcugggagaggaaccacacccugcugcuuuuggcuuccucaccuggcaccgggauccggugacacaaggccuggcacugggcugggccgucauugaguacacaggcugcccacguguaagccuuguucauucagcagguugagagcaaagcaggcuguucucuuccuaugccaggcacaguuugcaaaaggccugcagggauccagcuucucuggccaaaccaauccugccccaggcugguggcuggcagggagaugucucuuccccugagaaguuacuggagauaaccauugucauuuacagcguuuuaggcacaaaaauugccaccacccuccaccccuugucucuuugggaaauguuuauucuucucggacuguuucugguaccaccacuuccaggaagcauauccugauuacuguagucagaacugaauaaagugaggggacugggcugggcacagagcuggggaaaagcauuccagcccgcgggaggaacaagugcaaaagacccaggaaggaacgagaauucacaucuacggccguaugcuggggacuugcauuucgugcuuccucaccuaucuucuccacuaggcuuuuggguugaggguaggugcaaagguucauucuuaauaauaagaucgaucauuauuguugcccccaguuuuuugcagaucuaccaugcuaggcuccucgguagauaccguacuugcauuauuacaguuaauucucacaaaaacugagaagguggguguuacuugucaugucugucuccccagugccuaguuggggaacucaagcagaguaaaugcucgguaaaugucuuuuacaugccugcaugacuagugggacauuugaauuacuagguccacagaugcuucuguugguuuuuauggaaaucagcuccuuugccuggaaaauucauaaugcccagacugugaggggacaugagccauugcaagacuguucauucauuucugcucccauuucugacaugugcuagagccccaccagggacuccccauacacauucuugagaccgugacuggcagcccucuuucccagaggagggagccaaggcccaaagaccuucagcagccucccugcaguuacacagcaaguccacagugaccagagcugacacucacccccgccugucagaccucccuccauuccucucgcgugguaugcauccugaaagguccucguugaaagacguaauccagaccaguugccuugacccuugccuagaaguuuuguaaacaaguucacaguguucugagaaggaagcaaggucaaaagaaugaccuaccaaggccagcaagccugcauuuccuccccauccuuucucccggcuucucuuuucuuuugccccucuccugccugggaugcagauucuccccuagagaaagagcaggcuccugccccaaggauuggcuguccccugacacuggggaagcacacguacagcgcaccuugauggagccuagugaacugagcaacccuggugugguuuccuccgccagcugcuugaguagguggggucaggccuaaggaaggugagcacccagccacugccuugccuugccagccguaggagccuacucagacucucugagcauuaggcucauuguccaugagaaaaggaaucauaguaccugccuuggaaauggaucuccuaaacuuuaaagagacuauauguguaagugccucgcaugcauuagguacauagaugacaucugccguuugguacuuuguaauuuucaaggccugaucuugaacccaggucucuguggccucaggacacugcuuugcucucugaccugggcugguuuuugugguuguccuucugcagcaugugccgaaccaaaugugacaagcagaccugggcccuccccacuaaaauuucagccucugaaggaaaggagcacguaguguuggauacaugagcuuaggggcagcugguauuuggcagcaugugggauggucuuuucauuuuauucucaaauucacgaaguaucgggccuagauucugggugcucaucuugagguaggaaaggugaaaggugaacuccagcuugggggaaggccaggguuaguggacagaguggaggccuuaaccauuuucugaggcuuccagaaagagggguuaggaugcuuugaauguggggacaccugggggcaggaggaggugaaggagaaagucagaaucuaaaauugugaccuggaaggggauaggaauggaaaagggccucagauuuggucagagaugcgacaaaagugagcugacacagucggggaagcacaauccggguggggagacacuguggcaaaggccucagaaggacuggggucaagcagggcaugugaggaacagcaaacaggcugggaaggagggagagggagauggucgagagucccuugcacgaaaagcuugagguggugagcucugcacccugacaagacugagcgaggagaaauucaagucccuguagucauaucucccucccaccuuuacugacagaugccugauauccccacccccuuaucacuaugggagauuccuugaugcugucauuuacaaagcccauccucuguagagcucucauugacugccacuaaacccuggccagguaggcagagcaccggcccuuguuccuuugccggugagcgcacugaagcucacccccuggggucgacagcaggacagucccugucauugauggauuguguaucugcccugugccagguacucgucuagguacucaagguacagcagcaaacuuaaguguuguucucugcguacaaaaugacaucaaccacaugcccaugggcucuuggaggugggaagugaggugaucaucccaaaaugaucaccauaaugauacauaguaaaucaugaaauguaaauguacgauaucucccaugcugaaaagaggaggagggcgugcuccguaauguaggauggacaggaucaaguuuaauaaccuucauucgagcagaggcaagacaaaagugagcugucacacaguuggggaagcacaauuagggcaaggggacacuguggcaaaggccucagaaggacuggggccaagcugggcaugugaggaacagcaaacaggcugggauggagagagagggaguguggcccaagagauggucgagagucccugggggucacccugcagccgugaccaagcccuaggccuccaccuggaugagcugcaucaccacugcagguuuggggcagacgaaccugggcaaaaccugggcccuuugauaccaagauccaugcuuguuccacuggaccgccccuugucccacagaugggagagcuuguuuuucuucuuacuauuauuuccacaguuguaauucuuuccauagcuauucugcuaaaacagugaaauuggagaugaggagucuggcuugcgcugggugagaauggguagaggaagcuguggagagaacucacggugccugugguucgagauccccgccuuccuccuccuuuccucugccccuuggguuucaccuuuucaccuccgucacaucucgacagcuaguaagucucgugggccagcuccaccugccaccuuagauuaggaaacgcaaaaggacaaaagagauuuguuuuuaaucagcuccauuccagauuagcacauguagauccuuccuguuuuuguagaacauuagcuauaggcgcagaagacuauguauucuauagauuauaauagaaugugagugagcacacaaaaaagggagagauggguauuacagaaucccagaaugauaaaacuggcagagacuuuaagacugccuuguccagauguuugcaugacaguguaaauguacuuaaugccaaugaaguacacuuaaaaaugguuuaagaugguacauguuauguugugucuauuuuacuacauaauuuuuuuuuuaaagacuuccuugucuagugcuccucuuuaggucugaaaaacagagaaguugagugacucagccauagccacacagcaggugagagacagagccuagccuggaaacugccuuccuagcucuuagcccagugccuuuucccacgaccacaacuauuguuuguucguugguggaaauuaauacggaaaguagucacuccuugagcuuugaacuccuguaauccaaauaugaggcauuagagucaacccaggauuucacuaaaccuuuugcuguagagaacucccagcagcaaucuuuugguuaauuugaaccuugccccgcuucuauggcucuuaguggcgguggugaucacgcugaaaggcuaagaccuucaggcagacggaggaagagaaacagcaggagauggacuugagucacaagcucugacuuaugacccaaugugguuuuuccaagcucuuucuuauucaaugcuuacuugagcuuuuuuugcacuucggggcaaacagggcagaugcuugcacgugcgcuugcaugugugcuuuugagaugaaggaaauacgugaugugagugagacagcccuuguggaugcugucuuaauccuaacuccaacuccuccccaucccuccucaccuucucugcaagccuccaggggugugaugaugggauagauuaacugagcuuuugagacccaaggacuaccuacaacucucugaggcagugcccuagccaggagagucagaggaagauuucaauuuugagcacgggaagguagcaauuccuaacuuuccacucaaagaacaguagggcaggaaaacaggaauucuuaggaggccccugagcuaaggagaggaggcuggucuaggagcuuggggcgcuggguggaggaagcucucagugacuuucaccauagccuugaacaagucaccgcgcauccuggcccucacaguagauuagguauaguuaaugauaagaauucaacucacuuccaaaaguauuuccugagcacuuaauuuaugucauacacaaugaugacaucagaucuuacuguguaaggaugcaugcuggguuccaggcaguuuaaugcaggauuucuuaccucuuuucuugagcauacccuggagaguccuacuuuccugucagcaaccaugauggaccuuaaaugggagggaaagacuggggguaggaugccuaguuugaaaaggaucuugggcucaugguucuguucacacacacccuaugcacgcagacacgugggaaauuggaaucacagaugugcacagacagaagaugugggugaccuucaucagauguuagaaccuggucaaggacaaggccuugggaguaugaggggcaggacagaagacaaaggcggcaggaaaucuggggaaagaagaugguuuuguuuuucuuuuuugagacagagucucacucugucacccaggcuggaaugcaguagugcgaucucagcucacuguaaccuccgccucccggguucaaacgauucuccugccucggccuccugagcaucugggauuacaggugugcaccaccacgcucugcuaauuaucguauuuuuaguagagaugagguuucaccauguuggccaggcuggucuugaacucacccgccuuggccucccaaaguguugggauuacagguuugagacacugggccugaccagggaaagaagauggucuugauacgagggugucagccucagaaggaccaggugauaggaguccacuccugcuugaacauucccugcuuccugccugguccuaaagagaggcaccugguauagcagaaagagcagcagcaucaacuuaggaagaugugggaucaagucuucuccauuucccagcuaacagguuuggggaaguuacccgaacucucugagucucgauauucucaucuguaaaaugggauguuaauauccuacgugucuaauacaaagggcuguagugaggccaaaaugcaaguaaggugaaaggucuuuguggacuguggucugucauguuaguuacacgucugccaaaaguuguagacaaagcugugggcuuccugguugguuaggucucgguuugaauucuguggugcccuaucauuaugcaaaugugacuuugagaaagcuaguuaaucucuuguucccucaucgcaggggugaugaugaugugauucaugguucgcuaaggugcucaagguuugagcuccccaguggauuaucagcugcaugaaaagaccuugucagucuuguucacccauguggguguccucagcccuggaauaguagcuggcagcuagaaggugcucagugaguaauguuuggcuggucagaugaaugcgugaaugaaugaaugugaaugaggagucuucagaaacacuauagucgguuauguuaugaugcuggugguaacgugucucugagcacccucaggagcuuauguuuuccuccuuucuugcaggacucgggucaagcuggaaagccuggaagacgccuacauucugcggggagaugaugauucccucuccgacaagcauggcugcccggcuuacguaagcccagagaucuugaacaccaguggcagcuacucgggcaaagcagccgacguguggagccugggggugaugcuguacaccauguugguggggcgguacccuuuccaugacauugaacccagcucccucuucagcaagauccggcguggccaguucaacauuccagagacucugucgcccaaggccaagugccucauccgaagcauucugcgucgggagcccucagagcggcugaccucgcaggaaauucuggaccauccuugguuuucuacagauuuuagcgucucgaauucagcauauggugcuaaggaagugucugaccagcuggugccggacgucaacauggaagagaacuuggacccuuucuuuaacugagcucaugccccacggagacuuagcagguuccaggagugagcgagggcagcggaaaggaguucuuccgggggacacgaauugccuggcugaguagcaagaaagacacacucuuaaguuucuugguucagagcaggaaaaccuucaaggagcugacugaccacguagcaugggggcaagaggcgugggauggggauuggggugagauggaugggagcccgcuggagcuugucuucccuaacauagccugggagaccaccccuugccacuugggccacuuccgccuaccccacuuuucauuuuguuccaaaauaguugcagauccugacagaaucaaaacucucugccucaaacacacauccuggcaucgcacuguuagcauuuaacuucuuguuaggauucagggaaggaacaguuggccaagaauuuuuuuucuuuuaaacaagccaaccaccuagcugguaauuaaugagguucacuuaaaaaaaaaauucggugcacacagacugacaugaaaccugggugcuacaguaaaagaaaacaaaaguccaguuugugucucuuaaucgcucacuucaacucauuucuucuaaauaaacuauuuaauauccuggucaggaaaugacauguuaaugcuuugcucccugaagggggaaaaaaucuguccuuuaacaagcuauucuguuuugugucaauugguucguggcaggaagcuauuagaagucaaacguccagaugcauuacugcuaucuuaguuuaaagggggaaagaaaagggaagaagaaaggaaaagagaaauccaacuccuuuuucauguuuugcuuuugaacaaugaggguuugugugacaggcauuccucuuugcugagaugauagcaauggccugagauuuuagcaagcuccuggagucugaugcuuuugcaguacucugaucgcaacuaaacauuugucuuuguuuuauuagaaacuagugaaacaaagcagguugucccacauguauaaaauacagggcagcuauuuaguuuucuuuacagagaaugauccuuuuaaggcuuguaaggcccucugguuuggacaaaaacccucaguagagacaagcgggaaggauaauuagcugaaagcuaugaugauauaaauaaaaacagcucucuaucccaauacgcaccuuuguauuuucaagaacucuucuauuuauuaaggaaaaugucacauugugauguauuaagccaguacuucaauuacggguugacuugggaugacauauuacaugcuguaguuaacauuuauaauucuuuuuccuuguuugaguauuucugucucugaaauaaccuuuuacuuggcuuuucuagauagcuuuauuugauuucgaguggcaaaauguuuuuuauuacggcuuuucuauugcuguaugauacagaacucuuuuggcauaaauauuuguguucccaguaccucacuuguucggauuugacugccuguauauguuuugugaaaugguccuguuuuuggguaggugacacguggacucuaguauguaaauguuacuugaaucugugcuucauaauaguguguggcauguaugugcagacucuuggaugcuuuaugccugcgcagcaggagcccuguccucacguucccaggagggcggcuucacccuucguaaccaggagacaaggcggccauggauuugcccuugauucuauuuugcuaauggaagauagaaaggagagaagguuuuuuuuuuuuuuaacauucugaagauggugcugugucaagaaggaccuuuuuuuuccccucuccccuauuuuuuaaguaccuuggaggaggagagguuggugacaugcaugguggggaucuauggccucuggugcuuuguccuguauuugguuuaauguuuuuguccuaaucucuucaaucaauaaaauugugcguauuuaacuaaaaugcuggagucugg

SEQ ID NO: 16999 - RNA, 510 nt, Homo sapiens
ggcccguagcacugcaggaugggcaagugucguggaccucauacugcuaggagucucuguagucaccaacaagaucagaaguggcaugauaaacaguacaagaaagcccauuugggcacagcccugaaggccaacccuuuuggaggugcuucucaugcaaaaggaauugugcugggaaaaguaggaguugaagccaaaaagccaaauucugccauuaggaagugugucaggguccaguggaucaaggauggcaagaaaaucacagccuuuguauucagugaugguugcuugaaccuuauuguggaaaaccauaaagcucugguugcuggauuuggucaaaaaggucaugcuguuggugauauuucuggaguucgcuuucagguugucaaaguagccugugucuuucuuuuggcccuauacaaaggcaagaaggaaagaccaagaucauaaauuuuaauggugaaaacacuguaguaauaaauguucauaugccaaaaagaaaaaaaagaa

SEQ ID NO: 17000 - RNA, 2680 nt, Homo sapiens
ggcccgcggcuggguggcggguaguucccgccggcugugcgcgcccgccucggggcucgcucugagaggacgcggcggcagcggacucggagcccucggcgcgcaggcgggcggaccggccgagcugcgcggggcugcgcgccgccccugcuccgccgccaggccccgcgcggcucccgcgcccggcgcuccccuuuguccgcgggccggagcggcggcggcagcggcgguguccgagcggcggucggagccugcugcggcaguugaggcggcggcgccccugcggcugugcgccagcgcccucgcgccgaggcgaugccggaccagaucuccgugucggaauucguggccgagacccaugaggacuacaaggcgcccacggccuccagcuucaccacccgcacggcgcagugccggaacacuguggcggccaucgaggaggugaggcggccugcgcggcggcuccggccgcagguaucccgcgccccagccccgcccgccgcucccgcauccgcaucccgagaaaacuuucuuugcuccgaagccggacgcggccgggccaacccugcccgagacagaagcccuuuguucccgccuagguggcucggaggagaugggugauggccaccuugggccucuuuaagaccuccccucucucggccucguggcccucgcgggguuccgcggccuggucuuuuccccgcagcgcggccaacuuuguccagagucgggguccgcggcgagcgggggaucccgcugcccgccgccgcccgccgccgcccggggucuuugguacccggugcggaccuuaucaacuuguucuugaaguggaccggcgggggcagcuccgcgcuccgagcuccccgccgcagcccccgagcgccgcagggcccccacccucggguccgcggguccggggcaucccgggcugcccgggaaggcgugcccgccucagccagggcggccuggcugcgcuccacccgugcccggagaaggaacugcgggcaaggugugugagagucggcgcuucuggguccaagaagccuccaggagccgcuccccgguuaccugggucucaccugcuugaacccggaaugccgcccuucccccucaaccuggaaaaggccugguuuuaguaaagugcucucaaggugcaaagucaucacgccuagcugcuaagcaguacgcucuccagguccuggggagaggaacacguaggaacgaagaagcuugguugaaaauuaaagccguggggaaaggggcagagucugugaguccaggggccaccguuggcugugguuugaggcacauccucaccugcaguccuccuuuuccuuacccaucaaacgggauuaguaaugcauccuuuccaggaucagagacugugugaagugcuuagcacucugcucggcucagaauagguuuacaagucacacguguggcaauagugaaucugugauuaaaugucucugggccaggaugucagguuacaguuuuaaaauuggguauugcagguguuuuagcagaagacgccugggcuagcaggagugugugugugggugggggggugggugucaccaaagagcuuuaaaugaagcaauggcguuauuuuuuuuuucugguuuuuuuuuuuuuuucccauuugaacaaagcaucugcuauuaggaauugcuugaaaaaaaauccagaauguuuucccuuaauggaaaaauuuuuucuuuguagcuguaaacagucaauaaaagggagucaaaaguaacauucagcauucugaauccuguuaauauaacuuggguagccuuccuucucuccauuuaauuuggcggaagagagcugcauguaaaccuuuccuaugaauucggugauuccccagaucacuuaauucuacuuuuagcagcaaggcuuacagaugaugccuucaaaugaggcagauggggaugggugaaugaaauuuuuuccuaagugccaguuaaaaagcacgguguuuugagaauacaccauuaauaauguuuauggaaugauugcaaccaaaaagguagcugaauauuucuuaagggaaggaagcauugugcaugaugucuuucuuuagaaagcuugauuauguuuaaaguucuguugcuuuuccccacugcaguuugucaguuaaauauuauuaacacuggcagauguuggaaagccaagcaaacaagaauugcuauuaaaauuggcauaccuuucucugauuaauuuuaguuuacaguguauaauuccaaagcucuuuuuguaugcugugcaggagauuacccuagagcucaguuacugagcagauuacaaagagacuggauuuggucauuucauuaaauugcaagcuugcuucaugcugccgucuaagcccaagaauugguucaagucucaaaauggaaaaauuaaaaucauuucagguuuauuucacuuuaagcaaaucuacauacaugcuaugaugaugguaugugugagcuugguuuuauaacuaaauuugaaaguuguucacuuucugagguaaaucaauguggauuucuuuaaauaaugcucuuucccaggugucuaauguucgugucuauuaccaaaacuuguucuauguaugguuuaauaacaauugauguguacaguauuuugguuuuaaacaaaaaucuucucauacugagacgaaacaugagagggu

SEQ ID NO: 17001 - RNA, 9514 nt, Homo sapiens
ugagguagaggcagcgccaagaagaggccuuugccgcuggucgggauugggaugucgaagaacacagugucgucggcccgcuuccggaagguggacguggaugaauaugacgagaacaaguucguggacgaagaagaugggggcgacggccaggccgggcccgacgagggcgagguggacuccugccugcggcaauauccuugcauucaccgcccuccccaccccagcccagcccagcccgcccuucuccugggacccgggagccugcaggauccgcggggcaccggcgcggagcugcccucucaaccugcggcuuaaccugucucuuugggaucgcccgcucugagagggcaagggggaagcccccguuuccuacccagucggcaggagacgcgagggucccacucuuggaagccugcccucccccgcgcgccuuccacgcccccagauuccucagguugcacccgagugccugccugccucgggaacuggucccgccggccgcgcccucgcggcgcuggggaaggcggccccggcugguggggaaggcuggugccgagcgccuuaguuuuucuuccuagaacucugauuuccuggggucacauuagcuccagaaauuucugauuguggggaaccugcaucuuuccuuagugguuuuguuuuuuguuguguuuuuguuauugguagcguuaagguaguuuauuccuuaccggggggcggggggagaugggacuguucgaaaauugagggucccugugcuuucagcccauuggccuuuuuaaaaaaaaaaaaaaaagaagaagaagaaggggauuuggcaaaauauacauuguacagaauuuguuaacugggggaggggaaugaauacaaaaaauacaaaacuccuagaaggaagcuuggagccuuuuaccugcuaagaaaaggacaauagaaaaaacaacggggaaugcguguggagaauccuuggaaauauuuaaaauaaaccccaaugaauaagauagaagaugagucauucguauaaagcagaaucauuuuuguaauccuaaaauuguuuccauuuuaguuaaaauauggcagucaguucccgguuucuguuuuugcauauuugaauauucauaacuuuggcuucgcauuugcauuacaucuuuuuuagaaaaauguaaauguugcaaaaaaaccgaagcuguaguuuuagaaaaucucagacacugaauuuguaugcauuucuaauucuuggguguauucauaaggaagacucucaacaauguccuguuauaguggggaaauaugagagugaaaauauuuaauggcaacaauauccuuuuuuaaaggcaccuaaauagagcauuagacauuuaucaauauauagauagugcuuugccacaacuuucacaauuaauuagcuguugcucuuuugcauuauuuaaauacuuaagugcuuggaguuauaaaaaaugagcuaaucuacaucaggcaugcuucucuagaaaucccugcagccuugaaaauaacagcuugucaaccagagauuuuguguaagaacuuuuucuuuagaaaauaaauggugaacaugcuuccuaaaaacauuauuugugauggauagaugguguuuuaugaaaccccaguguauuuuagguaauuuguggugacuuuuaaaugguacugcuguauccauaucaguggaucugcuuuuugaucaguucaucuuaaaauauaaagauacugucucuucuuaccguuacauacagccaggaaagacagcccuaguggugggguacuagaguuggaggaacaagugaacucugugguuuuccuuuuaggggaauguuuguacauucugacagucugauuggccuucuguuucucaugcuugcuaacucacuagugcuuucaaagagagccugaauuuaauagguauggucuaacacaguuugaauaaccuuugugaaauaugagagaaaauaucuaaagcaaaaaauuaagcugccaccuaagggacauaugaauuauuacaucuucugugaugccucuuuucaucaauauugagagauugcuaauguguaucauucagauugcuaaucugccagcauguucuaccagcauuucagauaauacagaauaugguucuagcaaaaguuuggucuuuauuuuuucaauuagaaucacaggaaaagacauauuuugguugauaauagguuauuucauuugggggacuaauaauucugauauauauuuuaggauuucuuuaacaccacucuagguaauguuugcauauguaucucacugggaaaugaaagacuaucaagguguucacuugauaguuagaaccaagggugaaacagucuuugcuuuauuaaaaaaaagucuaauguucuauuuugcuuuugauauuuugccuuugauuaacauccuggaaaccaacacauugaauuuccaguauugaacauagugaccaaaguaauuuucuuuuuauauguaaaucaagucauaagaaccagugguuauaaugcuuuccugggggccauccuuugcuguuacacccuuaacuuccaucacaggaaacaugacagcugcccuacaggcagcucugaagaaccccccuaucaacaccaagagucaggcagugaaggugagucgcagacuacaacacagugaucucugcugauaucuuauucuuaguaaaauccucugcaguugcaaaaaaaaaucaauauuuuaacuguuugcuaucuuugacauagaagaguuuauaauguaguuugauagguaaaaauuucacgugaaaaaauagcccuauaauguaguuaugauaaugcugcaugguaagauacaguaaguucaaacgauagugaaaucauuuguguguguuuuuagaggagaccacucaggcugaauuugagcaaagguuugaaaaauaaguuaaaccuuuacaaaaauaaacagauuguaauugcuuuuuaaagauuuuuuaaaaccauacaaauacuaaauacuuauuauagaaagcucagacauaugagaagguuaaaaagauagugguuuguggucccagcacccagagauaacaguuacuacuuuggggccuugcuguauuguuacagaguucccuuuuguuuuuuuaagaaugaaauuuuauaacgugcuuuuucagcuauaugcaauguacaugagcuuuccuucgcaauaaguuuauagcauuuuuaacacuuguauauggauaagcugcaguguauacauaacuaaucuuuuguuauauauuuagacugacuuuuuuuuuccuauuguaaaccacugaaaucaauauuuuuugguaaauuuuuaauuguucucuuugaguaaauugcuagcagugaauuacuggaucaaagaaugcacuuuuuuuuaaggcuuuugguaugcaguauugccaaauugcccuucagaacaguugugcaacuuacauucucugcagucuuuuacuaauucuuaaccuauuuacguauuuauuuaaaaugaugcccauagcaucaaccccguuguccauagcuauucauacauccuaggagcuucaagaaucucaauugaauaguaguaaguaauaacuuagguaaaugcauaauaauuaucuagguaacauaauuuuuuauuggggaaaauuucuuugguuuuuacaaguuguaaagauugucguugaaauuucauuuuuaccguggaugcaaagauauuuuucuaaaucugguaauugcagucuuuaaaccaaagauaacaguaggugguagaaacauucugugaaauccugaccaguaggaaugcuggagguaucacuuuguguugaauggaaggagaaacgaauuguugaaaaggucaguuaaguguuuccuuugcuuggccggauggguaagaaaauaacugcuuuugaagcaggcuuuugccaaagaaaaaagaucauuauuaaugaacaucacuauauuucauaucuacagucaauucauauaaauuacagucaauuuucuuuuaagacagcuugguuuauuaaaauuuuuaaauaaaaaaguuuuuaagaaaaaauuacuucugaaggauaauucaaggugaaacugcaaaucugccuccuuguuuuguugggaauuuuuuuuuuuuuuuuuuuuuuuugagacggagucucacucuaucacccagguuggagugcaguggugcaaucucaacucacugcacccuccgccucccggguuuaagcaauccuccugcuucagccucccgaguagcugggaucacaggcacacaccaccaugccuggauaauuucuguauuuuuaguagagacaggguuuuaccauuuuggccaggcuggucucgaacuccugaccucaggugaucugcccaucucggccucccaaagugcugggauuacagcugugggccaccacacccggccguuuuguugggauuuuuuuuuuuuaagaucaagacauaaauuuaaauguuguuuuaauaaauuguuaaauuaucacauugaucuguuagcaaauccucucagcucugccuucaauuauguuaauagucugucuaguuucuuaccaccuccacugcuacuaugcuuaccacauccagccuguauuauugcaauugccuccuaauugcucucccugcuucuaccuuauccccuacucccacagcuuauuuucuguaacauagaugccaaagcaauccuguuaaaaugugagucagauuauggcacugcucuuaaaaccuuccaaugucuucucauuucucucaguaaaagccaaacuccuuacaaugccuguaggccuuacacgaucuguccucccauaaccucugacuuacucacgugcuuuucucccaccaauccacuccaaccacauuggguuuuuuucuguuccuggaacacacugaacacacacuaauagcacuguucuuuccucugucugaaacacuuuccucaguuaucccaagccuucuuucacguccuucagguccuuacucaaaugucacauucauaguguagacuuucugaaauucuaaacccuccucauacagauaugucuaaauguucuguuauuuauugacccaccaggaccgggcaggcagcauugucuugaaggugcucaucucuuuuaaagcuaaugauauagaaaaggcaguucaaucucuggacaagaaugguguggaucuccuaaugaaguauauuuauaaaggauuugagagcccgucugacaauagcagugcuauguuacugcaauggcaugaaaagguaaguuaugaauuauaaaucuauaugacugguucuuuuacaauagggaaugacaaugacaaccucucucaccuaaauaaccauuuugauuuguuguacauuuuuguuauuacaaauaaaaugcaugaaaaggauaguucauauuuauguuuacuagccuuggucuuaagagauucugauuccaacacuuguguuuauucaacaaugauuauuaguaauuaaacauaaucuugaacucugaauuaaaucaaaacuuuguaaaagaaaauaagcaauacaaaucaagaauucuuucacagugaccaaaaggugaaaacaacacaaggaucauaacagaugaacagcuaaauugugguacauacauacaauggaauaugauucaaccauuaaaaggaaugacauucugacacaugcuauaacauuaauaaaccuugaaaacauaccaagugaaaugagccaaacacaaaagaacuaauauuuuauaauuuuacuuauaugaaauaaucuaggauaggcaaacacaaagggacagaaaguccuuagagguuacuaggaaguagggaaagcaaggaauagggaguuagugcuuaauagguacagaguuccuccuuggagugguaaaaaaguuuuggaaacagauaguggugauggcuacaguacauugugaauauaauuaaugccaauggauuuuacacuuaaagaugguuaaaauggcaaauuuuguguuagauauuuuacaacuuuuuuaaagaauuaggaguuuggaggaucaagaauucuuaaaucauguuuuucuauuuucauguguauauuuugcaauguaaguagaugcugguacaucaucugucaaaagaguauaagugauuuugagcuuuggguaaaaaacuggauaacauguaaauagaaccagucauaaaaauauugaguguuugaaguguaucugagugaaaacacaaacauaagaaaaaagcacauaguaaaacaauaguucccccuuuuacucuaaaaugcaccaauuuggguaguaauuuauauggcacccuauucauggaacacuuucuguugccagguaccauacuauuaauguuuuauuuaaccuuuacaacaacccugugaaguauauaaauaucuuuaucauccucaauuuacagaugaaaagcuagcuuuaaaacccaagcagcguaguucuagcauagccucaagauugcagugaacauugauuacuuauuauauuccacauauucuucaaaggacuuuauaaauauuaacucauuuaauccucauaaaaauggagggaaaugcuugcuauuauuccucuuuugucacugaggaaacugaggcaugugugaagucuucauuucuuccaaaugucagucaccaguuuuuaccaaucuucgaaguauuucugaaaucuaucuguucaagcguaucuaaugcagcuguucacagcaucucucccagucuguugccauagcuuccugacugguuucccaguuaacaguuuugccuccuucaaaucuguucuccacccagccaucaaaaugauaucuuuaaaaucaaaauugcccuugucagucaccugcaggauaaagucaaaguucccaagucuagcuucaucuuccaugucauucuuccccucaggcuauagcaaugccagccuuuuuccugaaugcaccauauuguuucacaccuccauacauuugcucaugauuuucugguguuagccugucaccuacucauucuuuuaaugugucauuuccuccaugaagccuuagcugaaacauuccucuauacuguuaaucuggguauaagccucucccuggugcuuuaauagcaccugcagcacaacucucauuucauacauuagauuaaaauuaccuguuuauaugucugucuccucaugcuagaccagaaaaugcuguauuuguucacuuuuguauccccagcaucuagcacaguacucaguauacaaagguauuccauaaauauuuuuugaacagaaagaaaccagagcucagauuccuaauacuugaucauuacucucuauuuuucaaauuagagucagaguuaaaguuucuaaguucuuagcuauuaaacaauaccuucuuucuuugggagaaaaaaaaucugacaaaggcugacuaaucgaaguggaaguugggaugguugaucccaguuugaauuuucuucugacuauguggugagaaugagaaaugcagaauguccaccuguuuugagcaggaacacuaugcugcagauuuuuuuuuuuuuuuuuuuuuuuuuuuuuugagacggagucuugcucugucgcccaggcuggagugcaguggcgcaaucucggcucacugcaagcuccgccuccuggguucacaccauuguccugccucagccucccgaguagcugggacuacaggcacccgccaccacgcccggcuaauuuuuuguauuuuuaguagagacgggguuucaccauguuagccaggauggucuugaucuccugaccucgugauccgccggccucggccucccaaagugcugggauuacaggcgugagccaccgcgcccggccuaugcugcagauuuuuuaaaacauuauuuagaauuaauguacuaaaauguaaacuaguaucucacuagaauguaacuucaugagggcagggacuuucaagguuuuguuuauuacuguaaccucagugccaagaacaguaccuggugcauaauuggugcucaagaauuuauuauuuguuaacuaauaaauucagggucuauagcagugcccauuccuucuuuaagaaaaauguuuuaccaaauaugagaauugaccuuuuauuauucugucaacauuuacaucuugguuuguuuuuaggcacuugcugcuggaggaguaggguccauuguucgugucuugacugcaagaaaaacuguguagucuggcaggaaguggauuaucugccucgggagugggaauugcugguacaaagaccaaaacaaccaaaugccaccgcugcccuguggguagcaucuguuucucucagcuuugccuucuugcuuuuucauaucuguaaagaaaaaaauuacauaucaguuguccuuuaaugaaaauugggauaauauagaagaaauuguguuaaaauagaaguguuucauccuuucaaaaccauuucagugauguuuauaccaaucuguauauaguauaauuuacauucaaguuuaauugugcaacuuuuaaccccuguuggcugguuuuuuguucuguuuuguuuuguauuauuuuuaacuaauacugagagauuuggucagaauuugaggccaguuuccuagcucauugcuagucaggaaaugauauuuauaaaaaauaugagagacuggcagcuauuaacauugcaaaacuggaccauauuucccuuauuuaauaagcaaaauauguuuuuggaauaaguggugggugaauaccacugcuaaguuauagcuuuguuuuugcuugccuccugauuaucuguacuguggguuuaaguaugcuacuuucucucagcauccaauaaucauggccccucaauuuauuuguggucacccaggguucagagcaagaagucuugcuuuauacaaauguauccauaaaauaucagagcuuguugggcaugaacaucaaacuuuuguuccacuaauauggcucuguuuggaaaaaacugcaaaucagaaagaaugauuugcagaaagaaagaaaaacuaugguguaauuuaaacucugggcagccucugaaugaaaugcuacuuucuuuagaaauauaauagcugccuuagacauuaugagguauacaacuaguauuuaagauaccauuuaauaugccccguaaaugucuucaguguucuucaggguaguugggaucucaaaagauuugguucagauccaaacaaauacacauucuguguuuuagcucaguguuuucuaaaaaaagaaacugccacacagcaaaaaauuguuuacuuuguuggacaaaccaaaucaguucucaaaaaaugaccggugcuuauaaaaaguuauaaauaucgaguagcucuaaaacaaaccaccugaccaagagggaagugagcuugugcuuaguauuuacauuggaugccaguuuuguaaucacugacuuaugugcaaacuggugcagaaauucuauaaacucuuugcuguuuuugauaccugcuuuuuguuucauuuuguuuuguuuuguaaaaaugauaaaacuucagaaaauaaaaugucaguguugaauaa

SEQ ID NO: 17002 - RNA, 1749 nt, Homo sapiens
ucucucucaauaacagcccugagcgcagcuguugaagcuuucucagguuaaugauuucuuucuuggaucuuaaaguuucuuucucuuccuuuauuuuuggcauuuugcccguugcagggccuggcaaaucagaaagccacauagaaaauuaaaugaaagcuauugcuaaguuccagucucuacaccaguggaguuuucaaacuccucuucagcauauuugacgcccaaugaguaguacauuaauuccuaguccuaaaaucauucugugaacuuucucccaggaauuuuugcucaguuugcaauuaaaacaacuuuuuuucuucucuuuuuaauggcagaggcggggucucacuauguugcccaggauggucuccagcuccuggccucaaacaauccuccugccuuggccucccaaagugcugggauuacaggcgugagccaccgcgcccagccacaguuugcaauucuuaaggcaagggugacaauaggggucaggggucugacaggagacaggauuucuguggaaaacugcaccaagggccuucucgccaugucccguaguuugaagguuuacaaaggacugcacauuuuacaugagucaucucaacgaacgcucuccucaccgcauuaacaguccacgcgguuacgagucccauuuuacucacggggacaccgaaucuguaagaagccuggucgcuugucccagcaaaacgagccacggggcucagcggcccuaacuuuuaggcuguaggguccucgccgaccaccccgccaaaaugucaggccucggggcccuugcacccccaccgcagggacacggaucgaaagggucgcagcaacgccucccccgcacccaggagcguuuuccaggccuuugcaccaaccucguuggcuaagcccccugcccggcggcggcccggcugggaggaggugcuuucgggaggcggggccgcggcccggggauccucucgcgcccgcgggcuccaaucgcugcuccucacgcaauccuaaacgguucccgggcgaaccggggcccgcgcgcgccaaggccgccgagacccucaggggcugcggcccuggucccgcgggaccugugggggccugggcggcggcgcccccgacccagccagcggacgggccggggggggaaccgggaggucccggggggcguccacggggguguccccgggggucuccggaaggcgccggcggaggcucccgcgcugcgcuugaaaaucgcgcgcggccccgcggccagccuggguaggggcaaggcgcagccaaugggaagggucggaggcauggcacagccaaugggaagggccggggcaccaaagccaaugggaagggccgggagcgcgcggcgcgggagauuuaaaggcugcuggagugaggggucgcccgugcacccugucccagccguccuguccuggcugcucgcucugcuucgcugcgccuccacuaugcucucccuccgugucccgcucgcgcccaucacggacccgcagcagcugcagcucucgccgcugaaggggcucagcuuggucgacaaggagaacacggugagcccgcggggagggcgcugcgggcaggggagggaggcagggaaagcgaagccgcuccucacucacacgcgucuccccgcagccgccggcccugagcgggacccgcguccuggccagcaagaccgcgaggaggaucuuccaggagcccacggagccggugaguggcgggcguggggcagagggg

SEQ ID NO: 17003 - RNA, 1749 nt, Homo sapiens
ccccucugccccacgcccgccacucaccggcuccgugggcuccuggaagauccuccucgcggucuugcuggccaggacgcgggucccgcucagggccggcggcugcggggagacgcgugugagugaggagcggcuucgcuuucccugccucccuccccugcccgcagcgcccuccccgcgggcucaccguguucuccuugucgaccaagcugagccccuucagcggcgagagcugcagcugcugcggguccgugaugggcgcgagcgggacacggagggagagcauaguggaggcgcagcgaagcagagcgagcagccaggacaggacggcugggacagggugcacgggcgaccccucacuccagcagccuuuaaaucucccgcgccgcgcgcucccggcccuucccauuggcuuuggugccccggcccuucccauuggcugugccaugccuccgacccuucccauuggcugcgccuugccccuacccaggcuggccgcggggccgcgcgcgauuuucaagcgcagcgcgggagccuccgccggcgccuuccggagacccccggggacacccccguggacgccccccgggaccucccgguuccccccccggcccguccgcuggcugggucgggggcgccgccgcccaggcccccacaggucccgcgggaccagggccgcagccccugagggucucggcggccuuggcgcgcgcgggccccgguucgcccgggaaccguuuaggauugcgugaggagcagcgauuggagcccgcgggcgcgagaggauccccgggccgcggccccgccucccgaaagcaccuccucccagccgggccgccgccgggcagggggcuuagccaacgagguuggugcaaaggccuggaaaacgcuccugggugcgggggaggcguugcugcgacccuuucgauccgugucccugcggugggggugcaagggccccgaggccugacauuuuggcgggguggucggcgaggacccuacagccuaaaaguuagggccgcugagccccguggcucguuuugcugggacaagcgaccaggcuucuuacagauucgguguccccgugaguaaaaugggacucguaaccgcguggacuguuaaugcggugaggagagcguucguugagaugacucauguaaaaugugcaguccuuuguaaaccuucaaacuacgggacauggcgagaaggcccuuggugcaguuuuccacagaaauccugucuccugucagaccccugaccccuauugucacccuugccuuaagaauugcaaacuguggcugggcgcgguggcucacgccuguaaucccagcacuuugggaggccaaggcaggaggauuguuugaggccaggagcuggagaccauccugggcaacauagugagaccccgccucugccauuaaaaagagaagaaaaaaaguuguuuuaauugcaaacugagcaaaaauuccugggagaaaguucacagaaugauuuuaggacuaggaauuaauguacuacucauugggcgucaaauaugcugaagaggaguuugaaaacuccacugguguagagacuggaacuuagcaauagcuuucauuuaauuuucuauguggcuuucugauuugccaggcccugcaacgggcaaaaugccaaaaauaaaggaagagaaagaaacuuuaagauccaagaaagaaaucauuaaccugagaaagcuucaacagcugcgcucagggcuguuauugagagaga

SEQ ID NO: 17004 - RNA, 8472 nt, Homo sapiens
auuaacuuuagguaacaauaacuuaaaagauaggaaaauguaucauauuacagagauuuaaaaauugucuauacaauaaaugaugaagaaaacuaacaauaaacaggacgacguucaaauacugaauacaauuaacaaauggggccaaaagaucaacauuuaucucucaucaucuuucaugcaaugucucagcuuucuucucccaaacauaaaggcagauuaauucaaaguagcccuauuaagaauauuuguuuaucacgccugcaaucccagcacuuugggaggccgagguggguggaucaccugaggucaggaguucaagaccagccugaccaauauggugaaacuccaucucuacuaaaaauacaaaaauuagccaggugugguagcacauaccugcagucccagcuacuagggaggcugagacaggagaauugcuugaacccaggagauggagguuacagugagccaaaaucgcgccacugcacuccagccugggcaacagagcgagacuccaucucaaaaaaaaaaaaaaaaauuauguuucauucugaaauuaauauuugaauggaaacuguauuaacagcucaugguuuccuacuaaaguuuaagaucccccuagacaaugcucagauuuagacaaugccagaauaagacacugggugacugaaguaugaacuacagguaaaaucuagaagaacauagauaauaaaaaauuucugauuuaacagacauaguaaauauaaaugaauuaacucacacaaccuacuuacaccaaacaaaacuagaaugaacaacuuguaggaaccaccucuaguugauuucaccacuuaacaggggcaagaucuuagguggaucauuuuguuuaaggaugacuugaaauuuuacaauacuaccuuagcucccacauaugaaaacucuucaagaauuuuuucucaucaaccagacguugaggaaaauacagugagaaauaaaaugaaacggcuucucacacauaugaaggcccagaucaccccuaaauuucuagugauuuaacuuaagaagcuccuugcccugagagauuccuuuaucccacaacacucuacucagagggggcagagaaucccaggacacuacacaagccacaggauaaaaacacaaccugucuucuaucuggcaccaacugacuaauaucuagguauacacaggacugacuuuaaaguugguuaacaaauauuuuaauucauuaaaauaaaacuuaaaaauuacaugcuuagucuacacaaguuuaacuuacuuuagucacuuagugaauugugaauuggcucccauuaguggucaggagaauguauuugguguagaaaccaaauaaaucaagcuauuaucgccuugugaguacaaacaauguuuauuuguuuguaaagugccagguuuauauuuaaguaaacauuaaaaucugcguugaagcagugaggcugcaucuuuuaacuggcugugcugguuaaaggacuguuuaaucccgcugugcuaagcucacuaaagggucaccccucacuuuaaagccaagacugccauugucacugcuaugguaagucacagccagccaggccuucuggcaaaaggugauacuaccagcacuauaaacagacaggacugguugugagguagcuacacaguuuuaaagaugcuguuaaugaacauuacggacaauucaugguguggcuaguugguaacacuucagcugauuuuucuuaugagauggaaaaaaaaaaucagccaaguaagggcacaucuucaguucauuuagaagucagcauccaagguaaaagaauucucuguuggacuugacaucacucccauccucugauacucgccuacucucuucucaaagaaguuagucuuuccuuccagugaaauauucuccauaaagucaaauggguucucuacucugaaaaccugaaaagguucacaucaagauauaaauacagagcaccagcuucaaaacaagcaaaaggcuauguaaacaauacuuuaccuugcuaaaacccaguuccagcauaagucugucugccacaaacucaauguauugcuucauuagagugcaauucaucccaaugagcuucacaggcaaggccucagugaggaacuccuaggaaccaaaauacagcuucugaauacaacuaaagcacaggcauuuucuagcaagcuugagugacccauuucaucacccacuuuaccuguucuauccgaacagcauugauaauuauuucucuuacucucuccuccgaugguuuguguaccagguguuugaacaucaggcaagcaaaaucacaguguaaacccuagaaaaaaaaguucaagaucacuaaagccagaagacuucugucauuaacauggaauaugaaauuacuuuguccuuuucugcauucuccuuauccaacaugcucagccauacugagagcacuugaacucucaaagggaagaugacuucaacuacugacuucucugcugaugucacuaccaaggcaagcucagucccauucaagacccucaaaguugccaccuagaugaagacaggcaagguguauuucuugcucugcuguguguuggcaaaggaggagucagagcuucacucagugaucuuucuacagccaugagugcuaauuuugccacuacucccagcaggaaaggcaaagcucaguaauaaggcuaguuuuuagaugcucaggaaauuuguaugcaauuucaaguaaaucaaguuugcaaguuacugcauuaaacaucaagcuucacagcuuaucucccaauccaguaaggaaggcccuccuacaagguaaccauauuugauuugcccacugggcuccaaguaagauggaguucaugcuccuggcuuuucaaaugugacuuaaucaaagacauacacuagaccaaaauguauacucauuucauugaaaugcuuauuaauauugaaguagaggggcaauuucuagaucaaacaggagaaacauaauggcuacuaugaacauucuuuuucggggggacugucacccaggcuggagugcaguggugugaucuugacucacugcaaccuccaccucccagguucaggcgauucuccuaccucagccucucaaguagcugggacaauaggcacguccaccauacccggcuaauuuuuuguauuuuuaguagagaugggguuucaccguguuagccaggauggucucaaucuccugaccucaugauccacccgccucggccuaccaaagugcugggauuacaggcaugagccaccgcuccuggcucuacuaugaacauuuuuacggaaaaagggauaacauauuaauaccaggcaaaaauaauaaaacaucccuuaaaaucccaaucccaucaauaacuuguaguuuuggcugggcaugguggcucaugccuauaaucccagcacucugggaggccgaggcggguggaucaccugaucaccugaggucaggaguucaaccccagucuggcaaacauggugaaaccccgucuguauaaaaagacgaaaauuagcugggcaugguggcaggcaccuacaaucccagcuacuugggaggcugaggcgggagaaucacuugaaccuaggaggcagagguugcagugagccaagaucacgccauugcacuccagccuggaacgacagagcaagauuccgucaccucaaaaaacaaagaacuuguaguuuuaugcauucaaagccuauaggggaauacauauguacaaauguauuacaauauauugagaaugcaaguaaaacaguuucaguaaaugaaaguauuuccuucuuuugucaaguauguguaugguugaacucacacauuaaauguggauauaugccaucuagcaucucagguccccgucagugaacacaagagcaugcccgaguuguguuugggguuuaggucacccuauuauuugacuuagacucaccucaucucugcuaauaaguucauuagaaaaugugaggccaggcaucaguccucguuucuugagccagaauaucgacgcaaaagaaccggaaaagaaaaugccuuccacugcagcaaaggcuacaacacguucaccuauuuaggaguuaacaccaacaugauucuagugaguugguauucaagggccaaaaauccaguaacauuacuuggaaaaugaagcucagguuuaaguaggggcaagggucuccuuaccauagguagccucuuuguccccaauccagcgcaaggcccagucugccuucuucuugacacaaggcaucguuucaauggcauugaagagaaauucccuaguaggcacauacgguaucagcaauugaagcauuacaguaaaagaccuccgauuaccaacugcuagauaagagcucugggacaaaggccaaauucaaguauuugccaauccucuuccuaaaggaagaacucacaccgaaauguuuuauuuuuacuggucaguuuuucccuccaguguucuuuuaaaaaccucaacacuugauuuacauuaauacaaguuuggguauucuguaguucauauugagcuucagggucuacagacaguaaaacauaguccaguacagcagggacauuuguugccuuuaaaauuauuucaaguccagaucauuguucaauuugaagaaucauagaauuuaaauuugaagaaccauaaaauccuaacugcugugcuauuaucagacuaugauuaggugcauuauuuggccucaguugccacaccuauaucauaaaauaauuaaaccaauaaacuaagauugcuuccuacuaggacucugugcuacacugucgaucccaggucaggaaagcaaauccauggguacuacaguuaacuggaucucccuuaccacccuccucugccucccuuuauucuggugcccaccuugagaggcuacucauuucccagacuguuccuacccagaugacuuuguguucugaagccaagggcaccagacauugggcagcuuuuuuuuuuuuuuuuuuuuuuuuuuuuuuaaagagaugagggucucacucuguugcccaggcuagagugcagcgagaugaucacagcucacgguaaaaccaaacuccagggcucaagccauccuucugccucagccugccaaguagcugggacuacuagcucagacuaccaugcccagcugucguucauucuuuccaucucacugucccucucucugagaccugggucugccucucccuuguuuuugaggcuuccccagcagaccuuccuguuccccuucugggcauuugcccccgaucguaccccuaaucuuugccuucuuuucucaauuuccaccuauaaacauguucaaaucucuuuacucccaauguuuccucaguccuuucaaguuaccacuuuuccucuucauguacuucaaagucuacaacggcuacuuuagguugcagcuucaccacuuccacuccauacaagguucugguccccaaagcugaccuuuguuuuuuuugcuugguuuugcuuuuugagacggagucuugcucugucacccaggcuggagcgcaagcuccgccucccggguucacgccauucuccugucucagccucccaagcagcugggacuacaggcgcccgccaccacuuuuuuuauuuuuaguagagacgggguuucaccguguuagccaggauggucucgaucuccugaccucauuguccgcccgcuucagccucccaaagugcugggauuacaggcgagaaccaccgcgcgccacccuaaagcugaccuuuguaucuagacuacuccagcagcccauuucuaauccccccaccuccaaucuccaaaacaaaacagaccuuaagcuaccuuuauucagccaaacuccugcaugccuaaaucagucucaggguucacugcugccucugccuuauguaacuccuacuaagucuuauuugccuauacuauacugcaggcuucuuaggaggcaaguccuccccguccaucccacugcagccccacauucuagcuucucaacaacuuuaccaaaugagcaaagauggucagacauagguuuuaguuugucuuacccaacaucuaggaauuuuuucaaaagaagguuuuacauugguagacauccaacuuuaaaaggaguaccuucacaacucuaagugaauaauaaagugcauuuaggccccuugcuaagagcagacaugaccacgggugcugggaaugccuaugacugucuuagucauucuggagucauuuuuaucccuaggugaacuaaaaauguguaauaaaucaacaauuagugaguccuaaaaaucuuggcauaccacuugaauacucaccuuucuuugggaucuuuuauguaagugucaauaagaagacuauacauuucagaauguauguuuuccauggcaauuuggaagccauagaaacagcgggcuucuguaaucugaacuucuuggcuaaaucgcuccaccuaguggcaaaacacaucaaaguuaagcuugagaaaaaaccaacagcagcaacugucaacggauacuggcagcaucgcacucuuuguaccauuauaagguuuauuucuauauauauuucauccaauuugucacaauucuuugauauuuuaugucauaugcucaacuuacauaucaggaaauagauacauauaaaauaggauuugugagcgcucgauuuccuaauuaauuuaugucaagaaagauccauucgcaauaagagauacaaccaaauuauuauuaaaacagcaaagccacaaaaaggagggagcagagccgggcgugguggcucacgccuguaaucccaacacuuugggaggccaagguggguggaucaccugaggucagcaguucgagaccagccuggccaacaugguaaaacccugucucuacuaaaaauacagauauuagcuaggcaugguggcgcacgucuguaaucccagguacucaugaggcugagguuggggaaucgcuugaacccaggaggcggagguugcagugagccaagaucacaccacugcacuccagccugggccagagugagacucugucucaaaaaaaaaaaaaaaaagagggggcagaugugguggccacaaagagucaucacauugcuaccacuuaauauugucucagcuucucuagagucgggaaaauaccauaagaaagaacugcaaaguguuacaaaacaggaaaugccauguaauauaaaacccagcuuacacacacagaugcacucagcauggaaaaacauacaagacgaggaaagcgaacuaguucgaccucagaucgucaacgucaaaugaaugaaagauguuuuggaaacucaccaaguuuucauuuacuaugccaucgcuugcugcaaagaaagccagaacaugggauauaaaauaucucuccucggguuucagggauucccagugcugaauguccuuggagagguccaccugagguucggaagucacaauuuuagcauaaaaggaagagaguaaagccuacaggacucacacugagcacucaaacuuuaaguaugcuggcaccacuuacuaugccccacaguuagccccccuugccaacgggaaccuccaagugcauuuaugucugaggcgugacggucaccccugcaggggucuucugggguccuccgauuaccuccucggcgguccaaaaggaagccucugccuucuuauacaucugccagauaucaugguacucgauggggaagaugacaaagcggcggggguuuucucucagcagcggcucauccuccacgccgggggcagcugcuuuaguuuucuguugggggagaaaauaaaacauuuaaguaccgggcgaaccauaugaaacuaacguuuuucuggaccaaguccuuuccauuggcggcaauuucacggggcccgaugugaaaacguggcugucccgucgcacuccgugggucgcagcagaggagcgcacgcccgaaccgggaaaugggccgaggggcgcgggaggcagcccuggggaggggccgccuaggcgggaaaggagccggggcgggagugugaacagcugaggaaacaaugcggcuuuggcgccaagacgcccaaggccgucccuggccccucugccccacgcccgccacucaccggcuccgugggcuccuggaagauccuccucgcggucuugcuggccaggacgcgggucccgcucagggccggcggcugcggggagacgcgugugagugaggagcggcuucgcuuucccugccucccuccccugcccgcagcgcccuccccgcgggcucaccguguucuccuugucgaccaagcugagccccuucagcggcgagagcugcagcugcugcggguccgugaugggcgcgagcgggacacggagggagagcauaguggaggcgcagcgaagcagagcgagcagccaggacaggacggcugggacagggugcacgggcgaccccucacuccagcagccuuuaaaucucccgcgccg

SEQ ID NO: 17005 - RNA, 991 nt, Homo sapiens
uaaaccugucaacuugaaagaauaaaaauuccaacauuacaaagugaugaagaaauuauuucccuauaaauaaaucuuggaggcguggaaaucaauggcuugcacuauuuugccaggcguuuaaaagccugcacaggacaauggagcaauggagcccacgauaaaagcaagggagaaaacaacaccucccggcccguggaagccuaggaggaggaaccuagaaagacuagcgguaccagcuaagggggcucucaaggugguggaugugccagaggcugcuuggcaaaagaaaaaaaacgguuuuaccaacacccuucaccccaacccacccgaggggccccucaggagacagaccaccagagacuccaaggucggagaccuucccggcgcuccaggaaacgcggacucgccccgaaagccggggcccgagcguccggggcccgcgccaugcccuccccgggacccccgguccgagcucgccccuuccgcgcacuccucggcugucccaccuccccgcccgacuccccgagcccggccucgcccccgacuccuccccaaucccgcggcaaagcuucgcggaccggccuccacacugacggucucccaaccugguccucagcuccggcggaacgggcccgcucggcugcaggcgaugucagaggacggggaagcaagagacggcgacugcaagcgcgucgcccucaccacacccggcggccauauucuucccucuccgcgaacugacagaucacgugcccuggguaggggagggacuccggguugccacgcccccugggcguggaggggaggggcggggcggggcguagagcaggcggggcuggaggggccgcggggcggggacacccaggacaagcgccccaggcaagguuuuucagugucaaugucacucuuauuacaguuaauuuauuaucccuauuuuccauuauaaucaagcuuauucagagaaauaaacaucaauuauaucuucaga

SEQ ID NO: 17006 - RNA, 112452 nt, Homo sapiens
caguucgcggagagggaagaauauggccgccggguguggugagggcgacgcgcuugcagucgccgucucuugcuuccccguccucugacaucgccugcagccgagcgggcccguuccgccggagcugaggaccagguugggagaccgucaguguggaggccgguccgcgaagcuuugccgcgggauuggggaggagucgggggcgaggccgggcucggggagucgggcggggaggugggacagccgaggagugcgcggaaggggcgagcucggaccgggggucccggggagggcauggcgcgggccccggacgcucgggccccggcuuucggggcgaguccgcguuuccuggagcgccgggaaggucuccgaccuuggagucucugguggucugucuccugaggggccccucggguggguuggggugaaggguguugguaaaaccguuuuuuuucuuuugccaagcagccucuggcacauccaccaccuugagagcccccuuagcugguaccgcuagucuuucuagguuccuccuccuaggcuuccacgggccgggagguguuguuuucucccuugcuuuuaucgugggcuccauugcuccauuguccugugcaggcuuuuaaacgccuggcaaaauagugcaagccauugauuuccacgccuccaagauuuauuuauagggaaauaauuucuucaucacuuuguaauguuggaauuuuuauucuuucaaguugacagguuuaaaccgaugaaaaauuuuuuuaugaauaacuaugcagccaucucugcucccuaugggcgcuuguuaaaaauguagauuucuuagcguuuuagagauucccauuccuucggccugagguguggcucgggaaucaccccuucagguucguuccuguccacauuuugacaacacugaggaccagacaucuacaccuuuuuaaaccaccgugggguauugagugcagagcccagguugggaaaugccguggccagguguguucuuuguucucuucuagcuuuacuagcauggacuacuuucaucagaaucauuuuggggugcuuguuaaaaugucaguuucugggcaccaccccagaucuagggaaugggauucucccggggaggagcucaagggauauguguauuugacaagcuucccaaauaauuuuggugcacacaaguuugagaauccuuguucuacacccuuugugugaauaauuuccagaucauucacacacagugugaacgguaucuuuuuccaaguauuggguggguuucuccaaccuaguucuuuugggacacuucaaauucagccuggccaaagccccauucgcccagcuggggugguggaagggaggaggcauaacuuaaguagagaaaagucugcucuuucuccugcuuuuuuuuuuuugguuaagggcagcuccauucuucagucaccuaugcugggcaucuggucaucuuccaccuguuuucuuuuccaaccagucacauaguuuuaucuuuauauccagaauaucucuucuggauauuuugguaguucagaaaguucaaaugucagggauuuuauauuuuucaaguuaauaucccucauuucuucucuauucccacugccucucuuguguacugucuggugauuccuugacugguaucuagggcccugauucuuuguauuuuuccagucugggucacauacacugccagauuaauuuuuauaggaucauguaugaaugugccauccccuucuuccugcuuuugcucaagaacggucaguuucuccauuuuaugugcuacuguauuugucagggcuguuuagaagacaguagaaacuuaaaccuuuuacuucaaggaaaaggagauaauaggauugaaugagagucagaaagaagucaggaucccagguaccuccauuuucuacaucucccuggggcaacuuuuuuuuuuuuuuuuuuuuuuugagacagggucuggcucuguugcccaggcuggagugcagguggugugaucuuggcucacugcagcccugaccuccucuuaggggccacauuuguucucuuacuuaggaggagucucuuuucuguucauaucuguuguauucucucuuugcugauuggcugucucagaacuguaucauuuuaugugugacccauauugauuggcccagucucugguuucuaauucccaguucuagagagagaagucugauuggcccagcuuaucuuuuucaacaguuucaugccacagaucauaugcccaucccugggaauggcugaugcuagagaacauggcuguugaggguagcaggggcugugggugggcaaaguccuucagaagagguaucuuuagcauaccuaugcaguuauuuaauuugaugguuaucuauuaaguuucuaccuguucuagaucuguaauagguucuggggauguaagaaugaaggagagagacagcccuuaauaaauuaguucaaggcugggcaugcaggcucacaccuguaaucucagugcuuugggaggcuaaggcaggaggaucacuucaggcuaggaguucaagagcagccucggcaauauagcaaguccugucucuacaaaaauuaaaaauguaaacaaugaucuggguguguuggcaugcaccuguagucccagcuauucagggagggugaggcaggaggaucgcuugaguccaggaguuugagucugcagugagcuaugaaugugccacugcacuccauccugggcaauagagccagacccugucucaauaaaaauaaauaacuaaauacauacauacauacauacauauacauacauaaguuaguuuauaggugacccgcgagggggguuuugaaggguguguuuuggcuuguuaagaauguuaaaguugggucaggcauuacaggugguuggaucagcuugggcauguccauucauucuaccgauacuggguucugugguguaccaggcacuucucuuaagugcuggagauucagcaguaaacaaaacagauagucuuuauucucauugagcuacauuuguuuggcuaggggaagcagaccaaaaacaaaguaugugguauguggagugaugcuagguguuauaaagaagaccuuuaaaguagggcuguggaagggggauauaguagagggggagagggcuguuuuauacacguauaaaugguauacaccauuuauacacgguggucagagaagcucugaucaggugacguauguacagaaagucacuguggccugaguagagucaaggagaaggagcagcaagaguugagcuuagggagguggagaagggguggaauagaucaagcaaggccuuggcccugguagggaucugggauuuugagugagaggacaaccguugggauguuuugagcacagaaugguuguaagaagacacgauucaggaggaccacuuaggccucuguguggagggggcaagcgcugccacccaggcccaggaaugucagcaccaggguaggcucuggggacugcacaggggugauuguugcuggagacuuaagugggaggaggagaagaggggcuggagauagagaaccaugggaggggccacauucaggaacuuacugugucguaucuggaggauaagaaauaaguaagccuugggcagcauggcacuauuguugcuuucaugcacugugucuguaaccggagaaaaguuauagggugcgucuauuaaccgauuggccuuuuggugaaagcauuuugaauacauuuagagauuuugccuauuaaauuggcaaguucuaaaaauggacuuacuacaacauaaauuuuuuguucugacauugcuguuggcuacaucugccauuuucaaaacggguggcaagacauuaauuuuuuugcuaauugugcaaaagaauguauagccuuauauucccauuagagagaaagugcuguggacauuagauucaacugauguccauuuauucaagaaauauagugucuuguaugggccagcuauuaagcuaaguguuggguauuugguauagaacgaaagaaaauaauucauuccuuuuaaaagcuuauauccuagugggagagacagcuauuaaucagguaaauaugucccauuccagcagguguagcuaaaaaaaaaaaaaaaaaagacaaauuuaaaaaacauaaauauguaaauuacaaguuuaguaaaguguuaugaaggaauaaaaaagauuccauaauagagaacaauccagguuaugagaaucaaccaagaaagggugguuaagaaaugaucauauucuguuauuauguaaaacagcuaauauuuauuggcuucauauggguuagguauuauuuuaaucccauugcauguaauugugcaguuauuugaagauggggaaacucagacacugaggugaagaaacuaccccaggggacagggagugauaaagagaggcugguuaauaaguacagacauacaguuagguagaaggaguaagcuguaguguucagcagcaugguacuaugcuuaacaguuuauuguguauuuuauuuuuuaugguauauuuuaaaguagcuagaagauaagauuugagauguucccagcaccaagaaaugagaaaaguuugaggugauggauauccuaaauacucugauuugaucaucacacauccuaugcauguaauccaaauauuacacauaccccauaaacauguacaauuauuauguauuaguuaaaaaaauuaaggaaaaaaaaaagaaacuagccugggaugauauaauggucaguaguaaagucaggagucaaaccaagguagucuggcucuaggguccauacuuuugaccacuagacagcuucguuuuaagccgaaagggcuuuuggaagugaacguugaacugaaaugugaaagaugagaagcuguaguuuuccuccugugaugaaacauuuuuuuuucuauugaaaaugaacguagacuuaauacaucaaguaaaacaauauagcacaaagacgcgugaaggcaaagcuaaucaucuccuccuuuuaguccuacaugguaagauaacgaauuuuacagccagguguguguccuuccacacuuuucuuuuuguucauguguacacacuggauagauacauauaugggggucuuauuuauuuuaucaaguagaauuauacuacacacgugcucuuaaacaugacagcgugucauugguuuuacuauuguguguaucaacagauguggauuuaauguucuaauuuuauuuuguaauuucuaggcacuuauauaugugcuuacaaacaucuuaugacauuuaauaaucaauuauucagugaaauuuauuaaacacugucagugcccucuagucaaagacugccaggaacauaccucuaguugaacaaaguuggucuuauuaacucccugcaaugaaggagaaugccuguccuagggaacguugggggucucuguaacagguuguuagaaaggacuuagaagauucgagaugauguuaggugauucggggaagaguucaaggaagcaaagcuuugcucagucucgggugcuucaggaauaaggaggagugggaauucugcaauuggauauuuaaaaucuuaacgaaaaggcaagagguauggaguaaggcuaaagcuguaauugauaaagaagcagcaaugcuucauauuagccacgauaggaagauguuugggcauuuugugguuugggugauguucauguuuuugucuauguucagauaugauuccagaguagucuuauuuuugucuucauauccuggugacagagugaccuuguuugauguuggcauucuuugaaauuguugcauuuauguuagaacaccaagucuggcugugugugccgggucaguucccgacagucaggggcugcuuuucucucucaccuccuguuguguaggcauugugcuagauauaaagcagauccugcugcaagaacuucuagucuaagggagauguggagagagugaguaaaauggagaggagaguugagugugaugugagcagucuacaacuagauguauacacagguguggaggagcccagggccuggcccagcuugggguaagcagccagucaaugaaggcuuccagaagaucuguuagagccauguucuuaaggauggguaggagcuguucaggcauauauacguggagaauggacuuucuaagcagagggggcauuaagugcaaaggucuggaaagaacaaaguguggggcagugaaggagcugcaaguagaucagucuggcuggagcuggagguguagaugugacuauguagagggugggagggauggggcugaggaggggagaaagauaaggcuggaaugguaagauggggccagauugugaagaaucugcaugcccucaucauaaucaagaauugaacuuacugaguuuucacucugcucaguggagagcaaagcuuuccguaggaauuguguauuugcaucuuuacaauggcuuuaaaagccuuagaaggcguaaguuccuugaauaacuuguaaguaguaaagcugucaucuguccucccaaccuugguuuuaggagagauguauuguaggucacucuugcuucaguguggcaaauggauugcagguggcaggccuggagagaggaggcaaaaguugcuagccugucacauugaucugggugagagaugguguaguagaaguuuuuaggauugaugccuagaucacaacuguuuacucuuuucuggaaacagugccaauauggugugaccuuguaacccccucccaacuuugugucucuaguugcuugguucugggugugcaacagauccagccugggcagucagagcccuuuucugggacuguuggaucugggaacaaagaauagccugcuuucucugguguuagagacuaucugauuuaggccaggugcgguggcucacaccuguaaucccaacacuuugggaggcagaggcaggcgcaucacuugagcccaggaguuugagaccagccugggcaacauggugaaacuucauuucuacaaaaaauagaaaaauuagcugggcaugguggugugcaccuguagucccaacuacucaggaggcugaggugggaggaucgcuugagcccuagaggucaaggcugcagugagccaugaucgugcuacugcacuccagucugagugacagagugagacccugucucaaaaaauaaauaaacgaucugauuugaggcuggauggcugugggaagccauauuucccuuuguguagaaguaguuggucuagaaggaaaguagauuaagccaguagagaaagagaauccuccuggcauuugagguccaguggcacccacucuuccuguagugugguuaugggaaauaaaccauuauccuucaaauacauuuuucuguuuugcuuaagcuaguuuaaauuagucucuugcaaccuuaggggucuugauuaguauagauggugaaggucuaaacuaaggcacugagugugggguugggugaucucacacuuuaggggguaaacuggaugaaaaaugguagcugugugacucagagggagaugggugccuugguagaguagagaugaggaugguguucuacauggaaggagcacauugagcauaggcgggaguguggagcagcacugggggaguguggugaauuugaguucuucugcuuggcugggcuguggggugagcuggggcugguauagagggagagccagauccugcaaaccucacugaggccuuaggcuugauccuagaaggagugggaauaaaugaagguagguguuggugaugacugcuaauacaaacccucacugcuuucuaaugauagaagcaucacauuccagaacauguaggagauaaagguuuuaaagaaaauaaaaauuacacuaaugcccaucaccauuuguucuuuuuuuauuuccaguauuuaaaaauguauacauuuaaaauagcugagaugcuguauauauagcucuuaaucuuuuaccucacuucuucuaucaugagcauuuuucuguaacacauuuuuugagacauuuugaugacuguauauuauccuacuuugugaauuuuuauaauuuauauaauauccauuucuaagauuuuuguucuuauggauaaaauuguuuuacuuaaaaucuuaaaauuuuguucauguuucucauguuuuuagaauaauuccuagaagugcaacuaugggaucaaauaacaucauuuuuuaaaauaauaguuuuucaccccaagaguauaaauucaaguuguucugaauauauacucccuaaaaguaagguauacugauuuauacuuuacauguaauaacauucacccuuuuuaauggacaguucugaauuuugacaaacgaaugauuguguaacugccacaacagucaagauauagaacagccauuaacucgccaaauucucuuguacucuuuuguagccaucucauuccccugccuuagacccuggcagccccgaucuguuuucugccccugcaguuuuccuuuuccagaaugcuauauaaguagaaucauauagugcuauaguuucugcccucuggcccccagagauagauuuccuuccugugucaaaacauauucacuccaucgcaaggccuccccaaaagucucaguucauuucagcaucaacccaaaguccacagucucauuuaaaucucaucaucuaaaucagguaugagagggucuggguguaguccauccagaggcaugauuccuuuccaccugggaaacgcaagaaucaaguuaucugcuccaacuuagaguuagggaaugggcaugggauaucaguuauagacaguccuguucaaggguggaggaaaaggaaggcaaagaggauucaccagucccaaauaauuucauuuucauaacagccaaaguuuucaauuuugacgaacucugguuuaucaguuuucuuuuuuuaugcaccaugcuuuuaguguuauaucaaaucuuucuuaaucuaaggucacugaagucaucuauauuuucuucuagaaguuuuguacuuucagacauuauauuuaggucaauuuugaguuagcaccuguaugugguacaaaguauggauugagguuuauuuauuugcauuuggauguccaguugaauauaauaaaauuucuacucuuuuagaacuuauaguuaugguagacagacaauaagugaacaauaugucauuuuuuggaugguggcaagugguguggagagcagugaaagcaggacaaaggguugagagugcagggugacagugaagccuguguggggucgguacccugacaucccacauccggugagacuuuguaaccaggugaccugacggggucaggggguaagccgugugcauguccuguggaagagaauuuuaggcagacagaaaaguagcacagaggccuggcgaggugggacggugcucaguguggccaugcagccaggagggugagagggggugguaggagcuacagucacaggugucacacaggugagaggcuugccacugaagaguuaucuuggccaagguaaaaacauuugauuuuacuuugagcaccccgagaagcccuuagagggcuuugaauaaaagaggccaugcucugacuuaguacugcucacauugugguucuuccucaguguugucagugucacagggagcuggauaaagaugcagagucaggggccccacucagaccugcugagucagaaucucugacgguggggcccaggaaucugcuuuaaaagcucuucaggugauucugauauauguuaaaguuuuaaaaaaaguaauguaauuuuaauugacaaauuauauauauuuagggguacaaugugauguuuugauacauguauccauuguggaaugaucaaaucaggcuaauuaacauauucaucaccucccauacuuaauuauuuauuugcagugagaccauuuaaaauccacucuuccagguaaaguggaggcagggaggccaguuaggaagcgaugauagugacgcaggugagucacgguggcucguccaggguggcagugaugaaguggugaguaguagucagaugugaaauguauuuuacagguagagccaaaagcauuugcuaauagauugaguguaggguguaagaggaagagguaagucaugaacaauuucaaugcuuuuggccuuggaagaauggaccuggagcugccguuuacuggcauggugacagcaggaggagcaggggagcauuuuggaguggugaugaggaggguuuggggauggauguggaguuugguguuuggauaaguuaagauggaggugagugugaaccuaagagacaucacggcagcuuuuugacaccugagcuauggaagccgugggaagucguaucuucacuucugccacuggagguguccuugcaugagguuaauguuaagaaggauauuguauuuaauaguaacuuaauuuuuucuaauuauaaauuauguguauuuugucuaauuuaacagguauucaaauaaaguuaauugcagcuuucugugaaaaugucaguuuugauaucacagagcgucauaaauuauguagaggaagaaaacauuccugcucugaaagcucuucuugaaaaaugcaaagauguagaugagagaaaugagguaagaccaaguuugcaaaauuacauucuuucacaaauauuuguugacugccugcuauguauaggauagaaguguguaagaaauagguaguucuaacccuuaguaauacugcacuguacuuaugauagaaugucuuauaguuaaaaguacuucaaauuucauguuuuuggaguacauuuuaacuuauauaaaugacuguugaauuuagauuuauuguuuuuuuuccccugauggaauaauuaauauucaggaagcuugauuacugaaaucaaguacuucugugaaacuuuacagaucaucuggaccugaucuugauuaaccagacaaaaucagggauuguugaaauacuuucuuuuuuauuuuuauuuuuauuuuuugagauggaguuucacucuuguugcccaggcuggagugcaauggcacgaucucagcucaccaaaaccuccgccucccagguucaagugauucuccugccucagccucccuaguagcugggauuauaggcaugugccaccacgcucggcuaauuuuguaguuuuaguagagacaggguuucuccauguuggccaggcuggucuugaacucccgaccucaguugauccgcccaccuuggccucccaaagugcugggauuacaaucgugagccaccccgcccugccugaaauacuuucuuuaaugagccccaacuaucauccuccauuguuugucccacacacuuugggauuauuaaaaacccuacaucuuuauuagagaguuaaauagguuauguauuauauuuaguaacacacuaauaaacauuaacucaaaugagauauuucuccucaauguuaugagguaaaaaauguggaucuuaguucauuaugaaaagccaaacuauuauuuuauauuauuuuauuuuuuuugagauggagucucacucugucacccaggcugguguacaguggcaggaucuuggcucccugcaagcuccgccucccagguucacgccauucuccugccucagccucccgaguaguugggacuacaggcgcccgccaccaugcccggcuaauuuuuuuuuuuguauuuuuaguagagaugggguuucaccguguuacccaggauggucuccugaccucaugauccacccaccuaggccucccagagugcugggauuacaggugugagccaucgcguccggcaagccaagcuauuauuauuuggcaggacauuuuaggugcuaauacaguuuuguauaaauauuguaaguaucaggguauguguuuguuuuacaaaacuuaaggaaaacaacccugucucuuagaacuguguguguuuucaagaguauaauauuucuugccaguagauaagaugaauaaggagugguuuuuuauuuuacacuauauguguauguguauguauauauacuuauguguuuguauauauuugcuuacauauauaucuuguguagacauauaaaaaguuuuauuuauaauuuuuuuauugugauaaacacauaacauaaaauuuauugucuuuacuaucuuaaccauuuuuaaggauacaguuuaggaguauuaaguauuucuccauuguugggcaauagauuccagaacuuuuucuuuuuuuuuuuugagacggagucucacucugucacccagguuggugugaaguggugugaucucggcucacugcaaccuccgcccccugccuuccagugauucucaugccucagccuccugaguaacuuggacuacagucgugcgccaccacaccuggcuaauuuuuuauauuuuuaguagagaugggguuucaccauguuggucaggcuggucucgaacuccugaccucaagugauucgcccaccucggccuccuaaaguacugugauugcaggcaugaccacugcauccggucuaccagaacuuuuucaucuugcaaaaucaaaauucugucuauuaaacagcagcucucccuuucccccucucccuaaacccuggcagugaccguuuuacuuucuauuuguaugaauaugacuauuuagacaccucauguaauuggacuuauauacuguuugucuuuuugucacuggcuuauuucaguuagcauaauauccucaagguucauccacguuauagcacguaacaggauuuccuuccuuuuuaaggcugaauaauauuucauuguauguacguagcacauuuucuuggucuauucaucuguggcuagaaauuuggguugcuuccaucccuuggcuauugugaauaaugcugcuauaagcaugggugugcaaauauuauacauguuuuugcuuguguuuuuuguuuuuagacagguucucacuccauugcccagccuggagugcaguggcagaaucagggaucacugcagccucgaccucccaggcucaagcgauccuccugcuucagcccuccaaguagcuaggacacaggugugcaccaccauaccuggcuaauuuuuuguaucuuagucgagaugggguuuugccauguugcccaggcuggucuccaacuccuggacucaaucugucugcccgccucgaccucccaaaguccugggauuacaggcgugaggcaucaugccugacguauaaauguuuuuaaagcugcugaauuacuuuauuauuacuuuuucugaccugugguaccuaauaucauuuaauguuaacucagucguuaaggaaauguugauauaaaaauguuguuauuacaauaauagcuaauguuuuuauugaauguuuucguucauuuucauuagcuauugaauaauagcuaauguuuuuauugaauacuuaugcaaauauucugguauauauuuucuauaucuuagcucauuuaacuugcguagcagcuguauaaagaauaauacuguuauuuaucuuuauuuaugaguaaaugacugaauuccucaguuuccuaucuaagauauuauuugguagaguccauauuugaacuuugcucuauuugacuuuaaacaaauuauaaucuguguaagcucuauguuuuuuuuuugagucuucagaauaaaauuuauuuaaugauaaugccuauauuuucaauguuucuauauugaacaaaauauauuuucauuaguuaacaucauuacccccuucaaugauuaugaauagucaaaaguuguuauacauagauaagauauaacauuuauaauuggagguuguuacaaaaagauuacagaaguagucauuuuguuagcauauguuagcauauuuggaauaaccauaugauaguuucaaaacauuaaauuuuacuuuagagacacuugucuagggaaugcuaagaaaacagcuucacuuggaaggaaaaaauagcacaucaauaagcguaaaauuaaucuuauugcuauaaggaguaaagcacuggcauagagcuuaauuuagcaucaugcgagauaagcauuuaauggauauuaauuaacauauccaguuuaauauuguaucaauuuaaauuggaguuuuaacgugauaauuugaaaccaucuaggcuuuuucaguuauggcucaguguaaaaguugguauuuuuuuuuuuuuuuuuuagcauuuugcuuuuacaacuucugauaaaguguaauuuuuauagaauuacaaaaaguuguuuguauuuuuuccccuuuauucucauuuuaaaaaauauuuauguaacuucauguuaauguguuugguuaccaguuuugagaaagauucuuaaguauuagaucaauuaaaauaauguggguaggcuguaugugguggcucacaccuguaaucccagcacuuugagaggcugaaucucuugagccuaggaguuugagaccagccugggcacuguagugagacccuacuucuaaaaaauauuagccagguguggcaccuuuuagaccuagcuacuugggaggcugaggugggaggauugcuugaccccaggaguucaaggcugcagugagcuaugacugcaccacuacacuucagccugggcaacagacugagacccuaucucuaaaaaauauaaaauaaacaaauuuaaaaagggauaaaauugccugauacugugcuuauuagcacauaauugcccacaaacagugaauucuaguuuccuuuuauugcuuuauuuauaaacuagauaaaucuuuggccuaugaauauucucaaugauggcaaaucuuuguccuuuauagaguagugaagaguuuuuauuuuuauuuuauuuuugaaaggaacaaacagucacugucagcuguccuugguauaagggaauaguguugaggcuggucauuuuuuucccguuuaagaaaaugaacugagacuuuaaacaauggauuuugcuguauguuuaugaguaaacuuuauuuuauuuuauuuuuuuugagacagggccuugcucuguugcccaggcuggaguguaguggcaugauccagcucacugcagccuugaccugcugggcuuaagcaauccuuccaucucagccaccugaguagcuaggacuacaggcgugugcuaccacgccuggcucauuaaaaaaaauuuuuuuuguagagaugaaguuucacaauguugcccaggcuauucuacaacuccugggcacaagugauccaccugccucagccucccaaagugcuaggauuacaggcaugagagucacugcgccuggccuguaaauagacuuuaaaggaaauuucaaaggaggauuucgaaauguuuuaguuucacugugguuauuggaagaaguagaaacccuccagaaggacugcuuuaaaaaaaccagugguuauuuaggucucauacacuuaaauaaguagaaaugggaaccuagaaauugggaagagcaaaaagaugcuuaaauaguaguuguuuuugcauuguagucuucugggaagcugagauaaaguccaguauuucaguaggugcguaguguucuguuuuguuuuugguguguuuuggcuugaagucacuaugaguaguagagcggggauuauguggaauguaauccuguguuuucuagaaggagauaggcauggaauuugcugggauguguggggucagguauggaaaggaucuuuacugauacauuuucaaguagaaaaaugaaaguuuucaugacauaaguuacucuaucucuacaacuguaguuacuggacugguuaagcaagaacuaggagaauccaaagauaggcuuuauuuucaggcccaacuuuuaaaauaacaaucguucuauuuuuggggauccuauaaaacuuuauggcagccuuuccugaaagucauuaucuuuuuggauagcguagcuacaaaaggugcaucaguuaagaauugcuuuguagugcauggaacagcucucaaaacagugauuuagauaaauuaagguuuuguuuuucucacaugacaagcuagaugagccauuucaaggcugauagauggcuucagaacccaggcuccuuucuuucuggccaguccucacugugugccuauugcgucacaucagucauguagcaaaagcuccagcacugugucucaguauugggcaagaagaaggaaaaggcacagaccagcugaauuaguacagcgcuuuccugggagagcuagccagggcaccguugugggauuauuuccagcugcaagugaggcugaacacuggguguuuuuuuuuuucagcugagcucauugccacccgcaacaagcccugucuuucuagauacuggguggacagcuaauaguuucugcaagagaaaauaaugacaauucuaaucuuucauuuggcauguuucuaggcuaucaaauuuauaccaucuuuccuacuuguguuauauguauuuauaacauuuauauuauguuauauauuuauaacauuuauauuauuaaaacauuuauauuauguuuuucucucauuaucuagaaacacuuaccuaugugaacaucugaaauguaacugugacccagagcguaaacagaaaacuucccugagucuuuggaauuauaauuuugaaaacugugauguaaaauugauguauucucaggacuguggauuuagaguuuguugcuuuaauuuauauauucuaccaaugacuuugauaccugacuuuuuaucccaguagauuagaagggagaacaguucuauagaauguauaccaaagaaccuagagcggacagaggcgugcguggcauaguaauugauguugguagugacgacucagaauucuaaacauaacuuuuaaggccaucugcuuaauaacuagcaguacgugcauagcuuuucagagugaugauuaucauaaaaguuauaaucagcuugaauguugagaagauaaauuuuuucaccgagaaaaucuauuuauguguaauacgucauucccuaaugacccugguuggaugacauguggcuaccacguauaauuuagcauccauccuuacauaggaaugucuauauuuaacgugaccgauacuugaacuuuaaaccagcguucguguuuaaauccuuacuuguauuauucuuauaauagcaucuguuguauuuugguaaucauuauaacuauuugcuuauuuggauguugugccuaauagauuuuuaaauucuuugagacuuugcucacucguuuacucagcaaauauuuggguaccuguguggcagccacugucccucacacuggguauauaguuuuaaacccauaagcaaaacagacauguuucccggcguuuaggggagacagacaauaaucaguuguuaaucacacaaugaaaaugugguuacaaacaaggauuaguauaggaaaaguaaauuauaggggaucaguaaggaggugggaaugagcaggaggacacguugaggccggggguggcacagacugggucgagggccaggcaugcccugcuccgcgucacucaggguuugugucagcuuggguaaggaugucgguucuuauccagaagaacuaugggaaaacauugaaggguuugaagcagaggaauaaugucaggugggcauuuaaaagaaucauagauuuucccuccauacuaauauacauguaguaaguagguguuuaaguguuugcauaauuaaacuuaauuuuugguguacauuuuucucauaugccuuagugugucuuaguaccuuuaguaucaucacucuuuaaccugguacuuccuuuuuugaaaaauuuuaauuuaaauuuuuuuuugagacaagucuugcucugucacccaggcuggagugcagugaugcgaucucagcucacugcaaccuuugccucccagguuccagcgauucucaugucucagccucccagguagcugggauuacaggcgugugcuaccacgucuggcuaauuuuuuguauuuuuaguagagacaggguuucaccauguuggucaggcuugucuugaacuccuggccucaugugauccguccaccuuggccucccaaagugcugggauuacaggcuugagccacugcgcucggccuaaccugguauuugccgaucuguuuccugucauggcacuuacagaaaaugauaacuuuuguacugcacuugcaguagaugaggcuugcuguuaggggugacuugucuaggcacccagcugccugagcccugcccucaucuccagggcugagggagcaucgucucuguacuccugugacucauucuuaacacaaaggcugggacacugauuucagcaguaggagcuuuauuuaguuuaaugaacuaaguuucuaagagaaggcuuuaaaaaacuacauauguguauuauacauagcaccugguuguuuuuauuuauuauuuuacuuuucuucuucucguccuauuucagacaaaacauauauauaauuaaaaacacauuuuagaucauauucuaccuguauuguuagagaauuuggcuaccauaaguauucugaaauuuuauguauauuucaguaauugcauuccaaauccuaguguuauucauauuuacuuacuuuaaaugaauuugcagugccaaaaacagauuauuaauacugugggaagaaaaauuauguuuuauuuuuucuuugacuuuuaaauuauuaguaaacugaaacuuaaaguucaaagcuguuucuaaauuaaauauaguaaacacaacuaaacaaugcuuaacauacauucaugaaaaugugugguauauuuaacugugauguuuuaguaaaagugcaguaacuugauaaguucccuuugucuuuuauauucucuaguguggccagacuccacugaugauagcugccgaacaaggcaaucuggaaauagugaaggaauuaauuaagaauggagcuaacugcaaucuggaagauuugguauauauuaaaauaauuuacucaucauuuacucacuuuuuucuuagcuauuuuuuuguuuuucagaagugauucaaaaguaguaauuaaaacuuuuacauauauuucaacuuugccuagugggcuauaucaguuuuuuuuaaaaggaguaauacaggagagaaauuuuuacuuucaaugaaggaucucagcucuuugguuuuuuuauauggaugagacuggcugaauagagagcauguguacauauaguuaaauaucuaccuagaagauauccacauacgagucauguuaaguaacuccccauaaugguaacuuauuauaaauaauaucauuacaugcgauaauggccaggaauauauggucccuucugauaucacuugugagggguaaaucaacauuccacacgguuacauuuccucugauucucccuguauuuuuggaauugcuuuugagggucacacagcuacaucuauuuuguuucuuaauugaaugaucauuugaauuauauuacaguuaggaauuaaaaaauaaaagagaauaguucuuuaucacaugguuucuaaacacaucauaugagaucucuguagucugcuaaccugugaaugugcuuuuaaaucugauuacagucucuuuaauuccaauuuauauuacaguaaugguggcuagccaugaggauuagcuuugagguuuugaugaucaucuuuucucguuuuuaaaaagcgcaguauaugauuagaaguucagugaguagacugaacaagcaguuguaaagccauguuuaccccauucuuagugaugcaaguggacagauagaaucuuaagagagcuucaguaugacuuuagaguaguuuaguuagcaugggucacaccaugucaacuugguaugaucauuugguauguaaguucaaauguaguuuuccuuacuuugacguguuauuuuugguuugaaaaugauaacuuuuaaaauauauguucaaggauaauuggacagcacuuauaucugcaucgaaagaagggcaugugcacaucguagaggaacuacugaaaugugggguuaacuuggagcaccgugauaugguauggacauuuuuauauguucuuaauuagcugaaaucuuauuuauaaucauagauaugugugaaauauuuuauuuuuaugugugaaaugauauuauaauaauguuuuuagaauuugggauugggcauugaaaugacccucaagaauguuuuaaaacccagguguuguaauauaccucuuagaauauucuuagucaucauuuuucauuuauuuuggaguuuaaaauucugacauauuguuacaaauaacucauuacucuuuaauauaucaauguuuuggaacuucugagacaguuguuuccuuuagguaggacuuuaggagggacagcguaugguuuuaaaacuauuaucagguguuugaaguuauacuuuucagaauaauauuuuuagauuuauuuuuaaaaaugugauuauuuucagacaugcuaucugugcaugacagaaguuuaacaagaugugauccuuaauuauuacuuagcucuuacuugaguuuggcaucugguuaaagcauaaggugaagagagaggucauuucuggcuaauucuguaaaauguucagcccuuuuaaaaguugauuuuaacaguagaaggaaggaagaaaacgaucugcugugauauauaaaauauuuauuacuuagcugaugaugguuuuugaaguacagacggucugaguuuuuaagaagccacagcauuucaccauuuugcccuuaauagcacauuauaauuucacaguaguucaaccuguauaaucuuauauuuguucucaaaacuaagugcaaugggugguaucuuuauuuuuauaggaagauacagggaaccacugguaucuuacauauuuccaaaaagaacuuaaguacguugcagugaaaguuuagggagagaagauaaugaugucaguaacugaggcaaagacggauaugacagccgagagugaaaugugguucuugccuuguugguacgaaagguagaagggaaaugcagggaguuaucgaguucucaauauuuuauuaaagguaccuuaccagauuaucagauggguuaaugacacaguggcuauaaagcaccuagagaggccagggguggaauagguaccauaccaauagguaccauaccaguuauuccgugccuggcuucuuuaggugcuuuauagcugcugugucauuuaacugacuucucagaacaauccuguggacuaagguugauuuuauucucaauguauaguugaggaaauugagacuggaagaagugaaucuuuauccuaagucacacagcuaguaagcacuuaggcuggguuuugaaccaggucucccugcuccaaaggcuuucuccucuaucauuguuuuacauagaucagcaagggaauuaggaacaauaaaauauacguuaugaauguguaaaaauguauuaagauuuguaaaaacugauuucuuaaacuuuuuuggcucuuccuauuucuucaaagugaugaccagaaaaccuuuaacauuuaaaggaucuuuauuaaagguucuuuauuuuggcuuuaaaacacugaaaguuggggaaacugaggaccaugucucucuuaguagcuaguuuugugggaccuuaaccucaaaggauugggugggugggugguaguaacuacccaaguaacuacucaacuucccaaguugagggaagacagagucccugggacuugcuuaaggagaggagagugaccacugagauccuguggggcucaggaagaauuccaggauuucauaucagaagucuagugaggacucuuccugugaggacuucuacuggcaccaaaaugaagaaagaguucaugaaauauaaagcuacacuauaguuaauuggucucagucuuuugccaauuuagcuucauuuucuugagauuaaaauuuuaucucauagguucuuauguagggggccagagggacauuauucuuuauuuuuuuuucccccugagacggagucucgcucuguugcccagucuggagcacaguggcacaaucuuggcucacugcaaccucugccucccagguucaagcaauucuucugccucagccucccgaggagcugggauuacaggugcaugccaccgcaccuggcuaacuuuuuguauuuuuaguagagacaggauuucaccauguuggccaggcuggucuuaaacuccugaccucaagugauccuccugccuaggccucccuuuuuuuuucuuuuucuuuuuuuuuuuuugagacagggucucugucacccaggcuggagugcaauggcacgaucucagcucgguacaaccuccauccccugggcucaagcgauccucccauuucagcucccccuguagcugggacuacagacacacaccaccguggcuggcuaauuuuuguauuuuuuguagaggcaggguuuugccauguugcccaggcuggucuugaacuccugagcucaagugaucugccugccucggccucccaaagugcuggcauuacaggcaugagccaccaugccuggcugggacauuauucaaauugaagugaggacaugauguuaaaaaguucugggcaaguauuuuacaaguuaaaauacagauguaagacuugacuugaucaaaugcccagcucuguaauuucaccuaaauugugucuuuuguggccuugacacuuuagaggaguacucaucaguaauuuuagaauguuccucaguuuggauuuguggauguuucucguguucaguugcagaugugcuuuagagggaaggaugucccagaggcgaugugcuuuucuugguguacccccuagggggaacgugauuucaguuuguaucacuggugaugucagccuucaucucuugauuaggguggugucugccacuguaagagcacuauuuuucacuuuguaauuacuaaauauuugggggaagauacuuugacacuaaacaaaauaucuuuauucugacuaaaacuuucaccuauuugauuuagcauucaucagugaaucuuacuugcagcaguuacuaccauaacuguggugguguaaugaugauuuucuguuucccucauauguuguacauuaauuaguuagaauucuucuguaaggaagagugccuacuucccuuccccacacccuacucuaucugucuaucaucugucuguccauccauccauccauucauccauucaucuauauaucuaucuauaucuuucuauuucaguauggacuuaugaauauuuauuccuuggguuauagcccaguacuaauauuacugcucaaguuguuccaacuuuauccauuagaagcucuuucaggcuggcucugugcccuuuuaagaugcuccauacuuaaaaaaaaaauuccuuaguaagauuugauuacauuggucuuuuuuauugaaucguaucguaguuaaggagaaaauuucuccuguagcuuagcaaguagaacaucaucaagugugguguugauucauaccugaugacuuugccuaccucuggaaauucuggucacagaugagaugccuuagcauccucucucuuuuagcaagagguacuaaaaugaucugggauuuaaaggauguguucaaaugcaggaguugaauaugauuguuagaaucucucucugaauaaaguuuaaauucauagaaagaagugaauaucuaggaacauagcaaguuuucugaagaaauuuuuauuuuuuaaauuuuuuuuuauuugagauggagucucgcacugucgccugugcuggagugcaguggcgcgaucuuggcuuacugcaaccucugccucccggguucaagugguucuccugccucagccucccgaauaguugggacuacaggcacacgccaccaugccuggcuaauuuuuguauucuuuuaguagagaugggguuucaccauauuggccaggcuggucucgaacuccugagcucaugaucugccugccuuggccucccacagugcugggauuacaggcaugagccaccgcacccagccugaagaaauauuuuuggacagccaaaauaaaucuuagaaguuuggaagaguucauaaugaauguucucuaauucagguuucauaauauauuauaaacuuuggacuaaccauuuguggaugcaagagauuugacuuauuucauguacuauuguauuuggggagccugggaauuuagaacuauauaauacuaccaucaugaaacaaugauuuauaaagauauuuacuaaagaaauuucauuagugacauuuuuuauacucagagaugauuuaaaguuugauucccuuaccccuacauuuuuuguuuagggaggauggacagcucuuaugugggcauguuacaaaggccguacugacguaguagaguugcuucuuucucauggugccaauccaagugucacuggucugguaagcauuaacaaaaaaauuuguuuguauuauaagugguaaguuuucuuagggaauacuuaagguugauuauauuuggcuucgugguggguagaaauauucuuuaucuuauuaaacguaacauagaauaugauuucaaaacacaguaaugauaauuuuuuucuaaagcuaaguauuucucaauuguugucagcaaaaaggcagcucuuagagcuuaaauguuaauuauaacuauauaacauugcaaaaggagauuuugagaucuuuagucaucuuccucuuuucugugugugaauccuuaaucugaacuuaaagaaaagaaacauuuacaaaauaaucauacuguuuuucuauacauucuguuauauauauuuacauuccucuuauuuugcuuucuucuuacuaguauugccuguuggccagauaaccacauuuuaauguguugaauuuauaaaaauaaauguguucauaauauauguuuacuuaagauuuauuauaucuuaguugccaauuauguauuaugaguauuuugucuauuuuuaaaguggagaaugguuuguaaucugauuuaaaaaaaacauuacuuuguguuacuuccuuugauguuuacuuuacuuagcaaauguguguuguaaauaucuaccuaaaagauuuuauuucuccuucccucccucccuccuuccuuucuuucuuuccuuccuuccuacuuaucuaccuaccuaccaaccaaucuauccuagcaguacaguguuuacccaaucauuugggcagcagggagaggccaugcagauauaguucaucuuuuacugcaaaauggugcuaaagucaacugcucugauaagguaggucagcagcaucuuuucagguuccaguccauguuauguccacucagugucuaaguuauaaacauuuuuauaugauuucaugaggcuucucuaauguauuuuauauuuuuguauauuaauguauuuuauauagauauauaucucauagauggauucccuggguguauuauguaguaaguauccuucugauguuuucuuaugucacauucaucauucccaagaaaacugaccgggauaacagagucccugucuucauuguuugaaguuuucuauuguaacucuccuuccuacauucaguccuaucugcuuucucuguauuguugugugagagaucuuucugaaauugaaguuugguuauguuucucuugugcuuaaauuccugaagaccaucucugguaugaugggugaagaugggccuugccuuccuuuuuccccuucucuuacugcuuguccgccaugguuccuugcaugccagccacugaaugacccacgguccagggcccuucacagugugcccgccucuuccuccucagcuucacaucaucucugaggcucugcccauuugccaucaccuccagaaagcaccccagaaugaugugcuauucuuuuuuuuuuuuaaauccuuaacacuuaccucaaucauugcauaaauaccuaccuaauuaucuuuuuuucuucuuacuuuuggaaagcuucguuggcuuucacuguuucgggauaaaacccaggcuucucaguuuggcuucagccugucuugcaggcucacuucuugccauuucuuuccauauaugcuguguuuuagauacaaccgauugucuaauguucugugaacguuguuucuguguuuauucuguucccucugcuaggaauguuauucccuccucugccugaugaacuccuguuuauuuuucaaggcuuauuugagguguuaccuucuuuguuaagucuccuuacccuaggugccccuuccuggguacucugcacauugccauuagggcacauaaccuauugccuuguaaugauugauuuccacauccuucuuaccacuagaguguaaguuucaugaagauaaggacugcucuuuuuuuuuuuuuuucccauuuuguaccuccauuauuuccaguagcggucuuagaauuuggcacauuguggggauagucauagucuuuucacauuuauagcauuguagcuaaauauaggaaaauagcuauuacuuaaagauuuguuuuucgucauugaaauagauucugugcauaaauuucuuuaaguacaacaguauuguuuaaccuuuuggggcuguuggaaaucauucauaucuugaucugggcaguaguuaugccaguguauacauauguaaaaaaucaucaaguaguacagugaaaauuaguauauuuuucgcacuuugugcauguuauaccucuuuuaaaaauauuacacaaaauaauagcuuaaugaggagcguagggaggcuguuguaaauauuuauauuaugauauggcauuuaagaauauugcauuuguacuguugguuaauucagauugacugagguuugagguaugucuaaaauggauacaguuuugucuguugauggaauuuuuguuuuuuuuugacagagucucgcucugucaccuaggcuggagugcaguggcaugaucuuggcuuacugcaaccucugccuccuggguucaagcgauucuccugugucagccuucugaguagcugggauuacaggugcgugccaccacgacugucuacuuuuuguauuuuuaguagagaugggguuucaccauguuggccaggcuggucucgaacuccugagcucaggugauccacccgccuuggccucccaaagugcugggauuacaagcgugagccaccacgcccagccugugauguaauuuaauuaucauagagaagccuuuauuuuauccuucuugccuauaauaaaauguuuccauauagcuuggcuuucaaggcccuccagaaucagguaauaaugcuaccuaaucugucacucauuagcauuuugagaaaauguuuaguacccacuaugcagugcccuguaccugcacuuagcacagaagauacaaaaacaaagaaaaaaugaucucuguuuagagaagcagggagauaagugggccauguaaaaugcaaaggcccagggucaggugacuuaggaguguggaggugggagaauucacugauggcgcagcagucagucaagauuucauaaaagaaugcgacuuccucuagaccuugaagaaaggguagaguuuacauccgugagagaggaggagcagagacgaacugggcacagggaaaaugagagcacaagguaccaggggacggcuucagguggccuguugagcuaguguugagugcacccucaguggugaggagaugggugggaggaggaagcugggcugcagguggagcuaccuuugggugagucuuggauacuuggcugaggagcuuggacaucuggccuguagacacucagaaucacuggggguuuuaaguaguguaguaggugguugcaaagggguguuuuagaaaaaauuaacguuuaauaguacacggugggauugauugaagauugagaguauuuuuauuucugacagaaauagggagguuucuaugggaacugauuuuuagagaagggaaaggaagucuguuuuagacauguuggccuugaagugguagaaaccuguaguugaagguguccuacuagauagcggacauagagauuuggguugccggugauccagggcuugccuagaggugauucuugaaaugaugugaaugcggauuuggcagcugagaucaguaguaacggaauauggugagcaaagggcugauuauuaggaauaauaauuauuauuuucuuaauuauaauacauaauuauuuauauaauuauuauuaaucuccagagcuaggagaacuuggcuauuguagcaucaaagguggugaaugaaucaaaaauucaauuuggaagggacagucaauauaguucaagauacugcagagcuuucaggaagaaaagaaagaacuuaguaaaagauacauagguggccgagugcaguggcucaugccuguaaucccagcacuuugggaggccgaggcagguggaucaccugaggucaggaguucaaaaccacccuggccaacaugguaaaaccccaucucuacuaaaaauacaaaaauuagcugggcaugguggugggugccuguaaucccagcuacuugggaggcuaaagcgggagaaucacuugagcccaggagguguggagauugcagugagcugagauugugccacugcacuccagucugggcagcagagugagacucccucucaaagaaaaaaacaaacaaacaaacaaaccaaaaaaagauacauagaucuggaguuuagguaacuauuugggugaccucugaaauggugguuuuguaauguuuauagcagaaacuaguuuuuuagggggguuugguaagggguuauaaauuaucuugaaaagcuuaaaagaaagaacagugauuaucuucagaggguagccuguuggaaaaauuuguuagaacaggagagacccacaugagaaggaccucauucagagaccuauuaggaagagggaauaagaagaaaagacugaugauguggcaggagauuauugaguaagggccugggugaaagaggaccauagggucaggaauacacauaaagggauuagauugagaagggauagagaccagaauuugagagaugagagacuuauugagguaguucagacuguggcugcagagcuguuuugaagcagacagcaugcaaggugagggaaggucuugcuggaugucaggaauucuuuguaauguugaaagugggacugucucccuaaugggaguggguaaggacuagccggcucaugugcugaggcaggggaaggagcagaaaucauagcauauaaucguggauaguucaguugcaucagaagggcagaaauccaauacaauagauauucaaaggaugagaacucaguuacaauaaguauauuuuuaaaaggcuuuaugaagggugauuuucuauguguauuauguuugaagauaucuaagauauugauauuguaaaguuaggaaaggcauuuuagccagaguaaguauuauccgcaaaagaggaggcuagaaaagagaauuuaguucuuuuuaguggagaaaaccacagaugcaggaaugaaguugggaaucuccuccuguauuucuuuuuuuuuuucuuuuugagacagagucuugcucuguuacccaggcuggagugugguggcaugaacacggcucauugcgaccuccaccucuuagguuuaagugaucguccugcaucagccuccccgguagcugggacuacaggcauauaccaccacgccuggcuaauuuuuuuguauuuuuaguagagauaggauuucaccauguuggccaggcuggucuuaaacuccugaccucaggugauccaccuggcuuagccucccaaagugcugggauuacaggcgugagccacagugccugcucauccuguauuucuuauucguucuuccuaagccugcuuugaggcgguggcuguggcagcugcuuucccuccauucucuuccucguuuugugaggugcuggcucccaugugcuguauuggcaaccuugugauucugucugucauggagucuucauccaucugggaagccuguccagggcuccagcccucaacagugugguugguugcuguggugccugacaugauuuauagagcgacucugcucaguacaguagccacuagcacaggacuacuuagacuuacauuaauuaaaaugaaaugaaaaagaaaagaacucaguucaucagucacaguagccacauagcauucaagugcuuaaucgucauuauuugacuagugacuacuguaucucacagcacagaauuauagaguauuuccaucaacacagaaaguucuacuggacagggcugucacagagaguagauuaaauuaaauuaucugugggcuccauguacugaaaggucacuguggacauucaugugucugcugaucgcuagccuccccagaggcaggcaauguggcuaaugcaugauuuauauuccuggaugccuuuugaaucauguuucagggaaaggugcuuuugagugcaguuucaagggcucaugggucuugucccaccucuugauagcuuugugaccuuugccuaugaauuaaccucuuagggccucaguguccucaucugugaaaaugugauacugugaauuguucuuacgauaaggaucacacacguagacccauguaaagugguuaggccacuuuaguuuguuuggcacuugguuguuacuauuccugccuacagucagacugcuggacuuuaaauucuguuucauaagauaugggaagcgaugaaagcuuguugaaaauuuggggcuauguuaccuuaugauggaaacauugucacucauuauaauaguuaaauaagagccuggcacagugguucaugucuguaaucccagcacuuggggaggcugagguaggcagaucacuugaggucaggaguucaagaccagccuggccaacauggcaaaacccgucucuacugaaaauacgaaaaaaugagccauuugugguggugcauaccuguaauuccagcuacucaggaggcugaggcaggagaauugcuugagccgggaggcagagauugcagugagccaagauugcacuacugcauuccagccugggugacagagugagacucugucucaagaaaagguuaaauaagguugguuaaaagacauuucauggacugguuaaucuacucaggagaaauaaaaugggagaaauaggauuuaucuaagauuacaauuacgauaaauguauacaguuuuaugagaaugauaaaaaguaagauuuuuauuaaaauucauguuaagagcuaguuucuuugaguauacuuuuuauaauaauuuuaaauuuauuguuuguuuuaauaguauggaaccaccccuuuaguuugggcugcacgaaagggucauuuggaaugugugaaacauuuauuggccaugggagcugauguggaucaagaaggagcuguaaguaucuuauauuuuaaugcuuggcaauagaaacauguuuuuuauuuuaagagagagaauuuauuucuuuaguguaugccuagagaaauuucccucuaguucuaaaaugauaguaacaggaaaacaagcauuuccuguuacucuaagaauguuauauuauaaacauauauacuauaaauagaugcuuuuaaggaucuguugcuaaugcacacacaacuggggaggcuaaaaguauaaagaauagcuuucagugauccuagugugauauauagagaguuaugugucgcuuaaugacagggauacguucuaagaaaugugucaucggugauuuugccauugugggaacaucauagagugcacuuacacacaucuggcugguauagccuacuccguuccuaggcucuaugguauggccuguugcuucuaggccugugcaguguguuaccguacugaauacugcaggcaguugggagacaaugguauuucuuuaucuaaacauaccuaaacacagaaaaaguacaaugaaaguccaguaucauaaucuuauggaacuuaugucauauaugccaucugucauuaaucaaaaugugcugugcauauuuugguuuuuguccgugguuccuggcugacugcuccuauaaccuguguaauuucauaagugacuacagcaauaagaguaucuuugguuauauuuggccuuuuguccuggguucuugaaacagcucuggaucaguuccagagugauaaagaugaaauauagucuuuuguuacuuaucauaagccccuuuuaaccacacuugagcuuauguuaaugagguuauuuuuggaaaguuucuagauaaccccacugguugaggugcugguugccagggacaccaaccaugugcucagaggguuggaacucacagcccuaacccaccaccucuggggaggggagaggagcuaaagauugcauugaucaucauugaccaaugauuuaauaaaucaugccuucauaaugaagcccacauaaaaacccaaaaggacugaguucagggggcuuccaggaagauggccaagaacacauccccguacugggaggguggcauagcgcagcuccauggggacagaagcuccugugcucaggacccuuucagaccucauccuauguguaucuucaucugccugcucauuucuauccuuuaaaauaucccuuauggaaacugguaaauaguacuucccugaacugugugaacugcucuagcaaaucaaucaaagccaaggaggggguugugggagcuccaauuuacagccagucagacaaccugagcuuucauuggcaugggaagcgggggcagucuugggcaccgaacacuugccuguggggucugaugcuaccuccagguagguagugucagaauugaguuggagaauacccagcuggugucugcugcagaauugauugcuugauggauguggaaaaaccccacacaucuggucauagaaguauuuaguguuguaagaauuuaugugaaauggaguuuguuuuuuccuauacguaguacaaauuguuuaauaaacuguucaaaucaaaugguuuuuaauauuggggaaaacauugugcugcauuaaaauauuuuucuuauaaaauuuaaaguaauauuguaauuuuugggauauuuuuagcugugccuuauuuucccucuucaaugaacagauuuuuaaaaaucagaaaucagcugucagaagccagaaagcuuaaaaacugguuagauacaucuuacugauuagcaauuuuuaauuccucauuccccagccugugccaguuguguuggagaggugaagaagccugauaucacuuuucccuugagccuauaagaauaugguuaaaagaaacaauauuuaugcauaagaaacaguuaaaauaauacagacugcuauuuauagaauuaguauguuacaugaguggaucauaaaggauucugagaagagacaguaccagaucuugggucauagugaaacaagaguaaacucuuuaugucauacuuuuuggcacacuaucaaccaguuccuccuguuugcauacuggcaggagcugacucauugcaaaccuucaaggcguaggcccuguuuuugugcugguggaggcagcauaguccguaggcagcugcagaugacauaccuuccaccugccuccucuggacaguuggucaagugaacaaguggcuuguuucugugaugauugauggcucaagaauuugaaaaggcuguguuauuuuaauaugugggagaaugacagcucaauuuugggggcugacccaaaauauuucuauagggaaauuguaugacagcuugaaguagaugaacaucucaagaagcaguuuuaauacuacuucugguagugagucacauucuucucuuaguugauuuauuguuuguuuauuuagagacagagucucauauguugccuaggcuggucuugaacuccuggccucaaaugauccuccugccuuggccuccuuaagcuuugggauuauaggugugggucaucguaccuggccugauuuauuguuauaaaauagaugugcaauuuuuaaaagaauuacuuaaaauaagacagguuuugaaaauguaguuucuagguuacuaugaaagccaaacaguauauuacacuuuucuugaaauagcucauggcuauuaauucauuguuuacuuuaguguuuuuuauggguuuuauuauaaagaauucuugaagucugauucaccugacuuuggauuauuuaauuuagaauguguuuauauauaaacacauucuauauagguguuaaaauagucacccugccaacuauuuuauccuucauuacugaguuaguuuauuguaaaugaguccaauuucagauuaucauuuaaauaacugaacuucauaauagcucuaaugacugaagaucauuaauguauuuucaaaaacaaaagauaccuccuagccauuuuugguauguuucuugcuauuuauuuuggcauuuuacuauuggaaaugacaauaauaggccaccuauuugaaaacauuaguuuuaugauuauggcauaaaucauauauuuucuagaauacauuaauuucuugggcuugcguuuuguuuuguuuuuguuguuguuguuuuuagaauucaaugacugcacuuauuguggcagugaaaggagguuacacacagucaguaaaagaaauuuugaagaggaauccaaauguaaacuuaacagauaaagauggaaauacagcuuugaugauugcaucaaaggagggacauacggagauugugcaggaucugcucgacgcuggaacauaugugaacauaccugacaggguaggucaucuauuucacauuugucuccuaguggugaaguggaugaaaggugaccuuagugucuuauuaccuuucaagauucucaugcaugacauaaacuuguuuuaaaauaaguuuauuucugccuuugaaacuaguaaguuaaaaacuguucaauaguucugaaaaauguccuuuuuaauuuuugucaaauaauguuguuauugaaaaugucacaugugcuauuagucugugacugaccuugaugugucacuguaggugugcuuucuugugcccuaacuucuuugagcucacacuuacugauccaccucuaccugaacgcuccacuugaaugucuaauuggccucuuaaacuuacaauaaaacagaugccuugcuuuuuucaccccaaaccugcuuucccucauucuccaucucagcaagugguaccaucauucagccucuuguugaagccccaaauccugugcauuagccuugauuucucucuuuuccucaucugcccuccagcaggcuuuguugacuuuacuccaaaacaaauccuuuaucuguccacuugucuucauuccacuaucacuucccagcugaagccacugucucugguggugcuacugucaaagcaguagcuuugcaacuggguucuccacucugaucuuggagugaucuuuaaaacaauaaaucucguguguacuucuuuguuuaaagucauccaagacuuccuguugcacugaggaugaauguuaucuuuuuaguuauagacaugacaugacauugucuuugcccaaccucucuccccacuuuguaccccucuucugccaguuuucauagccugcagccauguuugcuucuuucccuuucuugaaugcacugagcuuguuccugcuguggggccuuugcagcagcugugcucuuagucuggaaugcugaucuuggcuccuucuugucauucucaccucagcuucaagguuuccuccucgggaaggucuucaacuacuuaauccgaaguaguuacgugaucacuuuuuuugagacaggguguuauucuguuacccaggcuggagugcaguggugugaucacagcucacuguggccucaacuuccuagacucaagcgauccuccuugccuuagccucccaaguagcugggacuacaggugcaugccaccacgccuggcuaauucuuguuuuguuuugagagacagggucucacuauguugaccaggcuggucucgaacuccuggccucaagugauuucuccugccuuggccucuuaaaguggugagauuacaggcauaagccaucaugcccugccuaccugguagucacuuucuagaacauuaccuuauuuuauuugcauaguguuuguaugauuuuuuguuuauuguauguugucuucucugccaggcuguaaauucuuccagagguaggaccgcgucugucuuguuuccuaguaccuagaaugguggauggcacauuuaagaaguuuacuagucugcacccauguuaaugccaauguucccaacuaaaauuugucugccuuugguuuauuucugcuauaaaugugguaguuaacacacuacagcauggugcugaacuuaauaacccuuaaggaccugcauccugauuuauuucauaguacuuuuaagguccacucaggauugaauugagcugcagcccaugggcucauucaacacaaaagacuacaacugauuuuuaaguuagcaguaaauaauaaaauauuuaugcccauuuccaaaauagcuguuuccaguauuuuaaguauagguagauauaacuaaaaaugauugcugcuuggugaauauaguuucaggggagagcaauguccucaugagguugugaacuuagucuuaugcuggggaaugagucagucuuaauguacuacuggccuguaacugucaaauccacuagguuuucauggaugcugcucggggaacuuucucccuuaauugaauguggcuguagauucacugauaguuuuagcuuuauagcuccguuuuuuuagaauucauggcuuucgucauauagcauuauuccaagauauuuuuacuauaugauuuuaaaauguucauuugguucauugacagccacaacgucauuguauuuaauuuacauuuguaauaggcgguuaccuucaaagagaauagauuauuguucuggguaacuggucuuucuaaacuuuguuuaggaauuucagaguccucauuuuggggcauaaaguccucugucccuuacucugauaucuguuaauaucagauauucauauuaguuaaguaacauuuuucucuuauuuagagguagacuuuuuccaagaaauuuuuagaaaaaaauaugaaaacaugauuaacuguaacuuaaaaagagugcuuauuuguugucaauuuaccuuguuuuuguuuuuauuuucugucuucuuagaguggggauacuguguugauuggcgcugucagagguggucauguugaaauuguucgagcgcuucuccaaaaauaugcugauauagacauuagaggacagguaugugugauuacagugcaguugcuaucuuagaguauaauugcauguaaguguugacugaucauaauguuauucuucccacuuuccuauggagauaaacuuguaaacccuaguacauuuaacagacguauauuauuacuaaguuucacugccauuauuguaaaauuucuauauuaaugucgaguuaaauguagauagagguaaaccaaaaaagcucauguuuuuagaauauacuguccuuacuaauggguauauauagauucaauccucagaacuauaaugaguaguuagugauacugagagagucggugacacuuugaauaucugguacuuauuuauuuuuuuuaguguuuucucccuguuuugucuucuuccuccaucugcuguucuucuacuguuguuguuuuauuuucuucucccuuuuccccacugugccugccuuuccuaggaccacuugguagugccuauggacauugcuuaaggcaaucauaguucauagaaccacaaagauuauuaauuuuagauaaaagccuugcccacaguugugaauuuaucaaauacuucaagagcuuuagacuuuagaaaaaguucuuggcgucuucauuuuguuguuggacagucuacauuucugcucaguuuuuucuuguauuuggccaaaaaucucuuguaucaaaauccauuuuugaaucaaacuauaacuauuaugccaaauguuaugggggaauuaacaugggccccuugucuuuaagacacauguauuuuaauuugagagauuuuaguuuguuuauuuuuaugcuuuuaacauaaaaagugaagccacaagaugguauaugauugauugccuagcaaaagguucaaguaugagucuugagguagggaaagaaggccuuaaggucuggggcuuuuggaagaagguagaacuugagcuaaguuugaagaugaguuggauuuagguaggugaagagccuggccggguugcugaugccuguaaucccagcacuuuggggaggcugaggugggaagaucccuugagcccaggaguuugagguuauagugagcugugacugugccauugcacucuagccugggugacagaguaagaccuugucucuuaaaaaaaaaaaaauagaaaaggaaagcuggguguuucaggcaaggggaguuguaauaggaugagaaaauuagagaaaauuagaaagugaaagaccgcauuucauagcuagugaaugaaucauuuggcauugggcagugggaugguaggcauggugguggggaugguggggagagguggagaaaugaaaugggaggcggguagggccugggaaguuugaguugggcagcuaguguacauuuuuuagaagagaaacuguugaggaaauuuugguauuaggaacuuaauguggcugcugcaaaagucauucauuaucuccuggguuaaaaucacauugccacuaaagauggguucuaggccaccuacuuggacuuuuaccuaacuuccuugcgucugugaguccucuucuguguuugaguucguuuuuuuguuguucucuagcucuacuuucaaggucuguguggauugauuuuuggguuuugagcuagauaagauuuuaaagaucugaucaaggcaguuauagggguaugggauggauggaaauuaagaaagcuaaaaaugauaaugccuuauauuugugaaguacauuuucgugcauuaucuuuugaaaaauugggcaauacuuacagcauguuacagaugaaaaucuaagggucagaauagccaagugacaugucugaguuuacaggguucagguacugaugacuccuaacccaguguguguuccugaaaucugauuacauuacaaaaguguaguuuauuaacuaugugggauugcuacuuuuuagguuaaguaauacgaaguuuuccuaggcuucuuucacaaagaauuucucaaaaguaacuccaagauagcauaaggauuaauaguauuuccuaccaugcugccuguuggaaugcuuucugacagaaauguuuuguauuuauaaguagcaguuuuaaauauuguaucuuacaugaagugauuguguuuuuuuuaauuaucuaggauaauaaaacugcuuuguauugggcuguugagaaaggaaaugcaacaauggugagagauaucuuacagugcaauccugacacugaaauaugcacaaagguauaaauggcauuucuauucuguuagcagcaccuuaugcugaauguuaguacugcucauuuuauuucagucgucuuuguuugauguuagaguuacacugauuuuacugguaauauucucuaucacauugaggaguaacuuuguauccuuucaggauuuguguauucauagcaaaauacaguguguuguuacuucaauuaaauacuucucaggaagugcaauaucagccauucauaaauuguuauuauuuggacagcucaucucucccaaauucauuuaugccacuguuaucugaacacauuccuuuguggggagauggcgugugcucaggaguuccaggccagccugggcaauauagugagacccugucucuuuaaaugaauacauaaauaaccaugugacuggugguugguuccccagacuagcuacuuucaacuguuuuacucaaauuguguaaaaaauaaaaaauuaucuaauacuguggucuccuauuuagcguauguguaaucauuuucuauggggaaaauauauuuggaauucuggguugauauggcaggaauucuuaaugaauaaagcaaaauuauagagucauccauaagacaauccuaugucaucugcuguagaucaggaccggccaauuucuaaaucagugaugguacuuccaguaccccaggauagaaaauuucugagauaccuucugguuugcagguggcuccuuaauccucuuuuuucuuuuucuuuuggaccuuggugucagccagggugacuaccuguggcuucugaccagauuuuugucuaacucagugcugaauuguggucucuucuuguuucccuuccuuugguuuugaaagcaaucaugaacucuuuugagguuuucugaaggcauacugcuuguuucaaaugguuucacugagaauugaagugauguugguauacauuucugaaaaacucuggacacuggcuuaccuggacguugacaggcugggcuguggguuggucgguggggagaacgggaaguagccucuggaggggagcugccccaggucagugguagaaccugggguagggcagaagcagccacugcugccggcuguagcuuacgagcagcuggggcaggucccacaccuggcuacgugauuuacagucacuuugauacaaaugaguggguguaaaggaaaagcauuuuuuuguuguuagcuuuuauguuuucuugagaggguuuuaaauauaggcuguuaccagagucagauauuucuugacaugugcauuuguaugacauaaacacaggagucaagcuauuaaucuggcaaauguucuuauuugugcccacaggauggugaaacgccacuuauaaaggcuaccaagaugagaaacauugaagugguggagcugcugcuagauaaaggugcuaaagugucugcuguagauaagguaaaacaucugugcggagagaacacuguauggaaagcuguuggucgacugaccucuauauggaguggauuuaauggggaucugauuuuagguuguguggggagagaugacuugcuggggaugucugugugggcuuuggaucccacacaguagugugcugaggagugggugggcucagugugcuauuaacgcagcugcuuccgacuuuccuucuacggcucacagcagcuguggggcacugccauugacuaccacaucaggaggaggcucugccuucaucaggguagagcuugcugcagauaaacaggaggaaagaaugcacaggggcuggaggaggccgaugcucagagcagacgguguuaauguucacugacaggagucaauguguuuguucugccgcguguccuugcuauaauccuuucagaggaauuuuuauauuuucuauaauaaguuuagcucuaaguggcuucauacuucauauagauuugauuuuucauuuuaguuucuuuuuauuuuaaacaagcuuauuucuuucuguacuuuaaauugguuuucccccaggauagaagugaacugauguauaaaguaaaaaauaauauuguaaauuuucuccucugaugaaugauaugguuugggcuuuacuaauuaauaauagauugaaguuuguuuuucuauuaguuauaaggcaguuaaacaaaaacagggagucacgagucaauguguuuauguuucauuuugccauguuacaacauuauuuuaaaacauaaaagcaccuccccccugucauuaccauguuaacaugucauaucaaagaaaggaaacuuuaauauuaaaaacuagaagacauaaaaagucaaagaagaguuuucaaaauggaauauauguagcuuucuagaaaacuucuuauaaugccuguuuuucucaaucugccauugacucaucugacacuggucccccaauuugcgauacagaaccaccagacuguauccuucaagguuccauauagccuuguuaauuauauaauaugcuaucuuaaguaauugcuuuauacucauuaauaaguuuccugaaggccucugccuugguauucuuuuguguguugcugugcccagagucagcacaugauacuuguugacaaauacacaugauaguugcaacaguuguucauucaugaacacauucuuacugaggacggguaaagugcuauccugcuagaauuugggauacaaacuuuuaaaagucuugaaccuggaucuucauagagaauuucauaaaaacaauuuuaaaagugacgauuaauguuauuuuuaccuugcccgucacugcucucugauuauuuucagccugucagcaaaguaugcuaauauccucccugcauuuauaggaauuuuguaucuggcagaaaugcugcugcuacuguuuugucuucucacaggucuggggaugagaauuggaauugagaugggaaaauaagaugaaauuggguuuggauauguuuaguuugagggcugauaagacauucaggagccuguggccaguagacauugggaaaucuaguacuggaaucugggcaagaaaucaaggcuggugauggaaauuuggcaauuaguuacuaggauagagaguugcaugggagcgacuaagaugaucggugugaagaaagaugaaagcugaagucaaaauggacucuuaugcugugugucauacugcaguuuuuaaauugugcauguuuauccagucucuuccuauuacgacauaagcuacuuaaggucagcaacuauuuugucuuacaucuuuauauccuccaaaguacgaagcacagagccuuacauauagugagucuggugcauaguuaugcuaccacauuuuuuaggacaugagaggagagucuagaagaugaaaaguucaagauaaggucgugccuuggaagccacaggaagaauguguaggucauuuucauuuaguguccuggagaucaguguggaugagaacugagaauuuaauuugucaagguguuugugaaguaaucaauaggagagcacuuugcagcccgaagaggacuuuugaaauuuacauguuagcuuucauuaguguuggaugugagcacuaaugugauuggagaugcuaauaaggagagaagguggguugauagggaaaagugaaaggugaggagaguggaaaggugaggagaauggaagaggagaggagagagucggaggaggauagguguacauagaggacucagguggagaauguagagugaugagauuuaaggguucacuguggcaaaugguugacaaaggucauggagcugacaagaucacuuguguuagauggcuguccgcauggauuguaacgcuuucuagacaaaugaagaaagcugugaaauagaauuuaaauuaguugaggaagguaguugacauccuuggacaauaaauauuuggaugauggagggauacuaaugaaguggacccauggccuaggaggagcugcagggagaaagccuguugcuucuccucuuucacugaguuaagaaaaggggaaaagaaugaccuucauucuagagggcugugggagaaacaguaucugagcaaagcuggaugaggagcuacagaaggauauuauggggaagauagagauaaaaauucauauuauauaugugcuuuauaugaaaaauaagaaaaguucagauuuuguuauuuuacagaaacaugaaaauuguuacugucugcauacuauauauaaagauaagaaaguucaaguuucguacuauuauuuuacagaaaggagauacucccuugcauauugcuauucguggaaggagccggaaacuggcagaacugcuuuuaagaaaucccaaagaugggcgauuacuuuauaggcccaacaaagcaggcgagacuccuuauaauauugacuguagccaucagaagaguauuuuaacucaaauauuuggagccaguaaguauugaguuuugcuccuaacugagcuuuuaaauaaucaauguuccauuaaagaauauggaaaauaaggccaggcaugguggcucaugccuguaaucccagcacuugaggaggccgaggugggaggauugcuugaccccaggaguuugagacaagccugggcaguauagugagaccucaucuccacaaaaagauuaaaaaauuagcugagcgugguggugugcuuguaguccuagcuucuugggaggcugaggugggaggaucucuugagccagggagauggagauugcagugagccaagaucacaccacugcacugggucucacucuguugcccaggcuggaguacagugaugcaaucauagcucacugcaaccucaaauuccugggcuuaagcgaugcucccaccucagccuccugaguacuuggaacuacaggcccaugcuaccacacccagcugauuuuuuuucuuuuuuuguagagacgaggucuugccauguucccuagucuggggcugagugauccucccaccuuggccucccaaagugcugggauuacagacaugagccacugugccuggccaugauucuauuuuuuuaugacuuuuuguauuuuaaaauauuuuuucuuauuauaauaguaaugugcacuaauuacauuucaagaaugaaaacaugaguauagcagaaagugaaaauuccccauuacccccuauaucccaacuuguaauuguuuaaaugacccuccaggcuuuucuuuaugcuuauaaaaauguuacauacuauguauauaguuuuaaaaaauaaaaauugaguuauaauauguuacaaaagcuuaaagugucauauuuuaauuauugcauaauuuuucguacauugaguucgcuauuggugaauauuuaguuuguuuugcuaacaacuagugcugcagugaacaccuuuguacguauauccauugacucuuauuuuuaggauuuuuuuucuuucuuuugaaaauauuauuagagauucaggggguacaauuaggauuauuuucuuaggguaaauucccagaaguagaauugccaagucaguggaugcccauaguuuugauagacuuuccaaaaugguuguaaaaauuucuucucccucuggcaguguaagauaccacaauuccccacaagcuugcuagcacuggguauuuccagccucuuacucuuugcuaaucagauaaauaagaaaagaaaaucucauuucaauuuguguuuuaaaauuauuagugaaauugagaucuuguaauauauucauaggcuauugcuucucagccuuuuggcuuagauaauguguaauauguucauaggcuauuuguauucuugccaguuuccuuuuuguauccuuugcccacuuuuuaguuuuuaauauuuuaaaaaaauugauguaagagucuuucuguguuauggauauugauccugggucuaucccaugugcugcauuccucucccccggcauacucuugguugauggucauggauuuuuauuccucauucaaaaguuuuacauuuuuguaguuuauucauuagucuuuuccugcaguucuggccuuaguauuacauugcaaaagaaaggccuuuuuaaacaaagauuuuuaaaguuuuuccuauauuuccuucuaguacuucuaugguuuuacuuuuuucuacuuaauuuuuuaauguuucagaaaauuuuguugaggcuaugagguauauagcauuuuaauuuaauuuuuucaugaaugauuaaacuuucccaacaccacuuacuaauucauccuuuccugccuuauuugaaaugccacuuauguuaauauccuauaugaguuccagaauguucaaauuauuguuuuacauuuuuauucuucuccaguggcaacuacccuucaguagucuuuaauuuuuuuuucuauucuuacacauucuucuuuccuuucaauuaaaacaaaauucucauggauuuuaauuagaacugccuuaaagugauagaauaauuugggagaauugcugaaccuuucuuccuggaaucauaaaauguuucuuuuucuauuauuaucuauuauguucuucaguaacauuuuacaacuuucuuuguauagguauuacacguacuaaauuuauuuuauaugcuuauuuguguuaaucauauuuuaucgauucuaaaaugcacaauguucccauaauuuaacaucucugaaauuggaaugugucuuguaagugauggacaagaaagcaugaugucacaauuuggcaacauuuuguucuuucuuaguuauacauaaaaaugauguaucauauaauuaauaaguaucaaguucuaugaaauaugauaguaauuuaagaauaucugaaacuuuuuaugaaauacgauaguaauuuaagaaucucugaauuuuaaaucagguagccuuccaagucagaauaggcucagagacucccugaaacugucccuacauggguauaaacauuugaaauaauuuuuuucucucuaaucaaggaaacaaugaaaauaguguucauuucuaauaguaaugccacuguuuaauguaagauaugauguguuuuaauuacaggacacuugucuccuacugaaacagacggugacaugcuuggauaugauuuauauagcagugcccuggcagauauucucagugagccuaccaugcagccacccauuugugugggguuauaugcacaguggggaagugggaaaucuuucuuacucaagaaacuagaagguaaagggcuugcuuguacaaagucuguauauauaaagcaagguuuucucuggggauuuuucugaaauaaagaggaagaccacuuucuguauaagcauguguguuaugugguuuacugagaugaacuccccucugguugguccuucacacggucauuugaguucucuuucuaaagcagauccaauugugugauaaccccacauaaaacccuugcuggcaaguuuuuuucgggcccuucacagacuugucaauuugcauggucccaccugccagcaccaccucuggcaugugccccagcuucagucacagaggacuguuugcucuugcaagaacagaccagauguguuucccagguugcucccucuauuagcagcuccuuaguggccucacuaccacccacccaacaugcaugccuuuugcuuggcaaaagcuuacuuauucuucaaggauagguuucaguauugccuauaaaauuuuccccaaguuuuguacaaagaauuacuugugugggacuccauugggcucaacaugcaccuuuaagaacaguauucucaaaugugauuggagggagaagggaugagaaggaucacaguggaaugguggugauauguaguuugaagauauaggguauaguuuuuauuuuugcauguggaaacaauaugcauaugcauaauauuuguuguuuguguuaaugcaaaccacaaaaaacaaaucucaagaaaaucuugacagaugggaguauaugagaagggguuuuguacauccuccacgugaagcaggagaggguggcgagucaggccuagcugugguccugggggugagauguucaucuuuggcaagagaacacuggguaaaaugguuaaguggcaguauuccaucuagggaccuacuaaguguccaauaaauguuuacauugaaaaugugaaaacugcauauugaguuaaaaguuguauuucuuaaacaaaacaggaauaagguuucguauuaaauucucuuucagacgaaaugaaaaccuucgccggacaacagauugagccucucuuucaguucucauggcucauaguguuucuuacccugcuacuuuguggagggcuugguuuauuguuugccuucacgguccacccaaaucuuggaauagcagugucacugagcuucuuggcucucuuauauauauucuuuaguaagucuuugcuuuuuaucuuuuucaaaaauggagaaaacguuaagauucauagauaaagaaaaaacauuuucuuuaucugucuuuuaaaaccuguaugugauuuucauaauugggugagaaaauugaucuuuuugcuacuccauaaauuuuccuaaaggaacauugcucacaacuuggcugaaguagcuuauaaacuaauguacuacuuguuaaucuugaagcaagaaccuauauuauuauacuuacucuuuuuguuaauuaaugauuuauauuuaaaucuuuuucugggccgggugcgguggcucucacgccuguaaucccagcacuuugggagcccaaggcgggcagaucguaaggucaggagaucgagaccauccuggcugacauggugaaaccccgucucuacuaaauauacaaaaaaauuagccgggcaagauggcgggcgccuguagucccagcuacucgggaggcugaggcaggagaauggcgugaaccugggagggggagguugcagugagccgagauggcgccacugcucuccagccugggcaacagagcgagacuccaucucaaaaaaaaaaaaaaaaaaaaaauucuuuuucugaaaagaaggcuucaaagccaucauugguaugcucuugagcauuuugaccaugucuguacuuuuaauuuuaucuaaaagcaaaauaaaaaaaauauaauauaaucccuauucuugggggugucuucaguugcaagaaaggaaauagauuuacuguuagaggaacugauaaccaacuucaccaguugcgaauagugauaaacccaagaugauuugcauuugaaucugaacugcaguuauguuucuguuuaaggcauguuuuagucaguuuacuuuucauuuuucauaucuucuguaucuuaggggagguuaauggaauucuuugaggaguaguuaggaaauaguaugggaccauaggaagcuauguaagcuuagcucucauuacuugauacuugaucuuuggagaaaagaucugcuugacuagugacugcuuuggauaacuuuuuuaaacugugaauuucaguugucauuuacuuugguggacgaagagaaggagagaguuggaauugggccuggguccucagcacuagauuggcaagacauauuggauauuuggaacuccuccuuaaauugauguuugugaauccaccugaguugccagagcagacuacuaaagcuuuaccugugaggugaguuguaccauuugacagaagaaaucuucaaugagauucagaaaaaaauauuuuucacuucggaaaguuuauaggagccgggugugguggcucacgcuuguaaucccagcacuuugggaggccaaggugggcagaucaccugaggucaggaguucgagaccagccuggccaacauggugaaaccccaucucuacuaaaaauacaaaauuagcgggggcgucauggcgcaugccuguaguccuagcuacuuggaaggaugaagcaggagaaucgcuugaaccugggaggcagagguugcagugagccaggaucgcgccauugcacuccagccugggcgacaagaacgaaacucugucucaaaaaaaaaaaaaaguuuauagaauauaauuucucaauguauguuccaaaaaacauuggaaccuuuuacauacagaaauaaaaacaugcccuggucaaauaccgugggaaacacuucagauuauauaucccuccuguacguuaaaggaucagaggcaccuuuccauaaagaaaccuguuuaacuuuuauuuaccaaauuuuauuuaagcauaaaccuuuucucccuguuaugucaccuguuaccaucuuuuggaacacacuuugaagagagcacuggauggaggagggguccagccacuggccuugguccccagagagcuucccgcuggagaccuggcccuuccuuaugugagcgguuaaccuggggaaacccagcuccccucucugagcugugcuuuucucagcucaggaaauauauucacaugucugucuaaaauuauuauucauauuaaguaggaaauuuaugagaaaaaagaaaagaugaaaaauguuuaaguccaggaauaaaggaaagguagagggcuccagaggacagugaaaugaaaaaaaaaaaaagcuagaaaguuaaaagcaaaagaaauucaauggaaguaagcaauguaagaauuuaaaauguauuaagccagaugugguggcucacaccuguaaucccagcacugugggaggccaaaguggucaauugcuugagcucaggaguucaaaacaagccuggguaaaggcaaaaccccaucucuacaaaaaauagaaaaauuagcugggugugguggugcgugccuguaguucuagcugcuugggaggcugaagugggaggacugcuuaagcuucggggguugaggguacagugagccaagaucacgccaccgcacugcagccuaggugacaaagugagacccugcucaaaaaaaaaaagcauuaaaagaugaaaauuuuuuaguuauaagaaaaaauaaguguaauuuaagaugaaaauaaauaagccaaaccagguaaaauauuaaaacugaguauaagagaaaaauaaagguaaaaacuuuuaaguaacuagcauagagaauuaaguauuaagaaaaggauuuaaaagugaaaaaguuaaaaggaaaacagaauaaaauaauugggggaauauuuuuacagaaaauaaggaaaccagucuaaauuaaugaggugguauuuuuuuuuuucaguuagaacaauuaaaguagcaucgucaagaccacacaguauauuacagauuguauucugagagcaaugcuuaucuacuggacugagaugagaguuuaauuuagagauggaagggagaaaggaacuaacagaaauaauaaugauucagagacucugaauacaaauaauucacuuaauuuugaagaucaauugugaagagaauauuuuacaacuauuucucaaucccugguagacguggaagcuauaaauaaaauaagccaugcuaaaacuugaguuuuuaaaugguauuacugggcuugaaauucuuuaaugacuguaauuaauauuuuuucaggguuagagucucuuucguugguguuagaaaacuuucuugugcaacucuugguggccacaucaugacacgugugucaccuuuuaaccacuaugucgugagaucuguuggggugucuugauacuccacaucuaaguucuggcguaacuuucccccgccuguccuuagucagaauuacuuuauauggcccugcacauuucacuuuuguuacuguuuuuuccuaagaaaaguauguaagauuuuagaaguggaagcuaccuaauuacaaauucuuuucccuccuuggaauuuaaaaaacaauauuuugaaagagacaaaaagaaaauaaaggguaagugaugcaaagaugacauacauugaaguuauuuguuacuuuagauaauaaaguaauguuugauuuguucuuuucuucaagguuuuuguuuacagauuacaauagacuguccaguguagguggagaaacuucucuggcugaaaugauugcaacccucucggaugcuugugaaagagaguuuggcuuuuuggcaaccaggcuuuuucgaguauucaagacugaagauacucaggguaggauuuccuuccuuccuucuuuguguguaagggaugggggugggauagauguucaguuuauuuucaugaaaacacaccuugaacauuagacucaucagguauugugacuauaauguuaggauuuucuagauccuugauauguuaauuauuaaaaccauuuguugcauuacagguaaaaagaaauggaaaaaaacauguugucucccaucuuuugucaucuuccuuuuuaucauuggcugcauuauaucuggaauuacucuucuggcuauauuuagaguugacccaaagcaucugacuguaaaugcuguccucauaucaaucgcaucuguagugggauuggccuuuguguugaacugucguacaugguggcaagugcuggacucgcuccugaauucccaaagaaaacgccuccauaaugcagccuccaaacugcacaaauugaaaagugaaggauucaugaaaguaagcacucauugguuauuagaaaaaauuguaaugcgaauauguugccacugccaugcucauuugggcuuuaggaaguacacucucuaaauguuaaaguguugcauuuauuuuaguuuaauuuguucauucauucauucguucauucaagacuauaauuuaagguaguuuuaaguucacgguaaaauuuagagggaagugcaaagauaucccauauacccacuucccccacacauacacagccuccccaauuggcacgauuacccaccagagcaguacauuuguuacaauugaugaacuuaggcugacacaucauaaucacccagcauccauaguuuacaguaggguucacucuuggugugguacauucugugggcuuggacaaauguauaacauguauccaccauuauagucuuauacagaguagauuuauugcccucaaaaucuucugugcuucaccucuucacaccuguucaccccucccuccacccuccucccuaaccccuggcuaccauuucuuuuuacuaucgccauaguuuugcccuuuccagaaugucauauaguugaaucauacauguguagucuuuucagauuggcuucuuucacguagucauaugcauuuaagugcccuucaugucuuuucaugaccugcuagcucauuucuuuuuagcauggcuaaugugccauugucuggauauaucacaguucauuuauacauuuaucuacugaaggacaucuuuauugcuuccaaguuuuggcaaguaugaauaaagcugcuauaaacuuuuguggacaggcuuuugugugaacauaaaggauuugaaaacuccuuuggguaaauaccaaggagugugauugcuagauuguaugauguuucguuuuguuagaaacaaccagacuguucugagguggcuauuuugcauucccaccagaaaugaaugaggcuccuguugcuccacaucacauccucaccagcauuugguauuauugguguucuggauuuuggccauucuguuaggugugcagugguaucuuauuguuugaauuugcauuucccugauuacacauguuguggagcauauuuucaugugcuuauuugcuaucuguaugucuucuuuggugaauuggcugugaaggucuuggcuuauuuuucagucagguuguucauuuucuuauuguugaguuuuaagaguucuuuguguauuuuggcuaaugguccuuuaucagauaagcuuuuugcaaauauuuugcuccauucuuuugguugcuuuucauucucuugacagugucuuuugcagagcagacauuuuugaugaagucuagcuuacuaauucuuucuuucauggaucuugcuuuuaguguccuaucuaaaaaguuaacaccaaaccuacggucaccuagauuuuauccucugucauuuucuagguguuuuauacuuuugcauuuaggucugugagcuauuuugaguuaauuuuugugaagugugaaugugucuagauucuuuucuugcuugcuuucuugcuuccuugcuucuuuucuuuuuuuuuuuuuguuuccaguuguuccagcaccauuuguuaaaaacgcuauuucuugcauuguauugccuuugccgcuugucaaagaucaauugacuauauuuguguaggucuguuucugggcucuuucucuuugucuguucguuugcgcauaccacacuguuugauuacucuagcucuauuuucuugaaguuggguagugucaguccuccuauuuuguucuccuccuucaauacuguguuggcuauucugggucuuuuucuccucauaugaacuuuugauucaccuugaauaacuugcugggauuuucauugagauugcguuaaaucuuuaggucaaguauugagucuuccuacccaugaacauggaauaucuccucauuuauuuaguucuuccuugauuucuuucaagaguuuugugguuuuucucauauagaucuuauacauauuuuguuagauuuauaccuauuucguuuuuugcaguguuaauauauauaguaauuguguucuuaauuucauguuugacgcugauauauaggaaagugaucaacuuuuguauuaaucugaaaucuugcuauaauuguuuguuagucccaggaguuuuuuuucauugugguucuuucgguuuuucuacauagagagucaagucaucugugaacuaagacaguuuucuuucuuucuucccagucuucauaccuuuuauuuccuuuuuguuuguuuguuuuauugcauuaguuaggacuugcaguacuauguugaaaaggagugguaagaaaagggacaaucuugccucguuccugaucuuaguagauguuuucauguucucaccauuaaguaugauguuaacuacagauacucuuuaucaaguugaagaaguuccucucuauuucuaguuuacugagaguuucuaccauaaaugguguuggauuuugucaaaugcuuuugcuuuaucuaauuaugcaaucaugugaucuuucuucuuuagccuguuucuuuuuuuuuuuuugagacggaguuuuacucuuguugcccaggcuggagugcaguggugccaucucagcucacuacaaccuccaccuuacggguucaagugauucuccugccucagccucccaaguaggugagauuacaggcaugcaacagcaugcccagcuaauuuuguauuuuuaguagagacggaguuucaccguguugaucaggcuggucuugaacuccugaccucaggugauccacccucccuccucggccucccaaagugcugggauuacaggcaugagccauugugcccagccuagucuguugaagugauggauuacauuaauugauuuuugaauguggaaccggcccuaccuaccuggcauaaaucucacuugauugugguguauaauucuuuuuauacauuuugcauaugauuuucuaauauuuuguugagguuuuuugcaucuaugcucaugagauauuuauugguuuguaguuugcuuuucuugucaagacuucgucugcuuuggguauuagggugaugcugacuucauagcaugaguuaggaagcauucccuuugcuucugucuucugaaagauccuauguagaguugguauaauuucuucuguaagugcuugguagacuucauuagugaacccucugggccuggugcuuucuguuuugaaaaauuauuauugaugcaauuucuucaauagauauaggccuguucuugugaauuuuggcaaauuaugucuuugaaagaacuggucuguuuaucuaaguuaucaaauuugugggcauagaguuguuuguaguaucccuuuauuauccuauuuuuguccaugagguaggucuaaagugguagccucucuuuuauuuguuguuuuucugaauuuguguuuccucuucuuucaucuuaguuaguccaaggcuuauugauuguguuuaucuuuugaacuaacuagcuuuugguuucauuguuuuauuucuguuuuaguuuuuauuauuucuuuucuucugauuacuuuggauuuaauuugcucuuuuucuaguuuccugagguggaagcuuagauuauuaauuuuauuuuauuuuuauuuauuuauuuuuugagacagagucucacucuguugcccaggcuguagugcaguggugcgaucccagcuugcugcaaucucugccuccugggcucaagggauccucccaccucagccugccgaguagcugggaccacaggcuacacgccaccacaccuggcuaauuuuuguagauauaggguuucaccauguuccccacacuggucucgaacuccugagcucaagcgauccacccaccuuggccucccaaagugcugggauuauaggcaugagccacugcacccagccagauuacugauuuuauaucuuucuucuuuacgaauauaugcauucagugcuauaaauuuucuucucagcuguucuuuuguugcgucccacaaauuuugauaaguuguguuuccauuuuuauuuaguucaaaauauuuuaaaauuucucuugagacuuuuuucuuugacccauguguuauuuggaaguguguuuuuaaaucucugcauguuuugggauuuuccaauuaucguucuguuuuugacuucuaguuuaauuccacugaggggaagacauuguaugcaugauuucuauuuuaaauuuguuauggcguguuuuauggcucagaaugugguccaucuuggugaaugcuuuaugugaguuugaaaagaauguguauucuguuuuuuuuucuuuuuuuggaugaaauaaguguaggugucaguuauagccaguugauugaugguguuguugagcugaacugcguccuuacugguuuucugacugcugcaucuguccuuauagaaugguauugaggucucaagcuaugauaguggauuuaucuauuucuucuugcaguucugucagcuuuugucuuacauauuuugauucuccuuucuuagauauauaaauguuuaggauuauuaugucuccuuagagaaucagcuccuuuguuguuauguaaugccccccuuuaauauauauauauuauauauauauaauaauuaauauaguuacucccccucucuuuugauugguguugguauagcuuucuccauucauuuacuuuuaaucuacgugugucuuuuuauguaagguggguuucuuguagauaacauacaauuagcucuuauuuuuugaucaucucugacaucucuuuuaauugauaucuuuagaacacugacgcucaaagggauaauugguuuugauggauuaauaucuaucguauuuguuacuguuuucuauuuguugcuugauuuuuguuccuauuuuugucuucuacucuucuuuuugucuuuuaugcuuuuauugagcauuuuuuuaugauuccauuuucucaccuuucuuagcauaucaguuguacuuuuuuuuaaacuguuuuuuuugagugguugcccuaggguuugcaauaugcauuuauaacuaauccaagcccacuuucaaguaauacuauaucacuucucagguaguuuaucuuauaauagcaaaauaauccuaauuccucucucccgucccuuguaucauuguuguuacuaauuucauuuacauuuauaagcauacauaauauguacauuauacacacacacacacaccccccaccacacacacacacacacacacagacacacacacacauauauaagcuuacguaaucaaggaguggccacuuccaaaguguuuacauauauguagaaccagaaaccagcaguccuuuuauuuauuuugaguucuauuccagauuuuuccaguggaaauacauauuuggagugagaaacaucauaacaguagcauguuuuuauaaaauagacuuuuauaaguuauucaaaagaguuagcaacuacugucuaauaauauaaguuccucuagagcccaguaaagauaucuguuuuuaaaaauagcaaauugaaccaccaaaauaaauaauacaggauuuucuuuuucaaagugaaaggucagaugccaucagggagccagcagcaguguagugcuuugaucauuuggauuugcauccagaucugaaucuuuucacauucagagccucuaaucuuggcaaguuagucacucaacccaguuuguucuuuuuagaacagauaugguagugucuaucccacagugucauucugaggaucagcugcuguaauuuauguguagucacuugguaaauugugaagcacucgcucuuauuuuaaguggaagcacaacuggcagcaaggacuuugaaugucuucuguuccuauuagaugacuuucuaucacgcuuucuaagaaauauguuuaagcuucuuggaucuuccuucagugcuuucuauaccuuccuuugcaauacagguucuuaaaugugaaguggaauugauggccaggauggcaaaaaccauugacagcuucacucagaaucagacaaggcugguggucaucaucgauggauuagaugccugugagcaggacaaaguccuucagaugcuggacacuguacguuugcgccaccucaaaagccaccauuguuauguuguggcacuugagagaauguuugacuucacaaauaucuaaaaauagaacggaauugguuuuuguuugaguaguuccuauuuugugauuuuucuuuuguaaaaacaaccauucuuuauacagaaauguagcaagaauaaauguuuagucacaaagauauuuaaauaauuuuagcuuaguggcacugugagaaaaaugaauagagcaucuguauucaugaauguuucucaugugcauugauuuaccucuuuagcagacuguaaaugucugaaagaaggacaauauuaauuuucuuugcagguuuuaucuaugucagaugacaacaaaccuagauugagcugucaguaaaauuugcuuuugugcagaguaaguuuugaugaaaagaaauaguaguuuagaaauauugucaccaaaagguagcacauauuuugaagagaugccuuauucuuuuggacaauuuaaaauguaugucacaacuguacauuucuucugccacagguccgaguucuguuuucaaaaggcccguucauugccauuuuugcaagugauccacauauuaucauaaaggcaauuaaccagaaccucaauagugugcuucgggauucaaauauaaauggccaugacuacaugcgcaacauaguccacuugccuguguuccuuaauagucguggacuaagcaaugcaagaaaauuucucguaacuucagcaacaaauggagacguuccaugcucagauacuacagguaaagcucaggcuccuaaaguacuuugaguuugaaauaguuuuguaguuucuuuauggcgacucuccuuuuuaccuugaaaaauauuguuguuguuucacauuucuuuaaauaucauauacaacagaauuuugguguaagugaugcugucuugauaaauuauuuaagggauacaggaagaugcugacagaagaguuucacagaacagccuuggggagaugacaaaacuugguagcaagacagcccucaauagacggguaagaugccauuggcuucgagcuguauguuuguauugcuauucaauuuaauacaaauaaagaugaugccacuuaaauaauacuuuguaaauauugcauuaaacgcuucaaauaaacauuaucauugaauuuccuuucagcuucauguguuucagggaaugucugcaccuagaacccuaacaacuguacuucguauaggggucccaaccuguucucagcccaggugcugcuccugaucccugggaucuuaaagcuugccaaaugauuucauccaggguugagaaccacucuauucauuccuggucagguugagcuaugccuguugccaccauagcaguaggggagaaagguuuguagugugagaaaacuccuggcuuugucuuccuguuggccagccuucccuaaaugcuugugggacgcucacucuuuuuucucuaccacauaguaauuuguguccuucccagccacuggggguuucuccaaaacauugguugucccugaccuccccaucuuauuuguauggaacaagggcaugugcuguguauaugucuguaugcauaugacaggaagauauucacuugcagggcaguugugacagugccacucacacucagugaaguugggcuaguauuggcauuauguuuuuuucugguuugcuaccauuaaguuuggaugucuuacuuuuuaaaaaaaugucuucagugacauuuugauuuuaugccucuacccuuuacagauauggaugcaaaguuaauaugaugaaugacaguugacagcacuaaauucagaggcgcauauaacuuaccauuuuuaauuucuugccuggcaaccuugggugccccaugguugcauccauccuucccuugcaucgggaccuuagacaagagcacaccuugguuguaccuguucccccuuuuaugagauggaauuccuuuagcccacccacccugaagagugccuuuuguucauguggcgaugugaggauaguuagagaggcugucccuuaguuuucacauacuuuaaaauaaccuaaacaucaggccaggugcagugcucaugcuuguaauccuagcacuuugggaggauuaaguggaaggaucacuugagaccaggaguucaagaccagcccgggcaacauagugacacccucuacauaaaauagaaauaaacacauuagcuggaugugguggugcaugccuguagucccagcuacucagaaggcugaggugggaggauugcccaagcccagaacauccagguugcagcgagcuaugauugccuuacuguacuccagccuggguggcagagagagacccugucuaacaauaauaauaaccuaaaaaucaaaaugcugaauccuuaaaaccagacaagggcuuauuugcuuuauuacuuaaggguuucuauaaauagccagaccccauggaguuugaauaucauucucuuuacacaauucugccuacuuauaaucuuaaaagcauugagcuuccucuaacuguaccacuguaacuuaaaaugcaucugaagcuaaaccauagcauuucaugcaguugcugugaauaugacuuuacaauugcuuuacgaagauucuaccucacagauaauaauuuauuacuguaugauauuccucuuugacuaaaacuuuggauuuuuuuuuuguuauaaacauuuauuaacaucucaaaaagccuuaaguucuuagacuggacgcguggguuccuucucacugacgacgugcuguuucaggacacuuaccgaagaaggcagaugcagaggaccaucacucgccagauguccuuugaucuuacaaaacugcugguuaccgaggacugguucagugacaucaguccccagaccaugagaagauuacuuaauauuguuucugugacaggugacuuuugucucuuauugucuaugauaguuaauaagcuuuagcauucacaaaaccauuuaauuucagaaacaaagguauguauuguguguauauguuuacauugcugaauacuggcuuuauuuguauuaagugcacuuagugaagucaguuuuaguuuugacaaugaaaagucaacugauauuaucaacugucggcuguauaccauuauuuuaaaacuuuauuauuuaaaaaaucuuuugcuucaaguuuuucuuucacuauaaagauaauuuuauucugauuuguauuacugaguauaagcuuauaauuuaaaauguugagauucagauguuauaugcuuuuuuuuuaauuuucauauauuuugaauaaaaaauauugacaauaaaauugaggauuauugcccugugccugaagucccugcauggaauucugccuugugaauuccuccuugcucauagcuucagggcaaccacauaaauacuuguaauuuaguuuguaaaauauaugucucuuugcaggguauugguugguacuuuguaauauuuacuaguguuaacucuauuaugauaguuauacuagaauuguguuuaauauuguugggguucaugcugugaacuguauuccaagugagguuguaucuaauauacuuacaauauuuuugguacuuaaguuccuuuaagugaguucucaagccucacuguauuuauguucaacaaugggaauguuuuaguauguuaucaacauauauguauucauuuaucaaauguguagcgagugucugccuuaugucagguaacauuucugggcauuguggagauaagcagugaacaagauaaagucucugcccuaguagagaaaaccaaaagauauaacgucacagaaugaugugugucaugaaaacaagacuguaaacaggagauggccuucccucucacucgaaaauuacucccaucaacacacagauuguugcucccuucccaagaaaagcugcucuugacuguaccucugccucuagcuacuaccccauuucucagcaaagcuccucaaaagacuugucugucccugugucucauauuaaucucccucuguuuucucuaacuuauuccaauaaucucuugcucucaguucaguaaaauugcauuuucaaggucaccaauggcuuccauguuauaaaauucaguggccaggccagugcucaucuuauuugaccccauuagugguguuugacaguguguugaucacucuuccucuuugaaaaauuuuccuccuuuggcuuccagaaugccacaccgacuggauuuccuccuuuugcgcuggugguuagccuucaucucccuuugccauuuagcauuggaaugcccuugguugcguuucuuggaguucuccuuuucuaucuagaccugcuaccuuggcgaccgcauuuacucugaaaggcuuaaaugccaucuauaugccagugacucucaaauauguaucuucagcccuauagcucuucaguugcuuguuugacaucuaauggugucaauauauaucugacacauaauauguccacaauugaauguuugauucucugacucaaacuucauccauccaugucuuuccuaucuauuaauccaacucuuuuccaguuccuuaaguaagaaaaucuugaucuuucuuucauauacuaccaccaaucuacuaguaaauucuguagcacuguuuucagucuauuuccagaagaugagcacuguucgccauuuucuggcauaccacccucaucagauacauuaucauguucuaccuuuauuaauuauggaaauagucuaacuggucucuacuccugucuuuuucucucuacagccuauucuccauacggcaaccacagugauucuuuuaaaauagaagccagucauguuauucucugcucagaacucuguaauguguccucauuucacugaaaacaaaaaucuaaguccuuauaguuuccuacaaagcccuuuaugaucugauuuucugcauccccuuccuccuucugaccucaucucccaccauucuccuccuccaucccuuacugacuucuuugcuguuccuugaaaaugucagauaugcucccaucaaaaggcuccuccugcaauugcuauuucuucugccuguacagauuguucuuuggauauaugcaucaugggguuucucacuuccuuuuaagucuuugcuuaaaugucagcuuuucuacaagaucuucccucaccaucucguauaaaaugacaucuucuuugguaugcuuugcguuaccuguucccugcuuuguuuuacucaacagaaaaaaucaccucuaauucacuacaucauuuacuuuuuuguuuguuuguuucuuugguuuuuguuuguuuccccucaguagaauuuaaaauccaccuggcaaagguuuucuaucuaucuuucuuuccuucuuuuuuuuuuuuuuuuugagacagagucucacccugucucccaggcuggagugcaguggcaugaucucggcucacugcaaccuccgccuucgggguuuaagugauucuccugccccagccucccgaguagcugggauuacaggcaugugccaccacgcccggcuaauuuuuguauuuuuaguagagaugggguuucuccauuuuggucaggcuggucuugaacuccugauccgcccgccucggccucccaaagugcugggauuacaggcaugagccacuaugcccggcauucuaucugucuuucuuauuguuguuuucucaguacccagaacaaugucuaggacacuguuguuaaaugacuaagagaccugaaugaagugggaacugaguuuuauaucugucuugagaaaagcaucuuaacaggaggaagagcaagugugaaggcucugggguggaauuccagcaacagcuggaggccagugugguugcacuuuggggaucaaaagagaauagugggaaguaugucaaagaacuagccacuggcugggcgcaccggcucaccccucuaaucucagcacuuugggaggcugaggcagguggaucaccugagcucaggaguucaagaccagccuggccaacaugaugaaaccccgucuuuacgaacaauacaaaaauuagcaggcgugguggcucacaccuguaaucccagcuacucaggaggcuggggcaggagaauugcuugaacccaggaggcagaguuugcagugagcugagauugugccacugcgcuccagccugagugacagagugagacuccaucuuaaaaaaaaaaaaaagaaaaaaucuagccccuggguaguucacuuugaggcuuacaggccccaaauccauaggaaggauuuuggauuauauuuagacauuuucagacacucuaaagaggaccaaauuaacaucauuuaauaguugauacugagauacacauuuuuaaaauaaugauguuuacacauuucagaauagaaagaaaauaucuuccuaaagccacauuucaaauguacgaauuucucuaauauuauucugacuauacaguagacuuuccaauuguuaaaucagagauauuugucuuuuaugucucaucaaauauaacucugccuaugaaaaauuucuaaguaaaauuuucauuuuauaaaagccccuaacaccauuaguuucauugccuaaaagugcuauguugaaaaauaacuuacagguuuaaaucuguguguuuaaugaaauuuugauuucuuuuuuugugauguuuuccauuucauugaguaacauuaguuggaaguguguagggaaauauauuuuauuggaaaggauagaauuugaaggcaaaagacuuggguuugagucacgggcauguuacuucuuagccucuugaauccccauuucccauguaugcaaaaguguauguuacccgcccaacaccaugcaaauaguugcuauuaggaaagucauucaauagagagauuaauaucagaaaagaauuugagguuuuaguagauaaauauugauaaguauuuaguugagugguuuccuaauuaaaaauugugcuguaucaaauguacuuuauuucaaauuuguuuuauuggauuauuuuggaagauaagauuaaaaaauuaucuuagacauauucguuguucagaauuuucuuuugauauugcuuucuuuuuagcuaauuauaggcuagauauauucuuaggauagaauauuuauuuuuauucacucauuauaggcuagauauauucuuaggauagaauauuuacuuuuauuaacucaugcuuuuuuuuguuuuuuuucgagauagucucgcucuguccuccaggcuggagugcgguggugugaucuuggcucacuguaaccuccaucuuccagguucaagugauucuccugccucagccucucgaguagcugggacugcaggugccugccaccacgcucggcuaauuuuuauauuuucaguagaggcgggguuucaccauguuggccaggcuggucuugaacuccugaccucaaaugguccucccaccucugccucccaaagugcugggauuacaggugugagccaccacaccuggccuauucacucauacuuuuaaaauaguuuuccaguucucucugucuaccgguuccuucaugacuuugcaugcaugcauggugcauuugcuguuccuuuugucugaauguccucacucugcuucccuugucucugccagcccgugccuucccaccagacuaacuuggguucauccuucaucgcuuaguucuagugguuaguuacauucuuuuuuuuuugucuuuuucuuuuuaguaguuauauucuuaaggaaaucuucccuuaacugccgcuucuaaauuuggugcucauuuucucuuuucacacagcacuguguguauaucuccagcauagccaugucuccaucaaugcucacaucucaccuuccagggaagaggaauccagccaugaaaauauaauuucuguguaugagcagauuugcugaggaagugagggccuggugauauaggaagaauuggauuggggcuuauauaucuauauguauaucuauaucuaucuauauaucuauauguauauaucuguuaguaguagggaaaggaauaacucauauuggaacuaaaacaaauagguaucuuagucuacauacaaacaaaauagauaaugaugaaguaaaauugacaauguuugaaaauuuaacaacaguaucagcagcucagaauuucuaccaaaucauggugaaacaugauacaaugaaacaaggcauccguucugaaaguuugaggauugcgacugucuacauguacacaagccuagugguagaacagcaaaucagaguccucagaaaaucccagcaauagacaggguuguuuuaaaauacguaaauaauaaauauuagaaacauuacaacucaguugguagguuacuuacauagaccacccuuaguaugugaaaaugaaagccugugggauugcccauucaucuauacuacaacgagaauggacuggcauauuuggaucuguuuauaguccaucaauaggaucucagcagauggcacuuuagaggauugggguccauugugggugaauggauguucugcucaaugaucguggguggcguugaacugugugacacaguucugaaagauguuugccugcauauacguggucgaagaaguauaucucaccaguggcaaaucaaacaaccaaaaaauugcuuuagaauuaaaauuguguuuaagcccuaaaagcuuuacuuaaugcagcucuuuggauuuuagaagccauggcaguacuagauuugaauuuguaguauaaauuaaaugguaaauuuuagaaauuuaaaauauuugugaauauacuaaauguuuuacuuaacauacuaucacacaucuauuaauuuuuaaaugcuuuuguauuuuuuaaaaggacgauuacugagagccaaucagauuaguuucaacugggacaggcuugcuagcuggaucaaccuuacugagcaguggccauaccggacuucauggcucauauuauauuuggaagagacugaagguauuccagaucaaaugacauuaaaaaccaucuacgaaagguaccuuuugugaccucuuuguauuuuacuuuauuuuagguugaguuaaaaaaaaaaaaaaaacgcguauaaagcagacaauacaaaauaauauguauaaaauguauacuccuggauuuaaucauucuuauuaauuccauuauaauuuuggaguuguauuagcacagguauauauccugucauguaaaaucuaugacuuuauuuggacaaacuuuuccuuuuucagguauauaaaguuuauuuaaaauuuuaaaaaauuuuuuagaaacaggaucucucucugucacccggguuggagcacaguggcacaaucauagcucacuguagccucaaacuccuggacucaagucauccucccaucucagccucccaaguagcuaggacuguaggcgugcaccaggacuccuggcucuuucuuuuuauuuuuuuguagaggcggggacuugcaguguugcccaggcuggucuuaaacuccugggcucaagcauuucuccugucuuggccucccaaagugcugggauuacaggcgugaaacacugugcccagccuuaguguauaguuuauauacacuucuaagauuucagauaacuuuuauuuccuuagaguauugucaguauaugguuuuccuauuuuucuaguuccuauuuuuuauguacacauuuaauguuuucuaaguaaauaacugguuuuagaauuauagauguuguuguauuaguccacagauuugagcucuucuagguuuugcuguuuaauuuauaugaaaguaguuuagugguuuaaaccugugugcuguaucaaguagguguuccaguagaugcagugauguauaauuacugucugccuauugagaagugguacugaauugcaucuggucuuugagguuuuacaaaucaucuuauugugagaugcaugauucguuuuucucuugguucuguaguacaauauuuuauuguacauacaagguuuuauuucgugaauaaacguuuguauuauaauacaagugcuguauaauuaugaacguuugcuaagcgguuaaaacuuaaguuuuaaaaauauuuaagugccucguaauaauucauaccaauauaaugagguuuauuuuucgcauguuauauuuauacauaaagcccuauuuaauguaaacagguaaucccuugacacucucaucuauccucaagauuguuguuguuaucauuuguguguaaauaaaaaugugucauaaaaaagaauaagccuucguuuaggaacuguggagugaugucuuaagaaacaguaguggaaggaauuuguggcugcuuuagauucuuagacccugucugaauugguuuaggaguaguauauuacuccaggaauguauuucuagauuucaagaaauuuguaaacuugggcacaggagaacuaguuaucucacauggguccuugcuuaaggaggucgagucacuuaguguuacugaccuccuuccuucacgucagguacuuugcuaggugccuuauguauucuugcacuuuggaaagugcagagguguuagguggggauagaaugagggaugugaacuuugcuuugccauuaaaccaacucauuacuuuaaacuucggcauuuggcaggcuugccaucuaugacugggcuggauuuggggugauuuugagaugcuuuucuucucuuccuggugaaauagguauauuuaagucuuaaaugccugcaacuacuuacaaagaauauuucguagcuagucuaaggaagagaaaaaauauaguaagcaaucauugauaauucguaugaauugacuuaaaauaauuauauauaauaaggauuuggaaugaaaaacuauaggaagacacuuugauuaacauauuggaaagccagauauuaaaguaugugagaauaaucuagaugauuauguuucuaguuaacuguaguugaguucuuugaugcuauugcuugucauuugaauaagagaaaguuuuauuuacagccgacaaaaagcagcaguauguaauugauauucauuuguuguacuaaagaaauaugauuugguaaaaacaaucagaaaauaguauuuuuaacgcuaguaguaaaauuuauuuuuuuaaugcauaaaaagccucguuuauuuuuauagcaauuugaugacacaucugcuggcuuuauucaggugaaaaagaaaauguugguucuugguguuuggugaaauuguuaaauuauuuucuaaauuguucaacuuuuaacaaaugacauuugauacuaacacuggaaagcaauuucagcgaauuaaauagaccccucuguaaaccacgggaacauuaagaugacacacuguucauucaagaugguuuuaauugguacaauuauuguaauuuucuugcaauuauguguugaguugaaagcuuuugucuggaucauuugagaguuuuuuuuuuuuuuaacauacauuuaguaagaaagggaguaaaauaaaaacuaaaaauuuuuugucuaguuuuuauugcagcauuuuagacaaccauugaaauauuuuaaucuaaaacuuuauuucuggcauuuaaagcagaaugauagugguuuuuaaaaaaaugaauuuaaguaguuuucaugaagauagugcuuuaaauuucuguuuugacacugcucagucaaucuuuuacccaggccaugauauggucagaauaaguuugugauaaggauaacaacauucuuuauuuugguacuuuauuuugauguuuaaagaacaguugaauaaguucuaagggugcuucagaauaguagccauuuuccauuucauugaaguagcaauuugcuguacagacaauauggacaucuaauuuaugacuuuaauagaccuguuauuuuuaaauuauucaaguaauguuauuucuauacauuauuuaggacauucucauaauaaaacaucauauuuuaugauaaccucuccugauauucacccaaagcuuucauaagcuucauuuuaucacauguagucaucucauaccucuuguagcucucacuaaccugcuugcucucuccaucauuuucugggugaugaucagcucuccuucccucucuuccccgccaucauuuggccuggauuauugcacaagcuuguuucuuuugcauguggacuuaaguuaugaauguggauagcaugaaaaauuuaacauuaguuaguuuagaggaaguuguugcuucaccuccuuuguaguacaaaguccauccuuuguacugauaauuuuucucuuuaguuuuugagauacuagcaauauuuauuccaaaaacuguuuaaugcaugcuauuuugguguuuuuuauauauagcuuagaaucuucaugaaauucuuuguuuuugauauaugacuuauuuguagguauugguguugucaucauucaaaauuuauuaaauuacuaucuuuuauauaauuauuguuuccaucuuuauucucaaaacacacuugcuuugaccgcagagguucaauauuuuauccauaucuuuaucuuuuuaaagauaaagccugaucuaguuauuuguaaaauuacaagauaauuccccauauaggagaggaaacuaagcagguuuuuacugaaauaaagauugugucaucuauaauagaaaucauguuuuaucuggacagaaauaaaugacauuuguauauuugccaaguucagugugaagagugagccugcaaaccuuguauaaauauagccauaaucagauguaauguugaccauucaaugugcauuucuggcuuugcauuauuuuuauccaugucuuugugaaaauuggacaauugagauuucuaaagauaaaggugaagggcauaauuuuuuagcuuauuuugauguaucuuuaaaucaugccuacuuuuguuguguggagaaaacaaugaaaugcauuaaacugacguguuuggcuuuuuuuuaguuuaccuauuuguguauuuugcuacuuauuuauuuuguuguuguuacuagauuuccagcaacauccaaagaugugagagaaauuaaggggagaaagcuuaaaauucauucauuuauucagaaaacaguuauuggacaccuauuauggaccaggcacaguucugagagcuuggguguauccaugaacaaaaccagcaaagaucccugccccgaggagcuugcagucugucagagagugauggguaauaaacaacauauauaauacauaauuagcauguuaaaggcagcaagugugguggaaagaauaaaagguagaagagaguuaaggagaugaagaguagugcagguucugcauuaaguaaggggaucaggauuguccucauggagaagggaagaguugaggaaggguugaaggaggcaagacaguuuuccaggcagguaucugagaaagcauuuccaggcagagggaacaguuccgggccagagagcaccuggaaucaauguugaaggaacagcaacaagggagcugauguggugagauggggugcagugaagcaagugaguaggaggucaggucgggucaccagugggguucauggaccccuuuuggaggaccaugguaaggacuuuggcuuuuacccugaguaagauggggauucguugcagggucuugaaaaauguguggccauuacccugaugcuucagggccuauuugcuguaucagugcagcuuggccugaguuagggaagccuguugauucaagggagcuuguuuugagacucucacggugggaagggaauaggaaugaaccuggguggaaaaauuaagguaaaugaaaaguucagaaaguaauuggcuaucccacaguaaagaugaaaugauuaauagagucgggcaugguggaguacgccuguaaucccagcuacucgggaggcugagguaggaggaucacuugagccugggaguuggaggcugcagcgugccaugacugugccugugaauagcuaccacacuccagccugggugacuagugaaaccuugucuuuuaaagauaauaaaaguuggguuauagaaauagcacauuguggcauuuucuaugugagcuaggaaguaaauaaccucaccuacaguccuguugcaggguauugaaagaaaauuaguuauucuaaacaucugcaagaauuuauaagacuaauuucccuuugugucuccccugucgcaauacuuucuuguuucuuaggaucguuuuauucuuuauuuuuuaaugauggauuuauagccaacuuuuuguaucauuuaaaaaacugccuuccuuccuguuucuugccauggucuggcucucugauauacaaaccccugguugagagugaaugaaaggugauuuuuguggcauugaagacugcuagguguaggaaagauaucaugggcaggagagcaacuaaugaguugcuuuuagaauaauaaugauuuugacuuauagauaguauaaagugcaaaugauggucugugcauaucaaauugggcucuaaagacaaaaggauauaauuggucaaaaccuguauucaggcaccagguuucugcuggaguucgcaguguccucagccuggcuccggcuccuucucccucuuacuguuuacuuuucaugugcucuucucuuuggcccaucccaccuccuucuucuggucucaucuuaaauauuacugccuuaggaagccuuuuguuaccaagcccccccauccuucgaggcuuuauuagaugaguccuuuauguacuaguguguucuuucauaacacuggccauaguuaccuucuuauacauauuugcauugcuauuucuuuaauauuugucuccugaaugagacuauacacuucaugaacuguaacuuucuuaaacauugcugaauuuuuuugcuucuagacaagugaucaguauuuaggcaguaguggguauuucugaaagaauaaagaaaucugaugauaacuuuuggauugaggaaggcaugaauuggggaggugguagaugagaagccucacuuuaucuugaagagaauaccguccauccagauacuucauucuuuaggcuuaaauauggguaaaauguuucuuuuguuauauaccaguauaucccugggccggacacauaguagcuucucaguacacauugacugaaugaugacuguauauuucaccuaacacuuggcggcuucugccuuaugucaggugaugcuaaaaucacagcaauguuuuugaaggcauucccuguaacucugaguucagcugcauuucuaagguuucuuacauucauaauccauuuaugaaugccauggucugguggaguugcucuguguuuuuuaaaauuuuuauuucaauagcuuuuggaguacaagugguuuuuuguugcauggaugaauuauuuagugguguauucugagauuuagugcacccauuauccaaguaguguggauuguacccaauauguaguuuuuuuucccuagccuuccucccauccugucccuucugagucucuaaagucuauuauuuuauucuguaugccuuugcuuacucauaacuuggcucccacuuauaaguaagaacauaugguuguugguuuuccacucuuguuuuacuucacuuagaauaauggccucaagcuccauccaaguugcugcaaaauauguuauuuuguuccuuuuaauggcugaguaguauuccaugguguauauaaaccacauuuucuuuauccacucauuagucaguggguacuuagguugguuccacaucuuugcaauugugaauugugcugcuauaaacauauaugugcaagugucuuuuucauauaaugacucuuuucccuuuggguagauaccuagugaugggcuugcuggaucaaaugguggaucugcauuuagcucuuugaggaaaucuccauacuguuuuccauagagguuguacuaauuuacauucugguggaguugcuuuggauugacuacuucuagacagguuccucucacuucagagucuucuuagagacucaguuucuucuuagagacuuguugucagaauuguuuuuaaaaggccauguacuuagaugacuccaguucuguugugcuaaacauuuuaauuguguucauuuauuaaacaaauauuuauagaauuuauuauaugcagggcacagucuaauaaaaguaguagcuaauauauuaugugagcccucauucugucccaugcauuggauuaagcacuuuaccuagcuuaucacauuuaaugcagguugcauaucccuaaucugaaaaucugaaaucugaaaugcccccaaaucugaaacugagugccgacgugauguucaaaggaaaugcucacuggagcauuugggauuuuggauuuuuggauuagggaugcucagcugguacugccgaaacucccaaaucugaaacacuucuagucccaagcauuucagauaaggaauacucaaccuguacuucuaacccuaagaggcagagagcaggaguuaccuaagaccucacagcuguaacugcgcuuccccaagucuguuucuuggggccaggagccuguccucuguagcugccagcuaggcagugggucugagauaccagaaauauagaacuaaauauuuuaauuuccagauagauuuuaacuuuucauugauauaucuaugaguauuuagaauaacuuauuaggguaucaaugggaauguuauagcagauagaaauuuuucugcaguguugaauuuaucuuuucuguugaaaaacgcgaacaacuuagcaacauauaaaaucucaaauaaaugcuuuauuuaguucuaauugugucuaguaacugugcuagguuuuguguggaaagcuuuaaaaaaucacuucugauauuuagcacuuaaacaucugguacaucuguuuguuuaagccuuuauaccauuucuaugucuacuauauggcuauaauuuuuuuuagguaacuuuuucaauagguuuucuuuucuuuucuucuuuuuuguuuuucuuugagauggggucucgcucugucgcccagccuggagugcaguggcgcgaucucggcucacugcaagcuccgccuccuggguucacgccauucuccugccucagccuccugaguaacugggacuacaggcgcccaccaccaugcccggcuaauuuuuuuuguauuuuuaauagagacgggguuucacuguguuagccaggauggucucgaucuccugaccucgugaucuacccgccucagccucccaaagugcugggauuacaggcaugagccaccgugcccagccaauagguuuucuuuuacuuuugauuuugaauguauuuucucagacuuuacucucauaaugccauuuucaguguuuaaugcaaacguagaaugaagaaaaaauauuaaguguuccaaagucauguguuucuaacgucaacaugaaaaacucagguauauuaacccagaucuucauuauccaaaacccuuauuguacgaguuaucuuaaaagauuuaacauugaaaaaguauauagaacauuccaaaguucuacaguguuuggaauuguuggaaacuaauaccaaagacaauuucuugaaauauauguuuuaauauguaagaaauacauguuuaauauguaaaaaaaauuauuacuugugcagguuuacaguuuauuuuauaauauaguaagagcauuauguauaguuauauuuuucaaacaagucugauuauuaaagaauucaauuuaccaaaaaaauuacauaugccuugacagaucaaguagccaacuuuuuccagaaguugauuuuuccaguaaagguuugugauuucagaauuucaaaucaaaauauuuaaagacuuuuuaaaauacaagaauaaacaaaagugauuuguaacaaaaaugcuagcuaauucaaaugcuaagaaaaugucuagcugcugguguaaaaccaugcugcagaaguggcuccuguuagcaauauucaaaaaguccacaagaugggagcauuucacuacaaacauuauuagcauguuuggccaaaaauaagauguaauacauuuugcuuuccccuuccauagaaaaacaagucagaauuuaaugaaagguugaauuuccuuuuuuguuguuguuaaaaaaaaaaauggcuucaggacauuuuucagcacugagaaucacgauccuaggcaaaugaauggguaucuauucauaugacauaguuuuuaaguguuguacuacuuuugucuccucaaauuaguuuaaauuaacuuuugggaaaauaguggcuaugaaaaaagaggagcauaaagaaaucgaucugcuuacaaauuugcauuuagauauaaaaauauuaaauccuaaacauuguagaacuucaguucuauacuuuuuaaacauuaaaucuuuuaagagaacuugcauaauaaagauuuugccuuaaucugaaacauauucauagaucuacuuugaguucagagccuccuuucucuaugccugucauucaguuuuauuaucaaacauuugcguucuauauaugauuaauguaauacacuuuuagauuucuuaaagacgacaauugcauggacaauucaucacuugguagcaacuuaugauauugcuagugaugccuaaaacagcuaugaaaauuugaucucauguacuuuugucggaacauuuuaaaauaucaaguauaaacucuugaugccaaaaagcaggcuuugcuuuuuaaugauagacacuauuuucacauggagucaguuaugaauuauuuugccucucuuaccacuuuacuaaagucuucucucauuacccuagcugaaaguauugcuuugucaccugaauuacuaauaucugauuacuugcaugguuguaacuggguaaauaucaugcaguaauacacuauuuuuuagacuuguacucccaguggaagccugucuccagaucuuaugcaaaaguccaauaaaugaagcagaauuaauacaaguuuauugauucaaauuauaacauuuccuaacaaauucaguuagugagaaaaaugagcuauucugaagaauauuaaaauuggagaauuguggacaacuguuacaauccuaaauugguuuaaacauuuauuuauuucucuaauuaguuuugggacuguaacauuaagaaaguccuaaaucaugaguagacagaaauguuaccgguguuuaaacuuucuuugugaugacaggauguuuucauuuaaucugaucuagaaacuugaaagauugauugggaauauuguuuuauaggugaaucaccaauaguaucuuggaguuguucacauuucuuauaauuauuugaaguguucucugcuucucugacuaggugaaagucaugucaugcaauuuuuaaaucauuuuuacagucuuugcucaggcuucuaggcuguuguguaguguacugguuugcauaauuuuguaaacaaaaaagugcugaucuggauucugaaaaaaugaugaaggaaauuaaauaugugcaugaagauggaggagaagcuuuauuucagucugcaaaaaacugaaacuaaaagaaaaacccaggaugacuuaugagcacagcuuauuuguugaucuucuucaauuuguuaaaauguaauauguaacagcauucuuuucuauuauaguuuuaaggaguuaaaaacguguaagucauuaccugagggauuuugagccaugucuguggcuccuguuugaacuggugcagugagcagucagcagcuuuugaagcagucaggagcagguacccgcucugcugcuaugucuguggugguguugcauccauugcuuaccucucugagccucaguuuccucauguuaaaaauggaaauaauaaauaccuuaugggaugcagagagagaaguuagauaaacuagguaaagcaccugccucagagaauggcagacaguagguauucagccacuucguucuucuuaaaauucccucucaauucuucauaacuuuuaaauauaguuucccuguuagaguuuauauaagaagagggauacagagccccuaaauguaccuuccucagaacauucgacgucguagacaugaaugaagacagugccuuaccaguauuguacuugaaccuaggcagauaccccuuuugaguuuuuaucuuuuacccucccugguuguugauuguuuuuucauccaucuaguugccagaauugcagccuuaaagccaaagagaguuuuuguauaugaugacauucuacugaguuuaaggguuuuuuuaauccuuuaaauuacaugcguacaaguuuccuuccuucauauaaaaacauaaucuugggcccugauguucuggccaaauaggucaucuuggagauauacacccucggugggaaauaguuuuuguuuaaugucgaguaaacucuucuaguaagugaaauaauaacuuuguuuagcucugccaaugguuuccagggcagcuuauacaagugcuuuuaugguuugcacuauuuaacccuaaucacaccguccuuaaacacauaagucaaacacauuagauacuugcaaaugucuucuuuuaaaccagaaauagacaaacacacuugaagaaggcaugccaugaugaucuauuuggccugcagaauauauaagcacuucguuguuuccuaguguaguuacucaauaagaugccuaaaaugcaaacuuacuuuuguagaccuugaaaagugagugucagugagaacaccuggcacuguucgcauuguugucuugagaauauucugugaccaccacacgagcauagaugccucuuuucucuucuggcaaguucuuuucucuguugagaguuguuguguacuuaaugcagucuucugcauguggacagcuucagcucuuaguacuuuuauuacuuuggcuguggcagacaaagugucuacuuucugacccccuaagcuaauguucuuuccaacaugguaggaaaggugacucauggaauaguuaugaaaauacuuuuacaagaauauuaggaaugauuaaaacuuaugggaugcagcaaaggcaguacucagagggaaauuuauggcuguaaaugcguacauuaaaaaaagagaaagauauuaaauuaacacccuaaccuaacaccucgaggagcuagaaaaagaagagcaaauuaaacuccaagcuagcagaaggaaggaaauaauaaagguuagaguggagagacauaaaacagagaacagaauaacaauagaaaaaaagcaaugaaaccagaaguauuuuccuugaaaauaccagcaaauugacagauccaguguggaaguccaggcucagaggcagauccaaaggccaaggugagcagaggugccucgaguuggaguugcugcugagaccaggaucuguuccugaggauuggugagggugaacagggcuuaaucaugguagauuuuucucaaguauuuuuuccaguguguuuggaaccugggaagugaggauuuuaauuuggggauuacauagacaggaaaaaccacaauuuuaugcagauuacagguuggaaaagucauuacuaacauuccuaucaucagauuuaauguugagacggcaacuuauaaaagccauacagggcugggcgcaguggcucacgccuguaaucccaguacuuuagcaggccgaugcaggcagaucaccugaggucaggaguucgagaccagccuggccagcauggugaaaccucgucucuacuaaaaauacaaaaauuagccaggcgugguggcuggugccugcacucccagcuacucaggaggcugaggcaggagaauugcuugaucccaggaggcagggguugcagugagccgagauugcaccacugcacuccagccugggcaacaagagugaaacuccaucuuaaaaacaaaaccaacaaagaaaacauacagaauuccaaguccaggauuuaggaggacagagccauacugaagauguuauuauucaaacacagaugcuguggagcagacaguugugaccgagaccgaauuggcauuuccaagucaguguuaguugccauguugauggagagcugagaaaagccauuuuaauggcauuugcaaauaagcaggacauggaacaggccaugacucccucagagaugcacauucacuuggguuaucugccucgaaggacugaaaauggcaaauauucaaaacuucagcaaccagagguacuggccuucaugagacaacggaauggguaguugaaacauuaaagagcaaacaacaguacagucacuucugcuccucugaaaugaagacggccucacauaucccuuuggaaacaaucaagugugcuucucaugacuaaagguuaaagcuguaagacuguuggcauuuacugaacugacugugacauuaguaauaaauauaaaaaauagauauuuaguugaaaggguaauucaucuugauugagccaauuguguucuauguuguaggacaugcugcuucccugcuuucuuaauguuaaguacacauuccauuuguaugggauuuuuauucaaauaguccuauuaaaguaugcacuuuuguugggaaaaaacaaacccuauuuuuugaacuaaugguugcaucuuguuuguauaaacacuaguaaauaucuuaacucuuuuuuuuuuccuaaaaugaauuugcaaagauuggacuaaauagaauagacuaggaaauaguguggguagcauagucuucauuuucuuaauugaucacuuuauauuaagcuguuuuguuuaaaagcuuuuggauguaggccugacauugagaucaucauuuuagugguuaacuuuacugacuuaucugcagcuaacaucguacuccguggugaaagacugaaauuaucccuccuaaguuaaaagaacaagacaaggaugccugcugcuauguacgaauguuuguguccugccaaaauuuucguguugaagcccaaacccccaguaugauauuauuuagaguuggugccuuugguaauuagguuuagaugaggucaugaggguggaauccucguaugggauuagugcccuccuaagaagaaaccagagagcuucucucucucucucuguaguguccuugaugucaggaccuaggaagaagaucauuugcaaaccaaaaagaaggcccuuaccagaaccugaccaucuggcacuuugaucucugacuuccagccuccagaacuucaagaaauaaaugucugcuauuuaagccacccagccuaugguauucuguuauagcagccugaguuaacuaagauacccacuuucaccacugcuauucaacauugcacuagaagcuguagccauugcaauuggacaggcaaaauaaauaaaagaauccagauuggaugauucuucuauauauagaaaaaucccaaagagcccacagaaagcuauuagagcuaauuaaucagcaaaguuugcaggauacagaucaacacacaaaaaucaguuguguuucuguacaccuucagugaacagucugaaaggaaauuaagaaggcaguucauuuuacaguagcaucuaaaagaauaaaauauuucagaauaacuuuaaccaagaaaguuaaagacuuguacacugacaacuuaaaaaaauugcuaaaagaauuuaaagaagaucuaaauaagugggaagacauccugugcucauggguaggaagacuaaauauuaggaugucaauacuaccugaagugaucuacagauucaauauuauaccuaucaaaauuccaguagccuuguuuugcagaaacaggaaacugauccuucaguucauaugcaauugcaagacaccucaaauaaccaagcaaccuugaaaaagaagaacaaaguuggaggacugacaccucucaauuucagacauacuacaaagcuacaguaaucaaaacaaugugucacaggcaugaggauggacauauagagcaauagaauauaauugagaaucaagaaaaacccauacaucuauguccaguuggguuuuggcaaggaugccaaguccauuugaugggggaaaggacagacucuucaacaaguggggcugggauaacuagauuuccacaugcaaaagaaugaaguuggaccccuaccccacaccauguacaaaauugacuccagauggaucaaccuaugcuuucccaagcacaagguuuugucaguaucagaaaggacaauuaaggugaaaauuauucuauuuuaaagggguagaguucuugaggaagaacaccuuugugugcauguguaguuuauuccuucuacaaauauuuauuggacaacaguguugcgacaguauucugugcaggccacuggagauacagugguggaaaaaacuaaacuuguucccaguuuuaauggaauuuccagucuagauugggagauaaacauuaagaaaguaauuccacuagugcagaauuaugauacauauuaugcaagaaaguauauaugcucugggggcuuguaaugaaggaacauaaguuggucuccaggaugcucucugaggagggggaaauugcaccgagcacaaaggauggguaggaauuaacagggugaagauggaaggguguagccagcuccugagguauccagggcuuuugccuuuucacagauggcaguggguguauaaauggacuccauuuuuucuuuguuucugacuuuuuggcugcaaugccaaguggcuguuuucugucuguguguucugucugucucccagaaucuccaaaguguucuguucauggaugguauuuaauaaauggacauucacugguagaaaguauuugagagucuauuagaaguuaaauuuguuucaaggcaauaaaauucuaaggcauuuaagaguuuucucuguuuaaauuuuuaaacaaauugugucuuauuuuuuaacauccuacuaaauaaugacauuauuaggcagcuacuuuuagauaaaaugugauaaauaauacuuucuucauaaauucugcucuaagaaucuguuuauauuuugauuuaaaauagaaaucuuuuauguaauuuaaaaccucauuuugaauggaagugauaugaauaguuuaugcaauuucugccaaggaauuaauauggacuuuguauaaaccacugucauuuauaaucaaaaugcuuuuaacuuacauugauguuggcauuaacaaguauugcuagauugguagcauagaaggaaauugcauuuagacuuacuaggagcucauugaugccugagguuuuauaaugcuuucuuugggccauuuaacugcuggcaacuuuaauucacaugauucauaaugcuggaaauucaaauucacucuuaacugaaaagugaaguuacuuaaauucuuuaaaugcuaaccuuuggaaaaauaucugaaaaauaaaggcacauaugauuuugauggcccacugccaaaagauuaucauuuacauaaauaucucuuucagcagaagaguuuaauguauugagcucagaagguuagaauagagacuucaaucuggaagccagcaguagccuguuggcuugugaacagcagcauuguucaucauacugagaacacuguugcauucaggcagaagcagagcuggcauuaaaaugcaguuaauuuguuucaugugacuugucagcuguguguuuuuaucuaaaucuuucuagcuucucuuuuuaguauuuuguguucaacuccugcaauagaugaacuaccuauuuaacuguuuaagcucugauuuuaucaccacuugcaaccauucuccagguuuuccauuucauuuuaaauauauuuaauaaucaguuugaacacgauuuuaauguauuaaaaguaaccccaucucagagggcuuuucugucuugugcaugugucugugucuguaaaacggacuuucugaaguuaauuaagagaaaauugcuacccuuauuuucuccccagcacccuauucucuucuuguuugcuaauuguguucucuggguuuuucccuuagaugacuuucaauauuuggcuacuagccaaguauugggucugagcaguaaagugcuagucccaaagaaaugauauaacuguuacuaacauuagaauaagguucccauuucacuuuuugaagggcgugaaaaucuuacugcuccucugcaacugugcucacuuaguauaaucuaacaguuaauauucuuguuuaauuggaaggauauauccagugauuuuuaaacaacuuuuggagguguaauugacauacaauaaacugccauauuuaaauugaccaaucucacgaguuugauaaauguauauacccacaaagucauuaccacaaucaagagaguaaauguuuccaucaguucuaaaauuuuccacgucuuccuuugauacccucccuugucucccuccugccucacauuccuaacuucacagcaaaccuugcucugcauugauacuuuagauugguuugcauuuucuaguuuuauacaaaugaaaacauauugcuauacacucuuuauugguuggauuaauuuauugagagauucauccauguucuuuguaucaguaguucauuuuuuuuuuggcugaguaguauuccguuguguggauauaccacuauuuauuuauccuuccaucuguuaguggacauuugauuuguuucuaguuuucucaucuaccucuugucuuuuaacuucucuuucuuuuucuuuccuuuaucccucggugaugcguucuugcuuacugccuuagaucaggaauugucaacauuugaccauuuuugaccuacaaaaacuacaguuucauacaguaguguuuaauaaguguuuuuaauugaauauuacuuauuuuuacauucaagagucucugcaugauacagaauuguuuacauauugcuugaacucaguuauacaaaacauucugcauaauaaaagacuaagugacauauuauauuaggagguauugugucugauugguuaaaguauguuuuuuccugucuguuuuucuaucuuacguauauacauauauaguaagcauauauuacuuuuacaauaggaaacaaaacccuuuuuaaaaaaggaaaaacuuagcuuuuuuuuaaucuguguaauuuauuuauaaguucuugauuucuuguuuucuuugcaaaggagaaacugugguauucuauuuaaaacauggguuucagaaccagucagauuugcuuucguaguugugugacuuugggccaucuguuuaauuugucugaggccacuguccucaucuguaaagcaauaacucaaugaaucuucauugaggggugacccuuagccagcuuaggugaccccgagcauaugacacaccugugcaugugcgucuuuccuucuguuuucccacccaaguccugccauggccaaaggcaguagaauucuggccguacucauuguuaccuuuuuuuguaaccauacuacuuuuuugaguuucuuucucuuuuauuaaaaaaaaaaauuuuuagacuggaugagguggcucaugccuguaaucccaauagggaggccaaggugaauggaaugcuugagcccagguguucaagagccuccugggcaacauggcgaaaucucgucuguauagaaaaauacaaaaauuagccaggcaugguggcaugagccuguagucuuagcuacccuggaggcugaggugggaggaaagcuugaguugggaggcagagguugcaaugagccaagacugcaccacugcacuccagccuggguggcagaacaagauucugucucaaaaaaaacccuaaaaauuaaaaauagauuuuuuggcugggcaugauggcucacaccuguaaucccagcacuuugggagacugagguggguggaucaacuuagaucaggaguucgagaccagccuggccaacauggugaaaccccgucucuacuaauaauacaaaaauuagcugggcaugguagugcacaccuguaaccucagccacuagguaggcugaggcaggagaaucgcuugaaccuggaggcagagguugcagugagccgauguguaauuagaccaaauccaucagaccaagauguguaauuguuguauaaguaacuucaggugacaugcagaauuuaccuuucuaauagugacauuaauaaccuuuuucauugauuucuuauuugaagaauaucaaagaauauuccaacaacuaaggauguugagccacuucuugaaauugauggagauauaagaaauuuugaaguguuuuugucuucaaggaccccaguucuuguggcucgagauguaaaagucuuuuugccaugcacuguaaaccuagaucccaaacuacgggaaauuauugcagguggguauuaguaguaaauuuaauuuuucaucuaaaguucuaagaauuuuucauguuucuaacuuauuuguguacauuucuccugcucuaugaaaaaccaagagguauugaacuaagcacuacacagaaaaauucaugaaauuaaagauuaggagucuuggcauccuuuugagaauguuaagaaaaacaaaaacaaaaaaaaaaaaaaagaaaauccuguuaguauuuguggaucucacuuuauuaugaucccuguccccaccccucccgcccccacccaaguccuuccuuuggaacuuuggaauuggauuucuuuuaacauacagucaugacuucaugauauccauucauuguaauuugcuugucaccagucuuugguucuuaacagggaucucuauccagagaaguaagaaaaucuuuauauuacuuuucagauauuaacuuaaaucuggggacuagagcuucaggguagugacauuaaggcuuuggaauaaaugaaguucuggagguaccacucugugcacgugcacacacauaaaaccuucauugaaacagucuuuuguaugacauggcucugcugaccugccuuugaguuuuccaggaacugugaggagaucgccuuaaacuacuucuguauucuauuuucuagguaccuguuacaaggcugaugucaaaggguauuacauggcuguggaauuuguuguuguucagagguggaugagucucauaauuugcaaacccacagucuuugcuaacauuauauguguuaauacccaacaaauaugaguuauuaauacuugauaacguuaugaauaaaaguaauuguuagaauaucuuaaauccuuuaagaguuagagaagagucaauuguuccaauaacugaagagaagaauccagauauuggugacuucgaauggugaaaaugcuuuuuugcaaaguagcugggcauuucucacuaaaaggccugugaguuuucaagauuuucugucuucuuuuuuaaucuaguuggaauccguggcaagagugauaaagucauguuucugccuaguaacuaaagaagaaugugauaauuggacugauuccuaauguccuguuuucucuugccuucuggggucugauugaaucuuucagauguucgugcugccagagagcagaucaguauuggaggacuggcguaccccccgcucccucuacaugaggguccuccuagggcgccaucaggguacagccagcccccauccgugugcucuuccacguccuucaaugggcccuucgcagguggaguggugucaccacagccucacagcagcuauuacagcggcaugacgggcccucagcaucccuucuacaacaggguaaggaaguuggaggcagcuuuauuuuuaagaauuuguuacagggaaaccucaguuuucugcuuguggauucuguuuugguuuuaaagcuguacuuuggcuuuagcauaggaaaaauguaaaguuugaauguaaaauauaggacuuuuuggaaaucaaaauaauuuagaauuuuaauguguucuaggucucaagagagucugaauauuagauuuuuuuuucuuuuauuuaguuucuugauaaguaaauggacuccacagggucagcagugacuguccuagcuucaaaggaaucuguuuuuuguuuguuuauaaacaaauguucuauuuguuauaucuuguauaauaguuuauauuggcauuuaaaacaaugauaaacuuaaauuccuauaguaguuuaguaaaccuauacuuaauauaccuuugucuuuuaaaugugagauaauaaugggaaaguacugcuguggaacucagauguuuuuccaaauaauagcacuguagcccauuuuuagagucuuaugucaaguuaucuucagucaucuacaauuuuuuaguuaauauaaauaggauaauuucccagaugaaaagaugaaaugcaacuaauuaucagugguauucaggcccugucaaguuuaguaggcccaagcuauauucucacuuuaaugaccucaaacacuaauauuuccuguaggaaaauggagcaugaaccugggguuacacuuucuggaacuguucucuuaaggugcauugcaauuucuuauuuuugcuaucucccucuuuagucuaauucgagaaaacauaggaccuaguuagucauagaagccuagugccuaaacugccuguguaaauacaucucauaugagcugggaagaaagagaauuuaggauaaaugugacaaagaaaggauucuagaauuuaaacuuucaguuuuugaaaaaugguggccauauaaguaauuagguacuguuuaaagagucccgagaaauguuacuccguuuuucuauuuggacaaggagacaaagguggaauaauagcauuuuaucauguauuccaucuuuuaaaauuuaacugugugguaggcagugugaaaugcagguuuuuauuuaccagucuuaaaaucugcuguguaaguuugcauaaaauagcuccguugauaccaacugaaaauuugaaacugagaagcuuauuuuaaaaaaugaaagauuaccuuaccaucuagccugaaauacuauguucacuaauuucaugaauaacaauaauguaaucaugcuuuuuaauaguauuuuaucauuuuuaaaaacauuuacaguuuucucuuguuuuuaaaucuagcuacuuuuugcuguaguuauuugagauuuuuuaguguuaaaagcagaauaauuccucuaagcuggcaggaguaaaaaggguggggaagguuucaccucaguguaacaaaaccuuaugaacugcagucuuuauguuuagccuguauaauuugauaucuucuguuuauaugaagcugguuacaaauguaugccauuguuauaaaucucacauaaacaguggauuccccacguuuuuuaaaaaaaauaugcuugcuuauuuagguuauaaacucuaggguguaaacuagaggugaacuccaggaacuuguaauaacauuauucuuggaauuugugccaggguguuuucauauauuccagacuuuuuggucuuauuuaggcuaaucuuuuuuuauugguaaggaauaguauuaagauuccagucugcuucuuuuaaaaagauuaugaguuaauauugguuaaacugcuuagaaccugacagaugguaagcuuguaaacauauuaaauauagagagaaacucgugucaaacuguaaagugcaaaacuuuaguugcucauuuuucugaaaaaagcuuauaugaaaugaccaauauaaaaauguaaguaauauuucuuaaguuugaguuuagcaucuuauggaauaugagugaggcuuuuuuuucuuuuguuuugucauuugcauuaaaguuuuggaguuguaucuuauugguuucauuugaaaaaucucauuacacuuucauuucuguaauuguuuaccccuuuuuuguuacauguuuuuccauagccauucuuugccccauaccuuuacacgccaagguauuacccuggcggcucccaacaucucaucucacguccaucaguaaaaacgaguuugcccagagaucagaacaauggccuaguaaguauauaaaaggguaacgcaaauauuaauuuaauaauaaacauagauagcauuugagguuugguuauuuccuuuacauaguaaaagagugcaacugauuuuauacauaguuuuaagaaacaaccuauuacuaacauaaaauguauuuauuuucauuucugguaaauaucuauggaaggaaaaugacuagcagucucagcgaagaaauguugacuuguuuauagccagaaauuucuggcuuguaauauaguguuugcuaccaaaacuuuuaaaacuaagccuuuacauuugguaauuucuaauaucuucuuaaagaacauguguauacaguaccuuuauaguauguaaauauuagcaccaugauauaaaaaauagaggauguauugaaggaagaacauuucaaucaaauggcaggaauuaaacaagauaagggaaauucuuccaaugaacuauugaaucuaagaaagacauuugugcccaaaauauuagagguuccugaugauaaaaguaauaguuuaaaaaaagaaacucucuauuaauauguuuuuauaaaucaggaggcaaaaacauaaacuguugaguuucaguguuguauauuauuuuaccaucauguucauuugucuucacaguuuggcuccccccuuccccuuuucacccacacucuccuguuuuguguuguuaggaaguuaucaaggaggaugcugcugaggggcuuucuucacccacagacuccucgaggguaauggaguaguccugugguguggaucgcuggcaucucauugcuucugccucaguaaugacugucuuaauugugaugauagcagcucacuaacucugcguuuguggugugaugagcagcuaguguagaguagcugaaugcuaauaauuaugguuccugaauuaauuaaaaagcggauguuuaacuucacccauuauuuccuccugcuuuuccccuuuuucaauacaugggaugggguuuuuuuuuauucuucaauaaggaagggcuuuuucuaucagcugucagggguguuccguugguaguauuugcuccucagugugagcucuagcuuugccuuugacuguuuuuguuaagccugugguugcuauuacacauguggaauauuuuagaaaaguauccaguaucacccuugagacuacaaaaagacacauaagcuagaugguguagacuaaaaaugcaucuuuaauaacucaaucuaggugucuacauuuaguuaagucuuagucugaguuuuagugcaguguuauaauacuuuucuuugucuauauauuuguuaaaauaaauuuuccagauaaacagaagaucguucagcauguaaaagaaauuauuuauuuauuuauuuauuuuuugccaacaccuuaagguagguuucuuuaaaaaaaaaaaacaaaaagaaaaaaacaaaaaauaaacagaaaaaccuuguagagggaaucaccucauaaauuacuauguaaguggccaggcgcggugguucacaccuguaaucccagcacuuugggaggccgaggugggcggaucacuugaagucaggaguucaagaccagccuggccaacauggugaaacccuaucucuacuaaagaaaauacgagaauuagccaggcauggugguaggcaccuguaaucccagcuacuugggaggccgaggcaggagaaucgcuugagccugggagguggagguugcagugagccgagaucgcaccgcugcacuccagccucggcaacaagagcgagacucggucucaaaaaaaaaaaaaaaauuacuguauaagacuucguacuuaauaagaaauaaguuugugaggagcuuuaaaaucuucauuuagagccugggcgacagagcaagacuccgucucaaaaaaaaaaaaaagaacccaguuuguauuuuaacuuugguuguuuuauuuacagacuauguuacacccauguaauauggucaguuuagccuauagcuguguugaaauguggcauagcaguuagaauuaacauggugaaauauuacuaaguuuaucuguaauuuuuaacuuaaaacuugcauuuuagcaggcaauagguuguuuuucuuuugacggaguuucgcucuuuugcucaggcuggagugcagugaugccaucucagcucacugcaaccucagccuucugguuucaagcgauucuccugccucagccuccugaguagcugggauuacaggcucccaccaccaugccuggcuaauuuuuguguuuuuguaguagcgaugggguuucaccauguuggccaggcuggucucgaacuccugaccuugugaucugcccgucuuggccucccaaagugcugggauuacaggugugagccaccgugccuggccagcaguagcuuuuuaacuuuaauuuccuuugaguuaauguuaauaggagagaaaaagagaaccguuguggugcuuucguugagagguugaugauuauuuuaaagucauuuuaacauuucagcugaaguguuucagugacuucaguuauccacaguaaaccacaauaauucucuucagugcuuacaggaucuuuaauccaugggucaucaucacuauaugcaagaaugaccuuuaguuuagucagagagccuuuaacauacacauuauugcaugcaauucaauucucugagcuaaaauuccugagcaaaguuuugaagaaaaucagauacugugaagaaguuaauggccuuaaugacacagacaugcugacauaguagcuauucccaugcucaagaauguagacaaauacaugucauuaaaaggugucuguaguuucuuuuagggaccaguaaaggagcauuaggcaaauuuugaaaugaguuuuuggagaaggggaaaucgugugauucuugagauguguuuagaagcucaacaaaggugcucugcauauauuagugacuuugucuaguagaauaaccauaucauuugcuuuuauuuuacuaugaaaagaucauuuuaugauuagcauaacaaauaauagaugcuuacuaagcuuccuuugcuuuuaagaaauuaacaacgacaauagaauguaaaauuuguuuugucgaagccuagaaaaacuaaguagucacuuaguucaaugccaaauugaaagcugugguggaagguaaagaaucagaacaugggaacauugccagaacuuuguagcuggaccaacagagaguaccuagcagaaaaguauguguagcccaucgagcucuguagcagaaaacucuguguuucuggacaacgggauuucccauuggucccaucucugcucagucagccgucucuauacaaagccugcagaagagucaagaacuacacaaacguuuuuggacaaauugucaugucacaagguaauguguuaaaaaagccaggccauaagggguuaaccagcuauggucuuuucaaaauagagaugaucccauauauauauauauauauauauauauauauauauauauauauauuauauauauauauuuuuuuuuuuuuuuuuuuuuuuuuugccaugaggaacaucugaaucaccuuuauaaauuagauccuuauaaaaaucauugaguuuucucacauuaaggaacacuguagugcuuauagcuugugauguccagggagggacuugucagauaaauuauagauauauccaaguguuucacagaagugagguuuuauauaaauuaauaauauauaauauaaauaauauauauuauaaaauaauuauauuaauauauaacauauuuauauuauaaaauauauaauauauuaaugauauaguaauauaaaagauguuaauauaaaauauauuaauauauuaauaaaacaaauccucacuucugugaaacaguuggauauaucuauaagccuccaugcuagcuuuuuaaaaauaauuguauaauagagaaaaaauauaugccaaaucuugugaaaccagguuaaaaaauuaguacuauaugcaagacaugcuucccagaauauuagggcuagaaaggaacaguguuuuucaaaguuccaaagcauagaagcuuuuagaaaugaacucuuaaucaaaacuccaguuuguaaaaccaauaaaagcagaauccuggaacccacauuacacaugccuuuccucuugagggucccccaggagugcuagucuccacauggcacagauagaaugugugagacuuaccugagggacacaggaaaggggugccagauuuggaacuagaaugcaggagaccauggcgcucaccaccaugcugguggcucugccccguucguccugaacacgacuuagucagguauuuggucuuuugaguuaaacagacccuggugaugagcucuuugccuuggacagauuacuuuaccccucugauucucagcuuucucacugggaaaagcagaccugccucaggucugauucaaggauuagucagccuuagcauacuuuaaguacuucauuauuauuauuacuacugcuacuacugcccaaaggccagaauccguggagccuuaaagacgcagaacucaaacuguuuuugguuaaaucaucuuugucucagucaugggagugguguacaaauacuccaaucaguuuagauucaugcagccuuuuuaucuguugaugcuucuuagcccuaaaguuguuaaucgguuuguuuucuuagaauuuagaggaauuucuagguuauuugaauacuuuagauacuuuaaaauuuugaaagcuuuccagggauguuuucacuggugccuuuaccuucuuugaguccaguucccacuaggaaauggcagcauucacaugauucugugaccccagugaagcaaaggaccuaguauugaggcccugugucuggccaggucuccucaguggcauguuguucugucaucucaaagaguugcucucgaagcucuguaguuuggcuuaauuuaagguaugcugcuccuggugguaacuguguuucauugaaaagcacauuuucaaaggagcaauaaagcauuucuucauccuuucauuuuucccugaauuauuuuacauugaguaccaccgaugcuugugugaucagcgauuaguucaacgaauauuuauugaguguaagaggcgcuauucuagugggacacagcagugaagaaaacugaugaaaaucuugcuucacagaguguggaccugaaggccaccgagggaauuaucgguuuuaugaagucauucuuucuugaccuccucagcuacaggguuuacucguuaccuuuggacagcuuuauuuagaucacuuuuauaacuuguugaaaaagcaugacaauaauuagcacaaaguuuaaucauaaagaauuucagaacugcaaaggcaguguuaacacagcuccagugugcuguuaccuuuaccuuuagauguugaugaaaacuauugaaugaagauauuaaaacugaaagucuugguuuucauuaaacaggguccagucaguggagugaccaaguaaaaagugaaaacaaguccccaugggauggcccaugcaguaagccugcacuuaggaaggcugaggcaggaggaugacuugagcccacaaguucaagaccagccuaggcaacauagcaagaccauuucuuuaaaaaaaaaaaaaaaaauuagccaggcagggcaugguagcgcacaccugaagucccccuacuugagaggcugaggugagaggaucaguugagugccaagaucacagcacugcaccccagcguggugacagagcagaccuugucucaaaaaaaaaaguggggcucaccuguggacaauuuuuauuuucaccacugguuuagaacuuaagcugucucucauuguucaggagaagacguggacaagaaaguuaaaggugccauagguagggagucgaaggcguuuuagguuguguuuaggcuucaggcucaggacagguccucccugucagcucucagcgacuuugcacaguagccucaaccagcuuuaacaccauucacacuuuuuaaagugucuuagaaguggauuuguacuauucuguuugaauuuggaaaaguauuuacucauuuuugccucuuauuaaaguauagugaaaaauugucuucacuucccgcuugaaagucuuugugccagacuucaacucaagaaaacuuuuuuccuaaacaauuuucaacuaaauugauugggauauuuucacagaaauaauauuacaguaauguuaugaaauccuagaguacaguuaaaaguuuaaaaacaacaaaauuauguucauugcaguaguuuaguacuuguguuuuuauuuuguuuuguuucauuuugguuuuuuugagacagagucucgcucugucacccaggcuggaguacaauggcacaaucuuggcuuacugcaaccuccaccuccuggauucaagugauucuccugccucagccuuccgaguagcugggacccaggcgugcaccaccgcacagugaaaaauuagcccagcuaauuuuuguacuuucaguagaaacaguguuuagccauguuggccaggcuggucuugaacuccugaccucaagucauccaccacuguggccucccaaaguguugggauuacaggugugagccaccacacccugccaguacuuguguuuuuuaaaagauugcucuuaaaauguaguguuaugccuaauuugucagcuuugaccuaguauuucuuaaguagcuugaagaguaaguuauauuuuccaaucaggugaauaauagcuuucuuuuguguuuuggaugucuuguaguaaacuguaauuuccuuagcacuccuauuuugguauuuuugcaaaucucuacagacagcuuuuuaaaaaccuauuuauaauaaggucgauaguguaaacuagaaaacaggauuuccacgaagugccccagauauugaauauguuaaaagaaagacaucaaacgucaggcuagcaaaaacccugccauuuaauauacuaaaacaguguuguaaauuaacuuugguacaaauugccagucaucucuagaucauuuuaagcauuuuaagaauauuuauuaucaaucuaaguacagaagaauaacugccagcagugauuauuugcuuuggauuagaguuuuuaaaaauccaccucacugaaaugguuauguucaucacaguuugcaagguuugucuguuucucgagcuagaagccucuuggggccauucuuaugaaaugguauuuagugcaucuauuaugugccacauacccaaagaagcaaaacucaaauuugaaaguguauuucugaacaugaccuacaguguggcuagauauuuuaugaucaugugauagucuaaguaacuaagccuucuuauucaauguuuuuaaauuaauguuaaacuugcauauauuacgaauauugacuuuucauagccaaucugauguaccucauuuucuuauuaaauguauggcucaugauuuauucuuucaauacaaaaaauauaauuuuuuuuaggaguauaauuguaagaugaccaagcacaugugaauggaaugcagcuacugugguugggggugugugugcaugcaugugugcuccuugcugugugcuguuguccgugguccguucagagugaggaggaaauaggaaugaugaagcucugccuguguauguuagacauuuauaguugugcaucggauguguuacuuuaugcucuuguccuucacuguguuuuauuccuuccuuaaagcugugugacucuggguuuaacaaacagagacagguacagaaacucucaaugaaaucuuacuuuucuuauuagacuacuagaagcaaucauuggcaacuucaugcugggcugucuauaaaucugugcucacuaaggugcguucgguuuauuaguugcuuccagccauugcauggcacucauuucuggcuaaucaguuuugugcuuauuuaauaaauuuaccaaagaugauaaugugucagaguguaguucuaaucuacuuacaauacacagugauauaguuaccucaggguaauuucaguauuuugauagcuuuacuuuuaccuggagaaauucugaucuguguaaauuuuguaguuuauuuuuaacaguuuaaacacacuaauaucuucugcauucagcuuucugauucauaaaaaaauuuuaacaaauucugauguuaaaaucaauacgcuaaaauggucucuucuugacuuagauaauuucaauaagaaugcaugauaaacauuaaaguauuauuugaacuagucuguguauucucaaaguaauaugcuuauuuucuaguaagaauuuaccuacugaauuauugaauaugcuuuuugcccuuuccuuaucauuuuugcacucuuucuccucccuuuuaugagauuuccacccccaaauuauuauuuugguuauaagauucaugugguuucaaaauaauuuucuuauguaugauuauuuuagaaaaggucuagcagguaauuaccauuucuucuuuauucaaagaagcauauuauaacauauuuucauuaauugauaauuuagcucuuguauaaagcccaacuuauaauaagggucagacuauaguuuugauggaauuacaaagaucuuaaugucccuaugugucugucuuuucuuaaaaagcuuuuaaaaguaauucagagguaacauauauauucuacauaauccccaaugaaggauaaaauaugcuugaaaguaacugauaaauuguagaaguuguaaaaagauugugaaaguaacauuggguagagcuuuuugcuuuaaaggaaaagggcggugucuuuauugacaugucucuguugcugaauucucagcuucuccauagacauaaaauucuccucaguauuuuacauuuuucccuccaaagcugacaggauuaauuugauccgugucuauuauacuugucguuuuuagcacaaucggaaguagagagauuucgggauuuuugaaauaaauuuuuuacuuuaaaauaauuuuaacccuaaagaaaagaugcaaaaaaugcuauucugucaauguaaacaucuuucauaacuguaguauaauaaucaaaagcaaaaauuaaaauuggcauaauacuauuaacuaaacuacagacuuuauaugaauuucaccagcuuuuccacaaaugucauuuuucugguccaggauucaauucaguugcauuuuauuucuccuuagucuguuuuaaucugugacaguuucuuggucuuuccuuaucuuucaugaccuuaauuaacacuuuuaaggaauacugguuaguuauuuuguagaacgucccucaauuuggguuugucugauguuuccucgugauuacaaggggacuguauauugcuagaaaacugcaggagugaugcuaugcccuucccagugcaucagaguugaagguucuugauguccauaagccuucccaccacuaaugcuaaccuuggucacuugguuaagguggcaucugccagguuucagccuguaaaguuuuauuguuccuucuauaacuagugaauaucuuggaggagauacuuugaaacucugcaaauaucccguuucugcuuauacuuuugcccauuaauuuucacuuccgucuguggaucaugugugcacucacuguuacuauguuugccuaauggucauuuucugcuuuccuguucuacauuuauuaauuggaauucuguaaagaaaagcugucucugcuuccuaauuaauucacuuuuuucaauuauuuaguuauauuacuauggacucauggaaauuuauuuuaucuaugaggcauaauccaguaagaucauuaguuauuuuguugauuaaacuauuuuuuugugauuuuuuugaacaacaaaaaauguaaacaauuguaacuguauccagagcaaggagacugguugaggaauaaaagcauuugaaagauagaaaagauaaauaugacucagcaauaagaagaaaugaaggacuggcauguuaugacaugguggaccuugaaaacauuauguuaagugaaagaaguuggaaaaaggaaaauaggaaguuauaagaccugauaaguuacaguucugguucagguuuacuacuaacuaguuauuuguucugugacuuuaaaguccugauuuugaccaggcugaugcacccucuaaaccacaaugagcacaucugugcugggaagaugcauuuaucauugaccacggacaacugguuuguuaguauccacauuccgaaaauguuuuucuucuaaauaaauacuagacuuuuuaauuauuuugacuuuccuuuuaaaugagaacaaauuuuaauagaugguauuuacuuucacauguguuaagaauuaauacuguuguuuuguauuuacaucaugauuuaacagaugcuaaaggaaguuuuagaucccuuggauacaauaugaugaagaucugaaaacuucagcucuuguaaccauugagguagucuguagaaacacucaaaguugcuuaauugucuaguauagguacuuuaaaauuauuuuguagguuuauuuuuuguauucauauaauauuggcaucaguaguuuuccaucuuuuugcguguguguuuuuuuuaaccucucuucuuccucuuauuaagcacggcacccuucucucuugagauuaggcaguaaacauuugagaaguugaccuaggcuuuguucaugaaauguucuguuuucuuagaaaaaaugguuuugaccaggcuguaucagcuguaauaaaagcuacucauuagguuauaacaguaacuaaaucuguucccuaaugguauuuccuuaccaugcuaaacauauuuguuuuuuuuuacuuuacuucaugguauaacuuaaugaguuuuucucugucacaugaccucauuauagauggcauuaaaugcuuauucauaccuguauuuuuccuugacuucucuaggggucaggcccagccccaggcccagugguauuacugaauucacugaauguggaugcaguaugugagaagcugaaacaaauagaagggcuggaccagaguaugcugccucaguauuguaccacgaucaaaaaggugaggcagccacuuacacacggaccagagacagcgcugggggcggaagacaggacugugugggucguguaaacuuuauguauagcuucccaaacaugcauucccuguuaaaaugggaaagcucuaaauggaaaacauaauucuuacuaguuuguauucuaaaauugcccuguuuucucuuauuuuauaaauggauaaaauaaaauaaaguagcugucuuaccauguucuuuuuuaaaugacguaauacaaguaaagaaugccuugaugagaaagagaaagcucugagggauucccauugggauaaacagaacucaucuuuccaguguggaaccgaaaaccuuuguguuacauuuuuuucuaauuguaauauuuguuagugugauuuagugauuaucaaaguaagccacacuugccucauuuucuccaaauucucauuuucaugucauguaggacuuaggaucaugucacauuugaugaaaccacauagguuuggguuugcaagguuaaugcauuugcauaguuuuuuuuucuucuaagauccuauugcaauucuagcagcuaucaggaaguuggcuagagaugccugagauuugggggaagguuuuaacgaagucuuuauaguagguauuucacuaagguauacuuuuuauaucagaguacuguguaauaaaguagaacguuaauaaccagccucuaauauuuauauacuugaaagaaugacaucugagagaaguuuuuuaaagaauuaugagcauauguagacaccauuuuacucaucucagccaauuuuagaaagguuucagauaaugucaguuuccuuacagagcuggcucgugcuagucccuguuugcaugagucaaacaccggcuuuuccauggauaagccccacuuucuccuucaggcagcugguuggugucaggaaagagcggggucucccacacgaguccuuugugaugauuuuguucccaucgggguagugguuuucuccccacucagcucuuugcuccuagaccccggcuuucugaagccccucagagccgcuggccuccuccgugcuuagggcuccgcggcauuguugcagcaggaccucugucacagacuugcuguguauacuguuuucuucaggauuaacuuggaaacugaacauucuauugauuauaaacauagcuauuucauaaauuugccccaguuaauaaagucagguuuuacauuuuauaaaagcaguaagcuaccuauuauuaauaaagaaaaugcuguuguuucauuuaggggaaacuagaauuacagggaaccaaaaguaauaacuuccuuuuuuaugauuuuuuuuuucuuugagauggaguccugcuaugucacccaggcuggagugcaguggcguggccauggcucacugcaaccucccgccuccugggugcaagcgauccuccugccucagccucccaaguagcugggacuacaggcaugugccaccacucccagcuaauuuuuguaguuuuaauagagauggaauuucaccauguuggccaggcuggucucgaacuccugacuuuaggugauccacccaccucagccucccaaaguucugggauuacaugcgugagccaccgcgccgggccuugugaauuuaauagacuggaaaauuagugggugggcauucuucauaucuguaucuaauauaacggauaaacaaguuugccaggccuacuucauuuagaacguuguuagugaccaacacgcuuaugagaacagaugucuuuguccccucccagcagcuuguguucauguucauauuuucuaagauuagaaaacaaaaacuaacaguuuuguuguugcucaugacagcauagguaguuuuggaaauaggaggguuaguucuucgguuggucccagaaaaugccuaagacauuugggaaaauaugaaguggcugauguuguucaaauucagcuuguuuauuguauuauuauaugggaugauaaccuuuuuuuuggucagccuuucuggucucuagagacuuauuuaaaacuaaauauaagcauacuuggcaaucacuaguaauucagaauauuucacauucugucuuuauacccauaauuguuuuaauuuuuacucaggcaaacauaaauggccguguguuagcucaguguaacauugaugagcugaagaaagagaugaauaugaauuuuggagacuggcaccuuuucagaagcacaguaagauauuuguaacauugugauguuuacaacauuauuuuaugauaacauucaaaauuauuuauaacauuguagaaaaccaguaucaauaaguacuggccuaaacugguauuuuuuucauauuuuuuuaaauuuaaaaacugcuucuuacacuuaugugcaauccuguguuguggaaaauacacacagcagcacuuggcagccuuugccuuuuugggcauuucacucagagauuuggggaagaggccgccugccgguucuucaugcuuucaccugccuuaacucucaucaggcuccucaaagccuucgaggccuugaccuucagcauucauccuuauagggcuugcauugcccagguuuagcaagaauccuguuaagucaguuuacaugugugaucacccucaguauuugaucaaacgccucacuaacccccccacccccaggugaugucggcucacccuggccaucggcguaccaagagucccccacuccugcugccuccccuuaguaauguuccauccacgacccccacccugccccuuggugguagauccccacucauucgugcuuauuccgaguuggacucccuucuguagugagacugcuuaccccuguugccauaguucugaauaaaaucuggaccuaccgcccuacuccuggccagcucugguuuugacacaagccagcugcauuuuucuuuguccucaaguuaaguuuuaaacagaaguaauaauuuaauggacaaauugcaguguaguauauguauggugguuucuaccauugcuuccuuuaguauuaaugaacaugaaagauaagcugauguauaaaacaaauucacuagaaauucacuuaccagaaguaugcuuucucauugcuguugcaauagcuuuauaauguuugguauuucuaaauauuucuaaagcuucuaaaauaugauuuguuaguguaaauauuuauguuuuucuucuguuaagguacuagaaaugagaaacgcagaaagccacguggucccugaagacccacguuuccucagugagagcagcaguggcccagccccgcacggugagccugcucgccgcgcuucccacaacgagcugccucacaccgagcucuccagccagacgcccuacacacucaacuucagcuucgaagagcugaacacgcuuggccuggaugaaggugccccucgucacaguaaucuaaguuggcagguauuuauugaauggcauuuuucauauuauugaagaauaagcacaccguucaguucacugagauuauaugggcauuuagacagucauucagaaaaugcuuacugaauaccuaagugaacaggagacaagauggagggcucccuguacucaaggagcugcauccauguggagaggggcagucagugaaacaaacaaaaaaguagcucauguagacauugaugagagcugagauauccaucagggucacagcaugcagagucaauagggauuaggccacuugagcuaggguggucagcaaauucagccuuucucaggcgaucuuccuguugcauucaguaacuguugguugaaguacaucuucauuggaacacuggccacauagugucccuuugagcaccauccuuugguuuuccaggacgccugcacacccuucacggauauugguuucuucuggucuggcauuagauguaggcgcguucuuccuuuggagauucuuagaagaaggaggccaggugagggguagggguaggggcagggacagagcaaagugagagaugcaggaggaguagcgggagugaggagagcgcaggaggaaaagcagagcaggguguggagaacaacgggggaggaggcacagcgggcggcagcgaguaacacugagugggcagggcagggcagcggugaggaggagcagcgccuuggggaaggaagaaaauguccuauuuccuugagaagguccccaacaaauucacuuugcuccuucuuuuuuguuuuagccuuugcucuugacccuucuuaaacuuucuugauucuucuccuucuuuuuccucaucuguacuuuuugcuccuuguuucuuagcuauucugggaucugaagcaaauucuaauucuaaaacuuaauauuggaaauaaacuuguaaaacuacuuuauuuuucuguuuacuaaggcccaacuauuggccucauugcauuuuauauuuuaucaaugaaguugacuuuggccuuaaauaaaagcuaaacguuugaaguuauaaaaacaagugcuguggccgagcaugugggacaugcccauagucccagcugcucaggaggcugaggcgggaggauugcuugaguccaguaguuugaaucuagccugggcaacacagcaagauccugucucuuaaaaaugaaauaaaaaccagaaacaagugcuaagauuauuuguuaauacaguguuuaaucauacuuuuaaauauuaacaauaaacugauuuuauuaaaauuuauagaaagcuuucuaguaacagcauuauaaggucacagcuuuuguuaaucuguguuauguagaauucuuuuaaaagaauuugauguuuugaugacuuuuuaaaugguuaguguacauauauauuuccuaagcugauguuuaugccuuuuuucuucuuauuugaauuuuuaaauuauuuuuuuucugucuucacagucacaaacucgcagaaccccaagucuuucgagucucaauucccaggauuccaguauugaaauuucaaagcuuacugauaaggugcaggccgaguauagagaugccuauagagaauacauugcucagaugucccaguuagaagggggccccgggucuacaaccauuaguggcagaucuucuccacauagcacauauuacaugggucagaguucaucagggggcucuauucauucaaaccuagagcaagaaaaggggaaggauagugaaccaaagcccgaugaugggaggaaguccuuucuaaugaagaggggagauguuaucgauuauucaucaucagggguuuccaccaacgaugcuuccccccuggauccuaucacugaagaagaugaaaaaucagaucagucaggcaguaagcuucucccaggcaagaaaucuuccgaaaggucaagccucuuccagacagauuugaagcuuaagggaagugggcugcgcuaucaaaaacucccaagugacgaggaugaaucuggcacagaagaaucagauaacacuccacugcucaaagaugacaaagacagaaaagccgaagggaaaguagagagagugccgaagucuccagaacacagugcugagccgaucagaaccuucauuaaagccaaagaguauuuaucggaugcgcuccuugacaaaaaggauucaucggauucaggagugagauccagugaaaguucucccaaucacucucugcacaaugaaguggcggaugacucccagcuugaaaaggcaaaucucauagagcuggaagaugacagucacagcggaaagcggggaaucccacauagccugaguggccugcaagauccaauuauagcucggauguccauuuguucagaagacaagaaaagcccuuccgaaugcagcuugauagccagcagcccugaagaaaacuggccugcaugccagaaagccuacaaccugaaccgaacucccagcaccgugacucugaacaacaauagugcuccagccaacagagccaaucaaaauuucgaugagauggagggaauuagggagacuucucaagucauuuugaggccuaguuccagucccaacccaaccacuauucagaaugagaaucuaaaaagcaugacacauaagcgaagccaacguucaaguuacacaaggcucuccaaagauccuccggagcuccaugcagcagccucuucugagagcacaggcuuuggagaagaaagagaaagcauucuuugagaaaaacaagcaaaggagaagaguguuacuguaccuuuaugacagaauuguccuggauuuugacuccauccacgcccaucaccuuucuacauuuugcugacagauaacuaaccgaugaugaggccgagguaaaagagacaucugcagugugacagaagggagcaugagaagcauggcucaccagccagccucuguggucuuuguaauuagaagcuucagaacucacuaauacuacuguaccuuucauuggcgcauuaccccauaaaacuuuuugagacgaggugagaucugaguauaaagauaggucagaaguauuuuaaagggcuuaaugugccaaaaagaaaaaaagcuagagacccuuuuugcaaacauuuggugaccacacauuugagggaagacguggcguuaggugaagcagaagcaaacccugcucuuaggggcucaccuaggugagugcacagccugugacgcuacagggagaggcugaguaaaccgagauccagcguucuguauggcagggguauugcuuaucacagagguucugaagaguaggaaguacauaaugaagagggcuuuaaaaauugccaacaaagugagucaccagggcuggcaguagugugacggggcuguccugagcuguuaggagaguagaugcggggagggcuggugaccuccguggguuuauaugucggaaacucuucucuccaaaucccaggccuggcuuccagcaccauccagcugugcccaagaagccacccuggucuguucuccaacucuuuuaaauggugcccaacuuuucuaagugagcuuagcaaugagaagaaaaaaaaacaugaauucuuuuucuggaaaaucagggagacauggguaauaauagguacuaauaaauauuuauagaugagugaaugaggaaauaauuacaucaaaaaggucagugacaauugauaaaugacaaggaaauauuuaauuagguaaaacuaaaucauugcucucuauacuaggauagacuuuaucuacuucaucuguuccuaagucagcauguuaguucuggggaaggaucauaagaaaggaaauacuuuuuaaaaaaaaauuuggaaacauguaacaaagcaaggguaaaauauauauauauaucuauauaagugcugugacuguaaaaguguacuuuccauuaauuauuagccgaguuaagagaauggucacauugaaguacuguguggacuagaaauguacccugucaucaugcaaugaaauauuguuaucguuuuaacauagcucauuuauguagaaugaauucuggugguuuaccccaagucacaguuaggacgguagauggugagaucgcagaugcgcuauuaucuagauucaguguuacauuuucgauguuuaucacucaguggguuuuuauuaauaugcugauuaaguuauuuacugggccagucauugugcuaaauaguugcucuuuuguguuucauugccuugauguuugaguguaaucuagcauuuuaauacaguguuuauuuugcaugaucuuuaacaaauguuuuaagcaauuuuaaaaaggcaggauguuauugacauuauacacugaagucuuaacauuuuaacauuuauagugcuuauuugcaaaauuguauaauuaggaauuauuucagagacaauguuuucuuuuucaggugaguaguugccgcguaauaucauuggaguacauucuuuauacuguuugugaaauuaauacuagcauauuaaguguacaaauagauuuagaaaacaauaaaaaauugcaugcuauucugacucaugaauuuuuauucacuaugaugauucacauuuugauuaaaaauaaaaguaguuuguguguuuguuuugucacaugucugaaguuuguuaaagacuuucagguucauguacagucaugcaguuggcagaaguguucugaacugcucccaacuagucuuuuuaagagaauguggcucguaagucccagugccucaguggugcuuuaugaagcguuugugcccacagcaugcuagcgcccagcagcgcugugcagugcguuccuguagauagaaaagguagguuauccagaaccuggaggauaucaguuuauuccaugaacuuccuggaaaaguuugcuuuuucauacugauaccgaaauugacaaaccagaugaguuauugagucauagaccaucucccuugaaccugugcgucuauguguguguguaucuguuuauagcucagucugauucucacacaugcaaaacucugcuuuaaacugggugcaaaaugauagaaaaagaaauuggugcucuaaucuugcccuuagauucuauccauuuagaguccugugggguuuuuugugguuuuguuuguuuguuuguuuguuuguuuguuugaggcagucucucacucugucauccaggcugaguguaguggcgccaucauggcucacugcagccucgaccuccugggcucagccucccgaguagcugggacuauaggcacgugccaccacaccuggcuaauuuuuuauuuuuugaggagaugcagccuugcuauguugcccagguuggucucgaacuccuggauacaagcaauccucccuccucggccucccaaaggccugggauuauaggcaugagccaccaugcccagccgagucuuguguuuuauauaccauuuugccuucacuguaagccacagauaguucugauaauguaucaaauguuaagccagauucauucaccguggccuuacggagugcugccugugaguacaggcuuucugcaggagaagacuggaaauaaaagaagcuguuuuucucuuucaguugaaauaacuuccgcagugcuggguauuuagggaucagcucuccaacacugggaaauuuaagcauucauaauaaccaacauuuucaauauuaaaagcaaaauguguuuauguguuauauuuuacuuauauggguuuauauaguggucagaaugauuuugauugccuagccaaguaauuuuaaaugaaacuuacuugcgaaaaugcuacucucgagaccuuuuuagaacauuugcauguuagacugcugcaguaaaauacauuuguaaucaugauuuuuuucuuacaaauacuaaccauuagaagauauuuuuuugaauggaaguaaaucuuauggguaaaagacuaaauuuaaaaggugauuuuuaguuacacccggaauucucagccuauuuagaaguaucccauaguuuaaaaauccaggaaucucugaauuccuggcuaacuccugaguaaaaucaaccuaucuaccaggaaaagcacuagaaggcaccgugccccuucaugggcgagugacuugagggaauacguggguaaaagggaaggugccauaaguuaacuucuuuggccagcacuccagacugagcaucgagccuccuuuauucccaccuucucuuccaggcgcacgccgacacugggcggaagggaagaaaccaguggggauacuguucuuuugcgggggcagcaugagcagacucaggugggcucucugagacuaucgcguuuugaguuuccaggcugugguacucccuauccuucccuaccucagaauucuaagcauaggccauaauuaugcaacugaauugaaaaauagaaacguauagacaacagccagcacuggauaguuuuuuuaauggcuuaucacaaagguugagaaucccugguugagacugauuaaauagagaauuuacaaucuuacauaauuuuaaacccuuucaugccuaggaagaaaaugcuggccuugagauagauagcucuucagaggauccagauuaaacuaagguauguaaaaaauuaguuuucgaagucagcugcagucauaugccacguuaggacguuuuggccaacaaaggaccacaucugugacagugggcccauaagauucuaauacuauauuuuuaccguccuuuuucuauguuuagacaugcagauagcauggugacaguugccugcaguauucaguaccgugcuguacagauguguagcuaggagcaguagguuauggcacacagccuagguguguagugggugccaccaucuaggucuguuuaagugugcucugugaugcucccacgacaaaaucguccaacagcgcauuucucagaauguaccccugucgucaacugaugcauggcuguaauuuuaagccagcuguucaaaaaaguucucaccaauuagagaauuuauauucucaccacuuuaacaaacggaguuaaguaagaaaccucuaaaaugguugcuagaaauuaaauauugucaccgaccuggucaaaaccuuuuaaguaaaaugauuagccaaucacagccuuggcuuacacuggcaucagagucuggugugugucgcacacacgugcuguagguggaauguuucaugacgaggacuuucuggaacucagaagcccuuuuugaguggggcccggguagcuguaggaugggcagaucugaauucccaguacaguguggcauuuugaaaaagaaagaauguauaagaauaaaagggucagucaagaaguaggagcaauuauuacccaacuauucgaaggaugacccuuuaaaaaucaauaaaaaccuaucuggagugaaagaccaacuuaaaugagcaauagcaugaauuacguaauauaaagacaagcguuccugcuucaaagcacacgaaauauucugagucugccugcggagcuucagcugcagucaucuuuuuaccaagauugcacguaaguccauuuucuuagguuaaaugcuuuuuguaguguuauuuacacuagugguaugugcuaggaacccuuucuucguuuuucugagauuugacagaacauggaauaacauaucaaacugaauucuuagaacgugaguaaaugaaacuuuccuuuuagaagcaauguagaauuacaugcuccauauuauucaaauuaagaagcuuuugaaauaauaccaccuugauuauccaugaucauuuucuaauuuuaacauuuuguacacauuuaccucguuuucuuucaaggcaacaggcgcuguagaucuuaguacccugcccauagacccaagcacuuuucucauuucuucugacaguucgagucacuucucacaguugacuuccucaccaaauaauaagggggugaagaagacucggccuaccuacuacucaguaauccugcuguccagucgacuggagaagagagauuuguucaccucuacuaguuuuauuuguucuuaguaguuguagaauuuaaauugguuuuaaugaaauguuccuuuuaugaaauuuuaaauaaaagccauuuaguguauauuuaguauagcaagaagcaugugaauaagcuccauauaaccugacauugcgcaucuuacagcauccucuuggucagaugucuaauaaaaagauuguuauuuucaaauuuaucauaguuccugcaacuugcacuuuuuaaagcuguguuugugagaauuuauagacugcauaucgcuauacuugauggaaauuaaacuauuuuuauuuugaaagaagu

SEQ ID NO: 17007 - RNA, 3724 nt, Homo sapiens
uauugacuucagacauguuuuauuauaaucuuauacagucuacauaaauuugaacuuguauuuauuuggguucaguuauaacauagcauaauaaaaaucaaagcacugguccucugaaauaaagcaggcaaucaccauucaauaaacacacuugauuuauuuuguauaaaaggguuaaguuuacaacuaaacuuuuauaaaaaguuuagcaugaauaaguacaucauuacacuuuugaaugcagaaauagacaucucugccacuauacaagaaaacucuaauuaaagaguucacaagguuucacucaaauagauauauuuauauauaaauauauacacagcauucaguaggcuugugucaaaaagguaauuucugaccaaaagacuucauuuaagugacugaauacuggauccuucugguauucacgcuccaccuuugaaaaaaggcaaagucugcuuagauugggcaauuccuugugauuuuaacguuuucgcuccccauggugggaauaguauauaaagaaaaccuuccaacugcagaaagggcauuuaaaagucuuuuucauaaauaacgaauaucacaguccaaguaagagaacacccugggaagaugaucauucuuaguuuuccuuccauuuuuuuuuucuuuuuaaaaagguccauucaacuuguccuccuugugaaaugguugaaaaauaaguucagcacuuaaaagauuccgugaauuuguuguuguuguuguugugcaaagaauaaaagaaaucaugaacaccugcgaaagagugggggagaaaggcauguuuaagagaauguaaccuaagggcagaggcgggcgacuggcgccgggaggaagccacaguuugaacauuuaaccaaacacucaaagauugggcaaacccuggcguccagaugcaacacacacacucgccucgacagcgcaaauuaaacauuaaaauagcagagacucaagggaaaaacuucccaacccaaucuccuauuuggaucuccaacagcagugcuacaggcgccagucugcuucucguaacaauuauuugauugaaaacagcccuuuaguuaacagauagggaagucugggaucccacaucacaggguugaaggcacaggguagcaauccucaacuagcccagagaaucccagaggacuauaguuuuagggaaggaggaucacuauggaauuuguggcgguaagauuaauuacaguggagguuaguaccucauaguaccagaggacucguaggaagauccagggcauuacauuugcuacaaagccaauacacacguuccucggccgccuucguaguaaguuauuggcaucauuuccuuuuaaaggaaaauguucugugaucucgagcacccaaagcuacaagcuccuucaugucuagugagacaauguaguacggguaacaccgcgaaguaagcaugcauuuaccaaaucagacauuuuauagauacacaagcaaaaacacaugcgcgcgcgcgcacacacaccgaggggcaguuuacccacggguggcacaagcaaacacucaccgcuuauucagccacacagugcuuugcugucauuugacauuaacucagaagggaauucagaagccuggaaagaaagaggauaaagaguacgagguuaagacaauguuaaguagaaaggguuuuuuuuuuuuuuuuuuuuuuuuuguaguccacagaccagcaaguuccauuaaacacguuuaugguaacaauucagauuuaaagacagacgcauuaacaugucagaacuuacuagcaauuucacgcacagcucaaucuacagcagauucugaagaaaauaaaguuaaauagcucauacgaaagucaccgucugggcuacggaucuccuagugacagcccagacgaccgcgggagugugcggcggcggggcggggaccccggagcaggucuuaccugcaaggacaggaugcugauauccguguugaggguggucagcggcguccuggacgccugguucugcccgggucucuggugaugcaggcugacaauagugggaugcgaguccagggcgaucugcagguccaagauguagucgaugacgugcugcaggauuuccaucuugcucaccuucuuguucugggggaugcugggcaccagcuccuugagcuuggaguagcagucguucauguuguauagcaggcucaucgggucguccacagggguuuugcuccgggagaugcccaggcugugguccgacaggcuguuuuuccuaacggaccucacgggacugaaggcuuucaugcugaccgcgagggaaggcgagaccgggagggagcuggcugcccugaagcucaggccgccgcugccgccugcugagcuagcugcgcuuggcaccgggcucggcucagaaugaagcccgagcccggcggggcggcuuuuauccgcacucgccggggccacacgcuggagcuucccuucguccccauuggcggaagguggcacgucuaucaagacgagcgggcgcuuccauuggugggcgcgggcgcggggcgugggcuugguucuuccgcguucgcagccaauccccgcggggugggcggggcgcgagcccagcuggggugguaaauagaguacaguacaguaagugcggggcuggcggggggcggggggcggggagcggcgggcggggggcggggaggagggaggcgggaggagggagaggaggagggaggaggaagagaagggaagaugggggaggggaagggggaggggaagggggaggggaaggaggagggagaagggggcagacccugggcgccuaaauaugcauucuuaauucuaauuccaagcgcgcggcgggacccuugcccuggggguguucccagaccaagcccuacacaccuuagagcugucggcagcucuaaaaucacagcuacacgggcgaguucagcaccgcaggggggaagccacaguucacugcaacccaucggagggagagcgugaggaaagauagaaagcauuucagaagaaagugaaaacgcaaauuagguugucacugaagagucacguuuguagagugaguucgucucuucagauaaggaaaaguuauguuaacacaaacaaaccacccacgcacgcauucgacgacaggcuuagugugggcuuuugcaacccggagcagcgcgggaggcauuacuguaaacucaagaaaaugaguacuuauugcaaaccaugcccaaccucaccggucgcuaaggagcucucacaggcagggcgcuuucaggguuccuuuucaagaaggaggcagggcuauuauaaugaucguauuaaucggaaauaauuaggagaauuugcauauugaaacuacauuuacauacacugcccuugaaaggcugccggucugugcccuuccguguagguggcaaaguaaugugauuaauuaugcacuaauugugauuucuggugucacauuccaacaccuagaggaguuccaaagcuuugugacagauagguggcccuagccauugauagacaucuucacacuaaggaaaaaaaaauauucugucauaugagguuuggaaucuuuucagcacuaguacugaauacggguucaagguuuuuuuuuuuuuuuuuggcugaaaaucuuuuaagaacucguucuuucagucuaaguuuuaaaaaguuugcagcuauuuacuuaaauaccuuaauuuucacauaauuguagcuuaucua

SEQ ID NO: 17008 - RNA, 2581 nt, Homo sapiens
cauggaaauaguggacaccgaacuuauuauuccaaauuacauuuugcagaaacaauugucuagguggaccuuggucaaagucagcugugcggauucacaaagcaggagaugagaguccugaacuuuccaacuccgugcacugcgaaaucacgaccucggcccacaccucccaccccuucccugcuccccgccagauuucagcccugcacaggcuucucagaggagccuccacugcuguggcugagagcccugugaggcucagcccugguggggugagguagcuaacagugacugcauacuuccuggccacguuucuaggaacaaacaaaaaauggggggaaaaaaagaaaacaagaaggaaaaaaugauaucaaaaugucaagaaugcaguuguucaaggucuuugggcucuaaccccagcgagagccugggauccucauuuccuuggcaccccuccugaugaaccuccacugaagucaagccacucacacagcccagcgaccccucgcugccacaaaucccuggcucacaacagcgcuuucauuucuucuuuuguuuauuuauccaucucuucccaggucaccacuucccagauguggcaaugcagaggcaacaagcuaaguuauccaugcagccaauagggacguuacacagacaacgccaccacggugugggugggugaccccggggaugcacagucacuuagcauuuacaagauacuacaauagcuaaaaacagccacugaaaucaugagaaacagcugaauuuuguucauagucaauauucaaaguaaaaguaugcauucgaacuaaaagaggcuacaaacuccucaucugggaacuccauauuuuucugcugcccagaagggugagcacucauaaaguagguucuggaagugacagaaaaaucaaaaaaccacguucuauuuacacaugugagcugaggguguguggaauuguccaucuugaagcugaagccaucugaacaaguugaauucugucuuggcaucgcugggaagccauggauggguggcauuaucagaaguacagguuagcagaauccuguggcucucauuauguuauaaaaugucauuaaugagauaccaagaaggugcaucccauuaucaguuuuguaucuauaugagugagggcaaaaauucccuuuaaauucucuuuaaugcugucucuuuagacuuuaaugcuagccucucuccuauccaugcaggagcuaugagccaacagcagggagagggggcuuucagcagcugccaaacacgacauuucuggacaggccaccucacccucggcaggggacaucuggagagcagccuuuuaucugucagccucugcacgucuggcuaccugcaaggggccuggagcccaggguguguguguagcugaagccuggcucuugugcccagcugggccccagcagcgcuaggcagugagggaaauuuccucgcuuccagcagcaacaucuguucugggaagccuuuguccauuucucucugagaugcacguauggcuccagccagccuggaggaguggucuaaucaaugacaaugccugaaaucugacaggugcaggucccccaguggaccaccuccuguggcuugggaccagagcauuccaggagcaaaaaacugccugucaugagcuugccaccuggcucggggguguguggcaucaaaaagaagcauugcauucauuauucaccgauuccacaagagcagacacuugcacagggggcguccuuugcucccaggagaugugagcucaagauggaugaaccugucucauggggcaacaauguggccuccccucacucacagcucacccuggccaugcccucagguuaggauagucuccugcuguuuugauggaggaagcuuuugcccuagaaauauagaaauaauuuucggccaugugggaaaguuaaguugguuuaaaaaauggagagaaacauugccuugucuguccauuuauaagcccccaaaggucauugugugauuaaagaagacauaggugaaguguguauauauaaguauauucaugucuguuuuguaagugcacaaaaaagaccuaaaagaacacagaaugcacugcgagcagaagucaguccuggguagagaagggaaucaagaggguugcugauggugguccucuaugcucuucccuacacaauccguauucuuuguuuccaguauaauauaaugugcauauugaaaauuguuacuagaugauggcauggaugcuuggcucauuaaagugagauuacgaagcaaaaggaauacgagucucugauuuggggaacucuguguugaauuucuaccccuccccauucauccagaguuacagugagcuggacuguccuuggcuugcagccaagucuagguuugaccauagcucuaccacuaguagguggcauguagacuuugagccucaccuuccuccucaguaaaauugagauaagaaaauguccuucacaggucuguuaccaugaguuaaauaacauagcucaauuuucuggugccaaagaguguuuccaccaguguugccauaaaacacugccaccgucccaa

SEQ ID NO: 17009 - RNA, 992 nt, Homo sapiens
gcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaaggcuaucuuuucaaaauuaaugggca

SEQ ID NO: 17010 - RNA, 1693 nt, Homo sapiens
cccagagugagcucuauaagcauugcuggccuaauggaugcauugggggaagggggugggacaggggcuggaggaagagcucuggaguccaucacagcacaggaauaacacacagggugguggagaagccagggccagggugucaccaggucagcacaaugaccacaucauccuucuugaagaagccucaggccuuaccaacauucauggccaaguucacucggagguccacauccucagccuagggcuccuggaugggguccuuacacagcacagggaagauaccacgguacaggugggccuggcgagcugccuggggaugccaugucacaacaaucaugggggcacgugggcaguaucuggccaccuggugggcacaccugcagacuuggugaggacgauuauggccccacugcagcacuugaaggaggccuccacagugcccauggcaguagcuucugcggggucacugguaaugggugccagguggcagaacuccucaaauaauugcaagugguagaugguggccucugccucacaggcaaucaggugcugcaugugcacagccuccagaggauaguucccuuuggcuguuucuccagacagcaugaugcagucagcuuccaccagaacugcauuggccacaccacugcccucagcccaagugggguggagcuucuugaucacauccucuagcaucugaguggcaagaugacaggcuucccagcuugguugcaccacccaaucaucauccucugagcaaggcagaccuucccugcaggaaucucaucucgacggcuugugguggaucaccacgagcuaccauaaucccaucgcuggccuccaggauuucaucaaaccuccaacccccaucaugauucucaauuuugcugguuaucuugcuguucuuuccuuucucucccaagaccuuccuaacuucauggacaucagaugucuugcagaugaaugaugaaaacaucauaucgacaucuugcucgcccccaaacuucagguccuggauguccuucuccaacauggcagacagguccacggcagccccaggaagguucacacucuucuugcugcccaaggagccaccauuuuccaccucugucaccagaaagugagcauccuucugcuucacuuggagagaaauuagcccaucauccacguagaucuugcagcccacuuccaccaccuugcagauguucuuguagucccgccacaggauguucucuuacccuuuuccauguagguauuauccagcgugaacuugagaguggcucccuucuucagcuccaccucugcagugccgcugcccuugacgggcccaguugggaucucagguccuuuagugucuggagccacagcaaugggcugguagaggauggagucagaagcaaagcuuuccguggcugugcgcacguucuugauggucucuguaugguacucaugggcuccaugagaguucagaugagccacauuaauuccagacuuaaucguuuucuucagcaucucuagcaauggagaagcugggcccauaguacagaugaugccagugcuccaggcugugauggguggcgagucaguguccaggcagcacaugugcuccaagaaugugucagccauggcugcgugcagcugcugggucugaaugaaggcagcccuggcuucacuauggggcuucaacaug

SEQ ID NO: 17011 - RNA, 79425 nt, Homo sapiens
guaugcgcaugagcagaggcgccucccucuguuccucccaaggcuaaacuuucuaauucccuucuuugggcucgggggcucccggagcagggcgagagcucgcgucgccgggugaggagaacaaaguggcugcacgauuuuccccacuuuccagcccaccccccgcuuccgugggagcgacaggaaauggaagggcgccucuucucucuuugaacauuugccuuuuuuccccuccuuuccaccucuccagaaaggaagacgggaagaaagggcaggcggcucggcgggcgucuucuccacuccucugccgcguccccguggcugcagggagccggcauggggcuucuccaguugcuagcuuucaguuucuuagguaauuccguggaaacggugcggggaggcggacggacuugggcauggggaaggaaaacccaaaagcugcuugcucaccuucgugggauccugggggcuugggagagggacuggauggaaaugacgccccugggauuaaacgccaccgcccuugcuucggugguggcuggagacagcgcacgcggagcgccgcggacccucaucccccgggcucugcgcccaagccccggccccugcggccucccgcggcccccgcucaggguuuugcacccucggccgguucacccuggguuuccccaccgcagagggcagguucccugggguuggcggugcugaccgaggagggcucuccaaaaauccauugcccaggagagugccugagcugagcggaggcuucauucugggaacagaugggggccauguggcuuuaauuaaccaucucuguuugucuccggauggcaccagaaacagcaggaccuggcgcuucccuggaauggagaagccuugaaaccacuccagagccccagggacuguccaugggcuccccuagcuccggaaagcggcguccaccgcgagccccggcgccucguccccagcgaagcgccggugacccucgcgcgugcacgcacacgcacucucgcuucccaagcucacagaucuccacgcgcacacucacaccgaggaugcgcgggcugccgcgugcacgcggguucacgugcguggguguguggcccuuugggggucagccucccugcgccgggcuccggacacgucgaaguggagggucuacacauccacccuuuguugggggagcugcuccccggggcugaucagggugggcgcgagcgucgguggguuucccgggagggaggcucucgcugcuggacagaccugaugacguguguggguuucuuuccguguccuucuccuuucggagucccugccuucccagccucuccugcgcucaucucuccauugucuuuucugugcauuuugcuuucuuccgaauggacuguccucucuccgcacccacucccccgcccccgcuuguucguuuuuuucgggcuccacucccugcuuguguccccccaacucuguugccuguccuucccgcagcccugugcagagcccgagugcgcgcucaggaacccgaguucagcuacggcugcgcagaaggcagcugcuaucccgccacgggcgaccuucucaucggccgagcacagaagcuuucggugaccucgacgugcgggcugcacaagcccgaacccuacuguaucgucagccacuugcaggugagggcugagagcgggguucgaggcucugcuagcgccuccucccguccagaccuaaggggcaggcccuggggacuccgcauccuuccagcaauccagauaggaagcgcagccagccggggagucccgggauuaggcuuguagcucaaccuuucgccccaucucaguuugcacaguugcauccgccacacauuuccugccggcgcggugaguauggaaaggcaggacugccgacagcccuggcugcccugacccagagccuccaaaaggccugauuguguguguguuuuuuaaaacuuuaguuuuggaagugugcauuaaaggugauuuauccucuuuuuaaaacccuuggguuuccccaccccccucuaccgcaucuucacuuggguaaagaggauuccagcaaugacaggcgucuugcaaggugauuccaaucacugaacgaacccguuuuccucuccucauuuggugcuguucccaacuagauaucaggaucagaugcuugcuuuuacgaaaugcccugguugccaugguacccugauacaggaagaccacagugaaauuucaggguguuaccuguuucuaaaagagggcccaaauuuuagauuucaggggucauauuuauacaaagucaaaaguaauuuuaaaagaagacacaaaguguaaaauauucagaaucagaauacuuuuccuucauuuuuaaaaaggaggcuggccgggagcaaaauggcuccaugccuguaaucccagcacuuagggaggcugaggugggaggaucacuggagcccaaguguucaagaccagccuggacaacauagacucagucucuacaaaaaauuuuuaaaacuuagcugggcguggugguccacaccuguggucccagcugucugggaggcugaggugggaggaucacuugagcccaguaggucgaggcugcaguaagcgauaaucaguccacugcauuccagcuugaucaacaaagggagacccugucucaaaaaauuuuuuuaaauaaaggcugauauuucuggccucuaacaaaagcagaaaguaucaguuucacauucggggcaaguuccaagcuaauugcucagaacauggucagcccacccaccuguacaauugcccuucagaaggaggacagaguauugugugugguuugcacagcagaucccuuaaaauggagucacuuuuacaaagcagaaagcccauucuggagaccugaucaauuagaccaaaggaaugugguaaaguggauuccguucauuugcuuccagguuuauacagagaugucuagacugcuuccuccugauuagaagggaggcuguaauuaaacuuuuuuaaacuuuuuuuuuuuuugaguucuggugauuguucuccaguacuaguuuccuugacuacaaguuauugaaggcaguugauguuacuuuucuaauauuagcauuuaaauuuuaccuacaauauuaugcuaacacuuacuugagaggccaggacauccuguaaaugaaucaccagauucugaaaucagcuuugaccaaaaugagaaucacacuguuuguauuaaaagcaacuggaaagacuauccucucagugaugauuucuauaguucguuacuagagaaguuucucuaaacauguagagagcaucagaaaccacaaaaaagaggugcagcggucucuccugagugugaagcuggcucuugguauugcuucuugguucuucucuuccuuugggagaguaagaggaagaggaugcagucuuaguaguuucccuuaaaaaaaaaaaaaaaaaaaagcaacuggagccaggcucucugguauauaugauuagccaugcauuugugaagugcuuuucacagauagggccuaaagaaagggacuggacauaugcuuuucucaaacaucuagugggcaucaagauugagacaggaagcuuguuuuauccaggcuccuaaugcaucccuggcuuugggucucuguuuuuuagacaguacaucuugccagucuccaaauccuuuugagaagaagguaauaacuaaauaaauacgaugugaaauacaacguaaaaguacggucaguuaauuguguccuuauaagaauauuacccuuaaaugcuguuuguaacauacaugugggucucuauguauuucagucuuagccucauuuucagacuuaagaauagucugcauuucagaaaauguagguacagagcaaagcuccuuguggaaagagaacuauuaagcucuguuguuuaugauuugccuugauggaaugcacaggaaguagauaacucuccuaacccaacugcccagguggcucuggcucccauuuuaggagaaagaaaguaagagaaauucaaagcuaaccuaaaacuuacagucuaucuucauccuaguucaugcccauguugggguucuuugaacuggccccagauuauagugggcccaacauggcgugguccucccaacagccugguccucccuuccccagauauucugagcaauuugcagguuagccugcaugccaccaccauugauucacugcucgggcaggguggaaacgaagaaaucuuguucugugguucccaaagcuucucuaaauacuucugccuaauacuugguuucugcuucauuuagguuuuagaaaaucaggccaagugaacuguauuuuuuucuuucauuuuuaguuugcuuuaugucagcaaaaauucucuaauaucuccucugcauuuuacuguagaguaagcuucucuagcuguuuauugagauuaagguuuaagccuagaaauuugauuuugguuaaauuaauagcuuguggaaacaaugcccucuuuuacuuuagaucuugaauuugcaaggaaggaggaaauuauuuucaagacuauuuuagacucagcaaguuaaaagugaaagaugugauacaaaucuccuaagcaauuuucacacaauuauuuuucuugaagcuaauagguugauuuuuguauuaggagcuucaugggguuuuuuuaauuaaaaauguuuuuaaugagauugcuuucuagacugaugaacucaacuuuguuuguaggaggacaaaaaaugcuucauaugcaauucccaagauccuuaucaugagacccugaauccugacagccaucucauugaaaauguggucacuacauuugcuccaaaccgccuuaagauuugguggcaaucugaaaaugguaugugguugguguggggacaaguuccguugagugugauugauaacuuggguggagcuuacagguuccuggguguuuguaauuaugauucacuucucuguccuguaauuauggccucugacagauugacugccuggagcacuaacuucucuugguaaaaucuuauccuucuuccugaagcauguauuuccuauaagaaagcagucugucaugcuagaccaaaggagcauuucauaguccuuauucugaggggcuuuuggagagaauacuugugugccgggggcugucuggggaggguauggguacuaucucaggcccuuauucuuccacaaaauguaacaucuuucauuuugaucaaucccaaaggaaggggcagaaucauagcccccacuccuccccccacugccuuccuucaucuacagaaagugucuugauaguaauaguaacacuaugaauaagcagcaagauguaauuuuuucaaagacucugucaacauggauaugaccccaagucaaaugguuccuccagugauugcaugaauuacacccuuuuuccugucuuugcuauuugggauuugguguaauacauucaucaaauaugauuuuacuauugcugugacaugaagcccagaugaguuucacauuuguuucaaacucgaaugcugaaauuuggggaauaaagguagaguuauuguguucguuaauuaacaauguacuguuagaucuuuaaaauaaauaaauaaauaaguauccucaaagaagugaaccuaacccuggccguuaaaaagccuggagacuacuagauuucuuuauucuaugcaguacaccugggcaggcuuuggaugccgcugcagccaucuaucauucuguaaagacaaacgcccuuaauagauuucuuugucauugacuguuuguuuguuuguuuguuuauuuuugaggcagagucucccucuuucaccuaggcuggaaugcaauggcgcaaucucagcuuacugcaaccuccacguccuggguucaagugauucuccugccucagccuccugaguagcugggauuacaggcacaugucaccacgcccagcuaauuuuuuguauuuuuaguagaggugggguuucacgguguuagccaggguggucucaaucuccugaccucgugauccacccgccuuggccucccaaagugcugggauuacaggugugaaccaccacgcccagccaucgacuguuaaauugcaauauuuucuagacuauugguuucuaaggagaguugguuuguucauugguuggccuuggcaauucauugguuacaaacuucauugggucaucagaaagcauuuaucauuuagagccauguucauucuuacgggggcauauuuugguugauacuucagugugaaagagaaguuucuguaaaucugcaguguaccccgaggacuucugaaacagcagcaagcuuauuaugaacaaagacuaggaacauuuccugaucucccacauucuucuagugaaagaccguuugaagaagaugccucaacauuaggauggagacuguccccauuuuagucagcagacagugaaacaguuuaucaugugcuguaguucuagaggaagguuuuucuuaguuaugucgaguuaaucaacuucuacaacuuugaaucucugggacaaaagagaccagaugccagaaagaagagauuuuccaguagaggggcuugaguucucugucacucugucacaagagauuagaugagauuagacugauggaacuuagucuuuagaaagucagacugauuguuacuauacccuaucaucucucuguugucugaucacaguuuaagaguuuaugaaugugauuuuaucuauuuucuguguguugugcacaaguugugcuuauacguggcggggcuaaauuaucaguguccaggcacagaaacgagcuuggaauguacgacuauuuuuacccaucgugaugaucucuuccuaggucugacagaaaucaaauacacuauagaagaaugaccuuguuucuuuucucuguggauuuuucuucccauauaaaaaaaagccuguagugcuuuaucagguuauaaaucuaaauggaaugugcuuuuggugcacacauugcagcauauguucuuagguuacagaaauggcacuagucuugcuuugcacuuuacauuauuuuguuaucucuuaauuuugaacaaauauuguagguuuuuaaaagccuggaagaggagagauguacaguugccuaacauuucacucaaaaauaaaugcccaguguaguucuguaauaugguucuuuuugauaaguuagguaagauuaguuagugugaauauaauguuuuucuuuuaacauuccagcuaacucauauccguuccaaugaccacuuuccucaccccccgcccccucaauugacuuggcaauuuuccagcaagaguuuauuucaaaagguccuccugauuuccugaaaauacaccagucugugacaugauucauucugacacauuccugucuuuccgcauuuaagacuucuuuugcucucaagauggaccccaaaagcucucucaaacacaagaagcguggcaagccucccuugcugaacaggcaggcuugagagcucuagggacuggggaggaggugcuuuccaucucuggaauuccaguggccuuuuuaacguguuuaagugagacugacugacccucagggcaagggugcaaaggcucauuuguuuguucaggcuuuccccugaaagagaagauguuaguauuuguucugagccaguuuauuugacagauucuuuuuuucucuggcguuguuuuucauuguggaaaugcauccaaagguuuccccaucagggauagguuuuucuaaguugugguauaacuaacauaugugguagacucuuauuuauuuucuuugcugcugcauagagaaaaaggaauauuuguguuucuacuggaggaggauuguguccuugugcaucagacugcaagcugacccccuacugugcacaggaagugccccucccuuuuuuccuuugagagcagcuuggcuuagaggguugggaagauguuucacuucuggcuaggcaaaggaugucuuucuugacagcagcuagaggcacucugccagaugucuuguuccagugagcagauucaaucuguugaacuccagaaugauuuguggaaaacuaaagaaucauucaacuugugcuuuaccaccuaaauaagcccaugggauuauuauuuaguuucagcuucagcuuaagguagaaugcgaggauaauuucuauggggaacauaaaaguaauuuaaaaaauagucucaacuauucacagauguuucuauuuacaguuucauuuauuguuuuauuuuuuuuaaaucuccuguagguguggaaaauguaacuauccaacuggauuuggaagcagaauuccauuuuacucaucucauaaugacuuucaagguaagaaauccaugacuuucucacaaaugacacaugagagcacuguguaauguccccuuucaaaauggaugucagaugugaguugaccuaaaugggaacuuaaauauuauuguugccauaaauugggguaauugagcaguuuuuaaaacgagcaugaauaacugcauuuaacaaauacucuaucuucaugacaauaaguagaaagagccucuauucuaagguaauucaacuguaaacuuuuaauuagguaucuuuuuauuuccccauagaguaaggcaguguugacccuuuuccaaaccgcaauaaaacaucuggagaguaaaucccuggucccuuguguuucuguuuuaauacugacuuugguaacuggaaaggaaguguguucucuuugguuuucagaguuuugcacaauuugugagcagauucaaucuguugaacuccagaaugauuuguggaaaacuaaagaaucauucgacuugugcuuuaccaccuaaauaagcccaugggauuauuauuuaguuucagcuaaauaauagcuuaaggaacaguuuuacaguuccuuaagaaauguguaaugccuucuuaaauguggauuuucucaucauuuuucuuugagagauguaaaaugacuccagaacuagggaaugucucuguacaaagucccuuuguuucuucuuaagcagcugccuggaaaugacaggcuucacauggcuuaaaguacacauuggcucacagaaaacccauaauuuaguuauugcuucucagauuaaaaaucacuuuugaauagcuuucaguuggaguugggaaccuuaucuacacccucucaggauaggaaaaggugccaaggauagauuuaccaugugggcggguagccaugaaagucucacugucucugccaccaaagugggaggccaaggagcuagggugggugugggagucagaaugcaacuaggagggaugcugggcugugccucugagccuuuauccccuugcccacuccccagcagccugcuguuccugcuggagcaggaaggugggcacugugacugugacaccugguauugagagugguggggaagguuucacuaaauaaauugucaacuacuccuugucaccaaccgcuugucccuucauugaccacacaaucuggugauuaaacugaugcucaucggccuacaaggauguuaccuuuauguuaugugacaccugagaauacucaaaaucaucuuuauuaauguuuaugauccuauuuuuuccuuugcagagggcaucuguucauauacauggauaguucugaguucaucuagauccaaaauccuuuaggcacauguuuuguaguugaauacucauucaggugaauacagugggagaaagaugaacuuacuuguguaggcgcagaagguaaaacgggggugaugauugaacugagacaugcagaauggcuacaaguuggggccaggcgugguggcucacaccuguaaucccagcacuuugggaggccaaggcgggcagaucacuugaggucaggaguucaagaccagccuggccaauacggugaaaccccggcucuacugaaaauacaaaaauuagccaggcgugguggcacgcgccuguagucccagcuacuugggaggccgaggcaggagaaucguuugaacccugcaggcgaagguugcagugagccgagaucaugccacugcacuccagccugggugacagggugagacccugucucgagaaaaagaauagguacaaguuaucacacugguuuaugagaaaacaacucauccuucggguccuagcuccagugagaaaagcaacaucuaugggguuggguacauugggugugaaucccugccugcuccuucuuggcauguguggccagagcugugacuuccucauugguaaaugggaagaggaauaauaccuacaucauaggacauaggacagaauggugauguucuccuguuccccucuguuuuuuguuuuuuaaauacugagucuugcucuauugcccaggcuggagugcaguggugcaaucuuggcucacuacacccuccgccuccuggguuuaagcaauucuccugccucagccuccugaguagcuggaacuauaggcacaugccaccacaccuggcuaauuuuuguauuuuugguagaggcagguuucaccauguuggccaggcuggucucgaacuccuaaccgcaagugauccucccaccuuggccucccaaagugcugggauuacaggcgugccuaccgcgccuggccuguucccuucuguucugggaacugggauaaucuuguugcccuggcggauagugggaaccugaaagucuuuauaaaugcagaugcuuggcauauaguaauugcucuacaaauguuuacugaaugaaagaauaaguggauaaaugaauucaaccaucuucuguuuguaagaaacuacccuacuuuaagccuuaugggaaauuguaaagauagcacagugacugcccuccaggagcuuccagucuuccagaggagaaagauauacuugcaaauaacuuacaguaugugacagaaugugcuaaugacuacaacagaaguucagacaaucuuuguuagccuggaggagggugagauuaauuuuagccuggaauaaagaagaaaccuaggacugggacugcacuugaccugggccaggaagggagagcagggaugucagugggaggagauggaagaaaggccauucauggccggagggaaacagucugagagcaaggcacugguggugggacagugggucaggauuugcucagcaagugcuauguagauuugccucgaguuugggguagugagagaaggaaaggaaaggaaaguagaaaagcagauuagaugcaaaggacauugacuccuugcuagggagugugaacuuuauaagaaauagggagccauuacaacugaugaaucuuagaaauucuuuuuuuuuuuuuuuuuuuuugagacgaagucucgcucucucccaggcuggagugcaguggcgcgaucucagcucacugcaagcuccaccucccggguucaagcgauucuucugccuuagccucccgaguagcuaggauuacgggcaugugccaccaugcccagcuaauuuuguauuuuuaguagagacaggguuucaccauauuggccaggcuggucuugaacuccugaccucaugaucugcccgccucggcgucacaaagugcugggauuacagacgugagcuaccgcgcccagccuaaucuuagaaauucuuuuaguaauuuuuuuuuuuuuuuugaggauggaguuucacucuuguugcccaggauggagugcaguggcacgaucuuggcucacugcagccucugccuccuggguucaagcaguucuccugccucagccccccaaguagcugggauuacacgcauguaccaccacacccggcuacuuuuguauuuuuaguagagacggggcuucaccauguuagucaggcuggucucaaacuccugaccucaagugauccaccugccucugccucccaaagugcagggauacaaaagaggcaugagccacugugcucagccucuuuuuuguauuuuuaauaagaaaugaaugaucauuucuugccaaaauuugccacuaugaggugauugcaauaauucuguugcaaaaacauuaacauuuaguaugagucuuuuuuacuguauucuugcaguuaauaacugcugcuaucauguuauuuugugcuuuauuuuuguuuaugccagucuuaaagauccagauuucugaaucuuuuaaaaaaaauuaauaccaaaaaaaaauugggaaccauugacaagaaaaugagaccuguguuucaggaagguagcccaagaggaaauacaaagcaaggacugggauggcgagaauaaagggcauguugggaggcucuguugaugucagcauugaugaagcauuaauggaggguuacugcuaaugcaaaaacuggcugugauucuuaaguaggagggagccuuuuccugcaacccaggaguccuguaagaauaucuuagaaagcuuuuucaaaucccauguguccacucacugccauacucugauacucucugcuguuaacugccuuugaggaucauugccaagaugaggugccccuguuuucuaagggcagucauuuggauacuuuaaaaucaaaagcugaaccaugaaauggagaaagauuagaagcagaacaguggaaggaaagggcugaaucaaaaauuacuuagggcugcucugcuuauggaguagccauucuuuucuuccuuuacuuucuuaauaaacuugcuuucacuuaaaaaaaaauuaguuagucaagugaaauaacuaggaagauggugaagccacugacaguagugaaaucaggaagagaacugagguuguugauuuuuuucccccaaguucgccauagagauggcuaauugcuaaguggauuuagacuagcaaaagcucauuuagcauguacacaguauguuuuucuauauuacuagauguuucaaaacucauaacucuuggccaggcauaguggcucaugccuguaaucccaacacuugggggugcugagguggggggaucgcuugagcuucaggaguucaagaccagccuggacagcauagcaagacccugucucuacaaaaaauuaaaaaauuagccaggcaugguggcacacgccuguagucccagcuacucaggaggcugagguuggaggauugcuugagcccgggaggucaaggcugcagugaacuaugauuguacuagugcacuccagccugggcaacagagcaagacucuaucucaaaaaacaaaacaaacaaacaaaaaaaaacacaaaaaacucauaggucuuuuguuuauuauaaauuuggaggcaacugugcagcaauggcaggccugggaagguugaugacuaagcagagaguauggaaaggauucuauucguuagguaaaauguguuguucugguuuccagcagcuucuuaacuccacgggaaauuggaugacucgucaaugguccuuugggacuuaaaaguuuccaaaagagagggagaaggaagcacagccagaaauggcuuucacagagccauuggcacagagaaguccgauuagaccuuccccucucuuccucuccccaagccucccagccaggcucucacggggaguuugccaugguacguggcacacaugguucaguuaguccuuagggauuuuucucucuuacuuuaaaauucuuaggcugauauucucuugaguugaauacgguaucauuuucuuauauuccuggguaggugaaaaauaaaccuaagcagcuagugagugaauaagucaaagaaucugucaaaauguaauuguccauguucuuauccuugacaucuuuuaucagagaaaaagcucagcaggauuauuaaggagggcuaaaggaagccuaagcauguuucuaguuuucaccauuaacccucacccaaauuucugucaagcguugguuuuaauucggaaguaagugucuuuauuuagguucuguuuucuaggucagcugaaauuuccuuugaucuuuuucccuuguaaucugacuuccaauuccccaaaaugcaucacuguguugguuagugucaaaaccuuugccuguuugccuauuuuucagcgcucuuucugcuucaucuuuuacuuccaguugacccuguucacuacacccuccuaaaucucccuccugccuugguuucagaagacugccuuuuuuucucuuuucccucugacacucauuuuucagucuucugugccuucagccagugagggagaaagauaggaauggauuugaaucuaagcucugccuguaacuagcaagucagugucuccgagccucaauuuucucauuugucagacaaauguguugugagggugccuugguuuccuagggaugccauaacaaagugucacggacuggguggcuuaaacaacagaaaugugucuucucacaguuccauaggcuaggaaucucaggguaagguguuggcaggguugguuucugcugaggccucucuccuugguucgggauggcugucuucucccugugucuucacauggucuucccucugugcauguguguguccucaucuguucuuauaaggacaccagacauaugauuacagcccacccucaugaccucauuuaaccuuaaucaccucuuuaaagagcccaucuccacaucuagugaccugaaguauggaguuaggucuucagcauaugaaacuugcagacacacaaaucagcccaaauuauagagaguuaaaguaaagaauguaaugagggguacuggcaccacucuguuuuccuugucuagccccugguugauacguuuuucuagagcacagacuuaggcucucuuuaucuuacccauuccuuuuuucuuuuuuuuuguuugagacaucauauacuuggagguuucaaauaugugugugcagugacucccaaauucauguuucaagcuccauucuugcagcugagugccagaccacuuuuuccaagugucugaugggugucuccaaguggacaucacacaugugacuaauuagccuacaaccaaaugcuuucacgccucuuccacguugucgucauuggcaacacagcuaccuggcuacccaaguucaggugccuguauuucuuuccucacccugccuuuuccacuacaaucuaauugaucaccaaguguaauucaauagagucuucugucacuaaauuuucagaguggucaguuccaucccuuucuaucuacauuguaauuucucagguuaaaaccgucaucuuuuuucuuucacuugguuuuccuguguuuuguaucauccauguccaguaacuaccacaagaguuauuuuucuaaagugcaaucugaucauuucauuuguccacuuaaauuuuuuaguguucucuuuuccuugcaaaaacguaagucccuuagcauggcaacuucuuaccugccccgaccaaccucuucugccacgugcagccgccuccacccacugccuggaaaacaccuuguugcccuuuuaagauccaguuuggcccaggcgcgggggcucacacuuguaauccccucacuuugggaggccaaggcagguggaucaccugaggucaggaguucuaaaccagccuggccaacauggugaaaccccaucucuacuaaaaaauagaaaaauuagccaggcgugguggugcguguuuguaaucccagcuacucgggaggcugagacagaagaauuguuugaacccaggaggcggaggaugcauugaacugagaucgugccacugcacuccagccugggccacagcgagacucugccucaaaaaaagauccaauuugaugccuucuucucugugaaguauuccuagcuuuuuuuuucuuggcaguaaaauauccauaacagaaaguuuaccauuuuaaccauuuuuaaguguauaaaucaaugguguuagguauagucacaauguugagcaaccacuaagacugucuauuuccagaacuuuuucaucaccccaaacagaaauucuguggccacugucccucugcccagccccugguaacugcuaaucaacuuugugucucugucuacuuaaccaauucuagguauuucauacaaguggaaucacacaauauuuguccuuuuguguggcuuauuucucuuagcauaaugcuuucaagguucauccauguuguagcauguauuggcauuucauuccucuuuauggcugaguaauauuucacagcauguauauaucauauuuuguuuaucuucaucaguugauggguacauggguuguucccgccuucuggcuauugugaauaauacugcuguggugaacauucauguacaagugucuguuugaguuccuguuuucaauucuuccggguguauaccuaauaauguggaauugcucgauuuuccagcuucuugaguuauuaauuucuuccucuugcuuuuccaaagcacauugcaugcaacccuacuaugguguuugacauagcauauugcaaauuauugacacccauaucugcaccucauuggacuguguauaacauauacaacauauaguccacuggcugauacuaaggagguagucauaccuuuauugaaugauuaaaugaacgaaugaaggaacgagcacucaaacuugccacucauauuacaguggacauggugacuaaauauacgaaaguguguuugcuauuuaggccuguuuauaaucagcuucuaaagagaaacaguuuacuuauccaguaggguggggaaaaguauacauuuuagagguuagacauuuuccuugcaagaagagucucuguggaacagcuugaauuauuugaaauccagccacagucugaaauacaaaccauaugcaguucaaguuuguggcaugcaguugagugacauuuuuaccugagauuaaaaaaaguagagacuaccaauaaaaaacaucaaaugagauuuuugcuccugccuuuagacauuccguccagcugcuaugcugauagaacgaucguccgacuuugggaaaaccugggguguguauagauacuucgccuaugacugugaggccucguuuccaggcauuucaacuggccccaugaaaaaagucgaugacauaauuugugauucucgauauucugacauugaacccucaacugaaggagagguuuguuugcuucuguguuuuacauucuacuugcaaaucuacuuuuugauuauugcagaaguaccaauuacucuuguuuccauuuuuaggugauauuucgugcuuuagauccugcuuucaaaauagaagauccuuauagcccaaggauacagaguaaguucauuuucaaacaaaaguguuuuuuguuaguuuguuuguuuguuuuguuuuguuuuuugagacagaguuccgcucuuguugcccaggcuggagugcaauggugcgaucucugcucauugcaaccuccgccucccggguucaagugauucuccugccucagccuccuaaguagcuggaauuacaggcaugugccaccacgcccagcuaauuuuguauuuuuaguagagacgggguuucuccauguuggucaggcuagucuugaacucccaaccucgggugaucugcucaccucagccucccaaagugcugggauuacaggcaugagccaccacgccugacccaaauaaaauuuuuuguuuguuuguuuuguuuuguuuuguuuuuuugagauggaguuucacucuuauugcccaggcuggagugcaguggcgcgaucuaggcucacugcaaccucugccucccagguucaagugauucuccugccucagccucccgaguagcugggauuacaggugcccgccaccaugcccagcuaguuuauuuuuguauuuuuaguagagacggguuuucaccauguuggccaggcugggucucgaacuccugaccucaggugauccacccgccucagccucccaaagugcugggauuacaggcgugaaccagcgcgccuggcccaaauaaaaguuuugaugguaaacagcagccauggaauaagucuuacucagaaucuaaauauucagugcuaaaucuaccuuuuucauuuuccuucuuucucuguguuaccugaccagagggucuugaaauuagcaauaauuacucuccacugauagggaauacauuuacaucugauauaagauguaaauacaauacauccgauauaagauugauagguuaucaaguaauuguguugaucauaauaccuuauuuuauugcucaguauauuaggguauauauugggcuuuuguaucaaagagucuccccaaaucuaguuguucaaauaaggugaaaguuucuuucucucuuacaaaacccaccaaagaguuuucuagagaagaaguguagcucaauugccauaauuaagcuuaccagauaaaauacaggaugaugcccaguuacauuugcaaauaaauaauucuuuuuuuuagcauaacuauaucccauauaucccauauaauauuugugacuaguacaagugugucucaugcaauauuugugguugguauaaccauguccuaugugauauuugagacauacuuuauccuaaaaaauaguuguuuaucugcaauucaaauuuaacugagugucauuuauauuuacuuguuaaaucuggcaacccuaguuauaaggccauccauguuuccagguuuauucacaugguuagaguuagaccaccaccacuauguccucaccucaacucgggagaagagggaagacgaggcaagcaaauuccauuuaaagaugagacaugggccaggcguggaggcucacuccguaauccccagcacuuugggaggccaaggcaggcggaucacuugaggucaggaauucgagacuagccuggccaacaugguaaaaccgugucucuacuaaaaauauaaaaauuagcugacaugguggcauaugccuguaaucccagcuacucaggaggcugaggcaggagaaucgcuugaacccaggagguggagguugcagggagccaagaucgugccacugcacuccagccugggugacagagcaagacucugucucaaaaaaacaaaaaaaugagauguggaaguugcacacgucacuucugcucacaucucauuggccagaauuagucacguggcuauacugcaggagacacugggaaacaucucuagguguuucaugugcucuacuaacacucuuggcgagggcucuuacugucaaaggaacaagggaagaaagaauacugaagagaaaucagaagucucugccauucucaauauacucaauaaaaugaggguugcauuuccguuuaauagaaaaauaagcugaagcuuauagaguuggauguuauuacguaaagugauauggcuauuaaauggcagucagaucuugaauccauauguuacggugcucaguucagagcucuuuaccacauucaacaacugcucuuauuacacaauuacauuuuaaucuucuugggaggcauguaugguaauuaaaagaaugggcucacugggcgcgguggcucacaccuguaaucccagcacuuugagaggccuaggcggguggaucacgaggucaggaguuugagaccauccugaccaacauggugaaaccccgucucuacuaaaaauagaaaaguuagccagguaugguggugcgugccugucgcuugaacccgggaggcagagguugcagugagcugagaucacaccauugcacuccagucugggugacagagcaagacucugucucaaaaaaaaaaaaaaaaaaaaaaagggcuuuggagucacaaaguccuggauuuaaauguguucauaaaucauaaauguguucaguacaucaaagcuguugcuacauuuguugcuguugauguugcugugacuaucagcuuugguuuggguuuugcacaggacuaguuccaaauguuggaaugaaaggugagccugccucuccugcuacuaaggugcaaccaguugaguagaggcggggcugauucuugcugaucuuucccagcugcacaaggcccuauuuuuaaccaaggccccaaaaaacuuccaagcuugaagcaaggaagaguggaguggaagaaguccagggaauauugccagaaaaaugcugcuuccccauuuaaauuaauuuuacauguggcccagccugucucuggucuguaauuuacucauucauucucuuguaaaacaaauauuuaauagauguguccagcucugugccaauuucugagugagccaugaggccuuuccugcaugucucaaaaugcaguuaugaaaaacguccacaagggcucugggacagacacccccuaagucccuaaaaggacucaaccaucugcucccuuuaaggugaaauuugugggacuuggaggauguguugucuuuauaauuuugauucuuuugucuuuugugguuaaaugacaucggagaaucuuuuucuauguuacggaagcaugcauguuagcugaucaugcauuugauuuacuuuguaaucaagggagcaauaucucuuuaguugucuauuguugagaccugagacucacuucaaaagugauuugccacuuagaauagcagucaagaugaggcucgcuuuuuaaauauggcaggagagaguggggggagcauauuugcucuacugagggguuuccacaaaggucaguucaaggguuucuaaauacuccagcugcucuucaaguuuguuguuuggccucuugucaauaggcgcuugugcucauuuugugcaggaggauuugugcaggagaaaauguuggcguucauaacugccauucaguuggggaguaccacgguuucucuguuuaguuuuugauuuuacaaagaaccuaaguuuaacacauggacuuuuccuuucuacccgcagccauuucuauagcuucauuguaagcuaugcauguauuaaaagcauuugaaauuguauuugggcugugaaaauaucugauguacugggccacuacccuguugucuuauguuguaauuuauaagaaugcacagacauaaaugacaguaaagaaccguuucaggcuacagagcuugagagugcagacagaugaaucaaucucuggggauccaguucagcaugaagaacuuaguaacucacgaaaaccccguggagaagguugaauggcucuucguuugucuaguuacuauagaaugaauugguagcccagcauuuacaauaagcagaagucugcagaccuaggaagaagagggaaagauaaaauugauuuagagguaacuuguauuugagaaaaaauaauuugccccacauccuaauacuaagcuuauuuaugcuuaugucacuauauaauauugagaaacguggaaacguuuuguaaaacugggacaaaaaaguuguggaccaaaauguugcuuaaaaacuugaaauguucucuccuuagguuguaguuauucuauagcguuaacacuauuuugguaacuuggaugucauuuaagcggugggaaauuucaaauuuucccuuccaaaaauagagacaaaaauguuucuaacuaucuuauaauaacaaugagaacuggagugcuuugauaaaucuuuuccuaccugaauggaauuuucucauguugaaacugacauuaauugcugugggaagcagauggcauugugcuacuucaaauuacugucugcccgcagguuccagcagucaugcagcugcguucuuauaauuucuccacuuucacacuucuuccuaaauagcuguucugcaaacagacccaucacagaauagcuacucuuuuuuguugucguucaggcaacucuccugccucaaccuccagaguaacugggauuacagaugccugccaccacaccuggcuaauuuuuuuuuuuuuuuuuuaaacaguuuugcucuugucguucaggcuggagugcaauggcacaaucucggcucacugcaaccuccaccucccagguucaagcgauucuccugccucagucucccuaguagcugggauuacaggcggaugccaugaugcccagcuacuuuuuguauuuuuaguagagaugggguuucaccauguuggucaaggcugguuuugaacuccugaccucaggugauccgcccaccucggccucccaaaaugcugggaauacaggugugagccaccgcgcccggucuaauuuuuguauuuuuuuagagaugggguuuugccauguuggccaggcaggucucgaacuccugaccucaagugauccaccugccuuggccucccaaagugcuggaauuacaggugugagcuaccacgcccggccgacauucuuaugaaacugaugagagggcaguaaccuuuccucuuugcagucauguuauguuaggcuucacuauuggagucaucuagaucauacaagaggaggaacuuaagcuauuuucaugugucaugccuuucucuaaaaagaaaugaugcaaggaaaaaaaaaaaaacuucuugcuugucugaucagacuuuucaucuucuugaugaccuuccuagauuuauuaaaaauuaccaacuugagaaucaaguuugugaaacugcauacuuugggagauaaccuucuggauuccaggauggaaaucagagaaaaguauuauuaugcaguuuaugauauggugguucgaggaaauugcuucugcuauggucaugccagcgaaugugccccuguggauggauucaaugaagaaguggaaggaaugguaaguaagcccucugugcaccuuucuccuuuauguggcugguaauaaaaugcaaagugaagcuagucuuaccuuaagccuuuuacauuuucuggggguuuuaguuuuacagaguuacauuuagcccuuugcaccauacagguagcugauuguugauuuucucuuugaagaguuucuuggacacggagaauguacagacuacucauuucauagacgaugaauuuuuggaauuuguugcuucaggcuauugcuaaaguagauauuuuagucaacaaggauuaaaaaguugucuaaauaacaauugagucugccuuuacauagggaagauuaaaaaccgcaguuaugcuagaaggcauaaauugaucucaacccaaagaaauggauuuuuuuuuuuuuuucuugagacagagucuugcuguguugcccagacuggagugcaguggugcaauuucagcucacugcaccauccgcauccuggguucaagcaauucuugugccucagccucccaaauaccugggauuauaggcccacaccaccaugucuggcuaauuuuuguguuuuuaguagaggugggguuucaucauguuggcuaggcugaucucaaacuccugaccucaagugauccacacaccucagccucccaaguagcugggauuacaggcaugugccaccguaucuggcuaauuuuguauuuuuaguagagacagggcuucuccauauuggucaggcugaucucaaacuccugaccucaagugauccgcacaccucugccucccaaagugcuggaauuacaggcgugagccaaugcgcccugcccacggcuggaaaauuuuaacccacacccaugggauaucauuuuagggaucaaauggaguugguuucuuucuaucuuuuccuccuaauuccauucuuuuccccacuuuuaugccacauuugcaacuuauguacauuuugaaauuugggauuugggugauuugccaaauggauagaugaguuuauucuauuaguaucuaggagaauucuuacagaccuagaggauuuuaaggccagauaggacuuaugagaucaccuagaccaacuauuggugauagagcccaaggauuaaguaauuuacuagagagcccuaaguaaaugagcagcagguggaagcucaagccucuccucacucagccccaggguuccuuccccuaagcuguggccuccccucaugaaggcugugcuuaugugcuguugccuuuucaaagauuguuaguccuuagaagguacaggauugaguguauucagcccuuuaaaaacuucugccuucccuuuacuccaguuagaacuuuuguugcacaacagaaguugaauuuuugacggagccugaaggggagggagguauuucucuaaucuuauugguccaucuuucagaaugcuagguagauuauguucccuuuacggcauaacaaaucagcuguguagcuaauguccuguuacuaucacgggucucacagcaugugcuguugauucaggcccaguagggucuuaugguaugugcuuuggaacugguuuucaguuuauguaaaaccaccugguaauaacaggacuuuagucuucugcuaacugcauucccaccaagguggguccaggagggaccugucuguccuguuccugaauuccauucuguagaaacucuuguuaaggugagaugcccauauacaugcauauuuaguggaccaaaaggccguaauucauuuaucauuuauaugccucaagggucguaagugugccuuacagugacacaaggcaaaaucauauaucaugggccuuucaucaggcaaauuaauauauuucuuuuacgagaucuuauauuuccuuacauaaaaggaaaacauaaauguaaaugugauaaaugauuaauuuuuaaaauuuuacugucauugaaagaaaaauuuaagugcuaugccugaaguaaaaaaaacuaaaauaagcuagcuaacaaaaaccuuuuuaaaaaaauggugauuuggcuaagugguaaaucgugcaguaauauaaauugguuuccaggugguauguaugcauuuaguucuacauuauaacuuuuguagauuucuauuacaauagguuuucuuaaaaaaaucuuaaguaacuaguuuuuuuuuuuuuuuuuaauuuuaaguaauuuucuucaucuggguucuuuucauagauacucaguaaaauauuucuugugcauccacuauguaauaggaacauucuagagaugaggcauguagccaucaacaagacagacaacucacugcaggcagggagaaaauaaaaacaaccaaacaacccuuuucuguggugagcuagagauuaguaugaaaaaggguuuuaaacuuucaauugauuauggagaaacguggcuauucauacaucucuuccuuuguucucuccuguuuuuauaacuuucaagguucacggacacugcaugugcaggcauaacaccaagggcuuaaacugugaacucugcauggauuucuaccaugauuuaccuuggagaccugcugaaggccgaaacagcaacgccuguaaaaguaagucuguguugaagggacauuuuaaauccauucaggcucuaguauccauuuccuaauuagagguacuguaacaguguacuguuuugcagaggguagaaaaguuacugucuuuuuuccagcuucacccugauacuccuagacaaccaacaaucugcauucaguuaauuaauauucacugaacagccucuguguguuugacacugagcugaguaguuuggcagcuacaguagaaaacuaaggugcuguccuugacauuguaucuguuuuguuuuuugguuuuuuuuugucgccuaggcuguagugcaguggcacaggcggcucacugcaaccucugccucccagguucaagcgauucuccuggaguagcugagauuacaggcacgcgccaccaugcccugcuaauuuuuuuuguaauuuuaguagaggagagguuucaucguguuagucaggcuggucuugaacuccugaccucaagugaucuacccaccuuggccucccaaagugcugggaguuuacagaugugagccaccgcgccagggcuguuuuuaaggcaagaugaccgugagagaaaaaugaaagaacuauauggcaggguagcugaugaaggucuaagagauauggaguagcauuuuuggccuuguuucugugccaguccagcugcggccucuggcauaccucccuccauccaucucagggguuuucuccggguggagauguagccggcaacaccacugccccuccccacuccacaaacagugauucugaugcauguccuccccuugaagagcagcuccgccucugcccccacugagaaggacuauuauagaaguucagcagccagugagagcuggaguggucaaggcuugcuuuguagguaaaaaccagauggcccuugauggauacuuaacauggagaaggaagggagggagggaggaagggaaggggaggaaaggaaggaaggagagagaggaaaggaaggaaggagggagaggaaaggaaggaaggagggagaggaaaggaaggaaggagagagaggaaaggaaggaaggaggaagaggaaaggaaggaaggagggagaggaaaggaaggaaggagggagaggaaaggaaggaaggagagagaggaaaggaaggaaggagcaagaggaaaggaaggaaggagcaagaggaaaggaaggaaggaaggagaggaaaggaaggaaggagagagaggaaagaaaaggaaaagagaggaaggaagaugggagggaguucagguaagaacaacaaugugaagcacaaggccgcaaggauguucuugaaaccaucacagaguccaugcugggaaggauuacuccaagguucacuucaaccaguguauugagagcaguacucuguugggcaccaaggaugugaguagauaagacacagucccucuucugcaggcuguuguguugcagggggagacaggcaaggugggaggcuggagugcagaggcucaggagggccaggcugagucaagcuucccugugcaaagacaagaaugggauuguuaagcccgagagcgagaugauuaaagcuggguggcaccaagaugaccgccgaaugggcucgcagaaggaagcgcugcacccaagggggucagcuagcuggcuguuaaacagaccuaccuuccuuacuauggccuggccuggugugguggugggaauaugggaauacggagaagggaauccauccuucaggccucacgguccuugaagcagggagcccguggacaggcuuuccuagcagcacaucaucuggaaggucccucgcuacaguguucuuccauccagucccaccucgaguggaccagaaagcgcccucagugggauggcagccauccucugucauacacuuccaaagggacuuucccuuagaguuuuccauuuuucauagcccauucucuuccacagaggucagauaacuguuuauuuuauaaaguucacauuuuugagauuucucaucuacuuuaggguuuaaacagugucaucgguggaugcguccuuuuuccccaggaguccugcuuguugacugccauuuugucugaacuuagucccugguuuccuaaaggaucuuccugccacccccauccuccauugguccauagauuuaaaaagcuuuucuugacguugcucuugucacgcagaauguaacugcaaugaacauuccaucucuugucacuuugacauggcuguuuaccuggccacggggaacgucagcggaggcgugugugaugacugucagcacaacaccauggggcgcaacugugagcagugcaagccguuuuacuaccagcacccagagagggacauccgagauccuaauuucugugaacguauguugagaaaugucacucacugugugggaccuacuucagauugccuuccaaacugaauagucaguagucucagagcucauaguaugagcaguaaagccagcauuguuauuguaauugcaguugaagacgcugggaguggaauuuacuugguaguugugcugcuuuuagucgacuuuugugagauuuagagggaggaagggaauauauguauuuauacaaagauacauugaguuuccuccugauuuuaaccuggugcuuugcauucuucucaggauguacgugugacccagcuggcucucaaaaugagggaauuugugacagcuauacugauuuuucuacuggucucauugcuggccagugucgguguaaauuaaauguggaaggagaacauugugauguuugcaaagaaggcuucuaugauuuaagcagugaagauccauuugguuguaaauguaggucuguuugcuaaaaaguuugggaguuuucuuguguuugaaauucccauuuuacuuuguaauuccaaagccagauuauuauuugaaacucacguggucuguguuucuccacuucauuuuguuuuaauacagcuugugcuugcaauccucugggaacaauuccuggagggaauccuugugauuccgagacaggucacugcuacugcaagcgucuggugacaggacagcauugugaccagugccugguaaguaaauccucauuacgugggaugggugguuggugaggaugacauguuuuaauagagaagccuuuucgccauuguagagucugcgaucacccucacguguacguguuaaaagacaugaguagacaaugcacacaauaggaauuacuaauggaugauuucacaagauguucaccaucccuguuagaaguguaaaggaaagccacaauaaaauaccacuuuuauagacacaauuaacacaaguuuuuaaaaaugggaauguuuacuauuaggauaucaugagguacugcuacuucuuggcugcuggugggcauccauauugguuuguacuuuugugaaaagcauuuuggagauacauaucaguagcuuguagaaaugggcauacccuuugacccaguaaccccaccucugggaaucuauucuaaugaaauaaucagaaaauuggacaaagauuuauucuccagaagacucauugcaucuuuuauuaaucauagcagaagacuuggaaacaacaguggaaaaauaguuaaguguggggacuucuauacaauguaauauuugguugccacugaaaaugacaauaacaucaggaaaugcucaugcugcuugcuauauuuaaaaaaaaaaacacacacaggauaugaauaguaucuugauuaaguaggaaauaaaauucaucaaggaaaacaaaaucuggaaggaaauacaccaaaaaguucacuguaauaauuccaaguaggauaauuaugagauaaguuuuuaaaaaucuguauuuuuaauaacauuguuauacuuucuaauuuagggaggauucacuacccccaaauuauuaccauuaaauauguauauuuauauauaaucuuaauauauucuuaaaggagauuucuggaagucuaaauugaugagccuggucaggugugaugacucauacuuguaaucucagugcuuuggguggccaaggcaggaggaaugcuugagaucaugaguuugagaccagcaagaccccaucucuaaaauuuuuuaaaaucauaaauaaaauaggcugggcacaauggcucacaccuguaaucccaccacuuugggaggcugaggcagguggaucacuugucaggaguucaagacuagccuggccaacaugaugaaacgccaucucuacuaaaaauaauagaaaaauuagcugggugugguggcacaugccuguaaucccagcuacucgggaggcuaaggcaggaaaauugcuugaaaccaggaggcggagguuguagugagcugggaucacaccacugcacuccagccugggcaacagagcaagacuucaucucaaaaaaauaaauaaaauaaauuggugaaccuguuuuuauauacucauuuuugaagugcacagagcuccucuucccuacuguuccauuucucuuuauuuccaucucuggugcucuaaagaucugauuuccucguggcucaguggugagaauagucguagcuguaugcuacauuuccacauaaauucuuggagggcuuucuguaugggauugaugacagacugaacugagggcagauuuaaaggccugccaaauccuugccauaauucucuuacagccagaguaauuauaaugaggaaaauugguaucuuuacugcuugcucuucuuaguuguuggauggagguuaucuauagggcagagcagcuagucuuugaccuggcacgauccugugauugugaacggcucucuuacgccagugccuacagcucagguuucuugauuucagaauacuccuuccuuuuguuggcuuucugcuuuaaugaugaaaaugagcauuugguggaacagccgaaacaagcuuuaacuugcuuguugcugagucuguugcauaauuacagaaaccuaccguuacauguuucacguuuuguucugcagccagagcacuggggcuuaagcaaugauuuggauggaugucgaccaugugacugugaccuugggggagccuuaaacaacagguaaauggagcucuacguaugcucuuguccucagucuuccaggaaagucaugacuuacaggaaugggugacauucaguuguuucucaaaaagacaugcaaaauauuuuuuguaugucuugauaaauguguguagguaccucuauggacuagauucccagugauggaacugcuaagucaaaguacauauguauuuuuaauuuuaauagagaauguuagguuguuccagacauauugaacuaguuuauuuuccuaucaguuacaaaaguaccuuuucccccauccccagcaacaguugguaucaucaaccauuuuauuuuucaacaaucuaagcacauggaaaauggacuccuguuuugauuuguguagagaaucuuuucauuuucuuuuuuucuuuuuuuuuuuugugacuuccaaguccauuaaugaaaaucacaugagauaauguugagcuacuuaaauaugcuaguauuccuugaauaaaugaagcauaaagcuccaccagaagcuaucagaacacacauuuggcaagauguuaaaucugugggaguuuaaccaccuucgagucaaagagaauguuggucucuguuccuggcucagagucagaacaucuggaacagauaguguaagugacugcugagagaauagacagauguuucccuguggccuugagucuucccagagagaacacucugaauucauugagcaagcuucauguacucaaaaauggacuuucuuucccaauuauuucccaacaccauaguagucugcugggaaggaaugagguauucagcagcaagaacauguuguguuuguccucuuuauuuggguuuguucuguucgaggucgugccauagacccaguacagcauguagccucugaaauccggugugaauaucuguucuuagaaaaccuccagagaggaggaagcuaggauaauuccauaaaagcagggaagaaagacagaaugcugucugcuuguggaaucacuuuucugacuuuuccuuugugacucccagaacacauguugaauccuuuaguaaaugacuccucaguucaaagcugucaucacuccuaaaguccuucuugaugagauaaaaguggcauaugcaauuccccaaauuaugucauaaacucaggaauguccuaugauucuuaacccuaaguaaguuuuguuccuacacucccuuccucuuuuucucuauuccauacacacuuccugucugucuccacccacgcacaggcccuagccugcccucuaaucucuugugcaaaaauuuauaaaaaccagaauguauucaccaagagaguuugggaagcaaaauugucuaguaaagauuuuuaaagcagguaaucaucugaucuuucuagcaugauugaugggaugcccuaucuuugagaaucauugguggaggggaaaaaaagaacauuuaaagaugccuuguagucuggugacucuagaguguuuuauggugagccuuuucaaaguuguugucccucaagaggaauuuccccaggagccccuuaggcagggucaacugaagcacugauucuacugggagaugugcacagaugccgcuugggaaauguuuacuggaugauugguuuguugcaaucacucaucaaaaccuuuuaccugauauuucuuuuuacguaguaaaagaaauacguuguagguacugaauaaaugcugauugaguagaauuuaaaaauaaaagauuucuaagauguuaaaaacuagauauguacuccuuagagaggcaaucucuaaaugugaucccagacacuccuuaguuacuuuguugagggacagaauuaaccauaaaaaucacuggaagugguaaaagcuuuaagauguuuuguauagugagcuaaauggauuuuugguaguacaacaaaaguuuaauaauccaugucuauuauauugacaacuaaccugaacuuuggaauaauuaaagaaguggccaggcgcguuggcucaugccuguaauccuagcacuuugggaggccggcgcgccagaucaccugaggucaggaguucaagaccaaccaggccaacauggugaaacccugucucuacuaaaaauacaaaaauuagccaggcgugguggcaccuaccuguaaucucagcuacuugggaggcugaggcagggagaaucgcuugaaccuagaaaacagagguugcagugaaccaagaucacgccauugcacuccagccuaggcaacagagcaagacucugucucaaagaaaaaaaaaaaauaauaagaccuaauuaauuuaaauaaucuaacugaagccaaguuaaugaaguuuugccuaguagauuaccuguuuuaaugaaaaagaauuggcauugguugcuagguaaaugcuacuuguaaauguuuaauaacauugaaaaauauaaacauuuuuacagcauccuucaagauuauuuuaacaaugaaauguagaguuuucauaucuggcuugaagcccaccccccccuuuuuuuuuuuuuuuuugagacagaguuucgcuuugucaccuagacuggagugcaguggcauugaucuuggcucacugcaaccuccgccuccuggguucaagcgauucucccaccucagccucccgaguaguugggacuacaggcaccagcuaccacacucagcuaauuuuuguauuuuuaguagagacgggguuucaccauguuggucaggcuggucuugaacuucugacccucaagugaucugucugccucaggcucccaaugugcugggauuauaggcaugagccaccaugccuggccccaccucuuuuuugaacucaccguggugaagccccgaacccucccuugaugcauugcuucugcaucucuuuuagcauuuauuuugcucuuauaguuguguuaaaaaggucucuuuggacagagauuaugucaucuuuguuuuugcaucucacuuggcacccagcacgguggaccuggcagguacucaauaaaugagggacuaaaauuuauuguacuucgaauccagaacggaaguuaguagauauuuuuaucauuguauugaaugacuaugguguagcuaacccuuuguuaauuauaaucauguacugcauaauaacauuucagucaaggauggaccacacauacaacgguggucccauaagauacuguauuuuuacuguagcuuuucuacauuuugauaugguugaauacacaaguucuugucauuguguuacaauugccuaugguauucaauacaguaauaugcuguacagguuuguagcuuaggagcaauaggcuauacucuacagccuggguguguaguaagcuauaccaucuagguuuguguaaguacacuaugauggucacacaacaacaaaauuggcgaacaacacauuucucagaacauaucccagucauuaagugacacaugacuauacugugauagaacaggauuauaggacguaggucuuaccaaaaagaaaguguccuaguuggggguggggaggaaugccacccugagaaaaugaauggugcugacggaacacugugguugguuauuaugaaugauguuuuuuaugcuuuaauauuuuucugccuaauuccuuaguaauagggaaauguuaaaauuccauuuucuuuauucaccaccauuuaaaugaaauggaauuuuuaaauguugccaauuucuauauuuaugauuuuuuuuuuuuuuuuuugagacggagucucgcucugucgcccaggcuggagugcaguggcgcgaucuuggcucacugcaagcuccgcaucccagguucaugccauucucccgccucagccucccaaguagcugggacuacaggcaccugccaccaugcccggcuaauuuuuuguauuuuuaguggagaugggguuucaccguguuagccaggauggucucaaucuccugaccucuugauccgcucgccucggacucccaaagugcugggauuacaggcgugagccaccacacccagccauaaauguauuuuuuuaagaaauaaucuuggccuucacccacugagaaaacauagagccuguaucaguuuucuauugcugccauaacaaauuaccacaauuugguuguuuaaaacaauauaaguuuauuauuuuccaguucuaugugucaaauacagucucaguggaccaaaaucacgauguugguagggcugcauuguuuucuaaggcucuaaaggagaaucuguuuccagcuaauuuggguuguuggcaggauucugcuccuugcagucguaggcugagguuccccuucuuuugcuggcugucaucuaagggcuauucuuguccucuagagcugcccacauuccuugacucaugguccccucucuccaucuucaaagguaccacugggucaaauccuucuuaugucacagcucucugaccuacuuacuucccugccugccucucccacuuuuaagaauuuaugugauuagauuggacccacccagaucauccaauaaucgcuccaucuugauguccuuacccuuaaucacaucugcaaaguuccuuuugccauaugagguaacaucccacagauaacagggaugaggauguggacaucuuugggggccauuauucugccucacacaggccuuauuuauuuuauguccuuauucucccuuacugauuuaaugaaauugaaucucuaguuuacagagaaauuuguagagaauacauaagaaucuaagaugugccauuucuaucagauuugauuuuuacuugaacacaggagagaguaauuacauguaauaaaucauugguaucacugugaagaagccaggauuugugcuugaguuuugaaagcugagauuugaaaggugcgauuagugagcaggggagggccuccgagcugggagggaaaagauggguaaaggcacagagaugggaaugacuguagcaaggucgagaucuggucugaucuugaccaucucugcccacauucccccaucacccucuuugcuccuguuauuccuguccucucucugccugucaaguccucuccaggcuuuaaggacaccucuuucaugacgccucccucagucuucucaaucagaugaaucauaucuucuucucccuuagugcuuugcuuguaacucuaucaaugcauagguucuuacugcauuuugauuuguugcauugguuaauuucuuuauuguuuauccccaauuagacuguaaguucuugaagacagggacuauuuuuuuuucuauuucucuuucuguauaucauuuagccagaaauaauagacuuagugaggaaguaaggauucauucagaacaaaguucacaauggacuaaaaugugagaauaccugcacugggaagcaaggcugcuagggccaauauuugaucaguaaauauuugcugaagaguaugaggaguguggcucauuggaaagcaaagagucggcaccagaaagagaagccguuuucagaggauggguuauggaggcugcagaaagccaggcagaggcaucauggcuugauaucauaagaaacaauuguggguuuucgugaaacaaugaaagcagcacuguaggaagaucgguuggcccgugguagacaggauggacuaggcagaagaggaagaagaauuugagaggucaguuuaggagauuguuagaguaacagguauggggugaugccauccuggacugacgcaguggcaguggcagugacaaugagaggaagcugcuaaguugagaaacauuuugaaguaaaagcugaguauugggauaaaggaaagagaaggugaugucucaccuauaccaugagaagaauuuuaaaucuacuggcagaaacagcagagcugaggauaagaagucaguguggguggugaugaucuguuugggacaagaugaauuagagaugacagcuggccaguccauggaaaugucccauugauggcuggaaauagagaagcagagcccagccaccugcugggugcugagagcuguagggugagggccaucugcauaggaaagccacaagaaugaguucacugaaggagccaguguugaaucagagccaugccuaucugugaugacaauucaagccuguggacacagacuugugauuggcagggccgcuguuaagggaauuccuuucacaugaucagcucucauggagccauuccuuguuuagaauugugcugcagauagaggcagcaccgggagccugcuggcgccuuuguccucaccuucauuugcucguucucuaaugguugcaugugaaggucuaguuguuuucuucuuuggugguucauguuuuggauauuuguugucucaguaaacaucuggggaggaaagaauuuucuuuuguccauaugauguaaugucugaugccugaauuucugaaaauagcuuuuguucauggacugugccaaaagaaggcuagguccuaauuggaacaagcuuuccuuucuugggaauuggcuaugggacguuaagaauuccuauuccuggcugggcgugguggcuuacaccuguaaucccagcacuuugggagaccgaagcagauggaucacgaggucaggagauugagaccagccuggccaauauggugaaacccugucucuacuaaaaauacaaaaauuagccaggcaugguggcagucgccuauagucccagcuacucaggaggcugaggugggagaaucgcuugaacccaagaggcggagguugcagugaaccgagaucguuccacuguacuccagcgugggcgacagugcgagacuccaucucaaaaauaaaaaaauaauaauaauaaaaagaguuccuauuccuguaggauaacaacaugauacacaaaaagaggacuucagcuaugcugcggcagggucguuuaggauuuuauuuauuuauuuauuuauuuugagaugaagucucacucugucacccaggcuggagugcaauggcaugaucucggcucacugcaacuuccaccuccugguuucaagugauucuccugucucagccucccgaguagcugagauuacaggugugugccccuacaccuggcuaauuuuuuguauuuucaguagagacgggguuucaccauguuggccaggcuggucucaaacuccugcaagugauccaccugccuuggccucccaaagugugggauuauagacgugagccacugcgcacccggccuugggacauuuuuaauaagccugugagugcaaaguguuccugugaguugcaacuugccuuagguaccuuguuuaaaacuuugggaugagaaaaaaagaaagaacaaaccuugagaaugaguugaaaguaacaauuccaaaccacagcucuucuuuaagugaaguaaaaauggauacauguaauuugaguuuuguauuguauacaaaauuaugauacuaauaaaagggacauaagcugagaacagaaguuucacucuuguugcccaggcuggagugcaauggcgugaucucagcucaccucaaccucugccucccggguucaagcgauucucgugccucagccucccaaguaucugggauuacaggccugcgccaccacgcccagcuaauuuuguauuuuuaguagagaugggguuucuccauguuggugaggcuggucucgaacucccaaccucaggugauccgccugucucggccucccaaagugcugagauuacaggcgugagccaccgugcccagccgcauuucuuauauuuagcauagcauagccaauggaaagggggaagagagacacaagaugcagaaguaaaaaucacagaauuugguuccugauggagugugaagaaagaaucuggagaagaacggggacuaaauuucugacuugguugacucagcaggugguagugccuucacccugauagagaccauccgagggauugagggcuucugucuuagauccguugguuugggaugcucugggacagccaagcuggagauguucuucagggagcuggauauuugagccuaaaucucaggaaauaagcaaaagauguaacaugccaaagcaagaagguuugggauguggaaaaccuucaugugaugcggacggcguguuagucaagagagggcaagggagguaaaaccgagaagaccagguucucagccacgcuucuggaguuugggauuaauccauaggcacuacuuuuuuccacauauguauuuucugaagaaaacaagaacaugcuauguauuugguccuguguacugaguaauggcagcuguagagcugcuucuggcggguugacucgcgugaccaugaacucagcugauguggcuccuccucccuuccaguugcuuugcggagucaggccagugcucaugccggccucacaugauuggacgucagugcaacgaaguggaaccugguuacuacuuugccacccuggaucacuaccucuaugaagcggaggaagccaacuuggggccugugaguaggggaguguguggcaggucgguaaagcaguguuuugggguguaguggaacauacaugcuuuguaaagaccccauuucagaagcauuuuuauagcuuugucagugagcacaaaauaaggaucaggaccaugccuuccugagaagagucauauuuaaagcuaaguaauucuauaacucacaaauuggcuuuggagcauucacugauaaggcuuuugguugguuuaagaaaugugucuuuacaagaaacuuuucuucucucuacuuaugcuccaaaguuaucaaccuagcaugguaaauacugaggcaaggauauuuuuucaucuauucauccccaaauuuagugacuuuaaauguaugccuggcucuugagcugggguggcugaaacagcuggaggcuggcugggcauuucucuccacacgaacacgaccuuucuuuuuucuuuuuuucgagacugaguuucgcucuuauugcccaggcuggagugcaguggcacuaucucagcucaccacaaccuccgccugcuggguugaagcgauucuccugcuucagcuucccgaguagcucgauuauaggcaugugccaccacgccuggcuaauuuuguauuuuuaguagggaugggguuucaucauguuggucaggcuggucucgaacucccgaccucaggugauccgcccgccuuggccucccaaaguguugggauuacaggcgugagccacugugccuggcgauagugagauuucuuagauggcuuccagcuuccaaaaagaggaaacaagcugccagcucucugaaagcuuggacucagaaguccuagaaaguuccucagguucuguuggucacaagucacaaggauucauggaaaggauaacauaguuugcaccucuugauggguaaggccacacacggguacauacagauacauacagggaaugaaagaguugaucccagccauuuuuggauaugaccaaccacagguauuaaaaaauaacccuguaaacaauuaaucagaauuaacucaucaguugugaacauucauuauaucaaguuucuucacuugaaaauggagccugaaacuaaugccaguaugagagacagaaauccacuagauacuggacuaaccuuauggagaaucugggaagcaccuuaugauuccuagacuugcuuauaacggcaugugggauguucucuuuuuucuuuuaugcuuacucuccuggucauaucaaauaagguauaucccaagccuuugagugcuauauccagugucccaagacugcuccaaccacaaaacuaaaaagaaaccaguuuccuguuuggauaucagaaacuuuuuacaaucuauuaggggagauuugacuauaaaaaauagacauaagguagccacccuuuuugaaucuuugggugacuucggauuacuuugacuauugaaaauuauugaauuccauuucaaauacagaauaaccauuguuugccaugcccucaggggguuagcauaguggagcggcaauauauccaggaccggauucccuccuggacuggagccggcuucguccgagugccugaaggggcuuauuuggaguuuuucauugacaacauaccauauuccauggaguacgacauccuaauucgcuacgagccacagguaaagaaaccacuuaguggacugguggaggagggaggggagaaucaguagaaaaauaguacuucuaauggguauuauauauaguuaugaaauauggagguugcauuagaacagaucagauuccuauagucucaccuccuccauggaaguuaaaauaaauguaccauuuucuuucuuucuuuuuuuuuuuuuuuuuugagucucgcucuguuguccaggcuggagugcaguggugccaucucggcucacugcaaucuccgccucccggguucaagcgauucuccugccucagccuccugaguagcugggauuacaggcaugcgccaccaugcccagcuaauuuuuguauuuuuaauagagacgggguuucgccauguuggccaggcugaucuugaacuccugaccucaggugauucgcccgccucagccucccaaagugcugggauuacaggcgugagccaccacacccagucaaaacguaccauuuucuugaauccaguuucucaaacguagugaucuuuugugaggcacucaaccuugcugacgacugagguggugaugaggauguaugagauccucuccuucccucacaaccuggcugugcagugacagacugaagccccgaacuguaacgaaagacugaaggugacgguguaacagcagagagaugcaugauccuagaagaugggcaugcaccagccagcccgagccagggcuaccaaaacguuuuccuagagaaucagagcuaggccuuaaagugugaauggaauuguggaaaguuggcacaaaaguaagaaauagugugaguggaagagagaagagaggguuuuguuuuuauugagaaucauuccacauagcuugaugagagauaugguuggagaugcuguuggcaaaaauacuaggauuaguaaaggaauuuggacuauaauauucacaggaagcuauugaagcauuucaagcaggggauugucauuaucugagcugcuuuaaaguggacugaaagggacauugggaagaggcagaaaacaguugagagguguuucagcauccagggcagaagggauuugggcuggaaccaggggaguagcagagguaguaguaaagagaaaagugaagagcaacuguuuguuuuccauuucaacuuggcaauugauugauucagagaggucuuuuuauaaacaggcaguggugggcuaacuaucuuuucauuguuuguuucuuauucuagcuacccgaccacugggaaaaagcugucaucacagugcagcgaccuggaaggauuccaaccagcagccgaugugguaauaccauccccgaugaugacaaccagguggugucauuaucaccaggcucaaggucagugugacggugguuuggcagcucaacgggcuucauaugcaaauuaguauuuuucuaauauuuugcgaguuuucaagucaccauuucagagccagacguugacugcugacuuuuuuccuuuggaauuaucgaugcagagcuuuguuuuuaauuuuuauuuuuuggaugcaugaagguugacuuucguuguugucuuucuuuuuuguuugggggcagauaugucguccuuccucggccggugugcuuugagaagggaacaaacuacacggugagguuggagcugccucaguacaccuccucugauagcgacguggagagccccuacacgcugaucgauucuguaagugcgagauugcuucuggcauaugcaggaaagccugggcggaaagugcccagcugcucucaggguguuuuguugagggguaaugcugaggccagcguaagcagaaucauucuuucuugccuccacgguuacuuugcuuauacuccaccccauggaaaggauuuauuccuucuaaaaauauaaaaugucuuuuaaaaaaaacagcauuucacuaggcguagugacucacaccuguaaucccaacacuuugggaugcugaggcaggaggaucauuugaggccaggaguucaagaccagccugggcgacaaagcaagaccccaucucuaaaauaaaaauaaauagcauuuaaaagccaucaagcuguguaaaacauaucuaaaauuuccugccaagaguauuuaggaauagggagguuuauacuuuauuuaaugagucuaaugauuucuguucaagggucaaagaagcauuuggguuuucuacacguuugcuugcuuaaacccaugccauggggcaccacuguaaggauguuuggccguucucauuucuucacagcuuguucucaugccauacuguaaaucacuggacaucuucaccgugggagguucaggagaugggguggucaccaacagugccugggaaaccuuucagagauaccgaugucuagagaacagcagaagcguugugaaaacaccgaugacagauguuugcagaaacaucaucuuuagcauuucugcccuguuacaccagacaggccuggguagguauugcugggcagcugcagcagcugcuguuucuggcucugaguauaucuggcacaugaaguacaguggagugcccacccccuagcccuguguuaggcagcacaagggaaauagugucucaguuacaguuugucuuuaucuuuuuaaguaauauuucagugaaagagcaccacugaagauggaauugauauucaagaaauaugcaaauaacaggugaccaggggaaaaguccaugaggauaaagcauuuccauaagcaggguagggagaggggaauggaaucagagaagcaucaaauaccugaaauguauguuuuucucuuugaaacgucagaccauccucugaaggucacugggcuuuggucuaauguccugugauauuugagcuuugaaggcaaggggagaaaacauuaaugaccuccugccuagaaaaacuguuuugaucugccaacucugccuccccuuucuucccuuccgcucaucauagggaugauacuguuuuaaaccagaacucugaauaauccaaaguaguuaaaggagaaaggaucagggagagcccgaugaugugcugcuccgugucauggguucuggccucucuuuacccacagcuugugaaugcgacccucaggguucguuaaguuccgugugugaucccaacggaggccagugccagugccggcccaacgugguuggaagaaccugcaacagaugugcaccuggaacuuuuggcuuuggccccaguggaugcaaacguagguuccucaaaagcauuguuaugcauucauucagauuaacucagccauuguggcaggguuccauugcugcagagccgaugcuucccuccugaaguugaucacaccaacccaugagcauucugaauuggggacagggugcuuauaaaaggagcauguuuccauugaaugaguuucucaaggcaguuccuuguuugccuguuucuuuagcuugugagugccaucugcaaggaucugucaaugccuucugcaaucccgucacuggccagugccacuguuuccagggaguguaugcucggcagugugaucggugcuuaccugggcacuggggcuuuccaaguugccagcccugccagugcaauggccacgccgaugacugcgacccagugacuggggagugcuugaacugccaggacuacaccaugggucauaacugugaaagguaugcagaugcugaaaguaaggagaauguagugaucucuggcugagcagacagcaucuuagaccaaccacagaauucaucuccaccaggcuucagcucgcucauucauuucugaccaccucacuauuuucuaggaucuuguuuguuuauccaguacauauugaguugacauccucuaugugccaggcaccguucuggugcuggagauaccgcagagaacaaaacugacaugaauccguccucuuggcgagucacccuagagcuuaccauagggcuguauagaaauucugucugucucagcagauucuggcggaggauaagaguugugaaaugcuccugccuaauuuaggcgaaaggagaaacuaauccaaaugggauuagucauuuuaaauagcuuuguuuuucagaacguuuuaugcaacuacaguuuccaggagacucuauaaaacaugccuaaguagaucuguucuccaguuagcaaaugucaguugaauaaucauuauggaugugcuagauguagaguaagaauaggagagagaauauaccuccauaacauuaauaggauagcucaauagauaaaaaauacuccguaugaaaaaguuaccugcugacuuacacuguuuauuacuaauuaagaaaugcagacaguacuguuagaacuggcuuuuugggcguaauagucuccaccuuuucacugugauaauuuuucucucuuccaacauccauucgcccuaucgaagauauuuguuuuuaaaagucacuugugaaacauugcagcaagugcuucagucaguggugaaguuacucaucaggugaaagagaaauuguuagugaaaaacugaguaugugauuaacuuuuggcaugaagauguucauggaggcaaacacguggcucucggcucaaugcuagaacgguacucaagaauuuggaggucccacggacuacccuuugaauaaaaauuaucccuuccaaccuuaaaauuguguuguagaaagauagcaaggacacaguuauacaacagugaaaggaggaaauuaauauuuuggggucaucuuuuucuuuucagccguuuuccauuauuguuuuuucaaagagagauggagaauaaguacgagagaaagauaugagaaaacagagaaagacaugagaaaaagauuaacagggagcagagagaggagggggaacagaagcaaacagcaaagggagcugccacaaugcugauucagaaucagcacucacacuguagaaugcauuugaacgaacaucaugucagaauggcauaguugauaucugugaccagcuuuggauuuuauuuguaaaggguuuugagaaugagaaaggguaugggagaaggaagauuuuuaacaauagguuuggguggcaaacacuugauuuuaaguauuuggaauucuacuaucuaguuugagccaguuucucaucauucuuuuuucucauuccaagauaaccagaguuucaauccugugaauuuacaaaaaaacucuacacuuagauuguccccaaggggaggcaagaaaugaacacucaguuucuaucaugauguauuuggauugccuccaaaagacuugagaaacaaauugaauuggaaauccuuggaccucaguuccuggcccaauucugcuucuaacuugcuuucuaaccuugggugaguuaggauauccagcuucuagaaaauuuuuuugagacggaguuuugcucuuguugcccaggcugaaguacaguggugcaaucucagcucacugcaaccucugacucgcagguucaagcaauucuccugccucagccucccaaguagcugggauuacaggcuuuuuguuguuguuguuguuuguuuguuuugagauggagucucauucuguugcucaggcuggagugcaauggugcgaucuuggcucacugcaaccucugccuccuggguucaggugauucuccugucucagccucccaaguagcugggauuacaggcacaggccaccaugccuggcuaaucuuuuguauuuuuaagggagaugggguuucaccauguuggccaggcuggucucaaacucccaaccucaggugauccacccgcugcagccucccaaaaugcugggauuacaggggugagccaccgcaccuggccggaauauccagcuuuucauaaguagaauaacuagguuggaugagauugucuccaaaguuccuucaagauguuauguuguaggacauaaaaaaguaacauaauuaccauucaccuugacaagcaggcuaacauaguaaaagaauguauugcuuuaaggaccccaaauucaaauucuggcucauuauuuaacuaguuguauaaacuuugagaauccuuugaccucccuguauuuguuaucuuuaaagagugggauugacauguuggauaugggaauuaauaaguaacaugacccaucccugccugaguuuggaaccaccugagagacaaacacaggggcuacacagcuggagagcaccccugucacccccucagcuccaguacugggaaaagcuggguuauagcacauggcuuuagaccuguggccaccgugggcuugccaacacaucaccccucucaggcauaggcagaggcugacagguauaagccccgccuaggaggacagacucuguaauacaaggagggagcagaacugaauggucaggacaggcaggcagcugauagaacaaucaagugcacauggggagagguggcucuuccucuggggagcagugagugaggggccagaugaagccaugggugucacucgaacgcagugguccugcaaguaggaucccuagaucagcagcaucaauauuaucggggaccuacugaaucagaaacucggugggaggagcccagucaucuguuucaggugauugugauugaagcuaaaguuugagaaccacuguucccauaguaaaucuuccacaugaaaacauaaagagaggugggcagaucaccugaggucaggaguuugagaccagcuugaccaacauggugaaaccccaucucuacuaaaaauauaaaaauuaggcuggguaugguggcucacaccuguaaucccagcacuuugggaggcugagguggguggaucaccugagaucaggaguucaagaccagccuggccaacauggugaaacccugucucuacuaaaaauacaaaaauuagccgggcaugguggugcaugccuauaaucccagcuaccugggaggcugaggcaggagaauuguuugaaccaggagguggagguugcagcgugcugagaucgugccacugcacuccagccugcgcaacagagcgcgacuccaucucaaaaacaaacaaaaaaacagccaggugugguggugugugccuguagucccagcuacuugggaggcugaggcaggagaaucacuugaacccaaaaaacagagguuacagugagcugagauagugccacugcacuccagccugggugacagagcaagauucugucucaaagaaaacaugaggaguggagaagagugugcccaaacagaacaguuuucaagacuuuccuuggaacagguuucuuagaacuguggggucauggccuguucucuucugugacugaugcaggugcuuggcugguuacuauggcgaccccaucauugggucaggagaucacugccgcccuugcccuugcccagauggucccgacaguggacgccaguuugccaggagcugcuaccaagauccuguuacuuuacagcuugccuguguuugugauccuggauacauugguaagucgugugcauacuuugggaggcaaagagagagaaaaagaugucuuuaugaguucauuguuaaugagaaaaaaagaugcaaagugaaccaauuaagucuacuuuuauaauuuuuaauuaaaaauuagaaaagaugcucuuuuccuauuuggcacauggaguggagucaauucauauugagucucugauaagaacguuauaacacaaagcaggaaaguaagcucguggaaaucuagaaacccuguggaacacuuuucuguuauuaaacauuagaaagauuaacuuaaguuuuacuccugccuuucuuuauccaacuccuagcaaaaguaucucaaagcugugagguuaccaaauaguagucagaagaaagaaauaauaucauccagggaaucacaagauggccgaauauauucuucacuguuaaugauacucacauuaucuaucaagauucaauuaaucuagcuggguuguuaaaaacucccucuuauuucauccuugaagccacuguuacaaauacugauuauguuuauauguaacucaguaaaauuuuuuugcauauaauuucagaauuucuuagggaaauuggucaucauuaaagaucccauuuuucagguugcucacagaggagugguaacuuuucaguuucuguaauucuuuguuuuguuuuguuuuugagacggggucucacucugucacccaggcuggagugcaguggcacaaucugggcucacugcaagcuccgccucccagguucacgccauucuccagccucagccucccgaguagcuggggcuacaggcaccugccaccaugccccaccaccacgccuggcuaauuuuguuuuuguauuuuugguagagaugggguuucaccauguuagccaggauggucucgaucuccugacuucgugauccacccaccucggccucccaaagugcugggauuacaggcgugagccacugcgcccagcccacuuucuguaauucuugaauuaggcugggugugguggcucaugcuuguaguuccagcacuuugggaggcugaggcaggaggauugcuugagcccaggaguaagagaccagcgugggcaagauggcgagacaccaucucuccaaaaaaaaaaaaaaaaaaauuuuacaaaauuagucagguguagugccgcaaaccuguagucccagcugcugggaaagcugaagugggagaauuccuugagcccggaaauucagggcugcagugagcuauuaucaugucacugcauuccaaccugggugauaaagcaaggccccaugucuuaaaaaaauguaauccuuggauuaggauuucuacaugaagcuaugcuuuacauuguuaguuugcucccaacaugcuccacccccaugugcucagaagcuaaagucucaugugcuaggaccuaacuguccacagccgcuguggccucuggggcaguugcaacacuguuagagacuacaaaacauuagauuggugcaaaaaguuacuaugguuuuugccacugaaaguaauacugccuuccucucacaacucaaagccuauucuuuccccuucagaugugaucacccugggcucuuuaaacagugcagugaagaugaagcaccgccacgaucagcucucucuaggcaugagugucggugcacuggugagcuuucagucaauaagcuaaacaucuuguguuugguuuuaucgggugacagguuccagaugugacgacugugccucaggauacuuuggcaauccaucagaaguuggggggucgugucagccuugccagugucacaacaacauugacacgacagacccagaagccugugacaaggagacugggaggugucucaagugccuguaccacacggaaggggaacacugucaguucugccgguuuggauacuauggugaugcccuccagcaggacugucgaaguaagaugcacauuuauucugcccacuucuuagaaugacuuccaccuuuuuuucauuaucagcagauuuuauucuuccuguauuuauuucacuugggaaaacacuuguucagagagguaaaauuucacuuucaacuaaggaaagaugagaccaauuuuuuuuuuuuuuuuaaugagacagagucucacucuaucacccaggcuggagugcaguggcaugaucucagcucacuauaaccucugccuccagaguucaagugauucucaugccucagccucccgaguaggugggauugcaggcaccccccaccaugcccagguaauuuuuguauuuuuaauagagacgggguuucaccauguuggucagguuggucucgaacuccugaccucaggugauccacccgccucggccuuccaaagugcugggauuacaggcgugagccguugcaccuggucauuuuuauuuuuuucuuuacauccacauuuucuggcaggagugaggucucaagaugugacucagugccugggagagauaacaggaaagaaaaaccauguagcuguccccaugauaaauggcauccaguagaggguacugaugguaugcucugcccaugaacuugcugguuggauggacuucgaaauccuaaauacccacuguggucccaccuuuucuaguggcauugauggaauagagccuuccagcuuaaggaagagaaagaaguagcaucucuaacaucucucuuuuggaccucuuuauuucucucuuaccgagaucaacuagcauuuccucuugcugcagcugcacagcccccaggcuccuggcuuuguuuauacaaacauguguggaaugcuagggaccagcaggacuggauuccuuaaaagccuuaguagcuuaaagggcuuuuaccugcuauguccaacacguuuauuacggcuguucucugccaagaguuugaaauuauuagauaucucaauucccacuggcauuuuuuaaaauuauuuccaguuaagccuucaauuuuaaaaugacucaccagcaucuugucaaaucuguguauuuugaacauacuuuuaggugaaaugugucauuguguguaucugggaaaugucagaacuguguaagaaaucacgagaacuucuaaacaguaauuuuagcuuuauuuuugaaucaccuccauuucuuuccuucuuugcauuucaaggucaagaugugaagugggaacaucuuagcauuuagauguggcuaacauccgcaugccuguguauuugggagugugacaauaaguaaaugugauguucuuuugcagagugugucuguaauuaccugggcaccgugcaagagcacuguaacggcucugacugccagugcgacaaagccacuggucagugcuugugucuuccuaaugugaucgggcagaacugugaccgcugugcgcccaauaccuggcagcuggccaguggcacuggcugugacccaugcaacugcaaugcugcucauuccuucgggccaucuugcaaugaggugaggggcugcugcuggggaugaugccuuuaugagcucaggugucagcccauggugacuuugccccaguuagagcaaggcaccagggcacacagcuugaaacacagcguggccuggaucuuagcccucauuuguaccccuuggcugggucuacauaacugugcacagaguccccaucagacacauccauagcauuucaguagagggucccagcugcagaugcagacucacuuaacaauagacaagggugugcuauuucucuucaguaccugggcgcugaagcagacucuuuucuuagcuucucgaaaggaaccaauuagccauacccagcauuguaaaaagugcuguuguuuccugacacaugcuaaggagggcauacucccuaagucaggcgagucaaagguggcccaggauuguggcugaucugugaggauaaaagugaggaaauauguaaauaaauaauaacaugccacagaccuuuccaagcccuguugcaaaagagcacuuagaugcuggcauggggcucucgacaccuacgauugaagugggagucccuuuuccuagucaauggagaccuucucagguaaacaguucauuccuacuucuaaguggcagcuagaaaaaaaagaugacaacuggcuucuggccugaagccugcuugaccaaggucuguguucuggccgcaguucacggggcagugccagugcaugccuggguuuggaggccgcaccugcagcgagugccaggaacucuucuggggagaccccgacguggagugccgaggugaguugugggcguucucgcauugacuugaucagagaguggagggaacugggguucuacaagagccuucuguaaauuauaaaacacaguacaaauuaacgugucuauaagaaccuguauuuaauugcaaaauaaauuaacacugauuguuuaaaaaacaaucuaacaaaucuagcccugcccauaaguauagguagucaagaguggaugugcauacucucccggccucacacccugggguaaaguuuguuucuguguguaagcacacacacacacacacacacacacacacacacacacaccacaaauacacacagagcugcuuuuuaaaauacuuuuaaccaaggugggaccaugugaacccuauguuuggcaaagugacuuuuuauccccucugaacaguauuuuguggccaacuuccuugauggcacaagaagagguaaaugguuauccuaguaagaucacuggauucaguggaucaacuagacucuguugacaguuuaagcucuuggcguauguguguaagauaacauccccaccagugaaaacuggagggcaaugucauggagacuucgugcacaacaaagggcuccaaggucaggggcuccaagucaguuuaaugugaauaaaacccagauuuucaccuaagcuuaugauuaaacaaacaaacaaaaaaagauggaaaugacauuuucuuacaaacaaaaacuuguuaaaauuaugugaaucaucaggauugcuugauuuuuaugguauugcaguuuuuuugaccuggaaaauuauuuuucagaucuuaaagucaaaauauggaaaagacugaauaggcuguugcaacucuguuuuuauauucuuucuuuccuacuugauuuucuucccuguuuuuaauugaucauuauggauaaaaauuuucuguaguuucuuaagugcucuuucguauauuuguugcacaucugaaauuauaggucucuguuggacucuugaauuuuuuuuuuuuuugagacggagucucgcucugucaccuaggccggaaugcaguggcauaaucucggcuuacugcaaccuccaccuccuggguucaagcgauucuccugccucagccucccaaauaacuggaguuacaggcaagcgccaccacgcccggcuaauuuuuguauuuuuaguagagaugggguuucaccauauuggucaggcuggucucaaacuccugaccucaugauucacccgccucggccucccaaaguucuagaauuacaggugugagccacugugccuggccaggacucuuaaauuuuuaaaaugaccguuuucuuuuuuuggacacaacuacagcaagaaauaauacagaucuucaaguuggcaacucauucaauaucuccuacagaaggucaggaaccuagaaacuguguuccuucagggugcaaacccauguguuccuuaacagcagaaaaaggucagugggcaagaccagaacaaauuagauaugauuuguuuuuuaaguugaggcuuagccagaaggguuuguauggaccucuuagauuaagguuuguuucacaguggggauaauguuugcuaugucaauaaacagguacuuuucuuucaucauucuccaaauuugguucuuaaugagaucugacauccccucuuccauuagaagguauugaaauccaguggaccaguuucuccaagaugucucuugaaaguaaaacucugcuuaaaaucuguuuuuuccagggcucuaaucacuacucuguuaaauuccucaaacuuguaaugccccaaggcuugauuuuuuccagauaauggcucuaucguugcacauacccugauucugucagcaugugucauuggcaaaauagcuuucucugccaaagcuuucugaccuuuggcuccaucuuagcuuuguuagcaggaaaggccugcuacccagagucagagucaaucagagaauuguucaugugguccuuagaacuuuacuccuuacccuuuuaucuuuucuuuaaacuuucgccucuaaaucugccagggaaauugugacuuauagaaaccuugucaacuuguuugggucaaaaguuagauccuguuuuagaaacucugcaaagagugagauucauggcaucauuguucgccaacuucuuuguuccuuucauccagaagaaaggucagcucauuacguaagaaacuuuucaucaggaaaagcaaacaaccgauaaaaaacagaaacuaaguauucugcaaggaaaccugguuuaaggagaauguauugaaacuggauaugucuguuccuuuuuacuccucccuuuggcauuuccuuuuuuuuucuguaagauaaucauagaaauuuaguuaauggaggaacuacaaagaucacauggcuuuaugguuugccuauuaugcuggccaaucccgguggcacgagggcagcagggaugcagacagaugaagaggucccauagccaagaguguagguccuggagccagacugcccacauucacuucaagcaauugguacuccuguauuagaagaaaacaaagucccuucucaucuccucacccaguauacuccucuuuuuacucagcuugauaggaaucuuuccaguccucucugcauuuauauguauacaucauucguauucgugacccuaauaaugauacccagucagcucacaccagcaagaaaaaguauuuuucaagcccucuggaagcauuggaagcuccaagugagcauaagugaaaauacccuaagagauacuuccagguucuagauccagguguuucauuuuccccuuguuuucccacuacauugucaucucuccaaccuuaucuuuaguuuuguuuuuuucauggaagaccagaaagccccuuuccccaaaguguuaaaaucuggggugaaggcaacugaccucauugcauacuuuggcaauucaaaguuauaaaauguuagccgggcacggugguucacgccuguaaucccaacacuuugggaggccaaggcgggcggaucacuugaggucaggaguccgacaccagccggaccaacauggugaaaccccaucucuacuaaaaauacgaaaauuaaucaggugagauggcgcacaccuauaaucccagcuacuugggaggcugaggcaugagaaucgcuugaacccaggaggcagagguugcagugagugagcagagaucgugccacugcccuccagccugggugacagagcaagacugucucaaaaaaaaaaaaaaaaaaagaagaagaagauauaaaauguuggggcaucuuuauuugggguguuaaaguagauacugucucuccuuugugcccacaguggcugagcugggguggggacauuuggaaauuugggaggaggggaguauuuugggucaucaccauaauggggucauugcuauaggcacuugguaugcaggagccaauaauaauaaaugucccacagugcuuaaggcagucugucaaacagagaaugugucggauccucaaugcuuuuagcacucuuuggagaaagcucauaaccuacaaagcacccagagagagugagaauugauuugaguggacaaugggggauugauucauggccagcuauggggucuggugcagacaggguggcaacaggaguaggaccaguguggccugugaaggcaggggccaagaugcagaggcagacaaggcucuugguuauguuugugcuggaaugcauucacgauuagaaacaggagcacaggggcuuucugaagggaugggcccagagaucagcagggacaagaagaggugucauucaaaauuagauggaacuaugcaaaaagaacaucagcucuuuucuccaguuauguaauugcuugacaaauauguuuucaguugaauugguuguuagagggcauaaauuuagacuuucugaugccaacuagcuaacaauaugcuuauagaaagauuuaaguccuagcuaaguauucuccuuauggaaaaaaagaauguaguuauguaaaagacaaaugaguugagccuccaacuuacagauuguugaauguuccuauuguccaggcggguuggggcuguuggucgauggugccaagccugaacaagcccaccacugugcugggauggagagggaaucucauccacccaccaugaacgugcuggagaaaacagccuggagcgcugcauuguccuccucaggagucaaagagucacaggaggaaucuuucuguugauucauagauagcaaaaaggaaggguaaaguuuccauuuggggccucuggcucuuggaaaagggcagugucucuaaacccaggcaaacgguaaauguggggcauaggcaagaggguccggguaguggccacuuccccaucaugcucguuucucauuuuguguuuuuuaguagaaaaacacaguguguucuuuugcccagacauuaaucuuuagaaugccuguauuuucuaauguugggauuucuuucacaaccacccaccuuaauauuuccauugugacucagaaaaucagacuucauucgauucuuuagagaacuauaaauacuguugucaguagagugaagucuugucuuauguaauccuaauuacagaauguguucucagaagagguaggcuagaccagagcugggcagaccacaggcagaggccaaauccagcccccugccgauaguagcuaauauaaguuuuacacccacuuguucauguauuuucccuggcuacuugugggcagcaaugccagagucaagucaucauaacagagacagaauggccugaaagcuggauuuacuauuucaacuuuuacauuaaaacuugaugaccccugugcuagacaggcagcucauuucugcagguaaaauuauauucaucucccaacuuucauuccaaaauugaaccuauauuacugaggccaaaaagggaaaaggauaaaagagaaugucagaaaaaagaaaaucccauguaagaaauaaaaauuauuuaaauugcccuugcuuuuaguaaauagaaaugccuaaguaaaguaucaguaaaauucuuggcauugcagcagauccuggagucccacguugcuuugaggcaagguccacggcagaagaaaaccccauuaccugaaucuuaggguguagcaguuucucugucccaaggcaaauuuaaguuuccaacaaaaaggaggauaaucagcccaguacugagugaccaaugguauagaguggggaguggacacagagagaacagcugauacuguucugccacuugcaggcuauuuggggacaugggguacauaaaaugaaguaacaagauagcagaaaguaaguggcacaaacuuuucaguugucagaagagggcaagaucaguaggaaauggagucauuagggaaggguuugcagaaaagauuagcucuaguggccaucuacagagaacgugcugagugccaagcacuuuuaggcauauuauauaaguauucuuaauuuuauccuugcaacaaagaaccuauggggguaaguaucaucuccauuucacacuugacuaaucucagacucagagagguuaagggacuugcccaaagugaggaaagaacugggaucugaagccaggccuauguggcccugugucccagcuguuuccacaagccugggggcuccucauugacagcugguauuuagagaggaaauuaucauccaagcuaaaggacaacacagacaacaugaagcagcauggcucugggaggugcccucgggaaacagucucagcuggagagucauggagagauuugguuucaccagauugugugaagccuucggugcugggccauuaaggguagacuuuguucagugggcacaggaaggucuggaggaggagagggaaggauguaaaggaagcaggcaaguuaggucuaugugauaaauggguacauagacuauuucccauuguggcauugacuugcuaguguuuuccucuggaccuuaguaucuuuaaaaucgguacaauagcuuucauuuaccuacuucuuaacaauuauguuugaaaugauaagaaaacuuaguaaaaauagaggaagccuacuggccacagaacagagaguguguuuacagaugaaagucaaauuauuauggcuuguuaaaaugaguaucucauuuaaaaaauacuauucuucaucuucaugauuuguucaucuuaaagauuaggcaacaacuuuugcuauguaugcucuccuuuccaagagaaaguuucugauucucugccaaguaaucccauuucuuaaaauaagacugcuuuaucuaggucauuuggauucugauuccuuucucuuaagagagaaggagcccacuggaccucaucagcugcagccugaauagucaguucacaguuuuucagauccuggugggugugugagaugaugggagaaucuccuccauacauuaguguccaugaaguuuuacuaacuugucaagugugaacugaccuuucugcuucagccacgugagugugggaguuucacugaaaauauucuugaaguggagggggucuuuuuacaagguuguaaaaugugggccuucuggugccugccucuuaggugacuccaagagaagcaauucuggaaauucaauagccagggaaggaagcacaugaccaggggcuucagcuugaaaucaaaaccugguacauuugagacuaguuauuuggugcccucccggagagucaggcccaacuuuuucaauaaugacacugcaauccggucaucugugagauuugaugguuuacuuuucaggugggagaaaggaauguuggucaguuuggcugaacugguuguugacuucuggagagagccgaagcucugcuagcucauuggaacucuuacccaggcuaauuucccucggccagauaaagagggaagccuuaucugccuuuuaagucuuucaggguugggcuguuuuccccuuaaagaugccuaugacagaaugggagcaagacaugucuuuggcaacgaaauaaaugaaaaaugaucacagaaauuaaaaauaaaucaacguaugcaugcaucccuugccccaagcaugaauccagcaaaaaccuaauguuuaggacugaacaaagguauaccuuugcaucaucuaugggaaagaaauaauugucuaagcaaacuauaagcauaugcaacucugccucaguugugucaagucuaagggagaugggugaguaggccccagagggcugccucacccugaccacuggcugguagacaagguaaguuuuauuacaaauggcaucacuucuuccucuguuacguaaguccugagauuugugcaucagccuacauugcugaacuuccgaagucgugauucugcuccagcuccaccuuuugaaggguaucucuuucuccaucucucacacagacacacagauacacacacacgcacaugcucucuuuuuuucucuaauauacagaaggcgggcagaaacagcugggaaaguaacagucagugcuccacaaaacggggucgcgugacugugaacaucaguaucuccugggaacgugauagaaauaaaaauaguucugggccccacccagaccuacugaaucagaaucuggggaugggaggagaguagagaagcaaucuguuuuuuaugaaccuuccaggugauucugauaccuacccaaguuugagaggugaggacccaggugacucggggguaacuuuuagcuuucuggaagaugacuaaauuuuaccaaaugauaauggaaauguauuccuaaaaucuaaacaacauaaacucuuaagguacuaaguuauuuaaguuauuuguaaguuaucuaaguucuuccuaaucucagaaaucgauuaauguagugguuuucccaagccuuucucauuauuucucuugggugucacuggcauugacuuccacuaaaaaaagaucccauggucaaaugacuuuggcauacauacaacuggauaaaaacaauauaaaacaguuuuuccugcagaacucuucugagucuguaauaugcugacacuuguuuuuaaucuucaagauaaggauacagaacuuuucaucaugggauaguuuuuucaaggaacacaucauagaacguauggucuacggaucaccauuaaaguuauccaugguuugccuaaacagcuuccugauucauuacgagaauauuccccaaacaagaaaaaugaaacauacuuuaaguaccuggaaaggaucuguuuuuugaaaagcauacacccaaguuuuacuuuugaaauccuaaggucuugguuuugaaaaccccaggcgcuaaggaaauuacauguuuuaaaauccuaaagguugaggaauuaauauucuaaacuucaaauuuuugaauaaucaugacguuauuggcaaauacauauaaauaaacauauaaccggaacacguuuuuccccuuuauccaauggaaauacgaucaagcaucacucuuagcagaagacuaccagacacuuguagggacacgaaaagugauaauaaaaacaauuuauuuauugaaugcuugcuauagaccagaugcucuucuaagcacuuuguaauuauuuuaucuugaaagcaguccuguauuuauaaucauuaccucuucuuacagauguggaagacgugacucaguuuccugauuacccagggucacauaacauguguggagaaggcaggauuuaccaccucaguccgcaguucaugcucuuaaccauaaugcuguacuccucaaaccugccacucgagagcuuggaauguagggggagaacaaagacaauaaaaagauaaacuagcaauacaaggcaggauguggugagggccaaaugaaugggccacaaacacacaccucuggguugaaaggauggugauguuauagcagaucucaggacccucaguauaacugguucugggagauguuccauuagaaaguuuuucagaggaaggccgggcgcgguggcucacgccuguaaucccagcacuucgggaggccaaggugggcggaucacaaggugaagagauggagaccaugcuggccaacauggugaaaccccgucucuacuaaaaauacaaaaauuagcugggcaugguggugcaugccuguagucccagcuauuuaggaggcagaggcagaauagcuugaacccgggaaguggagguugcagugagccgagaucaugccacugcacuccagccugggagacagagugagacucuuccaaaaaaaaaaaaaguuuuucagaggcaaaucacagcuauugacccaagaguggcucacaccuguaaucucagcacuuugggaggccaaggcaggcagaucaccugaggucgggaguuccagaccagccugaccaacauggagaaacaccgucucuuaaaaaaaaaaaaaaaaaaaaaaaaaaaaaaaaaaaagccgggugugguggcgcaugccuguaaucccagcuacucgggaggcugaggcaggggaauugcuugaacccagccaggaggcagagguugcagugagccgagaucgcgccauuguacuccagccugagcaacaagagcaaaaccuccgucucaaaaaaaaaaaaaaauccgagaaagcaugaaucuguugugcuuugccacaguugacauugcacuucaggaggauuauuuucuuuuaugaagguauguaaguguccuugcaugccuagacuaaaaugagguuagggcuucauuuggcaaagacguuuggauucugauugcaaguuaacccugaguccgaugcugaaaaacgaaaaaugguuuaagaugugccccugcccuuggaguccacaauccaguuagggaaauaagauaguauauucuuuauuuauuccugucuuuccucagaauggguggaagcccagcgauaagauguuagcauaaggccuuucguaauucaaacccuguauaaauacuuucaaaugucagauguugauauaaaaaugauuuggucaccugaaauuugggaaucuaagccaggguucaagggcacagccacugugcuaaguaaucucagccacagcuacuggccaagaacacauuuuguccuguacggcacgugauuuuccugugccauuuggcuuugcaugaggugccaacccuauugggccugugagacgcugagacugaauggcucccaagaucccugcuuguaguacuggcaguggucaucacaauggcagacacccccaaguuagauuauacuuaguugaaagccuuuaaacuggauacuuagaauuccuuuggguuuuguuuuguuuugaucauguuuauugcauuucaucaaguauguuuuguugugagauagagucagguacguaaagagcuucucauuugugauguauccgaugccagguggcacauuaucaggauguaaccuggauuguuuguacagacauggucuguggggaaauccuaaguaagggggaggcaaaggcaggacggaggugaagaguauagacuccggaguugcaaagaacugaaucagaauucuggcguggccuuuuccuugcagugagacuuggggcauguuacauaaucucucugaucucugaguucccacaucugugaaauagugauuauuauaacacguaucccauaggguuauugugagaguuaaaugggaucauucauauaaaacauuucuguuuaaaguauuauuacugcuaagaagggguuagcaaccacugaagucacgcaugugcuagaggaagcugcuacagucucuaccugagccauuggucaauuguugucgaugguugacaccuucccauuuucacagugaagugaguauucuaaaugccacaucuugucacugagguucaugauuaaguagaucagcuagcauugcuuauucccuucuagccugugacugugaccccaggggcauugagacgccacagugugaccaguccacgggccagugugucugcguugaggguguugaggguccacgcugugacaagugcacgcgaggguacucgggggucuucccugacugcacacccugccaccagugcuuugcucucugggaugugaucauugccgagcugaccaacaggacacacagauuccuggagaaagccaaggccuugaagaucaguggugugaucgggccuuaccgugagacuguggacucgguggagaggaaagucagcgagauaaaagacauccuggcgcagagccccgcagcagagccacugaaaaacauugggaaucucuuugaggaagcagaguaaguaguuaaugagccagaggaauuacucauaaagcugaaaaaauauugugaguuaacagcaaagauuuccuggcauggugcuuccaucaggagguuuuguuaguccugugggugagaacagauucugagccauuuauuuuccagcagucuugacugggcauuugggugagugaacguuggcacaucaguggggaccagccuucuggaggcugcaguacagaauaugcaagcauuauauucagugcuccuccuugcaaaucauguucuaagucaguaaaaugggaggaaugcuggauuuagaagacaaagauccauaauugagucuuggcucugaugcuaggcuugugaacuuggaugacucaauuccugagccuguauuuucucuccuguggagaagggguaggauaauauaugccauuaccuuaugaaguaaugaaaggauuuauauauaaaauaacaacaggauugcagaaaauuauaaauuaaguauugcuacuaugggggaaauuccauuaccucaaaauaagacugcuuacuucaaguuuuuucugcuucuccgccauuaguccaccagaccagugcuucauucaucuaguuauaacagcugcucuaugcugaaaaguccucaucccaccccuucucuagguaaucuucccucugauuggacaguguuuguuaguggaagccuagagaauugaccuucucaaggaucauuuaucuacccuuucuccuaccuccccucucuugccccuaaacuucccaacuccuuuugccaaaaaggaacccccaaaacagcacaauaagaccuaagugcuaaaggacaaaaauagaaaaggguaugaggcaucugugcuucccuagaugcuaugguuuuuucacugcagacucaccaucuaggccugaggggacugcuucacaguuaaauccugcacacugagguguuuauaugacgaaaugacaguaacauuuuuugugugugaugagacuuuaaucagcaccuuuaagaagccagagggacuuuucaucucauaccaggcaugaguagcagaggacagcugacauuagcucaagcgacuugaaggagguccuuccuagaccuagauuuaaaguaacuggaccuugaugucaagccuuggguuuuaugcccaagaccauguagcuggccagaguguuaggaaacgucugauguagagugacaaugcauuuagugaggcauuuuaccucacugaaaagacuaagccuccuaaugugcagagaucacaguuuuggcaggccgugguccgaaugcaagcccauuuaggaaaugauccuuggccugggucuuaggcaucucugggaggaagaaaaaaaucugguguccuuugagagccugccagaagagagauuacauucccaaaacagcucuguuucuaccgucacuauucauuuaacuagacagauuguaauaaucacaggaaaacuaguuccauuacucuuuuuuuucaacauacuauccaaggauacauguuuuaggaaccaaaguggccuuauuuuaaaauacgauguuagauuugcuuguuuuaaaaaaaauuguaucauuuuaugagaccugagaagaaaugaaagccuucugugagucauauaauuaauaaaagcaaagcacugaaaaaagaaacuauguauauuagccucaggaaaaaaaggcacugaaauguaauuuaaucuaccauuuuaaaccaucccuuuaaguacuuuuucuuugaguuggguuauaguuuuaucucagccuuacauaucauuuuucuaauggcucccaaccuuucagcaucuuuacauuuuccugguuuuuuauacuauuauaucgccaagaagacaauuacauucaauuaggugaaccaguaauacccagagguaaaaucugcucaaauauuacuuucuuuacaauacacauacaacccuacccacacccaccuggagcacacucgcaugugcacacacacacccauauccacacuauguacacaauaauauacaaauagaugucaaaaguacggcuuuguagguuugaaaguacagaacaaaaugcaguuuagauuccaaauuaaauacugugaaagcuaaaucuucuuauuucauucuuaguagaugcuauuuucuuauaaaaaauaaaaaggcuguugguagaaggaggccccucugacggaagagaggaguguaugaaagcugauacugguggcuccuguugucuuuguggcaggcuauagggcuuccccucugcauguuccaucuugaaggagaucccugaggcuuagggaagaauguuuugggcuuguggcugggaggccuaauuguauaacuggagucauuuaugucuucaguuuucacaauuguaagggcuugaagcugccugugaauagagccagaacuccacacucugaccugugcucaucuuacagcagaaauuuggaaucccuuaaauggcuugucugccacaacucagcugagugguacuucuguguuucucucaaaagucauugaacaaagaaaaauuguuagauuuaauacuaucuguuauaaggaaaauaaaacuagcacuuagggaugaaauguuacaaauuacugaauugguuugaaauuaguaauggauacaguacuaguagaaaauaugaaacgugaaaguucucccuuggguuuauuuuauguaaguaagcuuaacuuucucuuuacaggaaacugauuaaagauguuacagaaaugauggcucaaguagaagugaaauuaucugacacaacuucccaaagcaacagcacagccaaagaacuggauucucuacagacagaagccgaaagccuagacaacacugugaaagaacuugcugaacaacuggaauuuaucaaaaacucagauauucggggugagcauuuuuuggugcaaauagucccagacaauggauuuaacgauaugucuaacguuuuaauauagcacuuuuggggaaaaaaaaaaguuuucuaauaaauuuuaaaacuuuugcucauccaguuucuggcacaaaugaggaucaaaguccccauuuuacaaaugugggacuugggcacagagaaccuaagagacauagcaaaggucccacagagugaauggcaguaguuguaucagaaugguauccauuuccugauuuuuuuuuuuucccuccaguuaguaguuuaauccccuggccuuuucuuggaaggggguucuuuugaauaguuaagguauuaauacuucugcaaauccuuucacauucaagaaugcugcuuggucagaaaaaaacuuuugcaaaucauuauuuauaucauagacuguaaaggauccucagcaaaaagugaauguagaaauauguuacaucauacuguccaacuauccauacuguuuuaugcaugauugcuuuuggacuaaagcuaaaaacaugucaugcuguuauauauaauaccgucaucccuugguauccaugggggauugguuccaggacccacugcagaaaccaaaauccacagguggucaaguccguuauauaaaauggcacuugcauauaaccuaugcauauccuccuauauacuucuuucuuuuucucucucucucuuucuuucuuucuuuaagagaugggcucuugcuaugcugcucaggcuggucuugaacuccuggacucaagugauccucccgucucagacuucugaauagcugagauuauagaggugaaccaccacacccagcuuuacuuuuuucuuuuuuucccuucaguauauuuaaaaguaaucuguagauuacuuacaauaccuaauacaauguaaaugcuauguaaauaguuguuauacuuuauuguuuaggaaauaauggcaagaaaaaagucuguacacauucaguacagauacaaccauuuuuuccaaaugcuuuccauccacaguugguugaauccacauauguggaaccuacaaauauggagggcuacuauauuagucauuugaguggauccgaauaaaggauugagaaaagucaucuagucauauaaucuucaggcugccugaaaccagcuauuuauaaagaacuggauguuugcuuguguauagaaacaagauugcaugauuuucuuaauuuuucauuuuucacccagauguuugccauacucgagcuggaguaggugcuaaugggacaaaacauauucauugcucaugaaaacuguacuucauaaauauuuuuucuugaauuuuaaaacuuuacaguaaauuuaggacccgaagacaccaaauauagacacugcuuggggaggaagccuaguaugaugagguuaacugugggcaauuucauuuccuacccuaggugccuuggauagcauuaccaaguauuuccagaugucucuugaggcagaggagagggugaaugccuccaccacagaacccaacagcacuguggagcagucagcccucaugagagacagaguagaagacgugaugauggagcgagaaucccaguucaaggaaaaacaagaggagcaggcucgccuccuugaugaacuggcaggcaagcuacaaagccuagaccuuucagccgcugccgaaaugguaagguuuggggauguggccuuacugcuauggugccaagcaaaaaaaaaaaaaaaaaaaaaaaaaacaaagaaaaacaaaccaucuuuugucauuauuacaauaauuugcaaaugaaucagcaggacugaaacuccuaggcugaggucucuggauccuggaaugggguaucuguaaccaagacagauuaaaagcagcagcauauggguuuccagccuuccccucuucuguuucucugugguccucaacuaaagaaugaaucaugacuauucucccauacuguuuuagcuacucagugacaccgcacugaaacuugauccuuuuuacacuguggacauuucuuuaauauuuuuuuuccuaaguagagacagggucucacuacauugcucaggcuagucuugaacuccgggucuccagcaauccuccucucaccucagccuccucccaaagugcugggauuacaggcuaacaccccagcccacccccacccccgcuuuuuuuuuuuuuuuuuuaaagagauggagucucacuacguugcccaggcugaccucaaacuccuaggcugaagcgaucuucccaccucacccuccugaguagcugagaugacaggcaugugccaccacacccagcuuggacauuccuuuuuuaguuuguucugauuugaauuauaaaacccaucucaguguaggaauucagagucauucuagaaggggcuuccauuaaaaauuaaagggagcaaaagaauuuuuucacggguauuagcuauuauguuccuuuguuccaguaacuuuaccuggugaagauuaacccugaaaccagccuagaaaguagauucauuucccagaagcuuuuaaaaaggaacucuggagccaaaugaaauuggguugugaguuuaaugaaaaucaggcagaaggccccaaaaaagccuaacugagccuguuucuuccucuuccuuccuguguuuucaaggaaggauaccuaugugaaauaauuuggaggguauuuuuuauagacuaagguuuguguucucuuagcccagagacacagagaaaguuaaagauggaagguacauaggcgcagaagaguucaaacuucauuacagcuuugucuuagugaugcuuccucccuccucucaucacuuucucugaaauagacaaaauuggucacaauauaagacaguguuuauugaugccugcuagguuucauacucauuaucuucugaaacuuuauagcaaauagggagcaaauaaucugucauuuauuaaauggaaaaauaaaagaugaagaaaaaagaaaaaugaaggcuuagagcaauguguaaauugcagcuaacaggagacaaaguuaugaagcaugaaaugccaauucucuccaucuuucccuucagcauugauuccuuccuuacauauuguaguuaaaaaaaaaaaaucaguuaucacaaacaaguucugugugaccuacaagaaacagcuaagcaugcuaaaggauuuuugucuugaaccggaggcaucuccgugggcggcagggagaugcaugggcggugggugggguucgggguuccucuggccuuucaaaugugugcccuucccugugcuugcuuuuccaccugguaaacuaccuagggauuagcagcugcuucaguucucuuacuguguuuuugucuuuguuaaugauccugugagaauucuuucuguaaguucuuuacugccauuuccuuguguagagagaguuuuguccuuuuguuuuucagguacuucuaguucuguaucuuuguggauguuuagcuagagccauacuguguuuuuuuuuuuccaugucugccccaucuguugaaacaaaacagaucuucuaugugugcugucagauuguuuuuagaaagcaaccgagguuuuacacuuauguucuuaagacucauguuuuacagcaugcagaauacacuuuauuuucugaagcuuuuuguuuuuguaagccagauaaaugacuuauuuaguuguaauuugagauauaauggaauuauaauuaucuuaaaauuauuaggcuaaauaguugauuguauuuauuuaaaaacuacuuuuuuguacuuuuuaauaacaauacuuguuugggaauauucuguuaacuccuuuucacugcaguaaaucuuugucuucuuuucaguaugagaauuuccacaaacagcucuaaaugcaauuuucucccugcucagccuuuucuaucauauagcacacuuguauuauaauuuaucaauuugcauuuguaugccaugaccaaguggugaucuuugagagguuuugguagguaagaaaggaggacucuaugcaugugugauggcagucgggggugguaauuugggaacacuucaucuaccuuuguuccuuuguuuguacuguuuucuuuaaccuguggaauguuuucccacuuccccugcucaaaucccaccagccaacagcuucuucagcuacaacuguagcauuccucugcagucucuccuuugucuacuuucuuucauagugacugcaucugaccuauucuuggcuauuuuauguggaaugauccaguccuaacuagaugggaaguuacuaaaacgcuagguaauagaucuuuuaugucaccauauuuacuggaggaguuaacauggugcuggugcuggucccaaagaugguucacaauagguuuuuuuuuuaaacucuaacugguuagaaaaaaaggaaggcauuccuuggcccuugcacuggcagaauucaacuugauauagcagauguuugcauccugggcagagcucauauaguauuuuaacucauuugggcagaagauauugaugaguuguaaacuuccauuguuuccuuggaaauaagcagguuaguuuacuccuaaacucucugcuccucucuccauucugucucccaaacacuguuuucaagcacccuugcugaggaccaccuacacauucucuggggccacccaggcccugcacagcuguuuugcugcagcagauucacuauccgaaguauugugccugauccuuggcuuguugcagaccuguggaacacccccaggggccuccuguuccgagacugaauguggcgggccaaacugcagaacugacgaaggagagaggaaguguggggggccuggcugugguggucugguuacuguugcacacaacgccuggcagaaagccauggacuuggaccaagauguccugagugcccuggcugaaguggaacagcucuccaagaugguaacucaguggauggccucaguuuuuguuauguauguuugcuuucagcuguggacuaaaggaucugaaagggagaaaucaauucuaaaugcuaacugaaaugaaaagggcauaucacaaucaaauaugaaaguucauguuucugugaggucagagaaagagauggggagauuuucuucacagauaaagaauuugcuuucuccucacucaacacaugcuuuagagcaagauguuuaaaucuuauacuggauaauuugagauagccaucuuacuuuucugacuccaggguuauaaauacauccagcuguaugacaaaaacucuauacuaagcaauugagcauuuauucuucuaaagugacacacacuuuuuaaguauuuaugugggcaccugagaaaaagacucaggacuauuuuauaggccaggaguuaaaaaacaacuugaaaaauuuuaaaugcuaguucuauuuauaucagaauacuguuuaggaaucucuauacugaauacuugcagucuguaagauacaauacuuuguugaaugggagaaaguuguuucccagacauaugauuccaaguacauaguuuuucaacaucauuuuugagccauuuccaauauucuggucuccuuuagaaagaaugaaagucuucccuggguaauuuauucuucauauuuaggucucugaagcaaaacugagggcagaugaggcaaaacaaagugcugaagacauucuguugaagacaaaugcuaccaaagaaaaaauggacaagagcaaugaggagcugagaaaucuaaucaagcaaaucagaaacuuuuugacccguaagaaauuuuuucauuuuacuuuuagacauuuguuucugugugauucucuguuuacauuuuagauaaaauccauuucugucaggguacuaagugacauuuccaaauaagaaaaacguccguauauuaaauguuuccacuucuuaaacuuauauauguguaucaaauaacuuucuccaauguuacgcagauacagacacaccugaugggauacucagguagccaaucaaaagucaaauauuuacauugaaaauugaacguggaauuuguuagaaauuacguauaguaauuucuaaccuuaaagaaguggaguuuguuauuuuggcauugcccccaaagcuuuguaauucuauuauuuacaggauauuauaccuauaguuaguuaagaguguugcuagucacaguucaaguguuaccaguaaagaugguuuuggcugcaaauuacagaaaacucucaagugaaagggacuuaaucaaaaaggauguuuauuaucucacaucuuaauaagauauccaguagcaggauagcuuccugggucugcgacccacauacuuuucaucuuucuacucuaccaucuuaagcauaucagcuuuguccucuagcuccucaugguuacaagguagcugccaaaguuccagacaucauauaaagauuaauaauggaagaagagaccaccuauuccuugcaucuuuuuaaaaaggaggaagucuucccuagaagccuuuaagcagucauccuuauaaaccucacuggccagcaauaagucacaugccaaugcauaaaugucacuggaaaauggaaaugcgauuacaguaauucacaaacuaauauuuaaugcuggguugauaauuuuaccugacuuagaggcagguaccugaaaaaaaaucaguauucuguuagcaagaaaaaaggcauggcuaauaaggagucaacaguauuugcuaaggauaucuuagguaauauuuuauggaagccaucauucaaguacauauuuuauuugaauaaauccucugggguccauuuuuauguucaauaguuuaaaacauaagcaaagcuugaaaguaaaugaggaucugacguauuugaagcuuaacuucauaaacuuuuuuuuucaccaucuuccacauuuuacauuugaaacuccuuggcuuuguugacaacccauuauuccgguucuccugcuucuauaauuuucucccuuucuauaauuuccugaaucuagaucauuuguaggaaauaucaaaucuccauaucugcauucacaaguuucugagcuauucguccaaccucaauuaaaagauuucauugccuuuaagucucagcuuuaagcucuggcccucuaugguuuuccacaauguucagauucacucugcuauacuuucccguaacauacucugccguuccugucuccccaucuggaauuguccuuucuucuuucaaauucuauuaucccuuaaaaucugaucagcuccucaucuuccacgaagguuucccucacuacccagccuaaaacaaauucuaguaguacucaauugucugcaguuacuuuuuuguguguguaggucucaucuccccucaaaaucccagauagauuauaaacucuuaaacaggaaguuagugucucuugguguguaaccccaccaugcuaguccauaguagaugaccaguaagugguugaaugaaugaaccaucuauucuuuucaccucuuuuuggggacaucuuugcuuuucacagaggauagugcugauuuggacagcauugaagcaguugcuaaugaaguauugaaaauggagaugccuagcaccccacagcaguuacagaacuugacagaagauauacgugaacgaguugaaagccuuucucaaguagagguuauucuucagcauagugcugcugacauugccagagcugagauguuguuagaagaagcuaaaagagcaagguaucuaaagacauggcaucuaaggggcuuauuuuguguaucuaucauggaguaaaaaguaucucuuuaaccaaugaaacuucuaagaaggaccuaugcgagucucucugggucauuucaggaaggcuauucuuuaaagaaaagaacacugagaguacuuuuuucauguucagcaacaauauacugucucauuauuuuuuacucagcaaaagugcaacagauguuaaagucacugcagauaugguaaaggaagcucuggaagaagcagaaaaggcccaggucgcagcagagaaggcaauuaaacaagcagaugaagacauucaaggaacccagaaccuguuaacuucgguaggcauacacaaucauuacaugaaugggaacacaccuacauauacacuuaccagaaaaguacauuuguuaucuaugaacagaaauucuuacaacucaacauuaaaggauuccuuuaauaaaucuaaacuacuccguuagcauggaugcuaaaaauaaguggagauagguuuucaaggaauaaaaggacucugauucagacacuggaccauuacgucccaucucauuuucucccccacaaagucugagaaagauaaaaacuucuauucuugggcgggcaugguggcucacgccuguaauuccagcauuuugggaggccgaggugggugggucauuugaggucaguaguucaagaccagcguggccaacauggcaaaaccccuucucuacuaaagauacaaaaguuagcugggcauaguggugugugccuguagucccagcuaccugggaggcuaaggcaggagaauugcuugaaccggggaggucgagguugcaaugagcugagaucacaccacuguacuccagucugggcaacagagacuccaucucaaaaaaaaaaaaagcacuccuauucauugaggaaacagcauauacucuguucaguaguaugaaguauaauaauuuuagaaaacuguccugauguuauaaagcagcuuaucugguuaagaaggccaaugucucaagauuuuggucaucaaacauuuuacuauauaguaguuuuggaaacuaugggagaacagucagucugcuuucaauacccaauucuagagaaaccuaauagagcacuuauagcuaaacaaucuguucuguuuagaaugcauggaaaacuuaauguuuuuuauaagaaauauacugugacuaccagauauuaaaaguacucauuacgaauuuuucauagggaucuagcaccuugcucuaaaaauccucuuuaucucuuaaaagaaguaaugcaaacauaauuccauuaaauucuuuuguuucucagaaaguuaauguuuucguuccaauuuuacgaguuuuuaaaaaaugaagaaaauugaugaguuaucuaaucccuauacagguucucagaauauacuuugaaauuaaaugcucccauacccagcauugucagccuucucaggccaauccuccauguguuuaaaaccugggaagaugaauuuucaacaugcuuuucuuaccauuaguugguaaaaaccuguguuccccuauucuauugcugucaguuaaaugaaggccaauaauucuguccauuuuccuccuuaaauuucgaguaucaauaagacuuuuucuucaggcuauuuguucaaguuuagaaaaauuauguuuucccaccagacuauaaauauuuugauguuucgaucucuagguuuuuccauuuucucaguuugcuguuaauauuuuagugaauauuaugucagugacuguagaaauuauuguuuugaaagccaggugcagcagugugugccuguagucccagccacuugggagguggaggugagaggaucacuuaaggccaagaguuugagacuauagugcacuaugaucaugccuguaaacaaacagucacugcacuccagccugggaaauauagcaagacccuguuucuugaaaaaaauuguucugaaaagcaaauuagaaaauacugaauuauaggugagauguggcuugaugaugcaaguuaauaauugggguucuguuuuucaggggcccuagggggcaggaaguguuuuagguuaguaacaauaagaaacaaagagaaccucuaacuaaacuguguucaugaaagcuuaucagaaacaauucacucaaacuuuaucuucuaagaauuauaauuucuaagaauuuuauucuaauuaaaggguccuuagguuugaaauauuuacaaauuuuagccuaugucuuauacugacccuuauuaacuucauuauagcaguacuguuauucaguuaauucuauguaauuagacccauccuugaagaucauuuuaaagaaaaauugagugcucagugaaauugauucuuuugucaugggcucaacugcuuacuuuggcuagcuuuuaaaagucaauguuuauugauucuacuuugaaaggagaucagauguggauccucaccaguugcccagauauuuuuuuuucccuaaauaacuuuguguauuuagaguuuacagcuguaacguucccagaccauacaucaucucacaauucuauagaaauucaaagaacaucccuagucuccaugucuucaguaauuagcugaaaucuccacuacuagaguuuaacauuuauuuucccacucacauuaaguuggaaauuuauguggaaaucccucuucgcacagcugcuuauuugugaauguucuuuagccaaaguuugcagguguccuuaaaaugcuuucucaacacaucaugcuccuuggggaggugggguuuuuuguuuuuuuuuacugucagaaaaaauuuuacaucaaucucagcuuagaucaucagaaguacugaaagaaugaagugaauauaugaaauguagcaaagacuaaaguuagauacuucauguaacuuuuccugaaauauucuuuuuaguaauuacuucuuuuggucuagagcaaaauggcacagcagacuuuuaaaucuuccuccaaacuuguacucauaguaauuccauuucuuaaacuaaugucuugcuggaaaauugacaugcuuuuagauugagucugaaacagcagcuucugaggaaaccuuguucaacgcgucccagcgcaucagcgaguuagagaggaauguggaagaacuuaagcggaaagcugcccaaaacuccggggaggcagaauauauugaaaaaguaguauauacugugaagcaaagugcagaagauguuaagaagguacguaaaucuuuguaauuucagagcuauguuguuaaaggagccaccagucuccuccuugccugccuuagaguaagggacauggaccuaacagaaacagaauucaucagaaauaucaaaugaccuguuuugcaacagccgucuuuagaaguguggaugggaaagaauauggaaauaucuaauaaguaugaccuauguccucaaauccaaauuuggacaagaguuuagaagaacggaauuaacuuagggguagaagucucaaaacaggcuuuuuuuuuuuuuuuaaaccaacuauauugacaaaaaccagucauauugaacuuuuauuucugugcgguagucaguuaaauucuucauggcauauaguaauuaucaggccauuugagaauauuuuacaagcagguuggaacagagaacagguaguaggaaaccaaaucuuaucucuuugagacucauuuugaauuaacuaccccucaccucucauucgaaggcacuauauuuugcagagaaaaacucacacaacccaaauguuuaaucagaagccauguaauaacugaaacacauguucaguuucucaauaaugcuuauuucuaaagagaacauuaaaaacuugguggcgccgggguggggcuuaaaaccauugaaucacugguccccaacuuuuuuggcaccaaggaccaguuuccuggaagacaauuuuuccagacucggggguggggaugguuucaggaugaaacuguuccagcucagaucaggcauuagauuccauaaggagugcacaaccuagaucccuugcaugcacaguucccaauaggauucgugcuccuaugagaaucuaaugucaccacugaucugacagaagguggagcucaggcaauaauacuugccugcccacccaguuccuaacugguccguaggccugggggcaccugcauuuacugaccuaauuucaguauuuaacucccuacuauucaaaaauuuucuggaaguuacuguagcuuuucgggcauuacguaagaguaacuuucccuaccucucucuagguugggaaagagaacaaaacaaugagaaaaguucacugccacaauaucagacagcugucuuuucuguuuugguuugugugguuuccugcaguacugaggacacaaauuucucaaguacucugcuucagggcauuuugcauaaugacauuuuaucacaagagaaaggaacaaaaucucuugaaaugaaauuuccauaaauggcuauuugaacaguuucuaaaaagaaucauuugcauuccaaccccacaccccauuucucuucuccucacucacuucuugcauaugcuacaaucucaccuuuccuuccuguaucuuuuguuuaaucuuuuuccucugauuuccuuauaagcaagucuucacaaauccuaauuuagucaagauccaaagagccuccacuucuucaauaugggcuucucuaaugucuaaucuacuuuugaaaaaucugcgcuucucuauguaauuugcaauacaauuaugcuacaacuuuucuauagaaaaguaauaaucaggagaaugaggacuuagcccuaaggauuugcugcaacuccagaauuuuuugaaauguucuuuaaaaucaugucaauuuugcauucaauuccacuguuugaagauaaaauuuuaaauuacuuaccagugaauauccuugguggcccuuaauccagaaugcaugccaugauuacacuauugcucuuaaauguaauuacugacacuaacauuaccacuucuuucugucuaaauguggaacuauagacuuuagauggugaacuugaugaaaaguauaaaaaaguagaaaauuuaauugccaaaaaaacugaagagucagcugaugccagaaggaaagccgaaaugcuacaaaaugaagcaaaaacucuuuuagcucaagcaaauagcaagcugcaacugcucaaaggugggucuuuucacacaggcuuauuuuuuaaauuacuuuaaggcauccauaguuuauuuaaaagugaaaaauauauucacuuugucuugagaucaucauaguauaaauugcucagacuuuauauauauauaucuccccacagauuuagaaagaaaauaugaagacaaucaaagauacuuagaagauaaagcucaagaauuagcaagacuggaaggagaaguccguucacuccuaaaggauauaagccagaaaguugcuguguauagcacaugcuuguaacagaggagaauaaaaaauggcugaggugaacaagguaaaacaacuacauuuuaaaaacugacuuaaugcucuucaaaauaaaacaucaccuauuuaauguuuuuaaucacauuuuguauggaguuaaauaaaguacagugcuuuuguauauauu

SEQ ID NO: 17012 - RNA, 940 nt, Homo sapiens
aaacuaaacguuggguuuaacaaaacaauacuuuugaaguaaaacaaugaaaaauuuuuucaaauuuuuuacaaauggucaccucugggucaauuuacuaaacuaggggaacaaagagauguuaaaauauagcugugcucaacugagccacuuaucuguacuacaguaugguacuugaaaucaaucuuaaggucaagauuuaaaaccauuuuaagaaacaagacccuauguguuuuauacuaccucgauaagagguacucuuccuucccaaaacagucaaagcuuaaaagauugacuacacauaaguuuuuuucccccucauaucuuccauucaaaauacuauuaucauugguaauacggucuauaucuugucugaucuggaugaugugguccaggaagugggguuugagaaggcggacccugcaaucguggagguggugguggcccucuuggugcaggccauauaccaggacucauucccccugguuguguaaauggagggcucagaguuccuugaucuucagugaacugggguaaugaguuaggauuauaauggugaggagggggugcaguuacagguggaccaccauguugaggugggggagguccuggaggaggaugauucauauaagguggcaucugggcaauaauauguccagggggagggguuauuggugguggagcagaggucauugguggagguggagcuuggcuauauaccaagugaggaguaccugcagccuggggaggauguggcauuggauggcuuauuggugguggaggagguggggguggugcauaauguugcuguggaggcauaauaugaugagggugcgauaccacugguugacccugauauucaggaugauggugagcaggugcuggggcaggagguggugguucucuagcaccugaauuugagucauccugaauagggacg

SEQ ID NO: 17013 - RNA, 748 nt, Homo sapiens
aacgcuugucuaaauuuugcuuugucgugacgagcuaccuagacccacgcagagcuaacuugguauaugccccgguucccaucucuuaagucucuuuacaguugaaacacguuuauaaugcuugacugccacucacuuucuagggagagcgcuugugacgcuacgaaccucucgaacaccugacgacugggcgccagggccggauggaggguggagagccagugcggcgcagcugccuccucuuaacggggacaccuugcaggaaugugcggaguggagcuaacgggagcggauagaaaccgagggaggggaagagagcgcgaaggcuuggccggaaggagagguuaaaaaggaaaggccuaaaaugaggaagagaguuaccacaacaagcaguaccuaguuccaguucuuggucccaggaguuugugguuguugcugcuuucaucuuccucagccaacacaaaaggaaagugccaaggggcgauuccuaggaccuucagugcagucuccaccuugcggacuuggcucauuuguguccacuccuuucuccagccuuuuacacuugaugcucuuggaugaauagaaaggagcacaauuaauggaaaacacaagcuugggagucaagggauuuggguucuauucuuguccucccuuggugacgacaucauuaccuuggguuauucaagcuuucagugccagaguuccuauaucaauaaaagauuauuacauugaccucuuagagaaaugu

SEQ ID NO: 17014 - RNA, 33837 nt, Homo sapiens
uaagcaacuuuuuuuuccauuuauuugaaauaauauacaagaauauagugugcaaaauuuaggggcaacaucaugaagaagugugaugaacugaaaucaauuuuacagcugugauuccuaaccagaaacaccacuugguaaguaacaugaaaagccaugauuguagcucagagcaaaagcagcuguauugccaauguauuugcucuaauuuuagacaguuggaggaaaauuaaagugcaaguguugcacugcaguaagugcaaagucugcccccaccauaaagauuaugaugacaaaauauauuuaagauacauggcugaggagauacagaacacgaaguuaaaaaauacaaugguguugacuguuuguuaauagcaccauuacagugacuauaucccaaugcuauuaacuaacuuuaccuuggccugggcuaggucuccauuggaaauaauaacggauggcugcugccaccuggugcaucaacucagcaugccaugguaacugcagcagguggcucuuaggcugggacaccaacaccagccaccugccccauguucugguagccucuuggcacugaccagacuaggagcgccuauguuuggcacagaugcugagccauguggugguuacuagaggaaaggccgacucccagcuucugcuucauuucaucauguguacaauacagauuaauaagcaguaaggagccaauguauaaacagcaguuacauauuuuuuaaauuccccuuucguacaauuuaaaauaaaacauguauacacuucuccucucuuucuacuguacuuuagcaccacaggauaucaauuuucaagccuauuauuaccugauagacauauaugaaguuuggaagaaaaauaaggcaauuugguuuaaaauguugauaguuuuagcuuaaugcucuaauggagaaagcaaauccucacucauauuauuaaaucauuucaagacucaaugcuaucaguaucuuauggucacacgaauugaggacaaauggugagaccuugaucuucuuaagucuuuccaucaagagucaauguauaugcaaauauagacuuaagaacauaagcauccugguuuaauguuguugugagcccuguggaaauaaaauuaaacucagugaauguuuacaaaucaauacauaguaauccuauauaugaaagcuaagauguauaagauguuuauaaauuuacuauuagaaaauacugcuuucuuaaaggugauuuuaaaaagcuagcugauaucugauggcucaagcauccagaaaauguaugcaaugauaagacauugacuaggaugaacagaaaagggauacaggaaaaguccgaacacaugaaauucuaaauuaaccaagaacugccaaaauucaguucagccacccucucaucugacuacugacugaccacuauuuuuaaagaaauugugaaaaauuuaaacagauaugaccugcauuuuacuaagaaacaggcacauguacacaaugaauuuaaaacaucuuuggccagcccuccuacuauaaaaauauugauaucuucccuucaucuuucaaugauacuucaaauugaccccacuauaucacauguaauuuuuuugcaauuaaucuaaaaacgcugaaccuaaaagaugcuaguuuaguaauggaaaaguuauaagaaacaagucuauccaagauagcuuaucauauagacuuguuugccaccauuccugggccuauuucuucuccuccuugaaauuuuucaaucuagaaauucugugccaauggcacaaguccccaugaaugacagcuaacauaccccaacaccuccagccuuauuggucccucaccaauuaaggaaaaaaagcuguugagacaaucccaaaauuauuagagaaauuuucuacugugauauuaauggauuaauaaugcuuaucuuucaacccaacuagaaacacugcauuccaaaauuauuuuuccaacucaauguuuagaacaaacauucuuuugaaguuugccugagauuucgacuugccaugcuaugagaguaaaugacccuugaggaaaggcagucuuuauaugaugaugugauaacauuauuagguuuugaaguauaaaaaugcuagagacagcaucaacacaaccucuuaaagguuguaacaacugcuccaacaugccaguacaccugcacggauaaggcaagauaauuuuaaacacuauuuauugaaacauacugaauugguucuuuuccucuuccaacagucaggauuuaaacguuucuguucuucagccaaagccuuugcuucuaauguguacauucuucucucuucauucuucauuuucuuccaccugucaccaaggaucacacuuauggcucuguaaaauaaauauuuacacaaugcugaaagcacacauuuuucauaaaucucaugucaagugcugcuacuucaggagaaaaaugugaaguuaaaaaagaugaaaaucuugucuaucacagagaugggaaaaggucaaggccauaaugcucauuuccaguaaaaucccgaaucaaauaauccauuguuccguaucagcagcaugaaguauucaacuuguacuaaaagcuaaucuauuugugcccguaaccuaucaaauaguuuugauaaaggucuuuucucauucaaucauaguggaaguguagaauuaacuaugcauaucuuacuauuucucucucaagagaaaaccaaauaaaccuuuagacaguauuuuuuauuacuugagaaaacuggauaaacucaaaaugcuaagaaguuaaacugauaagacuacaucaugacaaauauuagaagcuguuuucuccuguuuguuacucugcuaugaaaccuacuaaaacagucucaccuaggcacacagauguaaaccaccuuccuucuaugaagagcuuucagccauucacuucaugacacccauauaaaacauaagguccuggaaauuuugcacaaagcacaucaagugauuuuuauacugacugauauggaagccaaagcaacaggcauuugugccuucgaacaguaaaccacagaagcucuccuacaaguguauuugucuuuuuauccaauaacuuaaugcaguuaaacauugugcugcauuuuccuuaauuauaaaccaauuuuugggcuggacguugugacucaugccuguaaucccagcacuuuuggaggccaaggcgggcagaucacuugaggccacgaguucaagaccagccuggccgacauggugaaaccccgucaccccaucucuacuauuugccaggugugauggcacacgccuguaaucacagcuacuggggaggcugaggcacuagaaucgccugaacccgggaggcagagguugcagugagccgauaucccgccacugcacuccagccuggggaacagaaugagacucugucucaaaaauaaauaauaaaaugauaaccaauuuuuauauuccauuugcagaacccauuaaaaaaaaaacuuuuagucuuggguuacagguaccauauaaugguugacacauuuaaacaaaucaauaaauauucacaccaucucagucauccacaguaggaaagaacaugagauguuuuugaaggggguggcacuugcgaaacauuuauuauuuuaagcuaaaagaugacagguaaugaaauguacacaaugcuguagacuauacucuguguucccuaacaaauguaaaauauacacaucuaaagauuauuucugcagugaauguuacauccagauggacauuuauagcaacuuaaaaugagcuacaugucucugaccuguucuagucuccauucccucagaauuugccuccaaaugagaauuuauucauugaauuaaggcagcuuuauuagagacagugaagaauccaauuucaaaauuaugauuuaucccauucaguuuagagauaggugauaucugauggcccucaauguuagaugauugauuaccaguauaucacaugggagcaaugcuaaaaugcaaagaaaauaccagauuuggcugggcacgguggcucacauauguaaucccagcacuuugggaggcagaggugggcagaucaccugagaucaggaguucgagaccagccuagccaacaaggugaaaccccaucucuacuaaaacuacaaaaaauuagccaggugugguggugcaugccuauaguucaagcugcucagaggcugaggcaggagaaucacuucaaccuaggaggcagcaguugcaaugagccgagaucacaccacuggcacuacagccugcgugacagagcaagauuccaucucauaaaaaaaaaaaagauuuuugagcaauaaaggguauaaccugauuuagagauccuauaaaaagaucagaaaacaaaacaucuaaagauaaaaugagauuuacaccccuuauaaucaggauaguccaguuccccagaauuggaaauaaauacagaaugcaucccagcugacauucucaacuacuggcggggaagagacuuacagggacgugaauccuguuucuagaugucaaaggauauguuuaauaauuaaauaccagaaguguacaaaaagagaaaugcagcauguaccugucacuaaaucuaaggccagucauuuucucaggaaaaacaaauugagcaaggggaaagguacaaauuacucuuaaaaugucuuuaaagccuaaaagucagucacagaaguagacuuccaaacuaacuuuuuuuaaaaaacacacuuaaacccacucuuuuuacugaagaaauggauuacaacuuaaagauuaauugccaaaagucacacaaaugacugacagauccaagaguuaaaacauuucaauaguauuaaaaagccucuuagcgcugggcccguggcucaugccuguaaucccagcauuuugggaggccaaggugagcggaucacuugagcucaggaguuugagaccagccuggccaacauagugaaaccccaugucuacuaaauaugcaaaaaauuagcuggguguaguggcgcaugcccguaaucccagcuacucggguggcugaggcaggagaaucgcuugaacccacaaggcagaaguugcagugagccaagauccugccacuacacuccagccuggaugacagugagacuccgccucaaacaaacaaaaaaagacucuuagaauucuugacucacuaauuacacacuuaugugucuaaaggaacuaggacaaagcuauucauuacugugguaacacaguaaugacuuuucucaugauaucaagauaaagcaaaugguaguuuugauccucaggguacaaagacuggaagaagacagcguuauuaauauauggagaacuugacugguuugagagggauucagcaguagaggacucggagaugaguaaggguacaggcaacagaguaggaaggacuugaguugauuuuuauuuccagcuucuacugaggacagcucuuaaguucaccguuuugacaacucuggcagcuugcuacaaauugccaguuccccguacaauccauaguugacucaggugaaaagcuguuccauaaagauagaacuguuaauuguuagaaccguguccuccaacagauaaauaacaugauuuuaaaagguagaucuugcacuuugggaggcaggcagauggcuugaacccaggaguuugagaccagccugggcaacauggcacaacccuaucucuacaaaaaauacaaaaauuaacugggugugguggcaugugccuguaaucccagccauucaggaagcugaggugggaggauugagccugggagauacaggcuacagugaguugcgccgcuguacugcagccugggcuauggcacaaauaauaaaagguagauccuuacuacuaagguagauaaccuaauugucuauguauuauaaaauaauuacauauaacccuaaaaauuccacuuaaacuuuuuacuuuaaagucaaccuggccgggcacaguggcucacgccuguaaucacggcacuuuaggaggccaagguggguggaucacgaggucaggaguucgagaucagccuggccaacauggugaaacccugucucuacuaaaaauacaaaaaauuagccagguaugguggugggcgccuguagucucagcuacuugagaggcugaggcaggauaaucacuugaaccuggaaggcggagguugcagugagcugagaucguaccacuggacuccagcuugggugacacagcgagacuccgucucaaaaacaaacaaaaaagucaaccuaagaguugaauaaaagcuauuaaagaauaaguuuacuuaacuauuccaguuaccaugaaccguauugaaguguuacucauuuauuguaaucagaauuaucacuauuuuuaccuguuaucuuucccuggauacaucugaguauauucaacucuguauuuuuuggcaaaaagcaugaaggcauucauuggucuuuugcacuuauuaggagaaguggcacucacagucccugagcugugguuuuugacagcuuuagcauacaaagaauuggaagagagcugugaugauccaggugagccacaguuuuuacugaauccagaucuugcaaagucuugaccaccagguccuccacaagacaaagaugcacgacgcuggcgagccauacuacuuaacacauaaacugcagaagaauccauaggugugaagucauagcuauaaaauuaaaaaaaauaauaauauuuuaauucaauuuugaauucucugauuucuaaaaagcagguuaaaaaaaaaaaaaagaaaacaucugauuggaaauuucagugcauuucccccuauaucauguuaccaacacuaacaacuuuugccacugauaguugcuuauaaaaugaaaucuguauaugugcuaacugaaauuaauuuuuuuaaaaaaccucugcagauaauacaaaagcuuaaaaaagacuuugaaccccccaaaggaauguuauaaucagcauacuuuauucauagcaaguaacuccuccaaauccuacacaacccacuuauucuuacuuuaaauucauuucuggacaaaugugacaauaugguuucuuggccuauaggcacccagaccuagaaaauuaaaauggaguggcaggcaacauaccaggccuaaggacuacuauagaaaacaaaugguugggaaaggcagugaaaagcuguuaaauguggcuaaaggaacuuaaggacaggccugguggcucacgccuguaaucccaacaguuugggaggccgagguggguggaucaccugaggucaggaguuuaagaccagccugggcaacauggugaaaccccaucucuaccaaaaauacaaaaaucagcuaggcguggcagcacaugccuguaaucccagcuauucgggugacugaggcaggagaaucgcuugaaccagggaggcagaucacagcacugcacuccaacugggcaacagagugagacuccgucucaaaaaaaauaaaaaacaaauaaaggaacuuaaaaugcccaguaaucugggucauuuguuuagguaaagagagccauacauacaucagucucccgaaaggccauccaugaccuauaacauagccuaauaacauaaaguucauuguaaaaaccugccuuugucaggaaaggccacauuuuguucuguauguucaguuuacauagacauggaaauaagcuaaagaauucucuuuuguuccagcauuaacucucuuucugccuauaguacuuuucuaucuucuuggcaggaaaccuuuuauucagcuucuaaucugaaccuagcuccuacuuccuucccugaaacagaaauuccgguaauacaucaaaauaguuuaauauuagcuacaggaauaccaucuaccuaaagguaaaacaugagauuacaaaauucuaaagauagauggaaacagccaaaggaaugagggcgguccaugccacugacuacacacaguaaaugacuucuaccacuuaucaagcacacaaugucuuuuuucugaaaguauugcaugaaauaaauguacuuaaacuaugacuccaaaauuaccucaugaaugcuuagcaaucaguauuacgucaggaaaacaaugucugcuuucuagguuugcaguuuuuguaagauaucuucagccccucccauacauaauuuagaaaaauagcaaacuucagcacugacacaaaauuacccaucucuacugauggaaaaugauuacaauuuaaaauacuaaaagauacuggguaagcuaauuacuaaaauuugaaaacuccaccaucuaguggcacaaauauaacuuaucaucuacuuccauuauggauacaacuuaaaucaguuuuaaauauucagucacaaaauucaaugacuaacauuacugcagcaguaaugacauagaguaucuuuaaaaacagcuucaucuuuugcuauacuaccuuagguaagcauucauucucuucacuaaagcaccuguacccaaaugugccuuucacagcucuacuuuguguacaugccauuccuuaagcuuagaaugcccauucucacuucacugucuaaucauuagucuuaauggcaaacuccacaauaauguagugccuauuaaccaugucacauauauuaacuuauuuaauccuuccaauauuauccccauucuacagauuuuuuuaaaggagccacagaaauauuaauuuacucaagcuuccauagcaaaucaauugcagagccaggauuugaauccaggcaguccagaucgagcucauguuccuaucaggcuacacugccucucaaucagcguguacaucuacuguauacauuuacuaauccauuuccuucucuagauuggaagcaaagagguauggccauucuuaacucauuuuuuaaucaauucugaauaacauaauaauggaaaauuuuaacugagugcaaauuccagcuaguaauaugaccuugggcaaguuaaauaaacccuguagccucaguuuacuuaucuguaaaauaaaucuaugcuaugcaguggugccaaaaagaacaauaaacauaagacacagggcagaggcuggcacaguguauuuugccauuaggaguaucuauuauuguagaaguaucuuaggugaguagcuagagaacucaaaauuuggaaucuuuacaagauaugggcuugaauccuaauucugauacuaacugccuuuguuuugggcauguuccuuaaccucucucaacuuuacuucucucuguaaaaugaggauauaaucuacaaauaggguaauuaauauuaaauaaauuaacauuauauauauaguaggcacucaaguuuguuaaaucauauuaccugaacagaaaugucaacuucaaagagucaaaacugacuguuuuaaacccgccugaggccuagaagguuggccucaauucucaauguuucagaaugggcuacuuacaacagaaccuugaauuauguaugagagcucaucaacugauugcugacuucugauucuuccugagcuagaaacuacucacauguccucuguaaaccaugacccgagaauuugcuuggagcaguccaacuuggacuuuuuccucuucuuaccucuuucucuucuugcccucccccuaggccaggcaucaucucccuuaaccagucuaauccacaaugaaaauaaagucacuuucagcuucucaauuuuuuccugguuucuccaugaugauaccacccauuuccacuccuuugcagggugggugcuccugcuguuauauugaagucacucaacaguaaaaugagaccaaugacuaacaucaucuugggagugauuauuauucagugagaucaaaugguaagaauuugcuaucucagaaaagcaggaauuaggcaggcaaguuuucccuuuuacuuuaaaaaaguuuggugcuauguaauaauauguaaacuuuacauauauuuguaaguuaugaagcauacaaauaaaugagugaacccacaauccaaauuaagaauaauauuuccaguaucacuaaguuccauauuugccaccccagaaauaaccacucuccugaauguuaaucauucuuuuucaauaauuuuauuaugaaaauauuacucauaaauacaacauauaaauacuacaguagcauuaguuuuauuaauaucuuucuuaauauauaagauacaguguuucauuaugcagaaaugacugcuauccuuucaaaagucuacuuacaagguugacccuugacuaauuucuagaacuuggauuuugaggggucccaucauucccacaacugagaagaguaguuuacugugccuagacuggauauacaaacaacacaguuuacucugaaugccugcuuuccuuuuggaaguuuggauuuuguuaugugccaagcagaagaaaccuacgugacugcucucaauaaaaacccuaggugccaagugcgccuaacaagcuucccugggagacgacauuucauauauguugucacagcccacugcuggggaauaaaacaugcccuuaauuccacugggagaggaucccuggaagccuggcuucccucagacuucaccccacaucuuuucccuuucccaauuuugcuuuguauuaguauuuuuuugccauaauaagucacagccaugagcacaacuaugugcagagucuugugaauucucugagcaaaucaucaaaccugggggcuagucuuuagggaccccugacauaauuauauaauguguauuacaaaccauauauaaggguuauuuuauuuauuucuaaggaacaugauuccauaaaauagacucauacuguauauuuccaagacuuauuuuuacuuaacauuguuuuaaaaauugauccauguuuuaaaguuuguagcuaagguucauucauuuuccacuaauuccacuauaugauuauaucacacuucauggauucacucuccaguuaauaaguauugauacuguuuccacauuuuugcuaucaugaguaauacagcuacaaacuuacuugcaccaucuccuugagcaugacuacaagaauuuacuucucuagaauauauauaaaagaggaaugaaacugcuaauacucaccuuuacaagauaaagccaaauuaucuuccaaaauuuuucuaucagguuacagucucaccaaaacauaggaguuaucauuaaucuauauauccuaaguaucaguccuuaaaauuuugacucauuuuucuaguuuuucaaaaaagaguguauaugagggauguaaucaaacagcauuaagagcauaagcuuguagacauuuaucgagcauguggcuugugucaggcccuaugcaauuugcuuuuuuaauaauaguuucacucauccucaugauauauaaaacauacuaauuaaacugaaugaaauaaaaucuacaggccagcagggacucuugagaauucucuacuuagugccaguacaugccuauggauuugauaauuaucuuaaagaaagaaugagucuuuaaaucccagauaccuacacacagacuuucucuggguuccuucuaggagcaagguggccaauuguuccaguuugucuaggacugagggguuuccugaaagcuagacuuucagugcaaaaaccaggaaagucccauauaaaugaagauagcuggccaaccuucuggagucaggacacauggguucuuguccuuuucugccacuuacuagcaacgugaucucaggaauaaccacuucccucucuaagccuuucuagaugugaaguuuaggcuauuuucuacuauuuguuaaaccaugcaacuaaugcccuuggucaaaaugaguaugaaacaaagauacaguuaacuauuauaucaagaaaaauacaguuaacuacaaaaaacacaagagauuuauaagcuguuuaagaacaacuggccagauaucacaacuuuuuaaauguaacuaucaaagcugaaccauuaaacucuuggucauguaacaugugauauucuuccuaaucuaauccuaaauguuuuauaaacucaauuuuccuauaugacaacuacacgcaaaacucucugguaacuauuauacuuuaauuaccuaauauguuuucaugucauacuuuccucuuaauaauucuuuuauaauucucaaaucuuuaaagacugaacuuccuaaauaucugacuuaaccaucauuagggaaaugaagggcaaacuuuaagaggaaaauaaaacaaagaauuaauccaauauuaccuuuuaaauguaucaaaaacaccugaaucaucaaaauuaauggcaucgggguguccaggagguagacauacaucgccaauaugaacuucacaacauggaaugccaugcuguaccacagucaagcuuggauaaaaugaugaccaaccuaaaguuaaacaauguugcauaaaggaugaggacucacagaaagcacccuacuuuagaacagacauaucauuucuauaucuuaaaaauaaaauguuauugcuaagucucaagagauucucuaacacaagucauguaucuuuacaauaaaguacuagauaaguauuuccuuucagcaauguaaaagcccuccaaaacuagcuuauuguucagcauuuuauuauauauagagcuccucuaucaaucagcacuuccauccgucuacaaugacaaugagcacuuccaucagucuacaaugacaauaagugauaaaugacugagaccaugaaauagucucugaauuauaaaaucaucuuuaacaugguguuacuguaauaaggcucugaagagugacucagguuuauaucauauuugguaacucuuaaugaaaaugugauuacuagaucacuacauuacccaaacuauaccaagauaauagaaagcuuauuauacuaugcuacaugaaucuaaaaauuucucauacaggaaauaaaguuccaccugacugcuaagauacuuacgcaccauuagguauuauuauaagcauucccuaugguaguuuuuuauuuaguuugaaagacguuuuccccucaaauuuuuucuuaaucaucaaagcuacagacauaauuacagauuuaagaagcuuuguuuaaaaaaaguuacuacaaaugcaauucaagcccuaccuuuauuuuuaacauagaaagggugguccagcuuacacucuacgguaaguaaaccaucuucuacuguaccaggaucaaaagucaacuucaguacagacucgccaaaugauacacuuucuucaugugauaacaacuuuagaccaucagaaccauagcccugaaaauauaugcauagcgugaaugaauuggaaauguucaauucaaaacacugugaaguucccauuacauguaagacuuuguggaaaagguaaaaauaaccaagacaggaucccugccauuaaagagcuuucaaacccgguagugaagaaagacacauauauaaauaacuagacuggaauaagcacuuacacucaaguauaaauaauggugaugcaguuuaauaaagaguuauuaauaccaaaagagagauuaaggaggauuuucaauuccaacuggaacugagauuuaaaagaagaaugcaauuuagaaagaugccuugcaccaagaaauuuguaauuaacaauaacuuuggggagugcugaguauuugcuaaaaauacaaggugaguucagauuuggggcaaauaaagcuaauaaggagaggccaguuaguaaaggccucuuaaagacaggcaaaguacugacaauuuuugcuuagaagguauugggaaaucaaucaaaguguuuuuaucagcaugacugucaauuuuuaagaugaugguaaauaagaaaagacucuacagaagaaaagaucucauauucaauuaccugaggauauaaugagagacaccuauuauagaccugaauugacaagugcaauaguaauagaaccagaaaaauuuaaauucaaugaauauugagcauuuaacacaugccacaugguaggaucugaaaauacaaacacuaacaaacaugauccuuacccuuacauucacagaaaaacaaaggagacaaacacgccaaaagcuugcuauaguauccaaucauaauuacgcuaacgcaugaacaaggucaugaauaagagaggaugacuuaaaaaucuuuacagaauuagaaucaaaugaauauaaauaaagggaagaaauagaauaguaaaagacaacuucaugguuuugaaucugguaaucaagaaggaugauaauaacaacuuugaaagaauaggaggaaaguaagccaagaagaggaagaaaaagguaagggcaguuuuggucacacuaagcuuaguucaaagaacugacugauauucaugcagagaugucuaacaugcagcuggaaaugugcaggugaaggcuauagacauagauuggcaaauaacgaaauuacaaaaucuucccauucucagggcugcaggagaccuuaaaacuaauccaaucccauuuuucagaucaggaagccaauacucagagggguuaacaaucugccuaagaucaguaacacagauaauugcuggagaagcuauaaagagagcccagguuuccugacuccaaguccagagugcauuccacaggacaugauggaggugcugcugacauuaucaggagagaggaacuggugaagaaagugaagggggcaaaaucuugucuaauauucagcacugcgggcagucaaguaccaggccuaaaagacugagaaucaggaugcugccaugcuacacaaaucaagggaagacaaugucaggaacuaacccaaugugucaaauguuguacagaugucaaacagaacaaacgacgucucucuuccuagaaaucagaauaaagcuaguaaccuuugagacaauuuuuguagaguaguagaggccaaaguuagacuauugugaacuucacuaaagugaagaguaaagcaaggggacgaaacugaaggcagccaagacaggacaauuuuucucaagagacuuaauagugagacauagcaggaucaaaacaagaauuuguacaagcacacuucacaugcccauuuucuugccuacaggagagauggagaaauuaaaaauuucaaagugaaaggugucaacuuuauccuaauauugcucgcuacugcuuuugcucaucgacuuagaaaaugcuaguuuuaguaacuuaauaugaaacaacuuauauaaaguaacuuaauauaauuggcuuucaauaaucuacaggggaauuaaucacuuuguagauuaccuaaggcaaggcuuugguuaguuuauuuauucauuacauauaaauauauauauauuuuuugagacagagucucacuguguugccaggcuagagugcaguggcgcaaucuuggcucacugcaagcucugccuccuggguucacaccauucuccugccucagccucccaaguaguugggacuacaggcgcccaccaccacgcccagcuaauuuuuuuguauuuuuaguagaggugggguuucaccgcguuagccaggauggucgcgaucuccugaccucgugauccacccgccucagccucccaaagugcugggauuacaggcaugagccacugcgcccgaccucauuacauauuuuuaauaccaguuuuccccauuguaaaguguauaaaacacgaagaagcaccaagaaauauacuauuucccauccaagaaagcauguuagaaaggcaaaccuaaaaucauugcuccuccccaucagacuaagcaaugaguggucauaaaaaugcucuaccuaaaauguacgaugucauuuaaauaucaaagugaauggaggauauuucuguagauuaacaauaaaucuuguuucauuuggaaagauuuugaaaaauuuuuuaagaauuuuaaaucaaccuugugaaugcccauuugaagaucuuccucauuaucacagccuucagcucuagcaaaaucuucaacaucuugccauuccuuauugcuucccuuaugaaagcacagucgugugccuaagguuuagguagaaaacacguauuagacacgugacuguacuagacaaguaagcuguggaaaauucaagguuuuuguuuguuuguuuguuuuaccuuucaaaaaacagugccagacaguugaaggccaggaauugcaccaucccaaaucaucaucaucugacagggaggacaugcagaaaaugccagauucugacucacuauuugccuauggagaaaaauauuaucaacuuuuuuauuuguuuuuaaaauauaccuuuuaauaucuguuuucaucccacgucuuuaggcccaugcuuauagguggauaacuuaguaauucuaaccuuagggaaaauauaaugccuucaaaaacugaggguugucaggcugugggagaauuugcuaaaaaaaaaaaaaaaagaaaaaaaaagaaaaaaaagacacacacaaaacaaaguuuuuggaagcuuuaguuauacgcacauucccauuaauaauaagcuuuccuaacacauagcagagcuguauauaaaaucaaauccagaucacuaacagaacagugagacuacuuccuaugaggaauguuaauguacuucaacuguuguacaaacuuuguaaaaguuuaaccucauaaauaaacuuacccuuucgugucuuacugguguuuccuccuuccaauggugaugagggaaggcugguucacucuucgaagaagaggacacugguggagggcgugcauaggaauguaaacuuuugcuaguggcuaugauguguacaggagaugaucuaaaauaaagcaacaguuucaaccauaagcauagguccuuaaaguagaucuuuccuauuaaugaaagaacuucauauuuaaaacgccaauguuauuacauugaacacauuuaugguaaacacuaguaaagacagcaagauuucauuuuauaauuauauuccuuaacuccuuauccaaacccuccucacacauuuuagacaucguuuuuuucagauuugacaauauauuuuaaacuacgacuaugguuucauuuauuuaucccauucauuuuucuaucaauacauauacauguguauauuucguuugugaaugauaauacccccucuaaugcagggcguccuauccauuucuuucuucuacuuugauguacucaguaagucucaguaugaagacagcauuuaagcuuaguguaaccaacucugaacucuuuaucuaccaaccacauaucacugggcagauacaagaacuaccuuaagcaaaaaugcuuacacuuuuuauagcagagagcagccuauccacccuccuuguaacuggacacuauuucuuguuuucuaauacaaacuugcugaaaagcaacuacauauaaggucuaguuauuuuuucuccucaaagaucaccuuaaaaaaaaaacuuuaucccuugcccucuuuucuuccccucaaaagucucuuuuaccagacaaugcucccuuuagaguauauggagcucccaggagcauacccagauccuucccucacaaacagaccagauauucaugggugggguaacagaaagaaacaagccuauagaggaugaugaaugauguguauggacucagcagucuggaaaggaagcagagaggaagacagccagguggaggagggaaaaccaucugaagguaaggucccaaaucaggauaauugucugagaugccaaauagagaucugguccuuaacagaaaaaguuuaugcaugucuguacuaauacucuuuaaaaaggagaggaagggccgggugcaguggcucaugccuguaaucccacccagcacuuugggaggccaaggcaagcggaucacgaggucaggagauggagaccauccuggcuaacacagugaaaccccaucucuacuuaaaauacaaaaaaccagccaggcaugguggugggugccugcagucccagcuacucgggaggcugaggcaggagaauggcgugaacccggaaggcggagcuugcagugagccgagauugcaccacugcacucgagccugggcgacagagcaagacuccgucucaaaaaaacaaaaacaaaaaagagagaaaggacaucuuuccaauuuuucccuuauucccugagaauuuguauuagcccuucaauuucuaccuuauccucauuaacauuuuucauuuuaccuuuccagaaauuacuuuuacauaaggaucuauacuuucauguucacaucacuccuuaaaucgaaaggcccucagauuuccaugcauuguagcauacucuccaauuuuugauuucaaauuauaugcugaauguuucaucuuuugcccaaaaacugcccauccuguuauuacacauuuagauauauaugaaguaucagagaauggccaaacugcuaaauauuccuuuuguucauuccugacucccuaauuuuaaaaagugaguuuuaucaguucuucuguuuaaccauuuaaaacagaaguaacaaaaaguaaaaauaaauaaaaaugaagggaacaaugugauauucuaaaauguauauggccuaaauacucugugaaaauuaacaugcuaaacacguccaaacacuaacagcauugauuucuucaucucucucucuauucagggguaauauaaauuuuuaccuguccucaacuccuuaacuauagacuucagauaucaaagcucaguaacacaguuuaacacucaacaauaagcugcaugagcagacaguguuaggagguaggccagacaacagagcauuacucaaaaugcuggacagaauaauacauccucagggagauacuccuuuccuuaugucuuauguuuuuauuuacacugauuuucuucugaaggguuuacucacuuuccauaaacuguuauuauuaauccuaugacucugcuguaaaaagugaaaaaaaaguaucucuagagaaagaaaaaaaaaauccaauaguuaaaucagguuuuuuuuuaaaaauaaauaaauaaaagaauuuuuagcuuuuugacuauuaagauuacaaugaaaacuaggacuauaaaggaaauaacaacucugaaaggaaguuuucuuuccuguggaaaugaacacggaauuaaacugaaguuaauuaaauucaauuugcucuagucaagaucaauauccugcuaaauguaagaaaagcagcacaacuuaauggguuacaagaaaagugagauuucauaccuaauaaguuuauucuuuagcaaugcauuacacucaagagcacuaacaaaauuuacaguuauuccuacauuaccuaguauaaaacucuggucuaucguuuuccacucacaggugugcaaauaugggcauuucucucccuuauaaacugucauauuuauccauuucuuuucagggauaaauaaugaaguguuuuccacuuaggucucccuaggcauauuagcuggaagcuuccguaauuucauagcacaaccacucauuuucuuaaacucugucuggauauaugaaacagugauuuuuaccaaugggaacccacuuuuguaaguuuaagauuuuaauauuagcaaauuuuagaauuagcaaacaggcaaauaauguaaggccacauaaacuauggaagaaauaaaccuagaccaaaaggaacccaacuaaagguugauaaaauuuaaaauauaaucuugauuacaacucugcuuccuuagagaaauacaauuuucauuucuauauguagaaauguauaguaaaaguauuucauggucuaauuuauuuuaaacauuuacaaauuuuuuuacucuaugguucucuuuaucaccuuuaucuaauucucaaaauaugaaaucaugguagugagugaaauaagucuuugaucauuagauaaggagcuuaauucuaaugacuuaaauucuaauaauuuaaaguauuacuacuuuuaaacuagaaaaauuuuuaaauaaaaccuuuguguaaugauagaauguuucaauaaaaauauaauaaaugcuccuaccuauuguaaaaugagcacugcaucaguggacuuuguggacuggucgcgauauuugccaauucuguuagccaguccaccucauuuucacgguaaguaguuucugguaugucugagguauuuugguuccaagaugaucuuggguauucuugaugugaaacaucugaacucagcugguacaugccagauuggguaggaucacuuugaacugccugaaguucaggaaggucaucugcaaauaagcacacucaaaaucauaaaaaggaaauuacuaauacaaggaacaauauuauaacugcaguuaaaagagaaguccucaauuuuagcuaauuaauuuugagagaggaaaaucauaaauuuaacauucuguucacagacuggaaaaacaugguuugguuuguguuuucugcuucuuauucccccuaguguuuuguaccucaccuaggagugauccauaugccacugagauauuuuuacauuaacaaguuaaugaagaaaaaggcauuuuaugugugcaauauggacuuauuacucacauacuuuaauaaccuguuauacagacuauaaacaauaauuuccauaaugauaauauagaucacauaaauauuuagcuacuacuuacacaacucuguguuaaaguauuucuuuuuacuaauaaauucugaacuuguuaauauuuacugguuauuuaucgguuauuuuuuccuauaagugcauuccuaaaaggcaauucaugauacccuuucagcuccccauaagaugacuggaacuauuacccagcuaccacucaugcacacaccaagcacuauaaggaacaugaauuccaaaauacugaauucuuaaaaaaaauuauauauauauucuuuuaaaaaaucauauauaugucuguauguauguguguauguaguagggaagaaaaagcaucuugaaggcuuaaaaaaaaaaacucuccacgaaacacauaccuacaaacuccacaaaccuauugggucccuuaaauauacaagucaagaaaauuucuagucuccuaaaugucacuauaaaaguauguauaacuccuauucaggcaaauauuccagaauagucuacuaaaaccgaaauguccuaucuuaaaaaaaaaaaaauuuuuuuuugagauagggucuuacucuguugcccaggcuggagugcagugguacaauuauagcucacugcagccuuggaccccugggcucaaaugauccucacgccucugccucucaaguagcuaggacuacaggcauguacccaccaugcccagcuaauuuuuaaagaaaauuuuuguagagaugauaucucacuacguugaccaggcugguccugaacuccucccaccuuguccucccaaagugcugcgauuacuagcgugaaccaucaugccaagccaaacugaaauguuuuaauuagaagcacugacucgggauauccauuuguaaaaacugacuucuuucauggagucaugaaggagccaaggaguucuagaacaucacacuaauuuaaaauaauucuacccuacaauuuucaugcugauauagcuauuuccuuucccucacugccuuugaccaacauuuauuuacugcaaaggguucauuucuguuucugaaguucaggaaauuacuuuuuaaacgaagucauagguggaaggggcauguuauuuauacuccccucggcccuaaguuucugaguuccuccuuaaaccaaaaacugaggaagaucaacuaccugauuaaaauggcacuccuugcucaaaaguaaccaguacucaauaaauacuaggguccagaaaauccuuggcauucaagcagguuaugugucccaagagcuuaagaucucuaaauuuccaaacauuaccauaguacauaaucuccuccauuucaucauuuguaaaauuaagacagcuguaucuucuccccaggguuuuuauaaacaugaaggaaacccccauauauuaaaugggggcaaagccaagcugaaaagcugggcagcaagccaaggugacucauuagcuccauacuccugaacaccagccuugaagcaauacaauucaaaaacacaccucaacaaacuuacacauuucuaaaggucacauaucuccaggaguaguuuagcaauaguaacaaccauaaaugucagauccucaaguuucaaggguccacuguaauuuccacaucauaccagcaaaucugccacgaagaguggcuaagcauauuuuacugagcucucucaaguauauuucaaaaguagcaucuuucgaaaagccacgagugggguccaaucuuuacacacaaaguaaaguaguuuaauuuaacaaucuguaaaugagugucuacaauaaccauaaauagcccaacucauguugguuuuaaguaguauuuuaaaagcaauaaaagaaugcugaaaauuccuaauauacaaauacuucauaucccuuucuagccagucaagguugguggagaagcgggcuaaguagaaaaauuuaucugaaucuuagugagauuucuauauaacuuuuaauuuugcuuaccaagcuccauguguucaucacaggaguuauauccaggugaagauggcaaauucucauuacacugcagcaacuccaaugagucauucauuccugaggcucucuuguccaucaccaacaggaguuucuguacugcauuaggcaucugauuugucuucacuucccacaccauguuauggugcucugacuuaaaauaaaaacgacauuaagaaaugaugucaagccaugcaauuugggcaguacacaaaccuaaaauaaaucagagacaugacaauguuguuuuguuuuuuuuuugagacauagucacacucugucacccagacugcagugcaguggcgugaucucggcucacugcaaacuccaccuccuggguucaagcgauucucccgccucagccaccuaaguaggggggauuacaggcacaugccaccacgccgagcuaauuuuuguauuuuuaguagagaugggguuucgucauguuggccaggcuggucuugaacuccugaccucaagauauccgcccaccugggccucccagagugcugggauuacaggcgugagccaccacgcccggccacaguguuagauuuuaacuuaaucauacacugccauuuauagcucccucaaauccuuuagacccggaugacuccuuaacaucuuggccuacaacugaauacucagcacuaaaucacauuucaaucccaaaagauuaauaucuugaauuauaaaaaaaagucuuuucugcugaggaaaaauggcauuguauauacuuuuauuuaaccuaguaaccguccuuucagaugcaaaaacugagacuaauaggacucuuuuuuucacuuguaccuucaaauucaaaaggaaauuuaaaaacuuuccuuaauaaaaguuaaaaaaaacuggaagaauauucuauuuuguccuuuuuuaaagauucuauuuuaaugucucuauuuacuguguuuuuuauuuuguuucuucauucugaaagugaacuacuucagcacacuuaaaaaaauacauuuucuuuuuuuugagacggagucucgcucugucacccaggcuggagugcaguggcacaaucucggcucacugcaaccucugccuccuggguucaagcgauucuccugccuaacccucccuaguagcugggauuacaggcgcgugccaccacacccagcuaauuuuuuguauuuuuaguaaagacaggguuucaccauguuggccaggcuggucucaaacuccugaucucaggugauccacccgccucggccucccaaagugcugggauuacaggcaugagccaccgcaccuggccaaaaaaaguacauuuucuaaauaacauuucagaguuucuuaaaauggucauauauuacaauucucauaaaaauaaaaauguucuuagguuuucuuaaugaaaauuugggaccuagccauaauaaaagauaccugucauucugaauaggauauuauguauagaaagaugaauaaucaucaugggaaauuuaaacaacuaguaaaucuaccugcaagccuacaaaauuaucacaaggaagagaauauggguuaauaaauuuaaauaauuucucagcaaaauccaacaacuaaauauuauuaugaaaggaaaaugugguugucucuuuuauuucacccuuuggacaacgaucgaauuaguucuuuauuuaacauaagcaacaaugguaagauuuuucugauuucucaggcucuagucuaaauuccauuuuuuaaaaaaguucuagccugaugcaguagcucaugccuauaguuccagcuacuuaggguagacugaagggggacgacaacuucagccuaugcguuggaauccagccugggcaauguagcaagacccccccucuuaaagaaaaaguucuaaugagugaauaugaaauacacaaaaaaauccugacuuuugcaacaacauauuuuuccucaaaauaaagcaauaaaauauauugcuguuaaaagucacugaaagucaagcacccagugcaggcugaucaaaacugcacugaaaaaauguuaaucacuuaauauuuauaagcuuucuaagucaugauguuaauuaccaauaaacaccgaugacacugauaaauuucuuucuacgaagacuuuuucaugaucuuuuugguuuugaaauguauuccugacuagaaaauacaaucacugugaaaaaaaaugggaaaaaaaauuuuuuuggaaaaaaaggaauaugauuacuucuaaccccaccaaccagacuuagauauuuuuacauuuugauguauuacaauccaauuucuucuucauguacacauauacucaaucauguuuuucuucauauuucauauuauaguuugauaccuuuuggccuaauauaaguucauaagcauuuuccuauguuauuuuuucaaagcucuaaaugguuaaauauacaucagaaggauguaccgaaauucacuuauccccucuacuacugaauaugcuauucccaguuucuucacucuucuaaacacugaauuuauauucuuauuuuuuaaaaguauuugcuuacaucugauuauuuuagauugcuagauacagcguucuugacacauagcccaacugcaugcauauugccuuacuguaugucuaauauucuauuuuggaugcuaucugccuauaucccucaaaaauaacccuuagccugggcacugcuuuagagccuugcucaauacugacuauacaauuugcuacuauuaugguguagcaaaaagggcacuggguuagauguaaggaaacggguuuugauuccaacuugaucacuuaccaaauauaugaccuaagugacugaguuucucuucaucuguaaaauagagcuaaugauaccugcccuacucuccucugauaguaguugugaagaugaaaugaaauagugaaaaaaguguaaaaugacgucuuuugaaauuuuuuuauccccagacauagggcaauauuaaacauacuuugggucuguaauguccuaaauagaacagcuacugaaaauacauaauuaacagguggaaaccagauagcuauucaguuucaacagucuccucccuaggagauauuaugacaagucauccagcacaucuccauaaaaaucauguaucaugccauuacuucaagccccuaaaagaugaaauuuggaagaaauuaacgcuucuccaguuuaguacaauguacugaucacaaucagucuuagcauauaguuacagcaaauaugcuaggauauaacaauuucccccacagaacuagcgacuagagaaaauguguaacacaaaucuauuucucaaguaugaaaucacgauuuuaagccuccacucucucccugaaaaaaaaaaaaaaaaaaauggagcaaauuuaauuucaucagugauucucuacucuguggcacacgaaaucauacauaugcuuaaaaaaauguuguccaggccccauccccagaggaucugaucuguuuggugugggguauggcuuugugcacuaguuuuuguuuccaggugcagaauacugagauacacugggcuaaaaaugguugcuaaauuccuacuuauuaaaaaaaucauuuauuuaauaaauacuauguacagggcauuguauuaguugcaaugcuggaucucacuaaugaacaauucaucaugagucugacuuuaguggaaagauauaagcaaaugaccauaguucuacagagcaggacuuggcuaugaauggguuaaaagaaaagaaggggcuagaucagugguucacgccuguaaucccagcacuuugggaagccgaggagggcggaucacgaggucaggaguuccagaccagccugaccaacauggugaaacucagucucuacuaaaaauacaagaauuagccagguaugguggcacgcgccuguaauccaaccuacucagcaaccugaggcaggagaaucgcuugaacccgggagacagagguugcagugagccgagaucgcaccacugcacuacagcuugggcaacagagcgagacuccauuuccgaaaaaaaaaaaugaaaaaagaaaaaaagccgggugcgguggcucacgccuguaaucccagcacuuuggaaggcugaggcgggcagaucacgaggucuggggauagagaccauccuggcuaacauggugaaacccugucucuacuaaaaauacaaaaaauuagccaggcaugguggcgggcgccuguagucccagcuacucgggaggcugaggcaggagaauggcgugaaccugggaggcagagcuugcagugagcugggauugcgccacugcauuccagccugggcgacagagcaagacuccgucucaaaaaaaaaaaaaaaaaagaagagagggaggucucccaaugagagaaacucacaugaguaaacucauauagcuggcaaaguccuagugagaucagaauauagaaucuaguuuuaccacaaaguaggauggccuugugugucaugugaucaugaacacugaggcuauacuacuacuacuacuacuauauggaaagguagucuaggaucagagucuucaauuguaguuuaggaaaacuauuuauuuauuuagagacaagaauaggggcucugaaaucaggcugccugaguuuaaauaccagauuugccacuuacuagcuauguacccuaaauaauuuacuuaaaaucuucaugccuuguuuauaaaauggcaauaaaaguaccuaccucacaggcugcuacaaaaacucagugagaucauguaaaaugcucagaauagagccuaacacaaagcaaaccuucaauguacaguggcuaguguuaugauuagcaauuaucagacaaugaagaaccacugaugauuuuuuuuuuuaaaagaggucugacaugaucagaacuauacuuuaaaacagucucuuugagucuauggacaaaaucauacugaaauacuguaugaguaugcaggaacaccuauaauauuuuaaggaggguauuuuuuuuuuuaaagagagcacucacauucccagucucuaugaaagccacccgucuccagcuuccuuugcaaugguucucagugcagauuccuuauuuauuaacucuuaagagagaaacuagucauacuaugugaguucuuuaaacaccuaauauuaacaguuuagauaggagauuuuaacucuuuccauagaaguauuucuggcaucuuaaguauacagaauauaauuuaaccuauuuugauaacuaaaaauccuuaugaauauccguacuaugcuucacauacagaugugagcugcacagucaaccuuaucugaacugaaaacauuucccauuuuuaccuuuauuaugaaauuuagaagcugcacuacacagguaucucucuucagagcuauccucuguguaugaacagugcuguucuugggguccacagaagcacagcugcagucugucuugucuucccccucccucugcagagcucuuugguuuccucauucuuuccagcuagaacuuuuuucuucccuacagcagguccugcaguuuccaacauucaccaaguauaguacacuaacgucucuuugcaacuucuaucauuucuucagcacuuugucuuaguuaucaaccaccaucccaaaacuccuuaaaugaaguuggaaaaagacauuauuuuaauuucaaaacagagcuaccuauaaauaaccaaaagaaccaaauaaauauuuacugaauauaaguucuauguguucacaccucucauugcucaaggcuaucagaaguuugguccugagaaaacugaaguucugcuacuguaaagcuaccauacaguaagagaagcuacacuucaagacaacagacuucaguuucacucuuacuagcuguguaaccggggacaggucacucacucaaucucagacucacggucggucccucuacuuaccucacagggcuauucugagaauucaauauaugaaaacaaaauucaaaacuacauacaaauggaaauuuucugucucuucugucuauucucaacuauucugaagaaagaaagcaaggucuccaauacaauaaaggaauaccagggaagcccuuacauuucuuacuccccuacauauauuauaccaauuacauacucauuuugauaaacaagcuccucuuucaaauaucuccugguagagcuaacccuauuguucauucaugcuuuuguauacugcuuugguaucagauucaacacagcuugccuuguauuuuaguuaacucugcacaugucaucucuucacgagaucagugauucucaguaucuauuuuccagaaguuguacucugaaaugucauguucaguguuacaaauuuuacuuucuuagaaugccccauugcuuuugguaugcaaacuuccagaagcaaauauccacaaaaucuuaagacaggagagaaagagagaacuagaaaaaccuaagucucaaugaaugaagaaggaaacaguuuuacaaaaugcuuaccuacacagcacuuccauguacuucaucuaauuuuauuuuaaacucagaacaacucugugaauaaaguauuauuauggaugaggaaaacaggacuaugaugacuaaaugggaucauuuucuuuuugaaggcgagagcugagagggaaaaaagacaaaagguauaagccagcauggguuacuuccugcuuucaagugccuauuauucccugaauccuuacuuuuccaucaucaucauggaauccacagcaggaucuucuauaugcucuccccuaauccugaaggauuuccauaaccaguccagacuacacgcucaaauuguuuucaaagaguaggugaagaaaagguaauuugcaauuaauuucuaucucugaaacugagguauuuuaaauggauuacauaauuacaugcuaaaacaagccuccauaacaaaguauauuaaaugcaacuuucuauaccaaaagcaucucugaggcuguaaugcuguucuuuuagaguauuuucaacaaaacuucaaaagauuucacagguauuugucuacaacucuaguuugccaccgggcuacaagaaaagacaaaacaacaacaaaaacccuuaguggauucguuuuggucacuuaccacuuucauggcccugaacaauuaaaucucuaggccuguuuucuuauuuggaccuguuuuuuuuauuuguaaauaagacuaguggccaggcccagucacucaggccugcaaugccagcacuuugggagaccaagacaggaagaucgcuugagccaggaguucaagaccaaccagggcaacauagcaagaucccaucucuaaaaaauuuuuaaaaauaaguaaaaaaaaaugggacuaguaccuaucuaccuaucagaauuguuguagguauaaaagauauuacaucccacagacacugcccaauccacaucuauacaaguucuuaguaauuucaugcucauucaacaugaaauacuauauugaucaagacaauagaaaacccauuaauagcagaagcagucauccacaaacuguuuuaggaguacugucaauucaaauaaguauuuaagaugagucauauaagauaagucacauauuaaaacgacaucaucuaaaaauucuuaugaaacuuguuuuccuaaacuuuggugcuucauaauuucuauuaucauuuucuauggagaaacuagaaacauaauuuucuccauaaugugguucacugaguuuacaaaacuaagaugaaacuagaaagugaaaucaaaacuucauucuauaauuuaucagucgaguaagcacaaacaauauuuugcuuuaaagugguuaaauggcuccucaaaaguauaagauaaacuccuaaacauuuuuacauuaucuauaaaaacuugugggaaaagcuuuuuuuuaaagcuaugaucaauaacuuuuaaaaacucaaccacaauuauggagaaaauuauguuucuaguuucucuauagaaaaugauaguagaaauuaugaagcaccaaaguaaaugcugauaaguauaugaaaaaugugaauguuacugauaucaggcaauuaauaagaauauuagaguaugccauuuuucccugaauuuugugauaugcagguaucuggcagcuuuaauuuuuuuuuaauucauugugauuuauuuuuccauucuaaguaaauacucacuuucauacuuaacagacauaaaauuccuggcauugacucuuuuuuuuuuuuuuuuuuggagaggaagucucguucugaugcccaggcuggaguacaguggccugaucuugucucacugcaaucucugccucccggguucaagcgauucccuugccucagccucccaagcagcugggacuacaggugugcgccaccaugcccagcuaacuguuguauuuuuaauagacaauuucacgacguuggcgaggcuggucuugaaccccugaccucaggugauccacccgccucagccucucaaagcgcugggacaggcgugagacaccgugcugggacaguaguaacuucuaauggauaauguaugcgugggguggaaaggggaguaccaguauuuuuauuucaaacacauauacaaaacaccagcuugcaauucacccugaagaacccucagcacagagcaguuucauaaguccaugccaucgugccauaugccuucuucacuggccacuucgauuagugaggaaagaauccaaagaaguuaaaauauagugggccgggcacgguggcucacaccuguaaucccagcacuuugggaggccgaggcgggcagaucacgaggucaggagauugagaccauccugcucaaaauggugaaaccccguuucuauuaaaaauacaaaaaaauuaguugagagugguggcgcucaccuguagucccagcuacucaggaggcugaggcaagagaaucgcuugaacccagaagguggagguugcagugagccgagaucgcaccccugcacuccagccuggcgacagagcgagacucccucucaaaaaaaaaaaaaaauauauauauauauauauauauauauauuuauacauguauauguuauauauuuuauauauauacauguauauguuauauauuuuauauauauacauguauguuauauauuuuauauauauacauguauauguuauauauuuuauacauauacauauguauauagugaagaaaacaacucuuacagugacaguaucauguuugacgucugagagguaugcccugugaagcacacaggauagcggagacauguaggugggcaauccugggagaagguacccuuuuaacuaggguauguaguuaggaguuugagaaguuaagaaagaggaaggguuuucgagacagaaaagauaaguagguuuacaaaacuaagaugaaacuagaaagugaaaucaaaacuucauucuauaauuuaucaguagagaaagcacaaacaauauuuugcuuuaaagugguuaaacggcuccucaaaaguauaacauaacccaaaaacuuuagggaguggauuuaauucucaauauaauucaaauuuccuugaaauuuugucaacuacugucuaccuugcaagaacugaguuuaaccaaggcaacugaacagaugaccgacucuaccacacucauuugcaagauaaaggaaaauagcaaaaaaaaaccaaaaguacaagacauacauugcagauuuagaucacuguuaaaugaccagaaaaguauuuccaauguuaaaauuauucuaauucucaaaaaguaccuuuaauuucaaaaccacuauuaggagugcuuacggcuauucagagggaaguauuaauaaagcuaaagccuccauccgagcuguuaguaggacuccaucgcuucccaguauguauaacuccuuuucuaagccuccucucguccuggcaucaguggcaccaugagccaaaaacaaaacaaacagaaaacuugaguauuaccucgcugucagugcuccuucuaaaaacgacuguagcugaaaacucccuaagaaugaacucgaguguagagugcacagcggagagugaaacacccuagacagcacgcagcauuuaaagcuacaaaaaccuggcuguccacuucgccugguuuguuuuguuuuguuucaaucggccugcgguggcagcauagguugaaaggcggagacuggaaucgccugccaagccuccucuuugggucacacagagcggugccucccgguucacgccaaguccaucccccacccucuuucgccauucaucgcguuccccucccuuccccccaucaugugaccgcagcccggacuccgggcuuguuuuuccccucggcucagccccagcgcgcaggcgccugggagcccauucauucgaacugcguaacaaugagccccggggcccagcggcuccgcgagcuccucagcucagccagaaucccccucaguccagaaggaggcggcgccucacuggggucccccaccuccggccagccccccaccccuggccaagcuccgacccuccgcccacaaacggggaguugaagucaaacuuuccugggcagccccggcgcugcgucggccccuucccccgcccuggcccgccccaucuccacacccggcccggccacccaccgcgcgaccuggcccggaacuucgcccucccccugccuccucccggcccccgcccgagacccccuagcgccgccgccccgaagcccaggugagcucgcgggagacgcugcuccggugggcucgccgcgggcaccaaucgaacgguuaacugcccccaccccaagggcaacccuccgagaagaaggaacgaggacccgagcccuccagucugcccaaucccccgcgcuccugccccucccuuccccacccccaccucuucccuaacugaaagacaacaaaccugccgcgaagugccggcagcccaggcgcgggccgcuccggccacgacaacaccaccagcagcucucguacccccucuccgaccgacgucggccucccccgcgcggguuacugcucccgcggcagcucuuacuccucaaccgaaacuuuccuacuuaccaaacccgucgccauuaccaagucuuucaagcuucgucuucccccuccccucaacccccuggggguugagccccgcccagcucuuucgcccucuuauuggacugcagaacugccauucgguucuuccccuuucccauugggugguaccgugguccgucucggggggcgggcauguauugacuuuuguguuguguuuacuggagaagauggcaugucaaucacaagaguaagugcuucggauuggacuauugccgagaguccggggacccaagccaaacuuuguccccgaaauggauuguggguucguagucucaagccuugguccuuggcugugggagacug

SEQ ID NO: 17015 - RNA, 4808 nt, Homo sapiens
gcuucaugguguauuagauaaacuucgcucuguuacaacugguaagauucauaacuuuuuuuuuuaauuucugcuugcuauggcauaugauuuguuucuuucuaaagucauagugcuuugggaaaaacccaucaauuucaaaacgguucauuugaacuuuuuuagaaagcacauacuuuuaugaacuuaagagcaguaaauuuaacauaauucaaagauaauuuaagugugggagagggagcagugcacuuuauccgaaggaaauaauuacauauaugugcaaagauuuagccucaaggauauuucaguauuuuauaauugaaaacaauuuaaaaguucagucauaauaaacgaaauuguuguauuaccauguguggaauaauauuuaacuauuaaaaauaauguuguggaagaauaacagaauauacacgcauaagauacauguuuuaaaaaauguguauauaugcucuucccccgaaaaaucaccuuugagauaauuggugauuuuuauuauauuuuuaaaauuuucuacaauaaacauacugcuuuugaauuggugaugaggaaggaaacgacuuaaaguaauaaaaauagauggccgggcacgguggcucacgccuguaaucccagcauuuugggaggccaaggugggcggaucaugggcucaggagauggagaccaucuuggccaaccaacauggugaaucuccgucucuacuaaaaauacaaaaauuagccaggcaucguggcacaugccuguaaucccagcuacuugggaggccggggcaggagaaucgcuugaaccagggauuuggagguugcagggagccgagaacgcgccacugcccuccagccuggcgacagagcgagacuccaucucaaaaauaaauaaauaaauaaaaauaagaaauaaaaauagauuaaaaggacuguauuuuucuuuucagaacccucuagucugaagucuucugauaccaacaucuuugauaguaacgugccuucaaacaagagcaauuucagucggggagaugagaggaggcaugaagcugcagugccaccacuugccauuccuagcgcgagaccugaaaaaagagauuccagaguuucuacaaguucgcaggagucaaaaaccacaaaugucagguaagagucugguguagaccugcugggggcagauggcucuguguaugugacauuuauauuaguuuuuauaucuuucaguuugcuguucucagcaauuuuuagaaacaaugaagugaucgugaguaguuuuuugaauaaaauaauggauaagaucuaaguaugauuaucuuuuaucacaaauuuaguaaaucaaaguugaaagaaagugcaauuucaaagcaguuuugaauggaauauguaaagggaguauccucaguuuuuucauugaaauuuuucaaguaaacauucuuuaaagauuuggugauaauugcccuaauuuggcuguaauacauuuuguuguucuuuuaaauagacagacuuacgaugauggagcugcaacccgacuaaugucaacagugaaaccuuugagggagccagcacccucugaagaugugauugauauuaagccagaaccagaugaucucauugacgaagaccucaacuuugugcaggagaaucccuuaucucagaaaaaaccuacagugacacuuacauaugguucuucucgcccuucuauugaaauuuaucgaccaccugcaaguagaaaugcagauagugguguucauuuaaacagguugcaauuucaacagcagcagaauaguauucaugcugccaagcagcuugauaugcagaguaguuggguauaugaaacaggacguuugugugaaccagaggugcuuaacagcuuagaagaaacguauaguccguucuuuagaaacaacucggagaaaaugaguauggagguuuguauguacuuuuaaauucuggcuuaggcuaaaaaucggcaguucuugauaccaaauaauauaugaaguaacuaaacacauauuccaaggcugggcacaguggcucacaccuguaaucccaggacuuugggaggccgaggcggguggaucacgaggucaggagauugagaccauccuggcuaacacggugaaaccccgucucuacuaaaaauacaaaaaauuagccaggcaugguggcaggcgccuguagucccagcuacucgggaggcugaggcaggagaauggcgugaaccugggaggcggagcuugcacugagccaagaucgugccacugcacuccagccugggcaacagagcgagacuccgucucaaccaaaaaagaaaaaacaaaaaacaaaaaaaacacauauuccaaauuuauuuuauuuuauuuuacuuuuugagaaggaguuucacucuuguugcccaggcuggagugugauggcgcgaucucaacucacugcaaccuccaccuccuggguucaagcgauucuccugcuucagccucccgaguagcugguauuacccgccaccaugccuggcuaauuuuuuguauuuuuagcaaagacaggguuucaccguguuggccaggcuggucuugaaauccuggcccugugauccacccaccuugaucuuggcucacugcaaccugugcuucccagguucaagugauucuucugauucagccuccugaauagcugggauuacagguguguacuaccacgaccagcuaauuuuuguauuuuuaguagagaugguguuucaccauguuggaccaggcuggucuugaacuccugaccucaggugaucugcccuccuuggccucccaaaguguugggauuacaggcauguaccauggcgccuggccccaaguuuauuuuuaaauuguuuuaucugcuguuucucaugcuauaccagauuuucuuccccauggcuugcuccuagaguucuuuuguaucacaucuguauaccuuuuugggauuuccagcauuugagauauuaaucuuaaauuaauuugggggguuucaaucaauuuuagauuguucaugguaauugcuagugagcaaccaauuaacucuguuuuauuaguuuccucaauagcacuauaugcagcuguugauaaaauaaauguaaaguucuaauuuuuguuuuagcuaaagguugacuguuagggauaauauuuauauuuauaguauuuauuuauuuauuuauuuugauacggugucucacucugucgcccaggcuggagugcaguggcaugaucuuggcucccuacauccuccaccucccggguucaagugagucuucugccucagccucccgaguagcucggacuacaggcacaugccgccacgcucagcuaauuuuuguauuuuuauagagacaggguuucaccauauuggccaggcuggucucgaaauccugaccuugugauccgcccacuucggccuuccaaagugcuaggauuacagaugugagccaccacacccagccucauauuuauauuuuuacauaaaaccaagaaauacucugugaauuucucauauuacuguguacuguuuuuuucuuaaaauggaaacauuuugugguagaacucuuguuauuuucugagauuagguaagcauaaauuuuaucugauugcaggaugaaaacuuucggaagagaaaguugccugugguaaguucaguuguuaaaguaaaaaaauucaaucaugauggagaagaggaggaagaagaugaugauuacgggucucgaacaggaagcaucuccagcagugugucugugccugcaaagccugaaaggagguaccuugaacauggcuguaaauuaaucuuuaacugccuugguggagucuuccugauuuauugaagagaauaaucacgaaaauaauuuuuguuuguuuuuugagacggagucucgcucugucaaccaggcuggagugcagugccacgaucucggcucacugcaaccucugccucccagguucaagugauucuccugauugagccuccugaauagcugggauuauaggugugcacuaccaugaccagcuaauuuuuguauuuuuaguagagaugguguuucaccauguuggaccaggcuggucucgaacuccugaccucaggugaucugcccuccucagcuucccaaaguguugggauuacaggcaugagccaccgcaccugacauaaauauuuaauguaauaccguguaagacuuuuccauuggguuuugagaaacacguuaaugagagaaauugcuuaacauuggagaggauugcagagaauauugacuaauaugguggggugaggaggaacaacaucaauuaagauucagauuuauuauuuaaaaaaacuaaaaggggccuaggcaugguggcucaugccuguaccuagcacuuugggaggcugaggcaggaggauugcuugagaccaggaguucgagaccagccugggcgauguaaugagucuuugucucuuaaaaaaaauuaaaauaaauuaguuggucauuguggcaggcaccuguaguccuggacuggagagguggauguggaagcauugcuugagccuagaaguuuaaggcugcagugacaucacacuccauccugggugagagaguaagagucugucuaaaaaaaaaaauaagguuccaguguaguuggcauuuucuaaaaacugcagcuagucuguuuaaaaccuagagaagguugugguaaaggcauaauagauggcuggccugugaggaacugaaauuuaaaguuuaauaaaaauaccuuucuuaacucuuuuagaccuucucuuccaccuucuaaacaagcuaacaagaaucugauuuugaaggcu

SEQ ID NO: 17016 - RNA, 37405 nt, Homo sapiens
aagcggagucgcugcaucagaugaaaggggccccucagccucacuccucaccgcagcuccugggaucuuaaagacagggucaggaggaucaggagggacaagagggauggaggcgaaaggcuggauccuuaauccaggccggagacaaaggugaguaacugcgcgugguggacgggaagaugggcaguaggaggcuccucgcccccuagccggguggcgugacuucaggaggacccagaaaaccggccaggacuggguaggacggaaggucccaggcggggcgggcgaaccggcuccucguggcacuggcaaagcugggaacgcccccuccaggccccgcccucccgcgcccgugccgggaacucgaacuuagguaagcgcccgggucacgcgccggggcugccccgcugccuccagcuucccagagcuggcgucugggaggaagagcgcgugcaucacguccuccuccccgccccgccuccgcgcacugcgcagcgcgcugccgcgccccgcccuuucucggcccccggagggugacggggugaaggcgggggaaccgagguggggaguccgccagagcucccagacugcgagcacgcgagccgccgcagccgucacccgcgccgcgucacggcucccgggcccgcccuccucugaccccuccccucucuccguuucccccucucccccuccuccgccgaccgagcagugacuuaagcaacggagcgcggugaagcucauuuuucuccuuccucgcagccgcgccagggagcucgcggcgcgcggccccuguccuccggcccgagaugaauccugcggcagaagccgaguucaacauccuccuggccaccgacuccuacaagguaaagcucggggcccgggcagaugaggaggagcggggcgcgcuggggacgagcgcgcggcaggggggcgggggcggcuggggcugggguuggggcuggggcuggggcuagggucgcggcgcggggaggcccgggggaggcgcgggcggcggcggcuggggcaggugaggaggcgccgcagugggcaggagguggcuugaggaggauggagggcugggcgguggaggcggggccugggggcgcgcggcggcggcggcgcggcggggggcugaggcgggccccagcggacucccgggcgccggugcucggggcucggggcucggggcuugggcgucgccggcgagcgcaugcccuucccugaagcgcggccucuuggccuggagcugggaccaguuagguaacggccccggggacccgcaguggagagugagcggggcuuucccccgggccagcccggcgcgcucgccccuggcugggcagguaagucucccggggcgcgaggugggagaaguccuggcgcgggcgccggagcagccgcgguccucugcggcuccggcgcggaggacacucgccuggccccgguagccguaguggauuccccugucccacuccgccgggcuccguuucaaacuccuuggcaccuagugauugcucgugcuccuuaucccuggguguagaggccgcucugcucuuaucugcuuuagggucauuacaggauuucugugaaaaggaaaaugaaacacgaggauuuaaaggaacuguaguuuuaacccuagagaacauguggagagggaaauggcacagcguugcguucacaugcccauugaacacuuguguggguagcugccacauucaguugauaugaagcacgcaguagugaagggaagagguaaaguaaauuuuacuugagcagcauagugguuuggaauacagugguaaaacauaguacucucauguuuuuguuuugauucuuuuuuuuuccuuuguuuuuagcccuccuccgauauuccgagaaaguauuuuagagaauuccauuuuacuuaaguuuugucuguuuuuuuccaaucagcuuaaaaugcuguuuaugauauuuagauagguucuugaaaucgagccaagauccaucaacaaguugucuuuuagaugcaaguuuaaaguauugcaaaauccgaacacuaucaaguaugauucuugaauauugucaaguauacgugauaauaccucaaguaugguccuuuacuugguccuaaaaccuccucuuguguucucuugguucaaucauaguguuuucaaaauuuuaaauagugauuuuagaauagccucauugauaguuuuguagaauuuuuuucuuaacuaaaucuaaaauaacugucagauuuuuuuuuuacauguuagccaaauguaaagggagguugaauagucuaaauuuuaaaaacagaagaaugcaacuuccuuuaguuugcaguuccucuaaccauuauacauaaggaauguaaaauuacuuuaacaucaguuuucuggggugcuuuuaguuagaauagugaauuaucuuaaagguuucuaaucuagugagccauacuuaauugcacuauuagaauuugcaccuauuuaauaaauuuuacuucugucaacuuucaagucagacugguguguuuuauauccuuuauaauaugaaacuucagaauauuuucaucuuagauuuuucauuuuuuccccaaaagucaccucuagaggguucaaucaagucgauauguuuuauaccaguggcuuaccgcaguaugcuaaaauagauuguguauuccacagucacauuuaagucuuagguuucauuucccuuauguuuuuagggguccuuauaaccuauuuuacauuuuugucuuuuuaucuuaggaaaaaggacaaaaaugauaaucuugagguuagaaguaaugaaacuuauuuagaaauuacacgagaauguuacauauccuuaucagugcuuacaaacuauuggccaaaguugggaacucuaguaguuucagauguguugaugaagagagcaaaauauuguugauuucuucuuucuaaaacugaagaaagaauaauugauugccuaagcacuacgaaaguuauuuugcaaguagaugguaugguagcaagcacaugacaaugggaguuuuguuuugucuuguauccugucaagagaguccagaacuauuuggaccaaaggagcauuugaaguauauacauucacuucuguaaacucauacuuuauuguauauaguaaggaauuaaggacacugacgacugugguuccucuauuuucaucgugguucuuguuagaaguaaggacaccguuuaaaccgcauuauccauuaguuaugaaaugugcuguccgguguagguugcuucucaaagggucaucuguaagcugguuaucuagaauucagcauauuuuuaaccauucauuuaauaaauguuggugaccuauuggguauuauaaaagaagacaaagauaaguaguauuuugaaauccaggagggacagaaguugauuuuauagaaguuucaaagagcugugaaauuuauauauggugauuaggaauucaaggcagcuuuuuuucaaaaaaaaagaaaauuuugcuuccucuaauggccaaguaacaaauuuuuguugcuugucuuucacugcuucugagcggaugcuucgguauugucacgguggcuccugagucaaccugagccucaugagugggguacuguugcagcuuguaccccagagacugccuaugcauucauaaagauauaugugacauuguacauauauuucaauuuuuccauuauguuuuguuauauaggaaaaacuugagcaccauaaauaaaauauauaaaucaugaauauacuucauagggagauuaauuuaggucauuaauaauugagcugguguucucguugugaguuaaugaaaucugguuuaaagguguggcaaaagagauacaagucauuagaaacuccaugcaagagguuuuaagggaagaggcaauaugauuauaggugauuuugcaauuucucuccuuccccaaauaacccaaaauccuuaagucauguuuaugagugaguauugcuucaaagccaaauagcagugaauuauuuuugggggcaacagacagauuuccaggguuuaagaaaucuuaaauaauacugaaaagaagaaucgguuaugguuuuugcuguuucuagcacauuagcuuugaagcagcagaaagucuuagccaguguugggcagaguguauccucuucugauugcccuuagauauuauauagcuaacauaacuugcccugugaccuuggguauguuaucccaugugaucuuacauauacagcuuauuuuuuaaauguugacuugugauuuuuuagcaguuaaaaaguauaacugaaaaaguaagauaguaguacuugcauuuggucaugugaucccauugugggaggaaagaucuucaaaucaacccuaagacaucaaaucagcccuaugggacaucuagagaagcaucuagagaaaacuaggcuuucuuuucccaaaaggauucuguucaacugaaauauaugugucauaucucauacuuuuuuaaaaaaacugucauacuuggaacaaggauauuuagccuugggaaucuaauuuuuuguuacaguugguuggccagcacuccuuaauggaaacagcuguccaucauuugacuuagggcuagaccguuuuuguucuaggcauuaaaauaauaccaguuacuguuaucuaguauguaauaauuuuuagaaguuuauccuuucaugaaguaaauuaaucacacaacugaagaguuauguuaaaagaacuacauuuuucuguuugugcuuauguuuguuuuuuuuuugagacggaguguugcucuguugcccaggcuggagugcaguggcacgaucucagcucacggcaaccuccaccucccagguucaagcgauucucuugccucagucuccugaguagcugggacuacaggcgcgugccaccacgcccggcuaguuuuuuguauuuuuaguagagacgggguuucaccauguuagccaggauggucuccaucucccgaccucgugauccacccgucuuggccucccaaagugcugggauuacaggcaugagccaccgugcccggccaguucuuuaccacauauguauugauguucagaugguguucuuuuaacagcaggagggccaugccaguuuaggaagcauuuucacugggaagguuugcugggaucuuauuagguauuuuguuugguuuacaucuacggaauaauuuuguauuuauuguagaaccauuuucuuuaguaauagaagucaagucagugcuaaaaaaguuaacaugauuuaagagcuuucuguguuaacuuuagaauacuaugaaacuuuuuguuagcguuacuuaacauuuaaaauugagcacuucauuucccuaccauuugauagccuuccccaucucuauaaauggcacucuuauuaaugcaguugcucaaccaaaaaugugggagguauuaauucuucucccucauuaucaucuuccacauccaauuuaucggcguaguuccccuuuaccuccaaaaacacugggcaaauucucccaucuaaccuaauagccccuaacuccugcacucuuuggucacccuauaauccauucuuauccaccacuaggcuaauccuuuuaaaaggugaaucaugucauauucaccccagcuuaaaacauaauggcuucccauugcacuugguauaaaauccaggcuccuugggguagucuguaagccuuacaugaucucauuucugccuaccucugaccuuaucguguucuuacuguccccaccccgcccccauacuuuuaaguaccuaccacauuggccugccuucuguucugucccuuaugccaaagcauuuccugucuccuugucauuuaggucuugcucacaugucaccuucucaaagaagucuuccuggcccccucuagcccaucauucucuuacauuuucauagcaucuaucuugaucugaaauuaauauauuuuuuuucuuccuucuucagcccuuauuaguccuuugaaaauagagaccaugucauucuauuuacuuucucauccucagugucugaaguagguacagaguauguauuugugaaugaaguauuuauaaaauaacaguugauuugaauuuaugcuauaucauccaauuuucuggugaagguucaaaauggccuguuuaguagaaaguaaaaugaagaggacaguaagcuagcaaaacuagaaucauuauaaauccuuuugacuacauuguuagaaauacuuucuuaaaaagcucugcuuuaaaaacauuuucccauuaaacaacauguacauauaccccuauaaguagaccuaaacaugcucuguauucuucuguaaacuuguuggguguuaguagauaguuaauaaaugguguuucuuggcuaauuaccugcgaguuugccuagauaacuuagaugcguuagcuauauucuaaaacgauacucuuaagguucuccaaagauuuuuagaguucauacuucguuucuaauuaagcaguucagacauuuuuguauuuuaaaugguauuuguuuucagagaaggcauucuaaguaaagguagguuuuuaaaguacuauaauuagagaacauagcugaagcuuuaaaauuauaaauauuuaauuauuguccagaacuggagcuguauuuguacaaagaacauuuucaguauacuuuuagaccaagauacagaguuaaauagcuuagagacauuuccauuuugcuuuugacucuucgucuucucagaaaaagaaaauaacuugccuucuaguaauuuuaaaucugauaaagaaugcaucauuaaguaccugaacaguaagggucaaacuguggagaaauaaaacuaugaaucagacuuacaaacuugugcuauaagauccacaccauuuuucaaguuuuacuucaucgugugugcuuuucuucuaucucacuacuuagucccacuaaagaaguuggaguuauuuacauuguaaacuggacauuuucauuuuuacauacaucuuggguguguuuuuagguagaggugucuuuuucuucaguuucauaaguaguugagguaguggucauauuuauuacuacagacucauucauaaauauauuuguuuuugcauuuuagugaauugacauaaauuucauugcugcagauucuguauuagcuaucuugcuuagcuacuucuuaaauuuuauuaaagugggaucagucccuggauucuaaccuuaauaagcccugacauauacuucuagcuuuugaugagucuucccuguaccuuuuaguauaucacuaucuguuguacuuaaggaaaacagcuccaagucuccugcuugacuuaaacucucagaucacuuguuacuauaaagauuuaccuccaagguugucugugugcugcauuaggggcuauuuuuauagaguugcaaguaugcuaccauuggcaaggaaacagcacauucauucagaaucaucaauggaaauauauucaucuuaggauucuuguacuaagcuaugaagauucuugaggauagagccaaguuuuacugagauugagacuguguacccaaagacagcauuggcuuuccugaacuugagaucaaagcuaaacaggaaaaaugauuuauguucacagugaucacucaugaaaaauggucugcaaagauuuauuccgccauugccaugauucacccuguaucuuaaaccucaaggcacuguuauuccuacucuugaaauugggcagauacacauuauucuuccacuuuauuuuuuauugguaaaauguuugaauuuauuuccauguuuuaaccauauuaaaaguauaaugaacacucacuuuuuacuuuuucuuucuuaaaagcagauaaauuuuuuacaugguggcucuuacccaaguucauggaaaagaaauuugugcuaaggaagaccucuucguauuuuaaacucauaaggauuugauguuuaagaauuuauuuuccaguuaggugggugauuugacaaagggagauuacaaaacaggauuuuuuuuuacuuugcugcuuuacuuugcugccaccgccguugcugucauccagguuuucauagugucacugugaaggcuaaaagugaucauccucaguaccucauuguacaaguaaaguagucauguuaagucauugacuuuuggaacauaccacauugagauauuagcaguaccaaauucugcugucuuucaguucauuccuuucuguugugugugcccauuaggcagcugcuucucucucucuucgccuggaugaaggacuguuccccaaaaccaaaugaaauacuuuuccaaccuagaggccuuguaguagauuuagugugcuuguauguaaaauuuaacgcucuccugugguuuuaagauacugaacucugaaaauaucuuagauacuuauuuuuuauuugguauagccaggaaaagaaacugguuaauagcaaacaagaaauauaguuucucugguuuugaaauaacuucaagccuuuucuguugugauuuauagucuacucaucgguguuuucuaacagaaguguauuucuuuacauagguuacucacuauaaacaauauccacccaacacaagcaaaguuuauuccuacuuugaaugccgugaaaagaagacagaaaacuccaaauuaaggaaggugaaauaugaggaaacaguauuuuauggguugcaguacauucuuaauaaguacuuaaaagguauuacuuuuccuaguauauuuuaaacacugcuuauuacucuuaacuccuuuaggaguucuuuuagaauuuuuaacaaaucuguuaauuuggaugcauuaaaucauauaauuugguguguguuugauguucuaaguaugagaaaaguuuucugaaauaaaagguuuuuuuuuuuuuuuggaaaccgaguuucgcucuuguuggccaggcuggagugcaauggcaugaucucaacucagcgcaaccuccgccuccugguuucaggcaauucuccugccucugccucccgaguagaugggauuacaggcaugcaccaccacacccaacuaauuuuguguuuuuagugaagacgggcuuucuccauguuggucaggcuggucuugaacucucgaccucaggugauccaccugucucggcccaccaaagugcugugauuacaggcgugagccaccacuccuggccgaacuaaaaguuuugaaauaaguuuagaaaagucauuaauuuuuggaggcuaaucuuguuuguuauacuuuagucauuaauucaaaguaaaggaguuguuaaugaacuggaaacuccuuuugaauuaugguagcaaucagaauauuuuuauauuagccaguuuuaccuugaagaccuauuuuuaaaaacuaccugugucucuggacuuaguugcaaaugcauauuaaaacaaaaaucccccaauuucugugcuuucuuauuugaaaggccauuucuagggggaaaacaguucccaaacacauuauacauguuggaaaaguuuaucucuaaccuuuugaauuaaacaauuucagaauugaaaacaguaaggugaauuuuaggccaauaacucuuuucuauaaucuugacucuuuuaagauuaggcaguucagauagucuuauacuacugaaaaccuagcuagauaucagaaguaauuauuaguggcaagaauaccaaaguuaauaccaaaguuuuuuuguuuuguuuuguuuuuagacagggucucacucagucacccaggcuggagugcaguggugcaaucuuggcucacugcaaccucugccucccaggcuccagagauccuuccugcucagccucucaaguaacugggaccacaggcucgcaccaccaugccuggcuacuuuuuuauagugacagggucucaccauguugaccaggcuggucucaaacuuuugagcucucaagcgacccgcccgccuuggccucccaaaaugcugggauuacagacaugagccaccacgccuggccccaagauacuuuaaacgaguuuacuaguuaucuuguauuaaguuaccagcaacugauagcacacuuuaauuuagucauacaacuuaagaacuuuguaaaauauuacucauuuuuaauuauaacuaaaauguauugauuaccuauucuaggccagcauuauuguaagugguucguaugucuuaacucauuuuguccucacaaacaucauauaaguggguacucgacuuuuauccucauuuacggauaagaaaaguuaauuaaaaguguguuguuuggggggcagacauuuaguaauuguggaaauuacugacuuaccaacccuaaagaugccacauucuuuacgaacgaagugagacguuucauuuggauguaagaagcuuuugagucaucucaaaguugaaaaguaccaaaauuaaucgagagaaaaaaauuaaguuaauaucauuuuuaaaagcugugcaaguaauaauuuuuucuauuacacaucugcuuuuacaauaaauaaacauuuauacuuugaguuauuaaaaguacaaauuccuuuucugacucugcuguugacucugggugagcauuuaaccucuuaguuauauuuuuaauccauagaaugggugaaauagccaaagauauuaagucugugacaguucagcaacucacagaaugcaccuuuagaaauguaaacaggacauguauauucuucuagguaaaguaguaaccaaagagaaaauccaggaagccaaagaugucuacaaagaacauuuccaagaugaugucuuuaaugaaaagggauggaacuacauucuugagguaaaagaugguuucaucuuuugaucuguuuugguuuuucuuucaguucaaaacuucuugcaaaggaauuuguuuuuguuuuguguuuuuugagagaaagugucacucugucacccaggcuggagugcaguggcacaaucucggcucacugcaaccucugcuuccuagguucaagcuauucuccugccuuagccuccuuaguagcugggacuacaggcacgcaccaccacaccuggcuaauuuuuguauuuuuaguagagaugggguuuuacuguguuggccaggcuggucucaaacuccugacuucaagugaucugcccaccuuggccucccaaagugcugggauuacaggugugagccaccauccccggccagaauuugaauaagagauuagaguaucauuacaguucuuuuuuguuugugaucugaauauaauggcuauuucauagccauuauauauccuuuugaaaaguuauauuauagccaauauauccuuuugaaaaguuaagguugacauuuuaucccucuccccgcaucccccauguuaaaucauuagcauauagaaucuacagcaagucuaaguaauuaauaaaaaugaauuauaacuuaaauaacauuuuugagaaagauaauucauucuugaaaauacacuauagguaggaaagggcaugguuauuuggcaauuucaaaauguaggucuguuuucuugacugaaaauagaugcugugagucuaucacuacacauaauucugggaaguuucucacuguauagugagaauggcuuggugcugauccacaaaguugauuuuuagucuugauuguauuauauuuauaucuaguauguuugaauucauugccuaaauauuaaggcacucaaagacaugguaauagaauuauaagaguuaaauaucccguggugguuuccuuuuauuacaaugaucaguugggaauggaaucuguuggcguaucuugauguugaguguuacuuuuaagucucacaaacgaaaguuucuuacauugaaaagacugucaaacacagaauaauuagaaauacuuuaacuuucaugccuauaugacaauacugagcuauacuauuugguacuuaugggucuugaaaaagucagguaaguacucugugcugcacuuuuccuguaucuuaaauaaggucaauagaaucugugagcuaucaccuguacuugcuccauuucucuucugugagguuuguuguaaggauaaauacaguaauaaguuagguacuaugcuuauuacuauacuguccaguggccagggcaauaagucguuugauuauaugaucagaaaaucuuggggaacuaaagguucucuagagauaaucuggucuaaccccauuuuacaaacagaaucugagaccgagagauggcaagugacuaguccagggucuccccgcugcuuuugaguccaaacuaggaccuguagggcaauguucuuuuugcuauacacugugccuccagugcuuguauuaaacagauuuuucuuguauuuaauuaccuugucccaaaucacauaaauaaauuaucaggauuucugaaacagcuugccuuccuagugaaaaguuaggcacagcucuuagcuuuaaaagggagguacagugucacauaacaaauaaccuucagccuaauuuuggaggcaauuauuacauuaagaggaagucaguuaagucauacucgaguguuaauugccaagauucuguguuuggccugucucauaguuucagguccacgaccagaauagagggaaccuauuucgguucuucugcagggauuucccuagcucuccuucucucucguuuuguuuucuuuuguucuuuaauagcaauccuuuaucuuucaaucugcagccuuuauuuugugaaaauaacgaauuuagaauaaagguaguguucuuggaauacuuuuagaauauguuggaauaaagucauccuuucucauuuucugaaaaagcagggaagaagcaacaguuugguuuugaugaguuuggaauuuucugccacuuguagugauaaauguucuuagcagaagcacguggcagcauuaaacuuaaaaauuaauaucaguacguauguuaauaauuuuaacuaguuuuauuuuagaaggauaaggauauucugacuagauuacaguaacaucuacaauugcaauuucuaugacaguaaauuuagcuucuauaaaacguaaagaaccuuuaguaaaacagcagggaauugaguaucaucuguugaauaaauaaauuuaucauuuuauccugccagaaguaugaugggcaucuuccaauagaaauaaaagcuguuccugagggcuuugucauucccagaggaaauguucucuucacgguggaaaacacagauccagaguguuacuggcuuacaaauuggauugagguaaauuguuuuuuuaauucuuauuuaacauuaauugaauaaagaccauugaacugagauuacaguuuagaauuuguuacuaauaaagcuauauaaucuccuauaauuuacuuaaccuuuccaggcuucaauuuccucaucuauaaaaugacagacuaaauaaucuuuaagguuucuucuaguagaauagaauguucugagauuuuguuuaaaucaaauuauugagagugauuguuuuuaaaaccuaguuggcuuucaucuaauucauugccauuuuaaguguguauuauuuuagagcaaacuuagaaaaacagcacauuucuaguaacuuacgacauucgaugaaugauaaauguucaaguuagacuaaaggaacuuuauuccaacuucuaguaacuacuuucuucauuuuucucucaucaguuuaggucuuaggaucuaccaucuguuacuuuucaguuucucaucuaaauaaaacaagaucugcuguucauauuguuuaauuucucaggaaggguacauuuugggcuuuggguuuauacugcgagccuuuuuuuuguuuuucuuguauguauaccuaaguagucauauguuuucacauggucagaguuuugauaauaauacucuaccuagcuucugaacaguuuaauaauagauuuaauccgugagaggaaauacccucgaaaguuacuauagaaauaacaccuuacuaucugguggcauuuacuuaguucuuagaacugacuaauuaguuuaucgguuaaaguaauuugcuauuauauuguaaaauaguacauuugaggcucacuuauaaaaauuggaaaacaucgaaauauaagagguccaagaggguguuugaaacacauuuugcuaaguugacaggaaauuaauagacuuuuuaugggccauuaacuaauaauacacucaaaaaaaagguacaguuaaauaaagguuuuaaauagucuauaccguauacuaaaacuaaauuaauauuuaggacugaaauaacauauugauuaaguaccagcuauguacccaaaaaaugcugggcacagaaguuagaguaagauguuuuacuuaaagggccuuugagugagaguuggcaauucauucugaacuaaccacuaauaucauuaagaauuagugcugaguugguagcaggaaauagguaauucugucuaaaggaaucaugaaauggaaaauaaauaagcuuuuaauaaggagaaggaagagcugaagaaauggcacaguguucuuagaaugacagauaguccuauggggacugcagcauaaaagugaaaaauguauaagauaaaccuuuagaugguaagcaaggcaagauucucaaauucuguaugaaucagcuccaccuccgccccauggacaguagaugaccguuaauggcuuuuaaggaaagaugcaaccuggaaaaaaagaaaaaaaacuuguuuuagaaugguaaccacuggcaauaugaagaauaauuagacuaaagaagagagguaggauaaucaugggcauuggcaguggaauugaaagaguaauuucagaagcagaauggucagauguuggaggugauugguuauagaguuuaagaauuguacugauuuucuauuguguaacaaacuaccccaaaacuuaauggcuuaaagcaacuauuauuucuccugauucugugguugacuggauggucgucugcugcucuugcuuagacuuaggcaucugcauuuagcugaggguucagccagggcuggacauccuuuaauggccucauucccaugucuggggccucaggucagauagcugggacuaccgggucucacuccagaagagguuucuucagagcaugguagucuugggguucuaagagaaugagaguagaagcugcaaaaccucuugaaacuggggcuugggagucacacaugacuuucuccacauucuguucgucaaaagcgaaucauaaggacagcacagacucaagggauaagaaaggagauuccaucucuugaugagaagagcugcaaaggccauauuuaaucagucacaggagucuaaugcuacaaaguaguuuuuuaaaaagaugacuagauuggcaaguucaagguuaaucuuuuuauuuguuuuauuuauauaucacuuagcugguauucaguaaaagcuugcuuuguaaaauuuaguuaauaucuuuuugguucagcacagacauugcaucaucuuagcagcucuuuuucaaacagauuugaagcugcuucaaauaacaaucugguuuauaaaaugaaaauagaaaauuaugaucuuagaaugaagaagugaauuucuaagccaugauaauuauuacgguugcugugauuagacagacuuuucuguggagcuuccugacaaccaagaaaaaaggggaaaucaaggaacuguucuuaucagaaaguaggaacccagcaauucuuucauuuucucauugggaacuuaauagucacugaauuacaaaguagacagugaccuugauuauacaacauaugcggaaguguuuccuguaacuuacgugaguauuuuaucaaauacuuauauauuugauaaaagcuaaguacauaaagcauaacucaguagauagaauucucuaguaguaagcuaaagugcuucaaguauuaguugucauauuaauccaagagaaaauuagaucugagacuaccucgaggaguaaacgaacaacuucuuuaaaccaauacuagucaaaaugcaguccacggaccaaugcugguucaugcccuauuugauccaaguccacauuaaguacagaaaugaagaguaagcauuuagaaacuuggggcaauuugacauugccucaacauccaaguuucaguguccuuuauaaacuauugauccaugacagaucaugaaacuuucuaaaaauugauccuuuuaucacauagucuuucaaaauauuauuugcuucuuugaagcuuuggauagaaacuugauaaugugaaguucucugcuauguggaccuggugugcuuaucuucuuuguugcugauuugagagcugagcuauguacuauaucuggaaugcacacagcaggcauccugcugcgcaguucugugucuaguuaauaguauggaaguucaggacauaccuccaaaaaaaaaaaaaagcuaggauuuuccucagaaagaaugcaguauuuuaugucuuaauauuugugguuaauuuuguuacuacagacuauucuuguucaguccugguauccaaucacaguggccacaaauucuagagagcagaagaaaauauuggccaaauauuuguuagaaacuucugguaacuuagauggucuggaauacaaguuacaugauuuuggcuacagaggagucucuucccaagagguaaguaacugaaaccaaccucauuuaauauaauguggauuguugguuagaguaccacuguaaacuuuuggggacguuauugagauugaucuugguucuaaaauuccaaagauucaaccaacagauacauauucaguaccuacuacuguguucaggguacaugggauauguccuucaacagaugucccuguccuuuauauauuagauggauggacagauggauagccagaaacagacauaauauaucagaugugaaauaaugccauaaagaagcucaaggcaggguaagggaagagagagugaugaaaagugggggugggacacuguuaaauaggucucuuugaggagauaauaguugauuuuuuaaaauauuuaggaaaaacugaaucuuugucauuaggaacuguuaugucugacaauaaauacuuuccuaagagaaagacaauucuuaugggagcuaugcuauauuccuuaaaugugguuggcugcauccugguauuauuaauguggguuucuuucuguuuuggauuuugguuuaugauugauuuuccagacugcuggcauaggagcaucugcucacuugguuaacuucaaaggaacagauacaguagcaggacuugcucuaauuaaaaaauauuauggaacgaaagauccuguuccaggcuauucuguuccagcagcagaacacagguaaaaaauucuguucauuuuuuaaaacuacuaauuuuuucacucuuguauuuguaacucagugacauuuuaccuaacugcagagccagguaccuacaguacaucuucaugaacuugagcaacacaaauucaguauuuauacaaaaguauaaacauuagucuuagagaggcagagaaauuuuauccaugcuagaagaaacaguuuaagagcuuuuuuccaauacuuauauugccauagaaguuuucuuuuaaggaauuuuuuuucaauuacuguauugucauauguagguagauuuuauucauuaaauuuagaagcacucacuguaaguaccagccacuuuuugccuuuucccuguccuccuacaugaccuuaucuauauuugcccuagaaauugucaucuguacuguaccuucaguuguagaugagaaagcaggaccuguugaggaaagaaaggguguucagauucuuuuuacgcuuccuugucugcuuucaguaaacuaucuccaguuacccaagaaagaaauuacaaucuaaacugcagcugcucugguccuagagcuaacuuuauuaaaaguaaaucagguuguuuuuuuuuuuuuuuuuuuuuuuuuuuuuuuuuuuugagacggagucucgcucugucgcccaggcuggagugcaguggcgggaucucggcucacugcaagcuccgccucccagguucacgccauucuccugccucagccucccaaguagcugggacuacaggcgcccgccacuacgcccggcuaauuuuuuguauuuuuaguagagacgggguuucaccguuuuagucaggauggucucgaucuccugaccucgugauccgccugccucggccucccaaagugcugggauuacaggcgugagccaccgcgcccggcguaaaucagguuuuuuaaauguuugccaaaccuuaucacugacuuuuauaacaaaauuauuuacuauaaucauuagggaauauuuaaguucugcuaauacuuaaaauugcagagugcuaaaaccagcagugaguuuagaaucaagcuaagcuuuauuguugcuacuauuugaggcauauuaguugacugguguucauaugcaaggcagucuacugggugcaacaaggguuagaaggauauuuuuaaaaaacugacccuauucucaggaugaaaauaauacacuaguaauagucugcucuguugguuaacuccucguaaggagguacaauuaaaaugcuguaguguugcaagggaaggagaggaagaaucauauuccuucacuagcaggaucaagaaagcuuuuauagaaauauacaaaaucuucacuucuugaaggauugguaaaauuuaauagccaacauugggcacuuauucauucucugaguaaauauuuauugcaugcuuaucuuguaucaagcauugugaugaaagcacaagaaugaaagaggagggagaauguuuagagaauaagggcugaaacacagauuuuguagggagcguaggggagacugagaagacagguucagguuaguaagggcgcucauauuuugacacugaauguuaacuaugugcacaucaugcuagcuauucuaaaucaggcauuuucaaauggaagcaggcacugacauuuuugagcaaagacgugauguuaugagauaaauaucuuaggggacuuuuuuauauuuuuauagcaggauaucuauccuauggauugaaaaaaggaaaaaucagaagguagucuuuauaggaagcuauuccagcagucuuaagguaaugaaguccagaccaaggugcuaaauaaauggaaagaaauagguaaacaugagcaauggcuugggagauaaaauugcucaaaguugguaauuugaguugggacucaguagaaaauagauucagcugacguuuaugagcauuguauuaguaaggccuuguugaacacuuuuacauacaacuuucaagacuaggaaacugggaaaauaagagugucuuuaacaaaguuuuaagaguuauuuuuaguuuggccuuagauguacauacaucuuuuaaaaaucuaacauaguaugcacauauuagacucuucguugaugguuauuucaaaguaguaacaucaugauacggaggacaaggauaauaucuucuuuaggacuuguuaaaaugaaaaggauacuguaugugggcaagggauaaaaauccauuuuauuuuuauggucucauauugauugcauuuguaaaauuugacuccuuauauauucaaaugccucacauguucuuaauagaaugucuuuuaaacaacagcguaguauagcaaaaagaggauuggacugaaaguugggaaaccugggugaccuuccggcugacauaguggguggccuugggcaagucacuuaucucucuguucuucauuucuuccauccaaccaaacaaaaggaggagcuaaaguuuuacaucuccaacaugacaaggucauugaugauaaaugagcuacuaucuaaauaacuuuaaaauaagagaacucuauaaauuuagagguuuaccacuauuguauguaucuuaauagaugaaucugcaccuaaaaauauuuaauuacagaagcuuuuuuucucaaacuuuggaaagguaucaaauuuaauuuggugcuugaaauuaggauuuauggcauugguagaauucauugauuauuuaugaucuucauauaucacauacuguacuagaagaauagagguuaugauuggacuagacagagagugccagagcaaguaucugugggaugcugagaugaagauauucaacuuucuaucuaacaaaguagauccagagccuggaagaaaaacagaggcuaagauacagauacuggaaacccucaugcagggacuuuuuuuuuuuuuuuuuuuuuaagcuuuugaguguuucacacaagguauguuacagaagacaagugccuaagucagaacuaugagaaauauugccaucugacagguuagauuaaagaaggagagcacagcaucugggaagacugaaaagggaaccauagaaauaggggaaaaaaggugaaacaugggagaugucauugaagucaagagaaagaaagcaucaggaaaauucaggugucauggagaaagcaaguaagauggggacagugaaguuugcuagacaugauacaaguagaucguuaggugacuuacugauacaacguuauaaguagugaccccuuaacuguaggaguuaauucauacguuguaaaguucuccaguauugguauucauugaucuuaauucucuccuuuuuaaagagaaaaguugcagaccugaauaugaagaggagcuucucuucagucauaucuuaauuuuccauuuagccuacagaugcaugaaguagagaauugacaucauagcuacuggcagccucuguagcuguuaagaagaguguucacuaaugaguuuuauauaaacagguucucucucaauuuuggauucggguaguagucuuuacaaucuugaaaugugcaugcugcacuaccccagguauaccauugacaguauggggaaagguucuaagucuaguccuuuaaaaaaaaaaacacacacacacauuguauaaagugauuauuucagacauaaagucugacucuucaaacaguuaugaguuaaacuuauaccuacuugggcuuuauaauaaaugaaugugcuaucuuuuuauuauuuacugaggagaacagauuagaggcggacuagaaaauuagggagaaugaccaauugcuuggcauaauuaaaugguaauuuucaaaauuaaguuguuugagaucuuuuaaaauuauuuacauuauauauuaacaaauauuuacacagguugagcaucccaaauccaaaaugcuccaaaaucugaaacuuuuugcucaaaggaaaugcucauuggagcauuucagauuucagaacuggauuucagauuucagaacuggggaugcuuaacugauaaguauaaugcacauauuccaaaaucugaaaaaauuugaaauucagaauacuucuggucccaagcauuucaaauaagcgauacccaaucuauaauuacauauugaauacaaaucuaucccguaagaacugauauuaaggacauugcaaaaaucacuauaaccauucuuauccaauagaaacucucauacuuuauuuuccaucuuaauuauguuuugcuuaaacuaaguauuugaauucuuauucccugggcauauauuaauucguaguagauaaucugcaaacaaaauacaugacuuccuauuacuagccacuugaaaauauaacagguaguugacuauauguauguaugguauaguauaaauaauugccucuaaguauaagauuuugaaagguaaaaaaacaaaauguaugucuguacuauuauugguauauaguuucaaaaauucacagaagggagccaggugcucucauugccuaacaaaauaauggaaauauguauucauucuaacaucuugacauacaguauaaagggcacucagcaagugcuuuuuaguuagacugauuuuaaaugaguagauucaggaauaccagaaaacacacacacacacagauaauugguugaaaauacgagguuagaaacuuaaccauugaagaggaguaaggcuacuuaaagcguuaaaaacuaauuggguaagguaugguugacccagcuacuucauuugccuuacgauguauauucauuaaacuaagucacucaccuucucugugauguugaugguuugguauaguaaacaugagauaugauuaaaggugauucagggauagaucaagugucugccuaaguaaaucuguguuuucauuuuuuuuucuaguaccauaacagcuugggggaaagaccaugaaaaagaugcuuuugaacauauuguaacacaguuuucaucagugccuguaucuguggucagcgauagcuaugacauuuauaaugcgugugagaaaauauggggugaagaucuaagacauuuaauaguaucaagaaguacacaggcaccacuaauaaucagaccugauucuggaaacccucuugacacuguguuaaagguaaauuuucauauguaacuuuauuauuagaaucccucuguaggccagcugcaucaauacuacuuuucauuuauauacacacaauuucagagcuguguggaccaguccccuuuauuuuagaguugcagcccagagagaguaauagauuugccugaggucacacaguaauagcacagaaggauaccaagacuuauggauuguuuuacugucaauuagacauuugaauagauauuuuguuuucugcuuaccugcaaaauuaauuaacagcauugccauuuuaauuaauccuaugauuugggcaccaaacuuauuugcaguuuguuucuuuuucagcauaagucacugcuagaccuuugaaguuguuagcacagaagaaauaggaacagggugauguggaauaaaaauaauucaaaaauacucuucaaguggagguucuuuagaaauacuguugauucauaauguagcaguguuacuuuuuguuguuaauguucaaggacuugguuuaucuucuucaaaaaguaguaauagcaggcuuauuugaugccuacuacuagaaaaauauuuuaggugauuuacauaagauacgccauuuaaucucuacaaaaaaaaacagugauaaauauuacugucucuguuauagaagaaaaaaacagaggcuuaaaaagguuaaaguaacuugcucaaggucacacaacaugaaagauaaggagucagauauccaguguaggucuuuuggcugcagccuugcuacuugaccacaccauuugucaguuaaugagcagaugauacuuaccccuuaagaaagggaaacagaauuaaggaggucuuuucuuauucuauuaaaugauaggccaaucugaaagucuugucuuagccugcaauauuugguuuuagcaaacuugauagguuucauguuuuuacuguuacguaauaaaaaauguacacagcuaguuaugagaaacugauuucaucaauggggaauuuucucuuuguuagaaucuuuaaucaguuuauuuaggaaaaagaaaugauuguugugggaagagaauguauuucuuuuguuuauaugaccaagcuuucugagaaauuuuaauuugguguacaaaacuuuuaguaguuagugaaugaguaagaugauuuguguauugugcaguuuggcuuuaagagcaaaggagaacuuagagacuauggguucuagaugcugugucugccuuucacaguuucucugaacuuugugauugaacuggauucauauuggaguuauauaucagacaaaaaccaaagucauugggcacaagcagaauaaguccaaauuaaaaguauaaucaugaguuuguuaaauaaugcuuuauauacuucuuuaaaauauacuuauuuaauauuaaggauuuuuuuuuccuugaauccauauaauuugaaaggucuaaggggaaaaacuuguuuugagccacuuuaugaugugaauucacuucauaggaaauaacaugcuuguuuuuaauguacuuuaacccuuuaaaguacacuggaccaaauuuuagagagcauauacauaguguuauaaaauuuuuaaaguaguuaauuuuuauauucucgauuaucaaagcaaaaucauuuaacuuugaaaagcucuuauacuuguuuucagcuuuaguuauuuguguugcauguguauuuuuccauauagguuuuggagauuuuagguaagaaguuuccuguuacugagaacucaaaggguuacaaguugcugccaccuuaucuuagaguuauucaaggggauggaguagauauuaauaccuuacaagagguauguguuuuauauuaaaaguuucaauaaggcauuucuuauaauuaaguuuguuuauguuugauaaagaacacaauauaaauacaauuuuaagucuuuguaaguguuuauguugguauaaaucucugugcauugcuuaaaguuuagaaauaauaguaguuuaaaauacagaggugccagccaagccauacuuacucuuccaguugucauuggccacccugaaugaugaaucuaaagaaguaucauugugaaacaaggaaaugucagucaagaaauauuccuuggaauauaaaacaaagccuugacucugcuggcauaggucugaguuuucauagacuggagcuucacaaaucuguaaaacucauaauauuaaugggugcuuuuucagaaauuauagaauagcugccaccucuucuaaauuaagcauugacugucaucaguauuagauuuagccagauaguauaaguguuaugcaggcguaccucauuuuauugugcuuugcaaacauugcauuuuuuuacaaauugaagguuguggccacccuguguugagcaagucuguuggugcuauuuuuccaacauguauucacuucaugucugugugacacauacugguaaauucucacaauauuucagacuuugucauuauaucuguuauggugaucugugauuagugaucuucgauguuacuacugugauuguuuuagggcaccacagggcacacccagauaaggcagugaacuuaauugauaaauacuguguguguugugacuccuucaccaguuacccauucccuuucucugcucacuucaaguuucccuaugcccugagacacaacaguauuuaaauuaggucaauuaauaaccccacaguggccucugaguauucaagugaauggaaaagucacaucccucucauuuuaaaucaaaaccuagacaugauuaaguuuagugaggaaggcaugcugaaagcuaaaauaggccucuuaaggcaaacaguaggccaaguugugaaugcaaaggaaaaguucuugaagaaaaaucaaagugcuacuccacuaagcauaugaauaagaaagugaaacagcuuuauugcugcuagggagaaaguuugaauggucugaauagaagaucaaagcaaccacaacauuuccuuaggcuaaagccuaauccagagcaaggcccucguuucaauucugugaagccuaagagaggugaugaagcugcagaagaaaaauuggaagcuagcagagguugguuccugugguuuagggaaagaagccaucuccaugagugcagaaugaagcagcaagugcugauguagaagcugcugcaaguuacccagaagaucuagcuaagaucauugaugcaggugacuaaacagauugucaguguagaggaaacagccuuccauuggaagaaggugccgucuaggacuuucauaacuagagagaagacaacaucugcuuugaaaggacaugcuaacucucauuaguggauaaugcagcuggucacuuuuaaguggaagcuagugcucauuuaucauucugauaauccuaggacccuuagaauuugcugaaucuacucugccugugcuuuauaaauggaacaacaaagccuggaugacagcaugucuguuuacaucauaguguacugaguauuuuaagcccacuguugggaccgacugcucaggaaaaaaaaaaaaaaaaaagauuguuucgaaauaucauugcagauggcaucugagaucugauggagauguacaaagagguuaauguuguuuuucaugccugcuaacacaacguccguucgacagccuauccaucaaagaguaauuucagaugcuauuauuuaggaaauauauucuuggccgggugugguggcucacgccuguaaucccacacuuugggagaccgagacaggcagaucacgcaaucaggagaucaagaucauccuggccaacguggugaaaccccgucucuacuaaaaauacaaaaauuagcuggguggggcaaugcaugccuguagucccagcuacucaggaggcugaggcaggagaauugcuugaagggaggcagaggcuguagugugccaagaucacgccacugcacuccagccugggcaacagagugaaacuccgucucaaaaaaaagaagaaauauauucuuaagucuguagcugaaaggguucaccauucuagaugccauuuaagaacaucaugcuucaugggaggacguuaaaaugucagcauuaacaggaguuuggaagaaauugauuccaaccuucacagauaacugagucuugauuugacuucaagacuucaguggaggaaguaacuacaaaugugguagaaauagcuagauaacuagaagugguggagccugaagaucugacugaauugcugcagucucaugauuaaacuugaacagaugaggauuugcuucauauggguggauacagaaagugguuucuugagaugaaaucuacugcuggcaaagaugcugugaacaucguugaaaugacaacaaaggacuucgaauaucaguaaaaucaguugauaaaaccaaagcaggguuugagaggaugcacucccaauuuugaaagaaguucuugugugggugaacgcuaucguaccaaacagcaucgcaagcuacagauaaaucuuucgugauagagucaauugacgugacaaacuucauuguugucauuuuaaggcauugccacagucaccccaaaaccuucagcaacccugaucagucagcagccaucaacaacagggcaagacccuccaccaacaaaaagaugacucacugaaggcucaagugaccauuagcauuauuuagcaaugaaguauuuuuaauuaagguauguauuuuuaagacauaaugcuauugcacacuuaauagacuacaauguaguauaaacauaacuuuuauaugcaaugggaaaucaaaaaauucccgugacuugcuuuauugcaguggucuggaagcaagcccacaguauuuucaaaguaugccuguauugucuuaaaauuuuugccucguuuacuaaauaagguucuuaagggccauaauuucaucauaacaccuaaaauacucuguagaauaucacuaacauaauguaggccauuugcauucagaaaccacugacauuuugauguauacgaaucucagaugguaucuacagcuaugaaacacaaguuuuuuucuguucgaaagaguuugguggagauagaguaaggucaguacccaaauuauaguaguuuuccaaagauuguuguacauaauacuucucacuuccaaaucaaacaguauuucugcggugaugguguauuuagaguuccaauaugaggcguccggaauagaucucuuguaauaacagagaugagguuucuuccacuaccucuuccaaacugccuugcuuaagagaagugggaauuccuucagcuaagacauuugguguugggacauaggggcuuucauguggaaaggaaaaaagaaauagaagaaaagucugcagggagaagggggaggaccuuacacauagcaaucucagcugacacaccuaauugccguuuuccccuuagcucagcugaacugacagucucuuaccuuggugucaguuaaguacuguucccaggugccuuucaggcacuuuagcacuuacguguauacacagacacacacacacaccccucccccuugcaggugaaagaacauggcaggguacuguaucuguuucagaaaucccauuagccugccuguugcugugccuaccuuuccuuguuccagcagucagcuguuggauuguucaggcaaguugaacggaguucaaguuggguguucagucagguacucaaaacuuuccuuucaaaaaucaaagcucuucggcuuucuuuuccuucuuuucuuuccuuguuuauauaaacuuuaggaauguaugugcgauuuuuuuuuuuugacagggacucagucugucacccaggcuuagugcaguggugcagucacagcucacugcagccucaaccucccagggucaggugguccucccaccucagccuccugaggagcugggacugcaagugugugccaccacaccugacucuuuuuuuuuuuuuuuuuuaauguuuuguagagaugggggucucacuguuucccagucugggaaacagucucaacuguuuggccucgaacuccuugacucaggccuccuaaagugcugagauuacaggugugagccaccauucccagccuguaugugcaucuguauaguugagaaucagcccaaaacuguacaugaauaaacuacauaaacaagaauauugagauaaauacucuuuggcauuagugaaacuuaaacagaacaauuagaggauugaaucguuuuguguuaaugcagauguacucaggaaggaaaaauaucuuuuucucuuuuuuuuuuuugagauggaguuuugcucuuguugcccaagcuggagugcaguggcacaaucucagcucacugcaaccucugcuucucggguagcugggauuacgggcgugugccaccacgcccggcuacuuuuuggauuuuuaguagaaauaggguuucaccauguuagccaggcuggucucgaacugcugaccucaggugaucugccugccucggccucccaaagugcugggauuacaggcgugagccauugcgccuggccagaaaaauaccuuuaaaaagcugggccuguugguguaccuaaaggauaauacagauguuccucucaacuuagcaugggguugugucucaauaaacccauuuuuaaguugaaaacguuaaguggaaaaugcauuuauuauaccuaaccuacuagaccucguaguuuagccucccuuacccuacaggugcucagaacacuuaguagccuacaguugagcagucaucuaacacaaaaccuauuuuauaguaaaguguugaauaucucaaguaauuuauugauguuccacugaaugcgaaucacuuuugcaccguuguuaaguugaaccauuguauguuugugaccaucuguacuuguaauuucuuuacauucauugguaugaaaaauauguucuuagaagcaggaaaaagaauucaguuuugcuuuguauacuaaauuagaugcuguaauuuugauaaaaugaaaaaucugcuuuauuugcaacaauuguuuucuuccuugacgucagccucacucuuggacuuugcuauucagccugucaccccugugaauucccaugagguugacaguguaaaccugcucuaaguuuucacuuugcacuguguaccaaaaugaaacugcuuauuuaggaaaauaaaaauaucuuuuguguuggacaaaauacagagcgccuaucuucuuuuucuguuguguuucaguuauggauucagucuucuuggguaucauugaaacuucuauuggagugauuuauuaaaauauuaacauaguauugcauuaucagaguuggcaagaggaagcuuucuuugaagucucacauguauuaaauguuuuucuucccagacucaaaauucacuuuaacuccaaauugucuaaauuuuaaaacuuuugguaaagaaacuuggccugaaauacagugauaugauauuagaugauacuguucuuuguuauuuccucauuuuguuuuugccucugaagcauaucuaaaaugaggugacaggucagaaacuauuuucucuauauuuuaccuuacccuccaucuaccuguuucccuuuucuuccccuuuucuguucuacucuuugcauuucuucuguauugaaauucacuuuguucacaauuauuuaaaggaaaaccugaacucaggggccuuggguaccuuuagguucagguacaauaaagacaugagacuggauuugcgugcauccuaaaagaaucacuuuuaaauaaguuuuauauguuuucaucuugauucuucuagauucaucuugauucaaauuagaugguuggcauuuaaaaagaaaguugcauuucuaaauguagauuuguuuaaaaaugaaguugcuugggauuuguuggguuuuuuccuuugcaguguugaaaacaaagaaagucaauucgagacuauuaaaaaagucaauuugagacuauuuggugagaaugugguaacuuugauacacauaaggcuguuacacuuaugauuuucuaauaacuucugaaaguucuguuuaaaacagagucagccuuuccaguugcuuucuguuugacuauucucaugaaauaaaugguuaccaaacuucacuugccacauucuaucaucaaagugauugaauauauuaaggcagaugcuagguaaauaaacuugacuuuggugaaagaaauacaaaugacauugguaauaaacacaucuuuaaaguuguaugucccuugaaagaacucuuuuagaacuguucauacaggucucucuagcugguuuauaacuaaucauucucccaaaaaugauacaguaaucuuaacacccacagcaccugugcauaauuuuguuucuggcacugguauaucagccagaauaaaaugacucuaccaguauaccaacuguuauauaggagaaguauuuuauacucuuuugccaccaauaucuuugauucuuacauguuccauuacauaugacauguaauuauacaguguauugugacuuauuggugaugauuacagucauuccuagagucuaguaaauuggcucccauugcuuguguugcugagaucuggacaauaacuuaacgaggugaaugagagaaguugacucaaguaaucuuagauauuuauagcuaguuuuuucucacuuucucucauuuccuucacuccccgaauccuaccagaaccacagugacagcaaugcagauucaggaacuaugcaugaaauccucuccuuccacacauauccaucuuuugggggugggugggucuuuaaaaacaaaaugcgggcuauaauuauuuauugaccguguuauaaaacagucuuggaugcuucauucaucaauauugucccuugaaaauaaucuccauucucuuccaaauuaagguuugguuugguuuuguuuuguuuuaaucuucuagauuguagaaggcaugaaacaaaaaauguggaguauugaaaauauugccuucgguucugguggagguuugcuacagaaguugacaagagaucucuugaauuguuccuucaaguguagcuauguuguaacuaauggccuugggguaugucaccuuuuaauuacuucuguguuacuaccuuccuuauguaucuagguagaaugugguuauugagugcauuugucaaagauugauguggccguggacuguuaauauguuguuggguacuacugaccuuaacucagaaacaaggaaagaagggagauauuagguaauaacagaccuaaggagacagagauuuggaaaaaggaagaacaauaaggaaaaagauuauuuaagagagauaauacaggucagucauuucccacugccguuuuuaccuuuagaucaaaaaguaauauuugaguaggaaugucagcuuaccuagccaucauauauuaaagacaagcaaguauauaaucacugaccaaacuguuacaggaagguagaauaugagguuuggauuguuauaccacagucauguucuaguagccauagaacagcuaggcaagugaacaacaaccccccuugcuucuuuguaacgucuugagagcuggagauucuauagagcaagggacagaggcaggaggaugcuaagaauuaagaacaccugaguugauucccugcuucacucuuugaucuuucuuuggaaaguucugggauugacucauuuguugcugcuuguuccacugccacuuguuucuguuucuuugcugccuaccuuucugauguagaaacacucugcugucuucagguucucuaagacuuuugcuucugacaauaacaaggcaaaaguaaaaaguaccaaaagagggauacguuaugaaauaggaaagccuuuaccuuaguaauacucuuguucccucuccaaagauugugugugugguuuuggcguaguugguauaguugggcuuuucuucaacagcauguacaugcugugcuuacugucaguuuaaaggcaguuuguaauauaaagagauaccuuaagggucacauguuagaaugcucacagacuuccuacaaauggaguauuagguguucuucaguggcaaaaaggauauccaagaugucauacuuuuucuuuauuacaaacgacuauccuucaaaacaggcuaaaguguuauguuucugaaagccagauguggauugguucaguuauaccuauuaagugcuuaaaacuuaaauguaaauuauguaugugcuuuuuuguaagggaguguuuagacauuucugaugauuagucuucuacuugucuaacuuucuuaauuuggauuucagauuaacgucuucaaggacccaguugcugaucccaacaaaagguccaaaaagggccgauuaucuuuacauaggacgccagcagggaauuuuguuacacuggaggaaggaaaaggagaccuugaggaauauggucagguauguaucuaugcugauugguuuuuuuaagcaauaguagguuggcucaccaaauuaauaagaaaggagguuuuuauguuauuguuuuuguggaagacaaaguauuauauuuuauuauaaaauguccaauugcugaccuggccuaccaaaauaagauacaaaacaagugucuacgucauaaacacggggccuguguauacauagggagaaauauuacguaaguauagugauugacagcaaguuuguauacacuuuauccaaaagcaaacuauguuacuuuaauauaaaaugugaaaacaaggugacuugauuuggauuacauaauaaauggugaaaccuugauuuaaccaaguuuucugauucaaaucaaccaaacuagaaaaauuuacaguacacuaaaguaguucauaugaucuaauggucuuuagcauacaaaaguacauuuauauuugugaacucaaguuaaaaaauuuuugguuuuuaagccacuugaucaaaaaaaacuuuagacagaacuauucaugaauauucauauuauuagaaaaaaguacacuaaacaugagugcacuauuacuuccuauuuugauucuuuauacuacaucacaauuacugcuuauaacauguuacuuuuacauuuauuaagguuuugagccagaauugaaauaacuuuguuaccguuaaugaaaaaauauguuuguaaaucaaacuuuuagaauuagaucccuuuauauagccuguuaggcaauuauuugaguaagcuuuguguaacucuuguaccuacuaagauuuuggcagauuuaguuuauccuagaugagcuaaagucacuucaaacuaaaaguaaaaaucuaagugugauuuuuaaaagacacugauuuaagaguaugugaaugauaguagaauaaacuagaaaauaauucauaaucaucuaggcaauuugauuuaagaguaggaacuaguauucccuuaaauuuaaauuugugaaagaaaaugcuacagcuaaagcacugugguuugaagcaacacaaugacagaaauauuagauaaugucauaugcaccucaaucuucagacuagguggaaaauugagauuacuucuguggauuuuucagagagaaaccagaagcagguaacuccuuagugagacaggaguggcucuaccagacccaaagggaauuuaauuucuucaaucugucuuugcuacucuuguauggaugaaguggauuaccuuugucauugacuuuuggaguauaaacagaaucuuuaacccagucacuguguguuagucaagaaugcaauacuuguuuuucuuuguuucuguuuugggauuggcuuuuggcuuuuuguggguuuucuagacccaaauuuagcacuagcaaauuucuuaaacuuccauuugauaaguuuaaucacuguugaguuuguuggccaggaacaaggcaggguuuaccaggcuuuuuugcugcacacucacaaugauuacaguucucccuaggcacccaggcaucuuccuucagccugaggaaaaaaaagauuggucagcuagguuucuugguuuuccuuuaagaaaacugguuuaagaauguaguauuaaggucauuccuuuucauagaaguuaaauauuucuacauaccaggcaacucagugauuggccauuuuagauaguaccuuguuccacuagcauuuuuuaugcaucaaaucaucucacaauuugaacaccauuggcaucucuguauuugacugguugguuagucuaauucaucaaaccaggauucagguauuuugcuuaauaauguaauauaaucaugaaauuuccauuuaugcaggaucuucuccauacugucuucaagaauggcaaggugacaaaaagcuauucauuugaugaaauaagaaaaaaugcacagcugaauauugaacuggaagcagcacaucauuaggcuuuaugacuggguguguguuguguguauguaauacauaauguuuauuguacagaugugugggguuuguguuuuaugauacauuacagccaaauuauuuguugguuuauggacauacugcccuuucauuuuuuuucuuuuccaguguuuaggugaucucaaauuaggaaaugcauuuaaccauguaaaagaugagugcuaaaguaagcuuuuuagggcccuuugccaauagguagucauucaaucugguauugaucuuuucacaaauaacagaacugagaaacuuuuauauauaacugaugaucacauaaaacagauuugcauaaaauuaccaugauugcuuuauguuuauauuuaacuuguauuuuuguacaaacaagauuguguaagauauauuugaaguuucagugauuuaacagucuuuccaacuuuucaugauuuuuaugagcacagacuuucaagaaaauacuugaaaauaaauuacauugccuuuuguccauuaaucagcaaauaaaacauggccuuaacaaaguuguuuguguuauuguacaauuugaaaauuaugucgggacauacccuauagaauuacuaaccuuacugccccuuguagaauauguauuaaucauucuacauuaaagaaaauaaugguucuuacuggaaugucuaggcacuguacaguuauuauauaucuugguuguuguauuguaccagugaaaugccaaauuugaaaggccuguacugcaauuuuauaugucagagauugccuguggcucuaauaugcaccucaagauuuuaaggagauaauguuuuuagagagaauuucugcuuccacuauagaauauauacauaaauguaaaauacuuacaaaaguggaaguaguguauuuuaaaguaauuacacuucugaauuuauuuuucauauucuauaguugguaugacuuaaaugaauuacuggaguggguagugaguguacuuaaauguuucaauucuguuauauuuuuuauuaaguuuuuaaaaaauuaaauuggauauuaaauuguauggacaucauuuauuaauuuuaaacugaaugcccucaauaaguaauacugaagcacauucuuaaaugaagauaaauuaucuccaaugaaaagcaugacauguguuucaauagaagaaucuuaaguuggcuaaauucaaagugcuugacaucaaaauguucuagagugauuagcuacuagauucugaaucauacaucacaucugacuagagaccaguuucuuucgaaugauucuuuuauguauguagaucuguucuucugaggcagcgguuggccaacuauagcccaaaggccaaauuuggacuucuuuuuauaaaugcagauugucuauggcugcuuucccacuacuccagccuaagguaaacagcugcaauagaagccaaaugagaaucgcaaagcccaaaauguuuauuaaccugcccuuuacacaaaauuacacaaaaaguuuccugaucucuguucuaagaaaaggagugugccuugcauuuaaaaggaaauguugguuucuagggaagggaggaggcuaaauaauugauacggaauuuuccucuuuugucuucuuuuuucucacuuaagaauccgauacuggaagacugauuuagaaaaguuuuuaacaugacauuaaaugugaaauuuuaaaaauugaaaagccauaaaucaucuguuuuaaauaguuacaugagaaaaugaucacuagaauaaccuaauuagaaguguuaucuucauuaaauguuuuuuguaagugguauuagaaagaauauguuuuucagaugguucuuuaaacauguagugagaacaauaagcauuauucacuuuuaguaagucuucuguaauccaugauauaaaauaauuuuaaaaugauuuuuuaauguauuugaguaaagaugaguaguauuaagaaaaacacacauuucuucacaaaaugugcuaaggggcguguaaagaaucaaaagaaacuauuaccaauaauaguuuugauaaucacccauaauuuuguguuuaaacauugaaauuauaguacagacaguauucucuguguucugugaauuucagcagcuucagaauagaguuuaauuuagaaauuugcagugaaaaaagcuaucucuuuguucacaaccauaaaucaggagauggagauuaauucuauuggcucuuagucacuuggaacugauuaauucugacuuucugucacuaagcacuugguauuuggccaucuccauucugagcaccaaacgguuaacacgaauguccacuagaacucugcugugugucacccuuaaaucagucuaaaucuuccagacaaaagcaaauggcauuuauggauuuaagucauuagauuuucaacugacauuaauuaaucccucuugauugauuauaucaucaaguauuuauaucuuaaauaggagguaggauuucuguguuaagacucuuauuuguacccuauaauuaaaguaaaauguuuuuuaugaguaucccuuguuuucccuucuuaaauuguuaucaaacaauuuuuauaaugaaaucuaucuuggaaaauuagaaagaaaaauggcaagguauuuauuguucuguuugccauaauuuagaacucacacuuaaguauuuuguaguuuuacauuccuuuuuaacccauucaguggagaaugucagcuuuucucccaaguuguauguuaagucuauucuaauauguacucaacaucaaguuauaaacauguaauaaacauggaaauaaaguuuagcucuauuagugaaguguuaa

SEQ ID NO: 17017 - RNA, 25029 nt, Homo sapiens
agcgcggcgcgggcccaacgagcgcacgcguacacgcgugcgcaggggaagaccgagugccaggggcugaaccgcagggaagggggcgcggcgcacgcaguauggcgcccaacaucuacuugguucgccagcggaucagucgacucggccaggugcggccugaggagaagccucccggucuccgccccggcccgccccucgccuccccagccgccccacuccguuuccgccccagagucucagccagcagcucaaccgccgccgcuccgccccgccccgccccacggccgcccgggcccgccuccgagcccggccagcgcgccagccccgccugcccuuccucgccaccgggcugcucuggucucgucgguccccuccuccgccccgucguccugacucucucucccuccuuuccucagaggauguccggcuuccagaucaaccucaacccgcucaaggagccacucggcuucaucaagguccucgagugggugagugcagcccgcgccggccaggcccgccugccgcucggcgcggcgcccuaggcggggagacggggaccugcgagccgggacgcagcccugccgcgcgggcuuugaggccgccgccccgggacugggaguggacggcagggagggcagggaggccgcggccugggccgcgcggggcggagacgccgcggcgggcgucgaaucacgagcuccucggccgccuggcucccaggggagccacccucccacaccggagcuccccucuggguguccccguggagugggaguucaaauuuccccuuggcuccacugccucccgcagaggaagggaaaacuuccugcugcggucuaaccgaaacccggcggccggcgucgcgcucugcggagaggcucagcgguuacgucccugccggugcccacucgaggucuagcucccugggaagccgauuuugucuuguagacgugauuuggcgagcauuccguucuuaauuuguuuuuaagaugggcuccgaguuaaaaauaguaaaaaaauaaacugugggccagggaaacuaaagaaaguccuuuuaacaaaacgcaucgagucagaucgguucacuuaauaacacguuaggaauggacaucgaguuuguuugggguauuuccaaacaacauccuguuuagaaagucagcuuuuaguccuuuccugagaacacucacaaucauuaacaucaaagaacgcuuauuaauucgaccuuggcaaugaucaguuacuuggaggaguuggugaauauaccaggcacugcgggcuuccuucaaacuucgcggcccacuacauauuucugcaggcaaguuguguuuauagacagcagcauuuacauccauagcuuuuucgcccuuuuccuuagugauagaguggugaagaagaauaagaacuuucaauuuccuguucuaaauaaccuaccgaggauguuuuuaaaagcagcguagaaacucaguuucucugauggguaccuaaugugauuuccuacuuggaccauuguaaccgcgcaagggguuaggcaauuucaccauucacugaacauuuuguguguuuucugaaaacugaaguagugcugacuucacacaaaugacuacuugaaagacgcauaaauaaauauacuugauuuuuuuaaaccuaaguccagauuuaaguauaaagaaaaccaugauuaaagcauuuaaaaauugcaagaggaaaaucucauuaacgaggcuaaucaaauaugaacguuaagaaagucuuauaucuagauuuagucucauugaggauuauaauuaaauguauaacuaauaauuuagauuuccacuuaaaugaagaggcaguuguuuauaucugugcuuauauuuuuugucaaguuuuuaaacaacuguagacuuagcuuuuuccuuaauauuucaagcacuagugauaaguucauucguguuuugauguauuuugaaaaauaucccuuuuuaagcaucuuacagaaauacuuucaguuugaacagcuuguuauuacacaggagagccuuuuaugaaaagacuacacauuguuaauggugugguaaauauuugacuauuuuauaccagaucuguacuaaacacuagcauaccacaugaauaaaacauggucuuuuucucaugaucuauuaaggaugaaggacauacaaaauacaaaaaugccauguaauaaacugugauaaagguguaugcaaagaauaguagaagaaaugagggagagagcauuugcuuggaggaacuagggaggacuucauagcugagagaacacuugaaggauggguacugguucacuuggggaguggcuuucuaggcagaaggaaucuuauguucaguggaaggaaauguugaagcagcauaacccuguaugagaacuuaaaaguaauuggggguuaguuggaauauaugcuagguuggaggguacgguuugagauuguucugaaaagauuucagaggucggcugcuucugggguuaaucuuugggaaucugggcccuuuccuuaggaaaaugcauaugugcaggguauggaauauuggaguguuuauuccauucaagcccagaaucccugccauaggggaugggaacuuaaaggcuuuaaacaagucaaugauacgacuaauuuuaggcacucauaauuccucaaucaaucgauuucucccuccaauucugaccuuuccaauccaucccucuaacugccgacaaaaugaaaauuucuaaaaggaugaauuggaaaggcuagaauuggaggaagggaaaucuguugauugaggaauuaugagggccuaaaauuaguuucaguaggacugaagggguuuacaaaaggggguuacaaauuagaauauauauggaagguaacaaagagggaggacccuaagaugacugcugucuuucugacuucguugccauuagcauauucaagguaaugucauuaagaggaggaggagcagauuuuaugggaagucaaagguuucagauguauugaguuuguggucucuuuagaucuuuuggagguauccuauaggauacagcuauauauauggaucuagaauuuaaaauaugaguuugggcugcagauauagcagauaucugccugcaaaggagagaaggaaugguuaggaaaauugagggaaauaaugccuuggcaucacuauuagaauuucaagaaaagaguaccccaaaacguaaggugcaauagaaugguaaaguaaaauaaggacuaguugauaaaauaaggacuaguuagcaagagcaguuucaguaaaaucaaaaagccagauuuuaguaggcugaaugaaugugugguaagaaagugaagacagcauaaaccgcuguuugacugugaagaugggagaaauuuggugguuacaaaaaaaagccacuaguucagcuuacaacucaguugcuuaaaugcauucucuggagacaaccauuguauuugguaugcaacaaaagucuuuauuugcauuucccauuuuauccuacugacaagagaacucaagggucaagguuuaauaaaauuuuuacugcuucaucagacauucuuaaguaaaacugguggggguuuuuuguucuuuuuuguuuuugguuuuuuguuuuuaacugcaaguauguggcagugaaauagaguuugguauucuuccugauucuuauuaaacccggcaguuuuccccaccaguuuaucugcuucaucaguacaaaugucagcacaguguaaaaggcaaauaaugucuuaguaucguuaggaaaauguuuuaccuucaugaacuccugaaagagccuugggagcuuucagggguccacagaccacgcauugagaauugaugagguaaacaccacuggggaccagaaacagaacagaaaauacggcagggagaaagacuauucccaaauuugguaauuauuaauaaaucugaagaaagcucaaccaacuaucuggauuuacgacuuaaauagagcugaguacuuaaaaguguagaaauaaagagauauauauagccucucaagaccuggaccaaucuacuugcaggcuuaaggucuggauuugugauaacguguauguucacuuauguuggugguuugggggucccaucauaagguguguuuguggaccaggggacucagaaggccaagcagaaaugaccaugaccauaaagccgcuagacagggauagaagcaggaggggacaaucaaguugagccuauaucaaauauccuaaaacacaugaagaaaacuaauuuuuacuuaaaaauucaaauuaugucaguggcaacaaaugcugucaguuuuccacagagugacaggcuuacuucaagacagccagccagaucaacaaucaggauauugauucacuccagaagacaugaaaauaguagagcaauuagaaaaugauuucuauuuuuaaaaauauaaauuauauuuuaaauuuuuaaaaauauagucucugucuuguccaggcuggagugcaguaguguggucucggcucaaugcaaccucgccuuccagguuccagagauucuucugccuuagucucccgaguagcugggauuacaggcgcucgccacuacauccagcuaaguuuuguauuuuuaguagagacgggguuucaccaugcuggccagccuggacucuaacuccugaccucaagugauccacccgccucggccuccccaagugcugggauuauaggcaugagccaccgcgccuggcugauaaaugauuuuuaaauaaauauauuuagguuccucagagauuuaaggugacauaaauguguuuucaacauacaaugauuaggaguuagcaaaaaacuucuagcuguuuauuucaguaggaacucuagaguuuacuucucauaauccaauuuuuuuuuuuuuuuuuuuuggagacggagucuugcucugucacccaggcuggagugcaguggcaugaucucagcucacugcaaccuccaucucccagguucaagugauucuccugccucacccucccaaguagcugggacuacaggcgugugccaccuugcccggcuaauuuuuguauuuuuaguagagacgggguuucaccugguuucaccaggcuggucucaaacuccugaccucagguaguccguccgcccuggccucccaaagugcugggauuacaggcgugagccacugcagccggccauaauccaaauuuuuaaggauuauggaauuaucuuggcaggcuauuuagaauuuucuacuauuguacauuagaagcaaagggagauagagugaaacugaagcacuuuguaacugacuuuauuucccagugggaauaaacugaaauaccaccaucaaaaacaauacuuuuuugaaaugaauaacuuuaguaaacauuuuggacuuugacucauaaaaaucauaccuuggcucuaggcaucuaaucuuuugauuguaaaggcaaacgugcuauaauauuucauuuuaagugcugaaugaucauuugacuuaaaaccagcauacauuucuuuugcauguaaacacucauacauaauauacuuuuauaucuauuuuugaagauuucaguuaucacuuugauaaacuaaaccuuggacagaaagaaauuuaaauagaugauuucagauuaaugaugaaauuaaauagcaaugaagauccugcaacuagaaacguguaaacaacacucauaaaccaggugaauacuaguauucuccaguagaauccucagaauuagcauggucuagcaauagaaguuaaggcuccaaacucuuuuuaaauuuuauuuauuuauuuuuugagacagggucucacucuugucacccaggcuggagugcaguggcacgaucacaacuaauugcagccuugacuuccccaggcucaagcuuuucucucacuucagucuacuggguagcugggacugcagguacacaccaccacccccagcuacuucuauaauuuuuuauagagacagagucccaccaugucacccaggccagucucgaaccccugggcucaaacgaucaccugccuuggccucccaaaaugcugagaugaaccacugcacccagccuccagagucuuuuuuuuuuuugagacagagucuuacucugucgcccaggcuggagugcaguggcaugaucucggcucacugcaacuuccgccucccagguucaagcaauucuccugccucagccucccaaguagcugggauuacaggugcccaccaccacacccagcuaauuuuuuuugauauuuuuaguagagaugggguuucaccauguuggccaggcugguuucgaacaccugaccucaggugauccacccggcucagccucccaaagugcugggauuacaggcaugagccacugugcccagccuccagagucuuuuuugcacuccuauuagugcaaaauuuuauggacagagccacaauaugcaucuacaacuuaagaugcauguuuuacuaugucaguuaguaucuuaagguauauuauauacucagugcaaauuuuguuuauauuuuuaaauccuugcuucagauacuauucugauaauuuuuuauuguugugccaccgucuugugaucugauuaaguagucuguuuuuaccuuguaauauggcuguugauuguaaucauagaguaguaugaaugcuuccauuuucucuuuuauacaugaguguguguguuaccaaucuauuucuuugaagacauuuuaaagccaugggucaauuuugugaagguugauuugguuaaaacuagacaaauuauuccauaaauccaggcccacucacauuguaaugcaugaacacuaaaagugaaagaauagaugagguuaucacugucuguccuuccauguaugagauuccccuuaccuucaggauacccagcaugcuguacugacaugugaccuucugaugugcaugcccagcauggguuucagugguauauuaauugcaauaaagcuucaauuccuuauuuaagucugaaaguagaucuaaauagaaguuuacauauuuucuucugguacuccagucuacuuuggagacuagugcucuggaaaaccaggcuguacuauucacccugagguuacaauucucugaauaagaucugccaugguggucaucuaguaugggucuggugggcagagaaguaagugggacuguuucucuggauacuuggggcuguaugugaacauguaacuuuucugacuaaacagaagcuugcugucaccccgccccuggauucuuacuagucacugugcagauagaauuccaugucaguaguuucagucauucuucaugggguaggaguauaugggaaaauaaguuucaaaaguggccagaaaauauaaaucagaacaccaguacuccuucauuuuagacuaggguuggaaacugaaauggucauaggaaccacccucuaaaguaaaugagugaagcaagauguuuggaagaaaaagaauaguaugucauugauuacuuacuggcaacuaacacacauccugagggcuguuaagacaauggagaagcggauaaccuggaaagcacauacucugccauaagugacaucugucacucaguucucucugauuguugcuuuaugagaauguaggucugauguugccauucuucagcuuucccauacacacucaggaaaagcaggaaauccaaauuuuuauguguaauacccugauauuaaaacaaugacaacaaauucacauuuuuuuguaauacuggaaaggccacacaaauauauuugcaggccggguuuuaccaacaggcugccaguauauaacuuccagucuagaucaaaauagcaguagaauauagggagaagugagauaguuggauauuuugcccucauaauuuuguacuuuguuuaauauaaaauaugugcuuuugucccuucuuucuauaagauaaagaccagaauugcugucaugauauuuaucuauccuuauaacaaaaagcuuuaaaauaauaauuauguaagauucaaaauaugguuuuauuuauaaguuauuggaaauuauuuuuuccuuaauuaaguaguuauuuagugagcaucugcuaugugccagguuuucugcuagucacugaaaauccuaaacaaaaccaggugcaaagacaugacagucuggcaaaggagcaguagaagugauagucuugaaagcaacaagcuguagugcaguaugccauuuauuugcuacuuguuauauuaggaaauucauuuuuccauuuaauuuuuuuauuuuauuuuauuuuuaagacagggucucacuguguugcccaagcugguauugaacuucugggcucaaacaauccuccugccacggccucccaaaguguuggaauuacaggcauaagccacugcacccggccccauuuuauuuuuuagaaagcaaguuacacaagaaaaaugccuauaguagaguucauauauaauagaguuaaugucuaugauagcucaagagaagaaucaugaguucuaccacagggaauuggguagggccuuaaaagaugagcuaaucagagacagggcauucccagaagaagaagcauauacauuuaagacauaaauacaugguauguuucaggaacaguaagcaguauaaugugacagaaucauacaguaccuggcagugaauagacugcagauaaaucuaucuagaaagauaaaguugaggaucgaucagccaugccuuuuaugccaaauuaagaaguuggagcauuuuuuguuuaauuuagguugaaaaacaauugaggaaauuccuuuaaaugggaaggacaugaucagauuuuuauuucagaucaguuuggcaucauucuaaacuagcucuguccaguacaaaaaaauacaaugggaagcaaaaaugcaaaccacauaguaauuuucaguguucuauuaaccacacuaaaauaagaggaaacaggugaaauuaauuuuaacaauauauuuuacuuaacccaaucuauccagauuauuguuugaacaagucgucaauauaaaaauuaaugaaguauuucacaucuuuuucauaguaaaucuucaaaaucuaguguguauuuugcaguuggaguauauaucaauuuagauuagugacauguaaaguguucaagacucacaaguagcauuacuggguacugcagcuauagugcccacauuauagaagaugaguaucaauuggaaugaaauuggaaaugugagaaagagucugcuggguuagucccaaugaaaaauggugagggccugaacaaaaauaguggcagguguaauguaggcagguaaacagagcuuuuuaaaaaaugguuuuauagucuagguagucauaugcaacaugguuuuuauuuuguuuuuguuuuaacucagcauuggauuucuaugauucaucuauguugauguaggcaguuguaauucuuauaucuuuuuugccguauaacuucccaguguaagaauauacuaugguauuuuauccauuucccuguugcuuuuccccuccccauuuuucaugaacauucuuauaugucucuuaguacgugugagcaaggguuucucuuagaucuauauacuaguaaauccuuugugacauuauguuuauuauaaauauguucaucuaauugguagcuuguuuuacauucaacagcugacuugauuaagauuuuuuuucuguaguugaauuuaacaaucuuuuaugguucuuuuuuacaaaaaaaaaucuuaaauucucccuuuucauguggucacagguuuucuuuuauauugucuucacauuuuuuaaagacuuuuuacuuuugugugcagcucaucuggaccauuuacugaacagcucuuccuuguauuaguuaucuauugcuguauaacaaauuacgccgagcuuagcaguuuaaaacaaaggucuguugacuuuuauuaagugagauaauaaaccucacccauucuucugugggucaggaaucugggagcagcuuagcuaugugguuugggcauagggucucccauaagguugcagucaagcuguuggcugggguugcuguuaucucaaggccuccagcuuauucucaugacuguugacaaaccucagaggauccccuuccaagcucagucaugugguuacuggcaguccucaauuccacaccaugugaguuuauaaaaguugccugaguauccucccaacauggccacuggcuucccccggagaaugagaaaguucgagagagugagaaaggaagacagaaguugcaaucuuuggccgggcguugugguucaagccuguaaucccagcacuuugggaggccaaggcggguggaucaccggaggucaggagcucgagacuggccuuaccaacauggugaaaccccgucucuaccgaaaauacaaaaauuagccgggcaugguggcaggcaccuguaauuaccccugcuacucaggaggcugaggaaggagaauuccuugaaucugggagguggagguugcagugagccaagauugcaccauugcacuccagccugggugacagagcgagacugugucucaaaaaaaaaaaaaaguuguaaucuuuuuauaacugagucucagaaaagacaucccauuucuucuacaguaccauauucuauucuguagaagcaagucacuacauuuaguugacacucaagggaagggaaaucaggcuccaucucuugaugggaguuguaucaaagaguuugugggcauaucuuuaaaaccaccacauuccuuuccuccgugaucuacaaaucaacucuguuagauacaauuugucuuauacacacuagucuauuccuggccuuuuuauucugcuccauugguucaauuuguguaucucauuucuuuucuuuuuuuuuuuuuuuaauuuaaacguggguauaugcucaggacucauuuucuggccuuuucacucuguguauucaugcauauuuauucugagagaguauugauucuuccaucuuuaccuucuuuuuuaacauaaaacauuauuuaguacaaauaaugaaaaaugauuucaugacacauuuuccaaggaaaguuacuuuuacauauuuugaaauccuguaaaaacuggggaucaccucuuaacaguuaagaccccaaacuaugugcuggacauuaccucagacucuuccuaucuguaaccagauucuuuucauguaucuuuuuugugggggggggggggggggggggggggggggcggaugggaaaaaacaaacccuugacaauuacuauaauguggauuauggccuacaagauucaaggcccuggaauaauccaugggaagcauuaugucaaguguuccacagugaauauuugauaucaaaucugcauugaauauuaucuacuaccaguugcugagugugugugaccuugaacaaaacgaagccccugaccucuucaaguuucuauucuagggaaagacagacaaauuaaguacugugucaagcagugguaauuagaacagagcagaaauagaguagagggaauagguagugcgggguaggagugcuguuauuugauauaguguggugaggggaaggucucucugagaaggucauacuggaacaggaagcuauggaagugagggagugaagcauguauuccaggcagaggaaauagccagugcaaagguccugaaggaagaguuuaucccgugucauuaaagguaucgcauggaaagcaguuuguguauacagauuagguaaaggaaaaaguagcaacaugaggucagaaauauaagggaagaaaggaucuugcaggccuuuauaugaacuuugguuuuuauucauagagagcucaaaagccauuggaggguuuugagcaaaggauaacauuuucugccuuacauuuuuaaaagauugucuuggcuguuguguugauaacagacugaagcuggggcaagggcagaagcagagagaucauuuagaaggcuguuagugcaaaauucaggcaaaaggugaugguaguucagaucaggaggcaguacaaguggucagauugcaaauguauuuugaaaauagagccaucaccacuugcugaaagauugagcuccuggacuuuaacagcgcaucuggaauuuuuugcuuacuuguguuguuuuguagaaaauucacaaguacaaaaauaaaaaggaauuauuuaucuuccuuugagaggugaccaguguuaaaauuuugaugcauaaccuuucuaguuuuuguuguuuaaaucuacuuuguauguaaugaacacuuucuauguuguuaaucuccaacauucuauguuguuaauuuccaacagcuauauaauguuucauugcaugaaugaaugaauggaugaauuauaguuugauucccugucaacauuuagguugcuucuagguuuuuuguguuuuagaugguauuugagagaacaccauucauuuuuuuaagcauauacaugauuaggaaaauaaguuuccaacaacuuuuugagaccuggaaauacccacaagggagguuuaacaggcucaugaaauagugucucuucucugcugacaaccucuuggcuuuacaaauuacugguaacuuguguuccaaauaaaaauaccuccaauucaccccuuuugauuuuauacuaauaaaugagucucccucuauauuucauacuaauacuuaguggauacacuaaaguaugagcaaaugaauugucauaugggcugguacauuuauuucuauauuauacuccggggaaaauaaaaucacauuugucgagguuugcaaaugaauguuuuaaugucuuucaccaucuuaguuuguguuuaagaauuucuagaauguagccaggcaugguggcacacuccuuagucccagcuacuugggaggaucacuugagaguucagggcugcaguaagcuaugauugugccacuacacuugagucuauacaacagagugagacucaucucuuuaaaaaaggguagugggggcugggcacagugacucacaccuguaaucccagcauuuugggaggccaagaugggaggauugcuugaguucaggaguucaagcccaaucugagcaacauagcgaggccucaucucuacuaaaauucaaagaaaaauuagccagguguggugaugcacaccugugauccagcugcuugggggacugaggugggaggaucacuugagccugggaggccaaggcugcagugagcccugaucgugccaguguacuccagucugggcgacagaaacccugucucaaaaaaagaauuucuagaauguuagccaauuuuuaauaaucagugugcuuacaguuuuagugacccuuguuuugguuguaguauugcuuaucuuuuuuuucuuuugucuuuuuucaucuuacuuuguguagauugcuucuaucuuugcuuuugccaccuguggagguuuuaagggccaaacagaaauucaagugaauuguccuccugcaguuacugagaauaaaacuguuacagcuacuuuugguuauccauucaggugaguuauauuuauuuuaaugguuucacaacucuuuuuacuuucacagugagucauuaagauuuccagcaauuuauugauugugggggguagaaaauuuuagacuguaugcucauuuguaagugaucauuaccucccaaacugugguacacagacccaugccugucuaaaaacaucuccugaucugugacaaaauaguacagaaagugagaguaagcauuuagaaacuuuuauaacaaugugauguugccuugauaauuuuauucuaacagaggauuggaaauguaaaaauaaagcaaacuagagauuguucuaucaccuuaguauaagaagcccuaauguagaaggaaacauaacuuagaaaaauccagauucucaguguuuuuuguaauugcugaauauuaaugucuuuauauaguuuuaagacauauguauauaaagagauuccauauuucauucauuagcauaaagccacacuuucuuaaaguaaaaugaguauuucaucugugaagucuuguuugacaucaguauccauugaaaaguuuauugaauauguccuguguuuaagccagggugggaaucuucuuucacuuacuaauuuuacuuacuucacccaagacucaauuuuuugguccaguaauuggaaguauuaucuuguaaggcuguuuugaugauuaaauaaaauccccauauuaaagauaagucagauaauaagugguuaaucaucaaagccucucuaucuuguauccuuucuccuagacacuucucacauaagggacuguuacagcaucuuuagugacaaguuuuuuacaauuuaugguugggaaaaaugaaaggcaauauuuauuguuagcaacuauugauccaggguuaaaaaugugaaucauuguugugauuggcucucuuggggcuagucacacauacucugccacacagaaugaaauaugaugucucaaaguauaaaccauuugguauaaucucuccuaccuaauuguuuacugcaggaagauaguaucuggguaugaaaguauuuaauucagucuauauucaauguaucauaaacuaauaccagguauaacauauacauuuauuaugaaaauuucaguuuacuuaaauauaauauuugaauuuuacuuuuuuccccaaaggaauguuuuuaauauauuuggggaguauuuuuugaagugucacucauuguuuugcuuaaauguuucugucucuguugggaaaguccaauaauucauacauuuauuuuaauagguugaaugaggcaucauuucagccaccuccagguguaaacauaugugauguaaauuggaaagauuacguccucauaggcgauuacucuucuucugcacaauucuauguuaccuuugcagucuuuguguuccuguacugcauugcugcccuucugcuuuauguuggcuacacgagucuguaucuggauagucguaaacuuccuaugauaguaaguaaucacuuuauuuuuuaaauacaaaaauaauuuguauaagcuaaauauagauuuucuuauacuggaaauaaaaauucuugguguaagccaguucagcauauuuuagccuguguuugccacgagguugagcuuucucccauuaaguuuaacucaauuuuuuuuagccuauuugcacuauaaggaaaguuuauuucuuuuuuaaaucuauuuuaacuuggaaaaaacucagauauguaauaaagcacaucagguuacaaauagcaaaaaaauuaagucgaaauucuuuuaauuugaagaauuacuuaucacaacauagucucauaacucuuucugcuucuuacuuuuuuucuuucucuaaaggcccacuuuauacuucuacaaaacuuauugaguuuaauuauaucauggguucacaaacuaugucccagaggucacugucuuauuuuuuauuuuuacuucuuuauuuauauauuuacuuuuugagacaaggucucgcuuugucgcccaggcaggagggcaguagcaccaucuuggcuugcugcagccucaaccuccugggcucaaaugauccuccugaguagcugggacuacagucacaagccaccauacucaguuacuuuuuguguauuuuuguaaagacgaaguuuuaccauguugcccaggcuggucucaaacuccugggcucaagugaucugccugccuuggccucccaaagugcuggggguuauagguguggccaggagccuggccuuguuuuuuuaaauaaagguuuuuuuuggaacucagccauacacaaucauuuacacauugccuauggcugcuuucacacugcaaugguaaaguugaguaguuguaacagagauaaaaaauaguugcuauuuggcccuuuucaaaagaaguuuguugauuccuggucuaugucccuaaacuccuuaauuuaaaaucagacccagguaauucuuauacucagcauuaguggcaaccaugaacuaauuuugaaucuuugagguaucaacaaaggacuuagauuugaaguccuauacuuuuggcuucagagccuacugagcuagaaauauucucugagauuuaguuaguagaaucugcccuggauuauugguggcaaauccagagagaaaucaugguuuuaagcuacaccuccacuauaaaagaguaacuacaaagucaguuauuagugacuuaaagggaaaacagagguguuuuuuaugugugauacuggucauucauauguaugagaaaacacaucugcuaauuauuugugaaguuacuuuaaagggaaggcuauuuaaauaugaaggauuauuaaauaacauuacaaguuuuauuuacauauuuauuuuuaauuuugcugcuggaucauaagaauggaaaugguaaguaauacaacagucuuuuaucauucauauuuaauucuguuucuuaugucauaggagacacaagaaaacuagagguuuucauaaaauacuucucgguuguuaaaaagauaagacgucaacuguuuuaauuugcagugcuuauccaacauacuuguuaggaaucugugucuucugcagacuuuucaaaucuuauuuaaaagggaacuggaauaaucuuauagauaauuauauuuuguuaaaauucuuuauaacuagaagcuauuucuugccauuuugucaucccaacaaauuuuuuuacuaaaucuaucagugugcccuuuauuucucauauuuugucuaguaaacuuuuaaaaauacuacccuucuuaaagcagcauuccaaucuauuuuuguaggugguuuuugucugauaaaacuauaaaacugaccuaguugcaucauucagaaacguaaaaaguaauuuuccaccucagaaugaccaauuaguggucauauaaagagauaauccaaaauuccuuaaguagguuuuuauuguuacauaaugggugcuucuugucuauaaaagucuagcuucuaaauuuaauuuucaguucuauuuuuaauguaaccauaaaaauauuaaaagauuuucuuugagagacugggugcagugggucaugccuguaaucccagcacuuugggaggccgagguggguggaucacuccaggaggucaggaguucgagaccagccuggccaacauggugaaaccccaucucugcuaaaaauacaaaaauuagcuggacaugguggugggcaccuguaaucccagcuacugggaggcugaggcaggagaaucgcuugaacccaggagguggagguuacagugagccaagaucacaccacuguauuccagccuaggugacagagcaagacuccaucucaggggaaaaaaaaaaaaagguuuuuuuugagauacccaaaauuuaagauauagccaaauaugacauuaauuuuuagguacuauuaaugaggacaagcccuuuuagcaauauucucaauucugugcuaagguguuucuaggaguauuucaguuaugaaaauuuaaaucuacuucaauucucuuuugaaguaaauauagcacuuuuuuuuuuguuaaguagcaggaguuuaagguuucaaggcaauguggaaaauugagaauaccagaaaaugaauccaaacaaaauuaggguaucccaaauucuaaaaaucuaugacucauauugugaauuguugggaggaguagagcugcccuaggcagcugcagguugugcauugcagagcuccagguggcaccauucgcuuagagugcagugugacuagaguccugaguagagcaaauacuaucugaagggaccagaauuccccccacguuccuucaaccuagguuacuuugugcaucauuuucagaaaaguuccugcuuuugaaauauaagaauggccucaagccaucaaaguggauuuaagaguauaacuacgaaaaaaaaagacuuuggaaggaagaaaauaccugaaaauuaggaggauuugacauauauugaucaaaguugugaacuuuuccguaaagagaaauuauuuaacaugcgauauaaccucauguuacucaucaguuuuccaaaaaacacuguauuucuagcaagcguuuagaaaaugucuaccugcagcagaauguauagcagauguacagcaguaaaaaggggggaguacuuccacagugcagaaaauauaagcuauauuucuagccuuuucucuuugagcuacgguuuuuaaaaggacaaguagcagcagagagcucagauacaaaaugcauguacuuccguguucauguaauuaguaauuauuuuugguucucuaauccuaaguauucauucaguguugucuugaccaagugggcaagcuauauagcauagcuucuauaucuccuaagagaucacugguauuuauccuaaauauuagguugguacaaaaauaauugugguuuuuaucauuaaaauaaauagcaaaaaccauaauaacuuuugcaccaaccuaauaaaugacuaaaagguggcuggcaaaauaauuaaaaacuaauuggguuuauuuaaaaaacaaaaugcuucugugauaagcuccaaaauccauucugagguuagaaagauuuuugcugcagauauguaagagcuccuauccuugaguguacgcauauguuuagcauauauagcauccaaaagauacaaauuuuauauuauuccuacccuggucauuaauuugaaggaagaucaaacaagauuagacuuaugaucuaaaauauuaaaaccacccauuagaaccauuuauucuaaaauauuaaaaccaucccauucuuuguaauaaauagcaaaggauuuaguacagaguuaauagugauaaggugucuugggagauuuuuguuguugccuuuuucuuaauauagugagcauucuuaaaauuugugguuaggaaauuuaaaagagauaccauucuggugugugcuuuucaccauuuuauuauccaucucauggagaauuugguuuaacuaaaguuagaguuuugcagaagaaggauaagugaguugagaguaugugcaagagaugauaaugaaggcccuuagaacagaaauugauuaaaauaagugaggacauuagugaaguggugauacaguaagaaagcaguaggaucagauuguaggucuugguggggucaaaggaguuuuaggauuggggugccagagacagugagcuggaaagagguguuaugggaaaaugggaugaucaaaacagaguauggaaggauacaguuauuggugaugacaaggucuaagguaugguccugggaguaaguggcugaggugagguuauguugaaggcuguauaaaacuuugguuucuagugugaaaaucuuagacuucugaggggaugacugagucuuauuuacuguuguaacucaggcacugugcuuguaacacuaacagcaauguuuacuaugcugacugacuuuuuuaauaaaguauaucaugaaggccauuucucagcaccauaagguugaauguaaucucaguuucuucaucauggauuugaaauuuaguauuaaaauuaacuguucauuauuaacucuuacugauuuuugcuuuaggacuuuguuguuacacuuguugccacuuuuuugugguuggugagcacuucagccugggcuaaagcucugacagauauuaaaauagcuacuggucacaauauuauugaugaacuuccgccuuguaagaagaaagcaguacuguguuacuuuggcucugugaccaguaugggaucccuaaauguaucugugguauguaugcauuauuuauaauuuuuuucuuucauauauuuguuuaaaguacuaguaauucaggaaagcaauagcuuucaguaaaucucuggaugguuuuuauuuuuacucagcuaccugaauucuaguaacaauauaguguuuagugaagaaaaguuugucuaaaaaaaguauuaccuguaaccaagaucaugauuuuauucaucucugagacuuucuuucaucuagucagauuuauaucugggaagauuaauuucuuuuuuuuuuuuuuuuuuugagauggaguuucgcuaugucgcucagacuggagugcaguggcaugaucucggcacacugcaaccuccgccuccuggguucaagugauucuccuaccucagccucccagguagcugggauuacaggcaugugccaccacucccagcuaauucuuuuguaucuucaguagagacaggguuucaccauauuggccaggcuggucaaacucccgaccucaagugaucugccugcuucagccucucaaagugcugggauuacuggcaugagcugccacacccagccaggaagauuaauuucuuugagguuaacucauugggaugggaaguaaaguugugugacuccucuuuuuuuguggcuacaacuguuggauuggaguagaagagaugguaggagggggugauaaguaaaugggaaaaguuacacaagcaguugauaaucauucuaaauaggagaaaagugaaaaguauuuggaagaguaaaucucuuagccaugauuuuauauguuagagauuuagccuuauuucauugggaauaagucauuauauaaccacauuuuguacauugaaguguagucuuccuuauuucucauuguguguaguauuaaacuuuaagugaaauaauggcguacuuccuaaaaauguuaaauauuuaaagaaaaagugagauuuuuaaguagggcaugaauuuuuauaaguagguauuugauuuucauauuucuuuuucucuuucauagauauuuggcuuucuaaauaugauacucuggggaggaaaugcuugguuuguguacaaggagaccagccuacacaguccaucaaauacaucugccccucauagccaaggagguauuccaccuccuaccggaauauaauuaaagggagaaauacacuguaugaaguauauguugauacuaugacauguugccaacaccuugagaagcauuauuuguuucuaauaaaaguaauggcuuugucaauauauugguggguuuaaaacuuugcugcuuuuuuacauaaagccugugccuuuccuagaaaguuaagauguaaauguauucucacauguaaauuugaaaguucaggggucuauuaugaaaugauacacauuuuuaaaugaaccauaauuuuuuucacuaagcuguuugccuuccaaaguguuuacaccuuaagccuuaacauguaucuucauucagaaaacaguuauauugucauaccauaguaggaagaaaaaccuuuauuuggaauauacacuacuguaaguuuguacagaucauauaccuaccaccugucuuugcuuaaagagccuugauuacauaaauauguaggaaaaaacauauugaguucaaaauuuauaucuaacauuguuuauguuaugauuuuuuuuuaauugcaaagacuagguguauauuuuuuucuguuuuucuaaaugacccgugguacuuaauagguguacuaaaauuguguugggagcagggauuuggaaauuucugagagauguguaguuaauuuaguaauucuguuucaugagauaugaucuguuaugcuagugguuuaauaggcuugcuauguaaguagaacguggcucaacuagauaucuuuauauguaugggcauuacucuuagugauauuuguuuccuguccuuuguugcucaugcuguuuaagugcaggcugagacccagccucuuuguaaguacaguaaaauaauccaccguuuuuuacagacccuagucaaaggguuaaaaaaauuaagauugcuuuccauguuugaaauuuaccauugagagucaaugaaguugcuauuuugaguuuagcauugauauugugaaaauaagugcaauuuggauuucauguuucuuaauauucauucuuguuucacaaaugaaugauuaaggaauuaugcaucauaaaggaaccuaagugagguauaugaugaguguauugucuuugcacacacauauagguauauucugaauacaagcuuauucacauuuugcuuccuaaucuuuuuguuguacagggauucagguuucuuauucuuacaacaugauuguuuauaugugaagcacaucuugcuguugccuuauuuuugaugcuuuuauucaugacaagaauugucaauauaagaauguauaucuuuuuugcaaccaauuuaauaaaggaguugaaagaaagagugcacugauuguuaauauuacaaagaaaccuucaucuuaaaggcauugagcagugcaaaacagaacugauuuucaaagcaggaaauagaaucacaguuuuaauguuuggcaaggaauaaaacagacagaaaugcuuuggagacuaugguucuauccuuuuuucuuccgaccucauuuagaaaauacuuauuugcaacucuuagauuguuuuccugauauaccuuuucucauuaauugucuaauuaacuagcaaagauuccugcuuaagagugugugcucugcaaccgaacugccuagauuugaaucuugucuacaccacuuacuagcuguuuaacuguaggcaaauugcccucugugugccucaguuugcuuauguggaagucggaaauaaaguaaguaguucccuccuguuuacuggggauauguuucaagacccccugggaugccugaaaccaaguguaguaccaagcccuaugugaacugucuuuuuuccuauccauacaugcaccuauaauaaaguuuaucaauugagcacaguaagagauuaacaaggacuaauaaugaaguggcacaauuaaaaccauacuguaguaaaaguuaugugaauauggucucucagaauaucuuacuguacuguacuacggggaacugaaacuaagaauaguuaaaccacuuuccugaucucaguguguuuaugauuuaaaagugaauuaacaaauguaaagcccuuagaacaguguuccgcauuuaguaggcacucuauaaauguuagcuacgauuacuaacuuuugauagcaucugauauagagauucuuaaacuaggaauucauggggcuggagccguuaggguggugguuuuggacaaagagaggauuggcgucaggcuuucaagcuugucccuuuacaauccuuaaagaguucuggaucuuuugguguguuuuauuuuucuguugguugacauucauaagguuaaugagaucaaaauuuaaaacuuaaaaguauugagauuaaaguagaucuuaaaaggacuucuauugccuuuucccuuugugcuuuugaaucaacauuacaagguuaacccauuuauaggauaauuuccaggagagaagcaauaaaagcuuuacuuacuagguguuagguuguagagaauuauuuauaaaaaagaugagcauuacuaauguuuuagugaacagaggucaguugaauagauguuuaaccuacuguaaauguuaaaggcaauauugcuuauguuucacauuuaaaauuuuuucauauaguauuucagauuaauagguaaguauacaaaauaauauuuaacaaaugcuuuauuugcaucagauguuuguuuguugagacagggucuuacucugucacccaagcuagaaugcaguggcgccaucucagcucccuguuaaccuccaccugccaggcuccagugauccucccaccuuggccuucucaguaucugggacuacaggcacgugucaccaugcuugguaauugaaaacauuuuuuguaaagacgaguucucacuauauuacccaggcuggucucaaacucaugggcgcaagcaguccuccugcgucagccucccaagugcugggauuacaggugugagccaccucacccagcguugcaucagauuuuuuuuuuuuuuuuuuuuuuugagauggaguuucacucuuguugcccuggcuggagugcaauggcgcgauuucagcucacugcaacccccaccucccggguucaagugauucuccugccucagccucccaaguagcuaggauuacaggugcucgccaccaugccgggcuaauuuuuuuauuuuuaguggagaugggguuucaccauguaggccaggcuggucucaaacucuugaccucaggcgcuccacccaccucggccucccgaagugcugggauuacaggcaugagccaucgcaccuggcuuugcaucagauuuuuuuuaaaggaaauaaaacauuacagauaaagccuuuuccuuacugagguaaaguuacauuuuuccuaccuuucacuauuaaaaauagcacacaaauauucuucugcagugugugaaggcuucucuaagaccuaucacuagaaaugggaacuauuggaaugugagauguucauguuuuccauuguaaccuagguauuccaaauuguucagcaaaaugucuguaacaaguuagucucccaccagcaauaaguaagauuuccucuugcuccauauugccaauaacuugauguuuuuggacuauugccaaucugauaaguuugaaauugugucuuugaugcuuuaaaauuuauguuacucugauugcuauuuagguuggugguccuuuccuguauuuauuggccauuugguuuccaccacccuguacugccuauucauauccuuugcaaauuuuucuguuuggugcuuuuuccugcugaauugacgugcucuuuauguauucuugguauuaaccucuugacauuuauagagguugcaaauaucuucucucuguuccuggcuugcauuuucacuuugugauuuuugucauauaaaaguucuuuauggccggggucgguggcucacaccugugaucccaacacuuugggaggccgaggcaggcggaccaccaggucaagagauggagaccauccuggccaacauggugaaacuccgucucuacuaaaaauacaaaaauuagcugagcaugguggugugugccuguagucacagcuacuugggaggcugaggcaggagaaucgcuugaguccaggaggcagagguugcagugagccgagaucgugccacugcccuccagccugguggcagagcaagacucugucuccaaaaaaaauaaaauaaaaaaacaaacuuuauuuuaauauuaauguaaguaucuucuu

SEQ ID NO: 17018 - RNA, 55928 nt, Homo sapiens
cugcaguccgcgcccgcccgcccgccggggccgcccgccugccggggaggggcagcgcggacgggcgagcgccgcgugcgggagagcgaaggcugcagcgcgcccggcagccgggaugcagcggcgccgcccaagccuggggcgcaggggucggggcacacggggauaggcccgacgcggggccgaaggaaggguggucuuucccgcagaguugccgcuggaggaccgaaaguuuugcaggcagcccuugcuuccagcuugucgcucucuccccgcgucccugucgcccaacgcgaggcgcccccgcuggggucccgacggcuugguggggaggagccgugagggguugcgccccccacccccacccgagccagggaagggacccuggugaccucgccucccagcccucacccccgucaccccuuucuucucuuuccuggaggacuuuggaccauggagauucugcaguuguugcucuaggagcugaaaccaguggguagaugucguucugaaacgcaggugaguuuggagcgcuacgagcuaccuucccaucucaggcugcggggcgugcaaaacucaaaaguuagggcccccggacccccggguuccccgcgcggugcguaucuccggcucucagagaaccacugcauggacuuugcuccagggucagcagagcgggagggcgaauuuacggcucuuggaagacgacgcuaacgggccuagccccugagccguuuccagcgcucccugccgugagacgaggguggcccggguuugcgcaggcaaccuuuggccaggaaucugauuccugggagaauucacuucaggcuuaacugcucuagccagcuagaaagggagcgcuagauuuccucuggauuuuggacguugggugcuuuaguugagauuuucacccuuuaaagaaggcuuuaaaaagucuucuguuacuucuuuuuaacaaauccuuuuguuuacuagaauuaucuaaacuauauggacaccgcccucaccccacaagcgacauauuuuuuuuucucuuucgccagcacccuuuuagcucucaccacugcuguuucccaaguugucacagcugaagcgcacugauuggaaguugcuuuguacugacugaguucugcccuggcugaaccaucuaauaauuucccugagcuuggcacccuguaucgcuaagccaguguuaggaugggcgaugaaggaggagcugcggauuugccuuuaguugugauguuugugugagucggcuuguuugugucagacucagauaaacugcauuugccuuugcucucuuucgaagggcuccuacauagcuaaggugucgcugggugaagaauucccauuguaagaauuggugguguuaacaaauauguauuacuuguugaccucuuguuauaugcuagacccugggcuugacauuuccuuccuuccuuccuuccuuccaucuguccaucuuaagucaaccaauauugccugucauggaacagcugugcccuccugucaggagggaaagaugagugagacccauccucacccucacagagaugcagucugguggucucuggaagaaggaaguugugaaacuuaccgauuccuugggaaaacaggcagguacacagggacuggccugugcagugggugggguggucucucagcugugccaguucauagaggaaccgaaaucuaguuaggagugaacagaaacugcguaacagaagaugggcucugcucugcaucuuggaaauugccaaagauuuguaaugguaaggugaagacuggucuugcggagggagggggaauaaugguauuagcagaggcuucaagcugaguauaaacaugguguguuuggguguugagcaugguuugccugggauggagaauuguuacugggggcuugggggugaugcauuuugauacccaggccuggaucaaauuauggaaggcaccaaacggcagccuaaagagucuggauuuuguuugacaauggggagcuacugaagggcuuucuguaccauaaagauaaguuaaaagugugaguuagaaagauuggaguacggagccugguuagaaaaguagugcugcaauauucauggugugaagagaugaaagccugaacuuugguggugcuaugcagguagagaagaggagacaggugugagacugugaagagagcaccugaucagagggugugcuguugggcuagauuuagagguggggagagagaaugcgagagcucugaggcaugaguaauuagaugcuggaacacuuucccuuucccuucugcuucccuauuuucccucuauuuauuaucuauuuugauguuuauuccuguguuguugugcaugcaaggaagguguaggcagcagcuaauguggccccaaaggucuguaccuccugguguucaugcccuuguguaauccucuuuucuuuagugugggcuagacuuagucacuugcugauaacaaagagaauauagcaaaaguggugggaugucauuucugagguuaggguacaaaacugcugucacuucuguugcucucacucucucuugcaugcccugucuugcucuaagggaagcccacuuccauguuguaagcugccuuauggagaggacuguguggcagguaacugagggaggccucuggucaucagccaguggggaacugaggcccucaauacaacagccagugaggagcuuaauccugcuaguagccaugugagugggccacuugcugggagucagugacuugagcuuccagaaugcugucuccucuucugggagcuacuguaaaccacucaaaaaaaucaaagguggcuuaucaucagaagucaggacaccucaguuauagugaagcaaaucagugguuccauauuuuaacaugagcuuacuuucccagcagagucugucaaguggagguuacuacacaggaccuugaagagagucugacagcccaaauauuauuuccuucuauuugggaugauuuuacuccacaguacgguaaauugugggcuagaaucuaaaagugauuuagcaucucuacaaaagaagacuucacaggcauugccacauuuaauugauaacagaguaugucuacauuguugcaguuaguuauggaguauaauuguagaguugcuuuacucuaagccuucuccagucucuccauugacuauagacauaauaauacugacuuguugaaacuauaacccaucuaugacuguguuggauaacaugacugucaaucaaauugcauaacugagaggcagagaauaaagaaagcaucgcucaucaaacuacuagacauuuacacuugacuuuggaugaaaauugaggucaguuggaaguaguguucagguuuacaugcuguguauguauuauauacauaucaauacucauauaucaacuauauauggugaucgauuuauuacagaauugaauuccuuuugguaguaaauaauuacaaaugcuguuagaggcaacaagaaucuaauacauccuuaauaaggauaaagugaccuguaaaacaguaauuuaaagcauauuaguauaaugucuaugugauaaaacuaucuagcaaaggcaaaacacccucuuccccucaugauuaauguuuaggaagaaaaaaggauguaaauauuuuuauuguuuuauuaucuuucuuaggaaaaugacagugugguugguuuaauuaaaagggagagucucccauagaccaaauaaagaaaucuguucuguuuuaaugacaauggaaaauaccuauuuaacuugaauaacaccugguucuguagaaaugugcaucuauuauguauccugcauucacuuagucugauucaugugcuguuucaccacauuacugaaaagaagagaagagggaauguuagcucucucauuugaggauauuaaacuccugccgugguugaggcacggugugagcacccuacuuccuaccuagacuguugggaguuaccuggaggcaaugaggagaaaaugacauguuccauuagaaugaggcaucccuggaauuauuugauguucuuugccuuaauugaauccaucugucccaucugccacucuucucucuaaauuuauuucccuaacccuuucucccugagaauuauaauuugggggaaauuuguuaccuacauuguuaccuuuuauaaaagcucucggcaucuggagggcaggugugccuucuacucugccuugcuagacaacuuuaccugccucuuuccugccccuugcaggcugcuggauuaaaaacaggacuggauaaaaggcccccaguagcaacaggagugggaacgaaaauagaaauuccaggcuuuuacuuauugguuucaauacagagcccuagccaugugccaggccuggcuaaccguggacucuauuaauaaauauaacuacacaaacauuugcauucugacugggucagaacagccagcacgggaguguguuaucucaagggaaagcugucuuaaaacucuugacugauucaccugugacuuuggccaguuggugcucccuggaacugcucuggugcugaagguugaggucaucucuguuccccagaauguggcagauccagccccauuccugaccacuauccuuugcaaggacgagacaggagagaugauagcuucucuuuaggauucuuguagaaaucacuuuuggcccuuaaccuacauauaaagaaauuuaacauuaauguacacauauugauuugagcaaagcccauccauaucuccaaaccuaccauuuacuauggugcaggaggcaguacaggguggaggccagagcauaggcuugagaugggcagguaugaauuagaauugcccuuuagucauuugcuugagaaccugccuugauccuucugaaccucaggcuccucaucucugaaauggguaguaaagcucuucucuugggauuguugugaggauuaagugagauucuggauacugagccccaggcauagggccuggcacacaguggacagugguucaauguucacugugaugauuacuucaguuucagugcaucguuuagacagcagcugccagucagagacaggcugacacugaccuaggaguagcuccucugguugcuucugacagacauccuucugcuuagaaaggaaacuuaaagcacuucucucuuuuacacggagcugcuggccugcaucaguuauguggaggccucugucugaaaccucugcccaaaaccuccucuugacauauacaucaugguaauauauaaauauaccuuuauucaggaaagguccuaaaagaccguuugcuaugcagagggacugcaaaauccaguuugguugcagacaaaacugccuuugcaugaugagguaaauaguugucuuaaaacuaaguagagugugauuucugcuuguuauuguuuucuuugaaaaauuuguuucuuccauaaaagaaacuugacagugaauuuugaaaaucaugugauauaguuuggcuguguccccacccaaaucucaacuugaauuguaucucccagaauucccauguguugugggagggacccagggggagcuaacuggaucaugggggcuggucuuucccaugcuguucucgugauaguaaauaagucucacgagaucugauggguuuaucagggguuuccgcuuuugcuucuuccucauuuuucucuugccgcugccauguaagaagugucuuuugccucccacuaugauucugagaccuccccaaccauguggaacuguaaguccaauuaaaccgguuuuuuuuuuuuuuuuuuggagacagagucuugcucugucacccaagcuggagugcaauggcacaaucuuggcucacugcaaccuccgccuugcagguucaagugauucuccugccucagccucccaaguagcugguauuacaggcauccaccaccacgccuggauaauuuuuguauuuuuaauagagaugggguuucaccacguuggccuggcugaucuugaacuccugaccucaggugauccacccaccuuggccucccaaagugcuggaauuacaggcaugagccgccaugcccggccuaagccucuuuuuguucccaguuuugggcaugucuuuaucagcagugugaaaacaaacuaauacaucaugaauaaacauguucuccucaugagauaguaaaacaauagagauaagggagaaauauccccuucaaauguggucacuccuguacccccaggucuaaaggcauuuuucauaccauuuucuacacauuuaccuacgguauaugucugucauuauggguguagaugauauugcugugugcguugucuuuuuuuuuuuucuuuuuaaugugaauaguaucacuucacggacauuuuucuguaauuuucuucuuucacacgugcuguuaaauguuauuauguguggaaauaccucauucuuuuaaacugcuucaugguauuccauaaaauguuccagggucuauuuaucuguuauuuuuauucuuauuuauuuauuuauuuauuuuucgagacagagucuugcucuguugcccaggcuggagugcaguggcgcagucucggcucacugcaaccuccaccucccgaguucaagugauucuccugcuucagccucccaaguaguugggauuacaggcaucugccaccaugcccggcuaauuuuuguauuuuuaccagaagugggguuucacuauguuggccaggcuggccuugaacuccugaccucaaaugauccacccaccuuggccucccaaauauuuaucuguuaaguugauagacauuuagguuucuaguuuuuaugaaaaauagguagucaacgucuuuauuuuuauguauguuuccugggcacgugaggaaguauuacuacccagaaauagaauugcuggguaugugcauuuuuaauuuuaauaguucugccagauugucuucugaaguagcugaguaauuuauacuuccacuagcaguacagagaugugcccauuuccuuaauuaaugcuccacauuuucaaaccuuuuaaauuuugcaaauguuaugaguaaaaaaaauuugauuuguauuucccucauuugugguguguuuuugagcauuuuccucucauguucauuguauuuguacucuguaaauugcuguuaguauccuuugaugauuugucauugguauuauuuagagcugcuuauugauuuguaggaauucucuauguauucucgauuuggaucuuuucucuauuuggaaacaauguaauuuuccaccuuguugcuuuucuucuuuugaccuuguuuauggcaucuuuuccacacacgcuuuuucuccccuuuggaaauagucgacauuucaggcuuuuccuugaggccuuuuguuuucugugucuugcuuaagaagaccuucacuuccucaaggucauaaaauaguuucuuauauuuucucuuuaugcuuuauagguguuugguuuuuuauucagaucuuggaucuuuugguuaaugaugugagguaaaaaguuaauuuucaaucuuuuuccaaacaguuaccauuuauccugagaaccauauauugaauaguuuauccuuucuguagagaucuuucuuaugcuuauuuuccaaacaccugggucuguuucugagcucuuuuucuguucauuguuugaacuguuucuuuuccugcaccaauuaauuacucuucuuuaaauaauaugcuuuguggucuacaaaaaaucuuuuucauuauagauuuaguaaauucuaucucuaaaaaauuauuauuauuauuauuauuuuuauuuuuuuuuuuuugagacggagucucacucugucgcccaggccggacugcggacugcaguggcgcaaucucagcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccaaaaaauuauuuuuuuuaauuccugggaaguguguuauacaugacauuguucaacauuugccaugucuagaagaucauaggaaacagagccucaccucaugcccacaggaugcuguaaagaugggcccagcgacuacagccaccucggcucuuggugaagcuuccccugagaugauuuuccaagacaaauaucucagacuuggggaacugaauuauugagagauauugucuucuaaguuucuaaaaaggccaaccucuguggguggugguugggaauuuucuugaaugauguggacgcucccagcuguccgucaggccagaagggagaaaguagagccauggaaagugaaggcuggaggagagggagacagcagaccugagacagggcauggaaccccugggcuucccagaggggaagggacugaaggucucccuggguggugggagagaagcagguggacccugugggcugggagcugggccaggcagcgucuggaaagaggaccugucuggaaugaccaaggugugacucuggaauccuucaaauccaguacccaguuguaagguuuucuguguugucauuucuuuuauuuuacccaaguuuuuauuaaaugaccuagccuucgauagcugugcuaugggaaacuaaauuaugaguugauacugcuguaggagccacaacaggaaggcugcaaguauccagcuucaugccagcccugugugguaacagcaccauuauucaagagaagauggcaaugcugggaaccuggcaggcagccaaguaccaagugagcagagggggaugccugagcugugauguuguccuuaacacuuucccccagcccuaccuuuuaauacccugcaaaggaggaaauccuggaagugagagaccagagucuggguuuuauuuauaugacaggaaguagaagcuagaaacuuuaaggucacagaacacccauaguagaacuuaaaguccaggucuccuuuggugggaggccagcuugcuguuucccaagaaugaugcuacggccauaaauuugaauuucuguguaggccaguguuucucuacugugggcaguuuugccacccccucgucccagaggacauuuggcaaugucuggagacauuuuugguugucaugacuggggggugaaggugcuacugauaucuaguggguagaagccaaggaugcuguuaaacuuccuacacuggaaugcacaggacggccccuaccucaaagguugaucacguccaaaaugauagugaugagaucgagagaaacccugauguaggccaguuaauuuuagguuuucuuuuuuuuuuucuuuuucauuccuggauaauaaaugccuaacucucaccaacuaccuugccaucaugggcuucuucgaucagaaaucuaguaagagaguauggugggggcugcgagacccaucaucacuaccaaaaaacaugaagucuuuucacuuucaauaugugaagaccuaaauuauguaauuggaugaaugauauuuguagagucaaagagaaugugaguucuccgucuuauggguauaguuauuauguaauaaucaaguaauguggucuuuuauugucuuaaucuuucacaaaccauugcuuuccuacuccaauaggaagccugaucagauacuagauagcucuuauuauugccaauguauggaugaugaaacugaggcucagagaggaaguaaaauaaagcauggcuccccccuacugguuuacuauauuccaaaguuauuaaacaccuggccagcacugcuguguagguuguacacugcacaauugugucccuucuaaggagucaguguucaaaucacagacaucagagauuuauuaugauaauuuuucuggcagauggcaguaaaguagcuuauucuaacaaaauugggaauauaaagacuauuuucuaacagauggaaguaguuuuuugaagcaggugagccuuuuccugaugcucacucaggugcuagauggacuagcagaaagaauggcgucauugaugucccuuuguauguguuaccaguucaucugggaauuuuacuuuuugcuggaaaaggagucacccucccuugccaaccacaugugugguuauacauugguauugcagagugaugccauuuacaaguaauacauuugaguuggcagauuucccaagguuucuuuuguauaugagaaacauagugccuugggucauggaauaaauauaagagccucgguaucuaauuuugguuguucacacuucaguuagggcuuaagucauccuaagcuaggcuuggaagaaagagacauugacauuuguauuaguuuaauaaauuuggcagcagggaggugcaaagaauguuauuucaauuauagauugacccaugauugauuuagcaacaugcguugcuuagguuguaaucgaugccaaguaauggcagguucuggacucuuaggaaggugggcacaaauguuggggaauugaucaauggaugagcuccauauuggccuucuacagggagaauaaaaauacaaguaaaauauuguaagaugggagugauagcauugcagauguuaacacagccuguccaagcuuuuauccuuuguaccuacgcagccauuuuuuuuaacacaugggacacuauucuucaacagauuuguucucuucuaaguuuguucugaaucuguagugugugucauuucacgguguuuuaaagaggaaaaggccuugcuucaguugagaaggcuuugauuuuuccaccuacacaaauacccuggcauucagggaaucuggcuaauuuaaaaaauuaucucuuauaaugccuaguuacuaccccaguucguguuggagguggaguauacaaaggaauuacaacccccacuuuauaaucgggauaagagagguugacagacuuaccuugccuggcccagugccaagugccacgugguauagacuaagaauaguugcuucucacgaggagcuuauuuaguuugggggagauugugugcaaucaauaauuaggaaacaggauagccugugagaagaugcugaucugaugugcagguaggaaaugucacaggaggcugagcagcacggauggcuguggugggcagcaaagucucaggagagaggagaaacuugagccccgcugugaaaggcagggaggauauaaauagcuggugggcagagugacccaaggcugaaggaugugaauaguggccaucuuaaguaagagccucaggucacagagauaacaguucccuguauaaagaccuuaguggaaaccaggugagucucaggaaguuuggaaucaagaagacuuuaaaagaguugcacaguguuuccaagauuaaaaucugcaaugugacauaguauagcuaauaauacaauguguucuuagucacaggguauauuucuuuuuuuuuuucuuucuuuuuuuuuuuuuuugagacggaguuucacucuuguugcccaggcuggaguguaauggcgcaaucucggcucacugcaaccucugccucccggguucaagcgauuuuccugccucagccucccugguagcugggauuacaggcaugugccaccacgcccagcuaauuuuguauuuuuaguggagagggggguuucucuauguuggucaggcuggucucgaacucccgaccucaggugauccgccccccucagccuuccaaagugcugggauuacaggcaugagccaccgcgccuggucuuaagugguauauuucuuugagaaauacuuuuuaucaagagcaaaucucuaaaauuagagcucugucgauccaaacaagcuaauuaggugagaaaaaugaacuuuucaaaauccuuuaaccaucugguuggcauguuuaaaaacuacaaccaaucauacugauaaaaggguagucucuacauuuguggccuacccuugaaagcuccaacacugggucguuuuuguagacagaguauauaaaauuuucauucuaaguaagcugaccaaacagcugagucugccuaggaaguccuggauuaugcuacuugucccaguaaaauuauuaauagcuuccccuuucagaaucaaaaguguccugguuuagaugauaaauuauauggcuacccuaauuuuaaaugaugcacuuuagucuuuuuuguuuacucugugaguugucaguggccaaaaaagauguuuccagcuuaagaguauuugcccacaugugaauccugucuuuaugaaauaguuguauuuuuucccuugcgcagaaagcaaucguugcaaaaaacucagaaggaauugaaaggcauaaauaagaguuauaagccuauaaauaaguguuaauauuuugauauauauauauaaugccacgcauuaucaauaauauauuuauauaccuuuagauccccaaucuccaaaccaagccaccuuauauauauuaaauaucuagaacuauaugauaacacagccaauauagaucaauauaaucacuuuuuaaauaguugcuuuuagagacuauaauauucuagugauugguucuuaaacuauaauauuuuuaacuaauccccaguuuuggcuuuuagguuuuucuaauauuucuauauguuauugacagugcugcaguaaauguuguguguagcuaaaucuuuuugcacaucuacgauuauuucuuucucuuucuuuucuuucuuuuuuuuuuuuuuuuuuuagauggagucuuguucuguugcccaggcucacugcaaccuccgcuuccuggguucaagcuguuccccugccucagccucccaaguagcugggacuacaagugccugccaccacgucuggcuaauuuuuuauuuuuuauuuuuuuguaauuuuaguagagacaggguuucaccauguuggccaggcuagccucuaacuccugaccccagguaauccaccuaccucagccucccaaagugcugggauuacagguuugagccacagugcccagccuaugauuauuucuuuaggaugcuuuucuguaaauggaauugccaagucaaaguggaugcacauuuacaauuuugaaauugccaaacuuugccaggguguaugagaauucccauuuccucauggccucauaggugcuguauggaugauucuuuuucaucuuucagucugaggagagaauuucaucuccagcuuguuucaguuguaucucugcuuauugaugauuuguauuucauuuuuuuguaaauugccuaccuuucuuuuagaguguucaccuuucucuuaaugaauugugaaagcucuuuauauuuuaaauaaaauaccccuuuauguuauaaauugcaagauuuuucccugacuugcuauuugucuuuuaacuuuauuuaugguagauuuauguguauacagauaagguagauuuauguagauucagaagucuuuacuuuuuauacaguuauaucuaucagucucuuccuuuauagaguuuuguacuuuuuaaaaggaccagguuugcaacaaaauuaaccugugaaacuuuuacagucuuaucugaugcucuaaaacccuugaucuccuuguuucaaacuuuauaguaugggcauugcacauaggugagauaauuuuuguuuccauuuccgugguucauuauauccuucagaagggguuuaggcacuuuagaaauucacagauaagucacugcaaguaagaacuagcgaugagcauucuuuuccucaaccacaaaccacacgugccucuauuuguauaauagaaggcuauaaugggagucaaagggacuaguuuguugagaauguugcugaauauaucauguugucccauugaugugcuuuauaauugcacugauguguuuuccagaaaacuguggcaccaacccaggauucuaauacauagucaagaaaaugcuacagccuguuguagcucccccaaagcaagcagcucuccauggaauggcguccccaggcuucacaccauggucaggagggccugccccacaagugcacauccugcucuagcuaggaccauugugccugaguuugcaucuggguuccuaugcuggugugcuggcuugaaccacaugugaaucucaaccccuucuuugucuuugaagguagauacaucaagagaacuccaucauggguggggugucuuggggaugagcaccaaggagugaauguuugguuuugauaaggaauuaugaaagagcaauaaauaugcuaacuguagaauaaccugcuccaacagcagagaaccagguuucugauccaacucugggguccagaccaggggcuugagaauaguuuuuauuaugaaaugacccuguuagggguuuaauuggccuccucccaagaugcuguacuuuuaugugaagugcaucaggggucccuucuauuuggagaagauaaacuaauuuccuucugucuauccagugccauuuggucucccucucccauccuccuauucaguagccaaagaacuaauuuggcuacaauacaacccucuucagagugcuggggagagagagaaaucaaauaugagcaaagcccacacccucuguagugggcaaagcucauuuguaaauaauuuuagucuuguugcucauucaguaauucuguaucccucccaauagguauuggcagcgugucagauggccaccaguuaugaagagcuuccccauuuccgaaacccccuagcuucucaagggucugugaacuggggaaaccaguuaugcuaaaggagucauagacccauucuuuucucuuuuugagggcugggguggggaaugguagaguggaacaacaucuucuauucaucuacucauucaagaagcauuuacagagcucuccucuguggcaggcccuacccgagagguggaaaagagaaaucuggacacaucguaugucucaguuuuccaaaggcauuucacaaaaugaguaauaaccucuguugggcugaaugguggccccugaagauaucagguccuaauacuugacaccuaugaauguuaccuuauuugguaaaggcuuuguagaggugauuaaguuaaggaucuugaguuggagagauuauucuggauuagccaguuaggcccuaaaugccauuaaauguauccuuguauaagaaggagacagagaaauaaugacacacgcagaggaauaggcgauguaaagauggagcaggaaagguuuaaagaugcuagcgauggagauuggagugaggcagcuacacacugaggaacaccgcagccagccggaacuggaagagguggggaacagauucucccugcagagcugcuggaggagugaggucuuuuggcaccuugauuuuggcucacugaaacagguaugggacuucuggccuccagaacuaugagagaauaaauuuguguuuauugacuccuccaaacuugaagaaaauguguuauacaguagucccaggaccauccuugcagguaaaauggagacgugggucuagaagacagugcaaguaggugucaagguauuugaccaacucugucuguuauucagucacaugggaaauacugacugacuacucaaaucuacagugcuucaggcacuggagcaguggauaaggcagacaauauccccacugacacugggguagggggaaggagcagcuaauaaauagguaaaugaaaaauaugaacaagguaacuuuagcaauugacaagugccuuaaagaaaacaaaacaggauaauguggaauggcggacggggauccuuuuagacuagguaguaggaagcccuuucuggugagaaagccuuggagcugaguccugaagaucaugaaggagcuaccaucuggagggagagcauuccaaguggaaugaguggcaaacacagaggcuuugagaugggaaugagcuuccugugugugagaagcaaacagaaggcccagaccccucuaagucaacagggauaucauugcucagggagggcugugggauucuguccuaggcucugcccuguacaauuuucauuuuuuauaauuaaauuggaagaaaacguaaugcaucauaaaugugcaggcaauauaaagcuuguaggauguguacuggguuagagucagggguugaguuucaaaauaccuugacaggcaugaacaaaacaaugaacuucagcagggacaaacugugaaguccugacuugggucugagaacaaguauuugccuaagucaagaaugggaaccugauuugagugcgguacuggugugaagucccugaagcugagugucagcacguagcaugaugugacugccauaaaaaagucaagcacuuuuacaacuuuuuuaaacugugggguacaacuccagggaggaaguagccaggggucuguuuguggaggacugaguggguaucacauuuuauggggucacagaaacagcucauuauuuguuuauucauucaauuaauaaaugcuuaaugagcacauauuaugugccuggcacugacuaggcuuugggguaaauaacagugaauaggauggaaacauuugaugacuucauagagcugacauucuagggagaagauagacauggcagauuuaauuauacacauaucuuuuucacuguauuagauuuuuucagauuauaaaauuauaguaauaaaauagcaauaucaaauauuacugaaauacauaacauaggaaaaaauaugcccugucaauucauccucccuccccagacguagccacugucaaccaguuugugcacguuuuuguaacuuuuaaaaauauacaugcaauguauuuuuaaagcauaaaaggggaaucauacacgucugaauuuuguuuuuuagcuucauauaucugggauauccucucacaugaacacaaggaaaucuaccucauucuuuuuaaugucugaauaauauuucaugcuauggaugcauuauaguuuauuugacuaauaucuuguugaaaugcauaccguuuccauuuucacuauuauaaggauuugcaaacaauuguucuacauaccuuuuuauauagccuguggucauauuucuaaagcacagauucagagaagugggaauacuggcugggcgugguggcucacgcuggcucacuaugacaucuguaaucccagcacuucgggagggugagaugggcggaucaccugagaucaggaguuugagaccagccuagccaacagagcaaaaccccgucucuacuaaaaguauaaaaaucagcugggcguggugguguguaccuguaaucccagcuacucaggaggcagaggcaggagaauugcuuggacuuaggagguggagguugcggugggccgagaucaagccacugcacuccagccugggccacagagcgagacucugucuugcaaaaaaaaggaaaaaaaaagaaguggaaauacuguaucaaaagguauggaaaauuuaaaugauagauaccacguuucuuaccauucaggauguaccucagugagagugcagaugagaucacauguuuucuugcagccucaacauuccaggcaguguagacagugcaaagguccugugguagagggaaccugguguaucagcaggacugaacagauucccuaggggcagagagcagagagccagguggggagugaagagggaggcaugggccagaccuugcagggccuugcgauucaucuugaggguuuugguccuuaucccaagagaaaggagaagccaaagggaauuucaugcaagcugacaugaugagauaggcauuuugaacagguaccucuggcugcuguacaggcaauggacugggaagauggaaaaguagaugugaagagcaccugggguagcuauuuugggaguccaggugagagaugaugguagccuggacucggguggaggcuggccauggagaggaguggcuacauuuaaccguuuuuuaggccacagaacugauggaagcugaugccuaagugggcuuagguggggacugaggaagaaggcaguguccuggaagaaagauggaaugggaguuaucauugggaugaugagaugucaaaggagcaggugaugauuggccaaaaaagugaagauccagaggagauaccugcuuuagagagcagccuuugcacccuugucucucaugcccgcagcucuaucaaaggcaggcugaccaugggauucugccacccuggccacagcugauuggagugggaaaguaccugagccguggccauaacguggucuggagugaaagccugcccaugaaggggcagugccaaauggagcugaugagauguccuucauggaguuugaaggagaacccaagugaguggcaauguuuggagcuggggagucagaagaaaggccacacaaggagagggcaggaaauggaagucguaaguuaaagucacaaggaaacaaggagagaagagagaagcaggugcaggagaaggggcugaagacccauauagcgcuagagagggauggaugaccucuguucccaguauggcugaaugcuuaagagccagucuuucaagcugagcagaucugaguuugauuucccaccucuugugcuaacuagcucagugaccuugaacaagccacccaacuucucuaagauuguucuguucauagacauuaaaguauuuauuucucggaguuguugugagcuuuaaagagaugugcgugaauaccaaagaagauauucacaacacaaaaccaccagagaacuggucuccagacuuuuuuaaaaaaacaaaagucucuuacaaaucaguaagaaaaaggcaggcagcccaguagauaaacaggcaaaauacuugaacagacacuuaacaaaagaggauaguaaaauggucaaaaaaaaugaaaagaugaucaacaucauuaauaaagagaaacacagugagauuccauaugcaacaauguggacgaauccuaugaacacaacguugagcuaaagaagcaagauagagaugaaugcauaaagugauucaauguauuuaaaguuuaaaagaaccaggcauuaaaacuccaauuaaauauuuuauacucucaucagagaggcauaugugaaaaaucggaugauaccaacugucggugaggauacaguacaacaggaaaucuguaugcugcugauggaauguagguuaguauaaccauuuuggaaaacaccuuggcauuauugaauaaaacuaaaaacaugcaugguacacaacccaguaauuuuguucuuggguguauguauauaagaggaacuuuucauauauaccacguauacauauacauauauguguauguauguguauauacauauacacacauacaagcauguccauaauuuuauugcuaucauggccucagaaacagugcaaauacccaucaacuguagaaugaguaaguagauugugauauauucacauaauggaguacuauacggcacugagggaauuaacuaugcuauagagaacaauaugaaugaaucuuauaaacacgauguugaacaaaagaaauaauauguauuauuuuacuuuagaauucaaaaauaagcaaaacuaaacuauaaauuauauaauauaguuauauauugauauuauauagcauagacuguugaggaaacuauaaaaaaaaguaaggaaacaaugaucacaaacaucagaguagugguuacaucuaggaagggaggggcccuggggccugaagggagugcucagagugagaggacucugcagugcuugagcauuuucuguuucuugacagaccagguaguuacacaaguguuugcuuugugauuguucauuauacuguauauuuguuuugaacacucuaagaguauuuuauuccacaauuuaagcagguuuuuuaaaaaaaaaaaaaaagauagcuaacacuuguaaaaugcuuggcauagugccuggcccauauuaagagcucaacagauggcaauuuuauuuacugguauaacccaguuguuagagccacauuguauccuaagcaaccuuccagcuccugaaccagcucuagucuccaugcggucuggcuuugagguugagauuccagaucccucuguuucccaggcuggccccaaauaaacccuauuacuuaaggcagugcuuuucaauggauaugugaugguuuauuuuauugccuuaaaugcuucccaagugagcugcaauguguaagauguuuuuugggagcauuucuguuguuauacaguucuggaaagcuagauugcuaauugagcaccgcaugaugugggauagagucagagucuagccugcugcaggucagaguucaggcagcagagguggaaccugauggcaauguagugccaaagaaaaaagaccuggguuucaaagacagaggcuaugagggaaguaaagacacacucaaauagcagucauguggauggggaccagaggaaucccaggacaauuguggauaccauuuuaagccuucaaguguguaaccccaaauucuagcauuccacagaaagagugacaaucacugauuuaagguaaucugagaaugucuauuccuugcaagccuaauaaagaaguuuccauuucauagucaucagaaggauuguuguaugcaauagcuaaugauaauacuagcuaauaauuauugggugcucaacagaagccaggcacugugcuaauauuucauucuuaccucaacccuaggagguagguacuguuaucucccuuucaguagauacagcugaggcacaggggaguucaguaacuugcugaaggucacgcagcugguaaaugcuagagccaggaagaaggaucauucuuagucucuaguucuagaagcaaggguguggcccaggguuuaggaguuagauggaaugacauuuugcuaacaguaagcaaaaacaugccaacaggccaauccaacauuggaauggggaguuuuagaaaacagcaaauucucucuaagcagcaugacuaucaaauauguuuuagaagagauuuuugcauuggguagcagguuggacuaaaugccuuucaagguccuucaaagaacccaagauuaaaaguuuagaucuugguagagcuucagauugggagcuggacuguaugcuuuuuauuuuuuuuuuaauuugaacuuccaaacuccaaugcauacccugaugcauaaacuauguacacuuuuuauuuugauguucaugaacuucucagaacucuugaggcaugguaaaauuauuuucccuaugugguuuuuuuuuuuaagucuuuuagcugacgguaguuguguagcaucuuucugaccagcaagaaaaugccuuucuaaucucuagaagagaaauuguuugcauaagguguucucccacauuuaugucuuuaauuucagacgagaggcacugaucuuuucauaaggacuuuccugcuacaccucccacaaauggugugugucuugugaacucuauagguguggcauugauaaugguguuugauaguguuugggcuguucagaaucugcccuuuauacugaaaugguaugucuagcuuuguuuccaggauuacagaaacuucuuuggucuauuuccgugacugcauucaguggagacacauuacuuucugcuuuucagagccugagaccaccuuccaggacaauggaggcauaugguggcauuucuaguuggaguuggcgcugauugagccuuugccauuacuuggcaaaauuaauuugguugugguugguuguuugacccggggguggcauuuuucugugggcagaauaguagagcugaguugcauauaguuguuuuuaaggucuuuggauaauaaccauuuuaaccaaauguguagaggcuuugaaauugccauaugugcaacuuaaguuaucauuucacauacaaguaguucauuaaauauauuaauugaguuuauugaacauaugcuuuuaaaaauagacuuuguauuuuagagcagauuuagguucacagcaaaacugagcagauaguacagagauuucucauauacccacccacuugcauagacucccaacuaacaacaucccccaccagaggugguacauuuguuagaguugaugaagcaacacugacaccucauuaucccccaaaguccaccauuuauauuaggguucacucuugguguuguacauucaguggguuuggacacauuuuuaaugacauguauccaucauuauaguaucauacagaguaguuuacugcccuacaaauaguuuguguuccaccuaggcauuccucccaccguucuaaucccuggcaaccuuuuuuuuguuuuguuuuaccuucuccaugguuuugccguuuccaaaauguugcaaaguugaaauuaacaguauguagucuuuuccaauuggcuuuuucacuuagcaauauacacuuaaguuuccucaaugucuuucuguagcuugagacagcucauuucuuuuuagagcugaauaauauuccauugucuggauguacggcaguuuacuuaucuguucaccuacugaaggaugucuugguugcuuccaaguuugggcaguuaugaauaaagcugcuauaaacauccacauccagguuuucguacggacauaaguuuucaacucuuuuggguaaacaccaaggagcaugcuuguuggaucguaugguaagaaucuauuuauuuuugugacaaauugccaaucugucuuccaaagugacugugccauuuugcaucugcaccgcagucagugagaguuccuguugcuccacauccuuaccagcauuugccauuguugguguuuuggauuuuggcuuuucuaauagguguguagggguaucucauuguuuuaauuugcauuucccuaaugacauaugcuauggagcauuuuuauaugcuuuuuugcuagcuauauaucuauauauagcuauauaaauauauauuuuuuauuucaauaguuuuugggguucaguugguuuuugguuaaauggaugaauuguauaguggugaaaucugagauuuuauuuuaccugucacccaaguaguguacccaauauguaguuuuucauugcucucccaccucccccuuaccuccuucugagucuccagaguucauuacaccacuguguauaccuuugcauagccauagcuuagccccuaauuauaagugagaacauaugguauuuggcuuuccauuucugaguuacuucacuuagaauaaauggccuccagcugcauccaaguugcugcaaaagacauuauuuuauucuuuuuuauggcugaguaguguuccauggggugcaccuguggauagccuuuccugaacacuucagcggggcugccucuccacaggcagcgugcccuccaguugcaggcuugcgcgagggguagagucacaauccaucucaacauggaacaucagccuuccugcagaugaaaagaggugucugucugaucugaauagcugggacacugggucaggagugugacuaggagguggaucacuuucaggggagcugagguguccgucccuuccuucugagaagaccuccgugcauuucacugagagcucccucagcugccucuauuagggcugggaccucuacccaucauuggguauugcauuuacccacuuugcuuuagccaccaauuuuuuuuuuuuuuuuuugagacagggccucacucucucacccaggcuggagugcagugguacagucucagcucauugcaaccucugccucccaaguagcugggauuacaggucuguaccaccaugccuggcuaauuuuuguacuuuugguagagacaggguuucaccauguugccuagguuggucucgaacuucugagcucaagcaaucugcauaucucagccucccaaagugcugggauuacaggcgugagccauugugcccggacaccacaaucgguuuuuaccuguggacaccuccccuucuggcuggaagcucaaccuguucaacccaguaaauaaagugcuagggaaaaaauuaaaaaaugcauacuacuggagaacaagauaagcuuugagagaccucugccauucugaccccacaggagacagugagcacauugcugcuacaaccagcagcugagaaagccaccauacaaagacucucuauaaccaaggaacucacacagagucuucaccccugaaagcaccaggagcagaauuaggugacaauaaacugugucuuuuuuuauaaggugucuauucagaucuuuugccaguuuuucaacuggguuguucguauucuuauuguugaguuuuuaagaguucucuguauguguuagguaaaauucuucaucagaugucuuuuguaaauauuuucucccagucuguagcuugucuucucauucucucgaauauacacuccucugacggugcucuguuagauguuuuaugggcacagaaauuauauuuagcacggaauuucucccuuucaaguugcucucauucuuauuggcaaauaccuauuuccugggugcagaaagauccccauugcuguuuccuauuggcuacucaugaagcuguuaaguggaucgugggagcaguaaacacuccagauaauuuguuuauuugggaaacuugcuuggauaguguuuuaugucagaauucuaugacaaacugugcuuuggugacuuauguauucagacucugacuuaucugggaagacaaaaugucauuagcauucuaagaaauauuaaugacugcuauuuauauaccccauccacaccacuuucacuggcaucuggcauugaugauugugaaguauugaugacuuuuccaaauaagauggaauauggcaauuugguaaagagcaaacauuuuuauuuuauuuaucugggguuaauuuuuuguauuuugaaauauucaaaaauacuuaguagaagggaucauuucuuuuuucuuuucuuuuuuuuuuuuuuuuuuuuuugagauggagucuccaggcuggagugcaguggcaugaucucggcucacugcaagcuccgccucccggguucaugccauucuccugccucagccucccaaguagcugggacuacaggcgccugccaucacgcccagcuaauuuuuuguauuuuuuaguagagaugggauuucaccguguuagccaggauggucuugaucuccugaucuugcgauccacccgccuuggccucccagagugcugggauuacaggcaugagccaccacacccggccacagaagggaucauuucuaaauagcauagaaucacagggaguacaccucaugugacuucacguuuagagucagcauuugcucauaaugaauuacauaucaguaaaugaacaugacaugcuucaacuucaauaauauuaaacaaaacucuuucagugugcuuauucauagaugaaaaacagggccugaaaacccagugugacuugggugucauauaucuucaguuuggaugcacuauaucagugcuaaucaauaaaggccaggaaugauuuuggaguauaauguccagccuuaaaucuuaaaugaaagugaaauucaaacacuuagcccagcaguagaagaacaaacacuagugagacaguauaauuuguuaagacgaacaugggccagauccauuaucuaauauauguguccucgacaguauguaccgucucgaagaggaagaaauagucaagguacccaaaugagccauuccucagagacagccaaagagcucugagagagagcaagugugggcaagaaagaggggacauuugugucucugaccaugaacauaugcugagucacccaacugcagguccauuuuuuuggugagacugauauaaauguucuuccaaacuggccaagcugcaagguuuccaaaagcaaagcuuaaggcuggacgcaguggcucccaccuguaaucccagcacuuugagaggcugaagugggagggguuugagaccagccugggcaauguagcgagaccccaucucuacaaaaaaaaugcaaaaaacaaaacaaaacaaaaacccaaaacaagcaggcacaguggcucacaccuguaauggcagcacuuugggagucugaggcagguggaucacuugaagucaggaguuuaagaccagccugaccaacauggugaaaccugucucuacuaaaaauacaaaaauuagccaggcaugguggugugcaccuguaaucccggcuacuugggaggcugaggcacgagagucacuugaaccugggugguggagguugcagugagcugagaucaugccacugcacuccagccugggcaauagagcaagacucugucuaaaaaaaacccaaaaaacaaaccaaaaccaaaacaaaaacagagcuuaaaaagcaagacuugcagaacauuaggacuaggagguagcuguggccagggcucuguguaaugcaaagauuaugucuauaggaccucugcaggccuggguuuuacuccuagcuguguccuuacuaguuauaucaucuugggcaacuuauguaaaccccugagccucaguuucuuccuuuguaaaaugggaauaacaauuucugccauucaguacuguugccuagaugagugauaauuugugucaaauaccuggcacauacuagggacucaauaaauuuuaaguacaguaaugucacuuaacaauggagauauguucugagaaaugugucauuaggugauuccaucauugagcaaacaucauagaguguaccuacacgaaccuagaugccuacuacccaccuaggauacaaaucuguacagcauauuacuguacugaauacuguagcaacuguaacacaguguuaaauauugauguaucuaaacauguaaacauagaaauguuacaguaaaaauaugguauuauaaucuuaugggaccacuguugucuuuguggccuaucacugauugaaauguuauguggcgcauaauuauaauuuuaaaaaaucacucagaccuaauguaugcauuuaaugacuccacucuaaggaaagcccagaugcacuuaaauauacuucuguuuauacugcuuucauuggaaaugaaaugccaugucaacuaugaugcuuucaguuguaaguagcaaaacugccaacucaaacuagcuuaaaaaauaaagugaauuuauugguucauguaacuggaaagucucaugaaaaugucagcuucaggagaagcuugacccagcagcuucaugauguauggaaauaccuggguuuuuuguuucugcucugcuacugugguaucagcuuuauuccaagucuggcuuccuuuguuguugcaaaaugcuugucagaagaagccuggguccaucuguuaggauuaaguuuacucuguaugcuguaguaguggcuaugacaagauagaaguguauuucuccuccauauaaaagaaauccagagauaggcaguccagggaugguauguggcuccacuaugucauggacccagacauuuaacuugaugcuccacguccuaagguauggcuccuuuucucaaguucaccucaagguccaaaaugacugcuagaguuccagccauuacaucugcauucuaggcaggaggaaggggcagaagaaaggcuugccucuucucuuuuaaggagacucauuggaagugccacacaauccuuugcuuacagcuuauuggcuggcacauaggguaguugccagggagacuaggaaauaaagucuuuuguucccccucccauccucaguuccuuuugcacugugcuaaacaauucuaggacuuuuaacagaacucuucauaaaagucuugaauuuuauuguauuuauuuauuuuugagauggagucuuacucuguuacccaggcuagggugcaauggugcuaucuuagcccauugcaaccuccaccucccacauucaagugacuguccugccucagccuccugaguagcugggacuccaggcgcgcaccaccacaccuggcuaauuuuucuuuuuuuuuucguagagacagguuucaccauguuggccauggcuggucucaaacuccugaccucaggugaucugccugucucggccucccaaagugcuggaauuaccagugugagcuaccaugccuggccaaaaaucuuggguuuuagaucccuucuuuauuuuuuuggaucuuuucugaaucuucuccagucuuuccugauucacaaggggcacagucauaagccaggaaaucccuaaaccuuuauauacuuuaguuuccccaucuauaaaaagauaaaagauaauuguagcuacccuuuuuccuccagagauuaaauaagaugcaugcaugcuugaugcagugaacauuuaaugaauguuaaguaauaaauguaauacuuugugauucacggguccugucuccuauuuguguuuuuaucuaucaugcuuguuucuuuaccugaaaccuccaaaucucuucuugcucaaccgcagcuucugcuucuguaauuuguuuuucucccuuuagaaaugcuucuuaauaaacgccuuugagucuauuucugacuucaucucgaauuugccaagguaguuuuuucagugucugaaaauaugacaauaagagaaaaugauucaggagggcaaagagcagaaaagcagcuauaaagagugggcagaggggaaggggagcguuggccucucccugggagcuccaggcuccaugugcacacacaggcucauccccgcuucugucaagcucuuguucccaggcugaguuacuuagaaaaggaagaagaauguuuccuauuuguucaugugaauucacuuaagaaacacauccucagugauuaggcguuagagcuaauuugucuacaugcagcuuaaaguuaagcuugggaauuuauuuuauuugaaauucaaaggaugaagcccucuuugucuuaagggcugagaaacgcagcucagcugcgucuaagaugguuuguacucacucucuuccucccuucuugcuucggcaaggauggaagggcugggaggauuugcauucaguuucucaugcaaagagcuccucacggaauuccugcccuuugcauaugcuggacaagaccaagauuuuccaggucgcugcuugcaguuguauucauaacuguggggggagauaauagcuaacaucaauugacggucacuagaagcauuuugcauguauaauaacaguaacagccaacacauaaaacggugccuacuaugugccaggcauaguuuaaauuauuuuguauaccucaaccaauuuuauucuuucauauuccucugaaguaguaauuaccauuaccuacauuuuacagaaagguuaaaugugggcucagaaagguuaaaucacuugcugaggguuauauucagcuagugucagagccuggauucaaacugaucauauggcucugugcucuuuuucuuucuuuuuuuuuuuuuuuguuuugagacagagucucgcucugugcucuuaacugguacauucuaccaucuuccuaggaggggguuuuaguauuaauauucuuauaaaaaggagacugaggcagggagagaggaaggaauccuggauuccagcguacgcaggagacuccagagcccgggucuucuuugcuaccuccuccagggacaugcggagacaucuccacauccagcacuucacauaggaaguacccugaggaccacgugggaugacauaacccaucuggaguaacuaguggcauggugcagggugcagagcugugcuugaggugcucccuaaacccuaucaguccugauacugcuucuggggccuggaggggaguaagggaggccaguguuugggggacagaaggcggcagcccugugauaaacaaaaucauguuucuggcaccaggagcagaauucaugugugcuuuuacugcuuccugugcucuuccucauuuuaccccagggccauuggucaugguguccugggacccucugggggcuuggagcaucgauaccacaaccauagucccaccuguuaaguaagagaacuagccagggaagacaucauuuaaaguguaauuuauuuauuuguaucuugccuugcuccccaaagcuuuuaugacaggauacagaaaugcuucacauacuggaagagugccucaguuaggugugugugugacaguguggcugcaaucccagcucuccuucucuccuucccaggagccauggacaagugccagcaucuuucuggcaccggauuuuucugccucuaaugugggaaugaugucuucccaguagaauuaggguagacauuaauaccaguucauguaaauuucuagcacuagccuggaccacagaggugcucaguggauaauuauuauuauuacaaggcauagaauuauuuaacggaaagaaaucaagggguggggucauaaaauagagccaagaaugagguccauacaaaaauaccuacuaugaagucauacgcacuuugucagggccagugugaugagagaaaccugauuauuaaaucacucacgauguucacaagaggaaaacagugggcucaggagaggcaaccgcucagaaagagcucuuuagaggccuucugagaagggcacugugcaacguuauaaacuguucucaacaacuuccucagaauaaacccagugauaagugccaccggcuucccuuuaauagaggcuaauggcaacaagccacagcaucagccaauagaaaccauuccugagagccagcaucauagaguccaggcacagugcuugcaggggcugugauuuaaccaggggcaacaacagcgagugcuuacugagcgucaggagggccagugagagcucugagcccucugcauggaucaccucgcuuaagucuuacaacacccauaugagauuguaauauggucauccccauuuuacagaugaguaaacugaggcccagaaaagcuaagaaagcuucccaaggucacugagcucauuaucccuaagcagcguucaaacccaggcagucaggcaggcaggcaggcaggcuggcucuggagccugugccacugcccucucugguaacugauuaggaccaaauaucccugugauaguccuucauaaaggcuguccuugacagcugagccuuugacaaaucuugggcagcagugaguuuaaggaaaugugugaauccugaugaguuccugaggggccaacauucuggagggcuaguuacuguggagccguaugcuuuacccgugggcugagauggaauaggaccaacagauuuccgcucagggucccaguaugggcucuggcuugaacugaaggugauccaugagcuggguucagaaaaggggguaggcaaauagggaagcaaggccaaagugcaccuagaaaguaagcuccaguccacuccagugcacagacaaauggaugauugagaacccacaguucauguaucagggcugccauaauuuuaaucggaaaaauucuuuaaggcaguuaaguuucuguucuggcuauuuugaaaaaaauaaugaauagggccaggggcacugguucacaccuguaaucccagcacuuugggaggccgaggugggcagaucacuugaggccaggaguucgagaccagccuggucagcauggcaaaaccccaucucugcuaaaaauacaaaaauuaacugggugugguggugggugccuguagucccagcuacuugggaggcugaggcaggagaaucgcuugaacccgggaggcggagguugcagugagccgaaaucgcaccaccacacuccagccugggcaacagagcaagacucugucucaaaaacaaaaaauaauuuuauauguguguguguguguguauauauauauauacauauauaaguguauauauauauacacacauauguauauauauguacguauauauguagguauauauauauacauauauauguauccuauauagguauacauauauguauauauacauauauauguauccuauauauguauacauauauguauauauacauauauauguauauauguauccuauauauauauccuauguauauauauguguauauauguauguauauauauguguauauauguguguguauauauauauguauguauauaguauccauaggauacuuagugcacaucucuuuuauugugauuucugccuaguauauuggacccccaaacugucagacaaaaaacacuuccaaagucuucuccaccccauaaucaccaucccagcagaauuuuccagaaaggcaaauacaguauugugcuauuucugcaugguagacauugcauacuuauaauucugacacagcaggacucuaagccauccagucuucugggcuccucuucuuguguaccaagauuaacgagcagagucccacuccucuucugugaaagccgaguccuccucaagauguccugagacugucucugaggacucacagacuccugguccaggguugucagcauccuggcagugacugcccuuucccugacaugucacccugcuguacagggccccaguuucucuauccuuucugccuuaggcugcauuugccugaaugccaaggaauuggagcacagcaucauaggggcaaucgcagaaggccuaauguucugcccuuuagccaaaccacuugccauguccccuuaaggccuugccuugccauuaccuucuugggcuuugcucuucuccagaaguggcugucuacucaacuaacagcuuccugcaauccccaaauucugguuacuucccaccggaacacaacacagcuuguucuucauuuuucuuuguuacuucccaggcuauacccagagcuugcauuucucaccuacaagucccaucaaggcucaugguauuauuucuucccuauaagagaauguauguccuauuacgugaaaguggcuacagucauggcuuuaaauagcauucucccacugcuacaauauguguauugaagcuuacagaauaguugauaguuaggaauuaagccuaaaaaaguaaggaccaaauaacaauauaacaaaaaugaccccaaacaagagaugcccaagcaguaugaucaagcaaagaauggugguaccaaaaauaagggcaaagaagaggagauggcugauggcggggauggccccauugggcucucacgagagaggugaagguggauugaguaugagggauggaggaugugaugagcggggagagacuaggagggugucucagggaggagaaaccacuugagcagaggcagggagguggccugacacgugacccacuggcuuggaggagugaguaggaguaauccaggcuggcggggaagagcaggaucuuuaccaggccagaaggagaagcagaaaccagacgauggagacccugccaauugucuucugauagcaguucugaagugaacaaguugauugcgguucucugaguguaagacacucaacaauguaaacugcuaggaugcagcucucuaauuaagacuauuuucuuacaacauguguuuguuuauuacagagagcugugaucacuugagggugucaugucaaccuugucucaugcaccagcugaauucagugacacuaacauccuggauccugcagaugagaguauuaugacugcacuaccagggaggcugcccagggcuggagauugcucugcuccagaggugcuugguuugcagugugggcggacucaaccugagcgaaagccacacaaaagcgccuugagcuggagccccaugcuaguguugguuccaccagugguucuuuuuuuuuuuuuuucugagauggaguuucucucuuuuugcccaggcuggcgugcaauggugugaucucggcuuaccacaaccuccaccucccagguucaagugauucuccugccucagccucccgaguagcugggauuauaggcaugugccaccacgccuagcuaauuuuguauuuuuauuagagacgggguuuuaccauguuggccaggcuggucucgaacucccgaccucaggugauccuccuggcuugaccucccaaagugcugggauuacaggcaugagccaccgugaccagccaacaccagugguucuuaaacuucagccugggucugagucaccuggagggcuaugaaaacacagagugcugggccccauccccagaguuugugccuucaguaggucuguggggggccuaaggauuugcguuuguaacaaguccccaaguaauacgggugcugcugguugggagaucccacuuucgaaucgcagguucacucuacagucccauuguuaacuuauaaaacucuuccucucuaguucuucuuuuuguaaagguguguccugaggaaccucagauuugaaagaagagugaauggaagucaaauguggaaaccacucaaauguccaucaacugaugaaugaauaaacaaaucaugguauauccauacaaggaauauuauucacccauaaaaaggaaugaagucuuaauacaccuacaacuggaugaacauugaaaacauuaugcuauccauucugcuucagguuggaaaaaaaaauacgauccuuaccuaaagaagccaucuacaaaaggccacauauugugugauuauaucauaugaccagaauacgcaaauucauagagacagaaagcagauuaaugguugccaggaacugggggaaggggaggaaugaggagugacuaacuguguuuuucccauugugauuaaaaaaaaaguucuggaaccagauaguggugaugguugcacaacauugugaauguacucaguaccacugaauuguacacuuuaaaauggucaguuuuggcugggcacgguggcucacgccuguaaucccagcacuuugggaggcugaggcaggggaaucaccugaguucaggaguucaagaccagccuggccaacauggugaaaccccgucucuacuaaaaauacaaaaauuagcugggcgugguggcacacgccuguagucccagcuacucaggaggcugaggcaggagaaucacuugaaucuggaaggcggagauugcagugagcugagauugugucacuguacuccagccugggcaacaaagugagacucugucucaaaaaaaagaaaagaaaaguuaguuuuauguaaugccuauuuuaucacaauaaaaaauuaaaagagugaauggaguguuguuuuaacucccaucaugggaccaguugaaagguuuauaggauagagguuggaaaugcaaagggccuaaaccagugguuuucagcccugauugagccauccuauccuuggagaguuuuaugucuuauccuugucuuagcugcgcccgagaccaauuaaaucaaaaucucuggagguaaggcccaggcaucaaaaaaauuuucaauacauccccagaugauucuaacauaccaucaguauuucaaacaguggccugaaaccucaagggucaaaugaguuaaugacuuuggugcaaacugacuugacccauaucauaaacaaugugccuucaucuucucccauacuugcuugggaggggauguagaguagaaugaggaggcuuucagaaucagaucugcccaggauuugaaaacuggcuccauuaccaacuagcugugucuccuugggcaaaccacauaacccuugugggcauguuuucuccuaagugaagaacaccauuucagaggguuuuugugaggcacacaugaagcagccaauuucccagcuuuaccagugucagacccuguuuagucaucauuccuuucuuuccaucucauucuagaccggaaaggagaaacagucuaaacugcaugaaaguccugguacugcuguaucucguacuauaaguucaguuuucucccuucaccugaggguaaguugaagaauaacuucauaagccagggagagauacguuuggaucaggaguuagugauaacaggugagcccaauaauaauccuuuuugcgcucaugcucagauguuuuuuaugcaccaagcuuuauaaugauguagauauacucuaagacaaaaacagauaaaacucaccuauaauuuugaaucauaaaauaguuuggauuuuuccauguuucuggguaguccuuacucuuugauaauauaaggaauauauuuuuauucaacuacaguuaaggcauagauauaauuuuauacucugcauuuucuuuaucuucagcauucguuauguuucuauaguucauuauugacauuuuaaugacuacauaguauuugauugaauagccuuacuguaauuuauuuugauauuccucuauuaagccuuuugacugcuaaguuuucaauauuagaaauuguacauaguaaaaauauuucugcacguaacuuuuaauuuccuuugacuucuuuucuuuuuuuuuuuuuuuugagauggagucucgcccugaugcccaggcuggagcgcaauaccacaaucucgucucacugcaaccuccgccucccggguucaagcgauucuccuaucucagccucccgaguagcuaggauuacaggcgccugccaccaugcccagcuaauuuuucuauuuuuaguaaagaugggguuucaccgugucggucaggcuggucucaaauuccugaccucgugauccacccaccuuggccucccaaaguacugggauuacaggcaugagccaccacacccggccuugacuuauuuucuuaaaauauauuuccuuuaaguuacuggaucaaggggugugaacauuuuaagguucuugagugcaguaucaaauugcucugguaaaggauuguaccaauuuacacugcuaccagcaggguguggguguacauuuucaacaacuugccagcaccgaauuucaucauuuaaaaaggguuuacagauuguacauaauuuaauuuaauauaaacuaauaaauuacuguguccaacuuuugagcaugcuuaaaauuuuuuccccauuucuuuuuugguggcaucccuacuauuucguaaacugcuugagggcaguuuacaaaccuugcacauuguagaaaaucaauaauugcuuuuugaaacaaugaauaauucagggaaucccuguucccaauaauucuucaguuuugauaauagcaguggguuuuggguuguuuugguuucaagauaaacuaaauuacacuuuauuucacugauguuggcagccccagaggacucuguuugcaggaaaaaaaauguaugaagauuuuccuaggugggaaguagaccucucccacacaacgagaagagcagcuaaaucauugcucuuuucucccagucucucccugcacucccaucugauuuccugucugcuccugaaaagccagcucaauaugaacuaaggaaaagcuauuuguagugcucaugggaggacaaagaacacaaauaggcucuuccuaaacuauugagcuuagcuuucacucuuuccagcaggaaaagggucaugcauguccaggugauacuacuuguacuuugguacccauugauugggacagugugugccgaugaaaaggugcugugaauucaguaaugcuuuuuaaauacguauuuuaauuucaauaaugucuacauaaauuucaaaaacagcaauuaaaaaauaugcuugagaccaauuuauccggcuacaccuauuuggugcauauuugcauucuuagauuccuuaaauguccucugcacaaagguuaggaaacugugcccugacaauaaagcaguaucuuauuagaacuaagagauuaaccaguaaagaggacuagagaagucguuguuaacugauacuuuauuaguauuuaauacaguaaccugccucugcuagaaguaaggacuccuccucaacuuuuaaagauagcuaauuuuauaacucugcuuccuaccuguucaccuuuuucucauuggugacagcaacaaacaauuaauggcuuucuuaaaugucuugcugucugaaauaagaucuuuuuccaauuaaaaaguaacaaaggcugcaucucuccucuguuuccuucuuuggcuguaacaucuugacaucucucucucugucuccuguuuuauccaagaccgaguuacaugaaaacaaaaugggucauaggcuuccauugugggggcggggcgggggggcagauuauuugugacuuugguuuuaaagaaaauuuaugcuggugguuugcagaaaguugacauauauccuaggguuuccuugucagagggcagcaggguccccauggguucacaucguugccuggacaaggagucuuuguacccuaguggugccuggguugucgcagggaugggguaacucauuuauucacacucuuucuccuuuccuguuuccuucaaagauacccugguccuaguugacucuacuuuacuguucaaaauucagcucaacauaugucaagcuguacguucuuaaacucaaggaaacagaaagguuauaaccccgugguuuccaagccuggcuuuucaucagagucucuuggugaacuuuuagaaaauccauauucuugcccccacagccauucugauucauuaggacugcuuggggccauggaacuuauauuugaaaaagcucuccuuguguuucugaugaucaguccaguuucagaacaccaagcuagccaggcucccaggguaagaccuccuugaguaucaucucuggcaggugguucuauaaccuccacuguaaaaccuccagccaugggacgcucaccacuuuuuaugaguggccugaguugagacauucuuccuugugcugaguggaaaggcauuuccaccacaauaauuucuaccuguugauuucaauuaugccuguuggagcaauaccaaaaaaaguuauucuuccccauaauaaacuuucaaauauuucaaccucucaagcaguuauuguuuccuucucaggaucucucuucccuuuuccagacucuuaguccaggguccuucucugauuaugguuggagugagaguguugauuaugugccaagugcuuuagaccugucuuuuagauaaagucuugagggaaauuuauggugucacuaucuucccaguauuugggaugagaagaccaagggcuagagaagucauaugaccugccccagcucccacagcuaaguagcuaaauugaaauuugaacacucuaucugacuccaaauucuacauccucaacuaacauguuaugcuucagaauuuuucuuucuuuguuuuuaaaugcgaaauaacaaaugcuaaaugugcauuaaaucaagguauguaaaaguaaaaccguccaguuuaaaauucuacucuagaggcugccacugccaaauuugagaaggcccucugcagcccaccaccacaagcuggaaguuauagucacagcagaggggagccuucgccuccuuugcucuggacaccaucugcagugacugcggccuccaacugcacugugggcuuggagcagugaguagguuucuuuugaccuugaagcaacuagacccugaguuuuuuguuugcuuuaaauaaacuuguucagauggcacucauuuuauauccuugcaaauguguuucuuggucuuagaaggacuuuauaucuaucuccauuauuuuucuuguugguugugauccauuauaucaacuuauauagaucuuucaguucuuucaauuugaucaccgauuaaauuaucucgcucaaugucauucucagaucuuaauacaugugaugccucucuuuguccaaauaauugauaagagcuuuguuaaagguaggaccaaggacagagucuuugagcacuuguaggggaauuaaucaauuaauacuccugggcuacaguuuuucaaccaaauaugaacacaccugauuguauuaucauucagucuugucuauaagggcaugaaaaauuuggucaaaugccuuucuggccacagcauuuuccugauuaauccaguaaguuuauucaaaaaaggaaguauucaauuuuauucuuggcaaaccuaugugaguuccuacauaccaucaccuuuucuucuuaggguucagaaaauauuucuuuuauggucugugcaagaacuuugcuguggauugauaccaaacuuacauuuuggcugggcuucaagugacucagaaaggggcuggguucaggcugggaugucuggagccuguagugguggcaaggcaaaggccagcagggauagugaauagaggccucagugaugaggugggugcguugguuaauugcacaggugauagggcuggcuaauuaggguagggaauugacuagcugucagugaggugaacugaagaauccacccuaugaaggugucaaggggcagggaaagaacaagaauggaaucaagguagaugucucuucagagagcagccaacugggcagagaaaggcuggaggcugaagcuugauuaauguacacuaugguagaaaccaugaaagcccaaggauccaggaggugaagcugauguaagucaagggugagaaacggucuuggggaacugaggccucaucggggcuugugaugagacaacuguauucccugucucagcaaaugaugccaacuacccaguuguccaaaccagaaaccugguguccuccuggaguccuacugcucccucagucuccccauagccacuugaauuaucaagcccuaucauuccuaccucccucuaauaguucucagugcccauuucucuacauuguucuaccacccuugccacugucaucucuucccugaccccccauuuuuuuauugugguaaaauauaaauaauauaaaauuuaccaucuuaagaauuuuuuuuuuuucuuuucagacagggucucacucugucacccaggcuggagugcaguggugcuaucuuggcucauugcaaccucugccucccggguucaagcgauucuccugccucagccuccugaguagcugggauuacaggcaugcgugccacaaugcucagcuaauuuuuguguuuuuaguagagaugggguuuuaccauguuggccaggcuggucuugaacuccugaccucaggugaucugcccgccucagccucccaaagaauuuuuaaguguacaguucaguggaauuaaauacauuuaccauguugugcaacuauuaccaucaucugucucuggaacucuuuucaucucauaaaacuggaacucugugcccauuaaacaguuauugcccaguuuccucuuccucaaccucuggcaaccaacacuccacuaucucuaugauugugacuaauucuaaguacuucauauaagugcguucauauaguauuuuucuuuuugugacuggcuuauuucacuuaacuugucacaacauaucuuguaacauguuacuuaacauuucacuuaacauguucauccauguuauagcauaugucagaauuuccuuccuuuuuaaggcuaaauaauauucuaguuuauguauauaucacauuuuguuuauccaauuauucguugauggaugcuuggguuaguuccauuuuuuagcuauugugaauaaugcugcuauaaauguggacauaaaaauagcucuuugaaaagugggauuaauggaucauauagcaauucuauuuuuaauuuuuugaggaacaauaauacuguuuccacaguggcugcaccaugugacauucccaccaacagugcacaagaguuucaauucuccauauccucaccaacacuuguuauuuuccaauuuuuugauaguagccauccuagugggugugaagugguaucucauuguaguuuugauuuacauuucccuaaugauuagugauguugagcaucuuuucaugugauuauugguuauuugcauauauuuuaggagaaaugucuauucaaguccuuugcccauuuuuuaauugggugguuuuguuguugaguuuuagggcuuuauauauucugcauuugaaucccucuugagauacaggauuugcaaauauuuucucccacucugugaguugccauuuuacucuuaauagugucuuuugaugcacaaaauuuuugaauuuucaugaugucuaacaugucuauuuaaaaauuuuuguugccuaugucuuuggugucacauccaaaaaagucauugccaaauccgauguuguaaagcuuugccccguguuuucuuugaagaguuuuaucauuuuuagcucuuguguuuaagucuuugaugcauuuucaguuaauuuuugcauauguuguuaguuaaggauccaacuucauuauuuugcauguggauauucagauuuucuagcacuauuuguuuaaaagacugucuuuucccccauugaauggucuugcauucuugucaaaaauaauuugacucuugucaucucacucuugaaucacaaguccucuagccuccagauguggcuucccauucagucuguguauuguaguuacagcccuuauuuugaaauaaacuugaucauaucucucucgggcuuaaaaagucuucagugguuuuccuggcaccuucagaauaaaauaaagcccuucagcaugggauaccugccccuuccuagggaggccucacuucucacgccccccugcuucaucuugcaugccucagacucuggugguccgucuacugguugaucauagugcucuuuuaugcuauuggacauguuacuccugcugccagaaauaucugccucccaccuaacucccguucaccuaacucccauucaccuacuugcugcucuacucaguaugucuccucugucuaccacaaccugcuccccauuaugagaaaugugcccuucuuugaaugcccuuaucuuauuucuuucauagaacauaauugcucuguguuggaaugauagauuuaucugcuugucuccucucuagauugugagauccaugagagcccagaaaauaucuuaggaucccuagugcuuagcacagagcuuggcauauggagguaagcaaaaagauuuuuuaaauccaguuguccauccacucauccauucaauaugaaugagagaacagcccuuuuuuaaagagggauggccuuuucuuaaaagaccucuaucuugaggcauuauuuucccuuauucaagucccaguuuauuagguccugguacuuaauggugauaaaagggcauuauuauugaaagguuggguaugucaggggcacaauauuaguucaaacagugaacugaagcuuuuuugccuggaauccauuggcuucuuugauggggauaggaagcagccugggacuauugcugugacaugacaucaaucuugguggcuaacgggaagggguuaugaagaaggggguggacuugggggaugaagaggaccuguggcuccaguccaccagaaugaaugaccuaggccaugggaaguaagacugggaaguguuuuucaucuucuuagaguuugggauauauggaugaauugagugaaaugaggauuuuagugaguaucucuacuagguuccugacagggaugguuucuccagggauucaacugaaucuuauagguagaucugaucuggugaaagauaagguauaaauuggccugucaacaggacauucguacugguaguuauuacuaccaugauggcuuuaagagauuuugggggcuggcaagaaguagaguaaauguagcagaacagauggauguuauagggaaaauauagcuguaaggaacagugagagcuuagugaugguggcaguagagcauaaaagacaaauuaucuuuaacuuuggcuuugcaaaaauugggguauaaaguggggcuauauuacugaagcaguccgauuaggaggauucauaaaaaugaaaugcauuucauaugcacaucugggcagcuauagccacuguagguuucuuguaggucugauagaaaaugagcccuguuggugaauaccuuagccaauaugaugaauaccuuagccaauaugaugaauaguagugaaaggcuguaccuugggaggcucaggauuauacugaugcacccaucacucacaguuacuagacauguggcagagacugaauaaaggguugacccagggacacuccuugaauauguccccuuuuuuugaucagcauauccuucuaaccuccuagaaguuccaauuuacaaaauguaauggugggaaugaacaaagaaguaaggcacaauuacucuaucuggguguuagggguacuuggccucugugguugacacagcaaggcugaguugugguaaauucuugcacauucuugcccauugauccugccgccuugagcagggccagguagccaguccuguggucuagaacauaacccccgugguuuuggacgcucagggugcuguguguguugauguugaaugaguaggcuugguucuuaguugagcuuucagaacucuggaaaugcuugaguuugcagugacucgugcacaguagaauggaaugccuaguauuccaugguguauaugugccacauuuucuuaauccagucuaucauuguuggacauuuggguugguuccaagucuuugcuauugugaauagugccgcaauaaacauacaugugcacgugucuuuauagcagcaugauuuauaauccuuuggguauauagccauaaaaaaugaugaguucauguccuuuauagggacauggaugaagcuggaaaccaucauucucagcaaacuaucgcaaggacaaaaaaccaaacacugcauguucucacucauaggugggaauugagcaaugagaacacauggacacaggaaggggaacaucacaccccggggccuguuguggguugaggggagggaggagggauagcauuaggagauauaccuaauguuaaaugacgaguuaaugggugcagcacaccaacauggcacauguauauauauguaacaaaccugcacguugugcacauguaccguaaaacuuaaaauauaguaaaaagaaaaaaaaaaagaauggaaugccugauucugcaucccucuagaugggaucaacaggaucaaaacaugaccuugauggccaagccaaguucucuuuuucccaaaggguuuaaaucugcccuauuuaauaugguagccguagccauauguauuuauauuaaauucaaauuaaucaaaauuuaaaaauuaguuacuuagucacacuagcuacauuuuacaugcucaguagccacauaaagccaguggcugcuguauugaacagugcugauuauggaauauuuccaucacugcaaaagguucuguuggacagcaguaauccagaucuccuuuguagaagaauuggcaccuggggcugccugaucuucaaggggcacaucacagagcaugguguugacccaucuggauaccauguuugaaguugacauggcccagaaauuugacuuccaccaguuaaaaauguacuucgacaguuuuguauuuaaccuguaaauccagaagcaugucagggccuucuggauggagcacugugaaauuagcauacacuucaaacccucuucccuaaaagaucaugcacuacugugcuguacaugguagaccuaucucauaguguaggcuucagcaaauacucuuugacaaauaauugguucugugcugaugauaagccuaauaggugaaagauggucuuucccuuaaaaaauugagauauaugauaccagucucauaaacucuaauucacaagcccuggcauuaugagaggcacuuaaaguaugaaugguguuaagauuauccuuuaauuuugcaguaggcaaaugaccucccaaagauauucacuuccuaauccccggaauuugggaauacauuaccuuacaugacaaaggggauuugcagaugugaauaagugaaggauuuugagauggggagacuauccuggauaaucccagugggacucauguaaucacacaaguucuuaaaaguggagaacuuuucccugcuguggucacagagaaaaacgcaaccaauguaagaacggucagagagauucaacauuguuggcuuugaagauagaggaagagaccacaagccgaagaaugcaggcaggcucuagaagcugggaaagagaaggaaacguauucucugcagagcuaccaaaaugcauacaucccugucuacaccuugauuuuaaccuggugagaccuguauugggcuucugaccuauagaacucuaagauaauaacuauauguuguugaacaugcuaaguuugugggaauuguaacaguagcaaugggaaaugaauacaccuuuuauacaguggaggaugacuaaauaauuuauuuugaaaauacaacugucacaaggaugaaauauucaugaucacaaauuggugcauucuuaacuguggauaauuauguaugaagccaaauuguaauaaaacuguuauuugccaaacauagaaaccuugcuucgugacuaggcugagcccagaguguuauucucuucuucugccuguuauguaucugggcaauuguagggccuuugcaggugaauccaguagagaacaugcuaagaaugagcagcagucaugcaugacuguaucauugaaagccuucuagccauuuuacagcuucaccuccgugguuuuauuuuuucagaggggacugaaggagaugaauggauaauaaacuauggcuaaaaacuuggucuggaugaacucuuugaugcggggcaucaggggggugggggugaugggugcguaccaugggaucaguagcccugcaccagcucagagguauaauugugaggcugguggaaaugcucaucggggagaaggaaaucaggaucacagcuucugaggacugaacaugcucucaaauauagaaucauuaauggccuuggcauucaugguguuagccuugacucaaaugagaaugccucgacccuucccagguucuccgaggccccuaaguagacugucacugggacuuggggacauggagcucaguuaauggccucuuauuuuuacuaugccauagcauccaccugauuucuggaaggcauugcuucacuuucauagacagaagauguaacgacugccacgaagaucccuggagcucugccuggcgauucucacucccacuggguagcugacaaauuuucccugagaagacaugguuuccuccagcagcagcagaaggagucauggguuuuucuguuucauggcucaaacuguugugacucggaauuauacuaggacagggcccugacuuauucuucugggcugggcugaguaaggccuggcugaguguagcuggguacacagguagggguggaaucaaagcuggagguacccauaaugcugguuaggaggauaacuagcuagaauaagguuggcaagaacugggugagcagggauaggaauuaagacugaggacugggcugaggguaggucagggguucuggcagcaacacagcuggaaugaauggagaagcacacaaacaaaaccaagcuaagaagagccuagaucaagcuuguccaacccauggcccacaggcuccauguggcccaggauggcuuugaauguggcccagcacaaauuuguaaacuuucuuaaaacauuaugagauuuuuuggugauuuuuuuagcucauaacuauuguuaucaucuccagaagguguucaauuuaccuugucuagauccauuagaggaaucacugucuaugacagcuguagcuuuaugaaauguauuauauuucuuaaauaguaaaacuugaaaguugaaauuauauauugauccaugggcugcagaaugaauguuguguuagcaaguaugaaaacaucauuaaucuccuuacacaucuccaucagagcucuuacguaaccagugcauugucaaugaacaguaauauuuugaaaggaaucuuuuuuucugaguaggucucaacaguggacuuaaaauauucaguaaaaccaugcuguaaaaaggugugcugucaucuaggcuuuguuauuccauuuauagagcacaaagcagauuuagccuaauucugaagaucccuaggauuuuuuaaauagugaaugaacauuggcgucaacuuaaagucaccaguugccuuagccuauaacaagagagucagucuguucuuugaagucugaagccagguauugacuucuccuuucuagcuauacaaguucuagguggcaucuagauggcaucuucucccaauagaaagcuguuuugucuaaguugaaaaucuguuguuuaauguaaccaccuucaucaaugaucuuagcuagauauucuggaucuugcacuuuuaugugcacaaagaugucuuuuauguuaacuagaugacuucuuuccuuaaaccucaugaaccacccucugguggcuuuaaacuucucuucugcagcuuccucaccucucucagucuucauuguacugaagagacuugcucugaauuaggcuuugggcuuaagagaaugucguggcuuguuugaucuauuuagaccacuaaaacuuucuucaugucaacaacaaggcuguuucacuuucuuaugauuugugugguuacuggaguagcaauuuuaauuuccuuuaagaacuuuucuuuugcauuuacaacuugguuaacaggagcaagaggcccugcuuuuggccuguuucagcuuugggcaugccuuccucaacuaagcuuagucauuucuagcuuuugauugaaagugagagaugugugauucuuccuuccacuugaacaguuagaggccauuauaggguuauuaauuggccuaauuucaauauuuuugugucucagggcauggggaggccugaggagaggaaagagaugggaaaauggcugguuucuggagcaggaagcacacacauauauuuauuuauuagguuugacacuuuauaugggugcaguuugugucacccccaaacaauuacaauaguaacaucaaagaccacugaucacagaucaccauagcagauauaauauugaaauauugcaagaauuacaaaaaugugagccagagacaugaagugagcacaugcuguuggaaaaauugcacugauaggucuugcucaacacaagguugccacaaaccuucauuaaagaaaaaaugcaauaucugcaaagggaaauaaagugaagugcaauaaaacaagguguaucuguaguugugcugcugcaaaaauuaucugugcucugucuauucauccuuucccccucccaaucccuggcaaccacugaucuuuuuccugucuccaucguuuugccuuuuccagaaugucauacaguugggauaauaaagacaguacguagccuuucagauuggcuucuuucacuuaguaguacacauuuaagcuucuuucaugucuuuucaugucuuuucauggcuuggcaacucauuucuuucuaguacugaaugauacucuauuguccggauguaucgcaguuuuuaaaauccgcuuaccaacucuuaacuuuuaauccagugauuuucaaacuggggccuuuggagaucugggcugaauguguauucuugaggacucaagaguuuuagaauuugagagauaacuagccaagcauauaguaugugcucaauaaguauaaucauuagugacagaauuacgacuauuguaaaagaagcuacaaguguugugaagcagggcuggguggggcauguguucacaagcguuaucccagagaggagaggcaugucaacgggauuuguagucaaugcuguuuauuugcagcuggagaggguuugaacuuccuggacagcugccuggggcugcccaggcuucaagggccacauuccuggggcagaugcuggacacugcuguggccugacaguuucugacagccccauuuuaaaaaccuggaacauuuucuuaccuugaguuuucuggcacuguucccuugcucagugauuuucagagauuacggugugauuccucaauuaccucugaaaggucuuccuguucccugggcuguaauucauggggccuggagaccugaacucauuugggcugcucggggcucccuaaaucucuguccauccaucuuuagcuucuguucucucuuaaccaucuguguucugcuccacuaauauuggagauuuugcuuccagauggcaaggcuagaguaaaauugcagcugggcagugucaucaucuguuccaccaucuaccccaggccaucaccuuccuuuguucaucuucuuaccugaaacacaauuuuacaagguccauguuuugcuaucugagcacugcacaggccugaggucagagcugugaccaugacccagccucuccuguacuguccuuugucugugcuccccucuaccugcauagugaaaugcucccugcacugacacacagcucaggaguuuaaguaccuccucccuuguguucaucuggauuaugccuuacuguauuuccagaauuucauuuuuuuagagcccucugcuucuuaagucauauuuuguuuuagggacgggguucucaacccuggcugcacauuaaaauggagaaaucaaaccucuaggguaugguuuuccaguuaaucauaaaaaaaucucucauguuuauguucuccauauaaucauaaaagaaaaaaguauuaaaaugagcuucaucaaaauuaaacauuccuguucaucaaaagcuacuguuaagaaaaagaaacaaaucacagacuggcagaaaauauuugcuacacauauaucugacaaaggacuuauaaccaguauagauuagcaauugcuacaauugaguaauaaaaagaagaaauugaucaaaaagcuugaacaggcacuucacaaaggaaaauuuguaaaugaucaguaaauacauaaaaaggcauuuaacaucaguagucauaagggaaaugugaauuaaaaccuacuaacauggcuaaaauuuaaaaaugacaacaccaaauguuggcaaggaugcagaccaacuggaacucucauuuguuucugguaggaguauaaagugguacaaccacuuuggauacuguucuggcaguuucucauaaagugaaacauacaccuacccaaugaccaaaaacacuacuucuaggugucuacccaagauaaaugaaaauagacacaaacuaguagacuuaaaagcuuuauuaauaauagcccaaacuggaaaccauccaaauguuccucaacuagaaaacuaauaaacaaauugugguauaucucuaccauaaaauacugcucaguaauagagaaggagcaaacuacugguucccaugacaacacagaugaaccuggaaaacaugaugcugaggggaagagaucacacacaaaaggguaccuacuacauaauuucacuuauauaaaguucuagaacaaguaaacuaaaauacagagaaccagagcggagguuguuucuaagacagggcaucuaugagugucuggaaacugccagagagaacuuucuggaaugugucugaugucuugauaaugguggguuguuacaaggcauaggcauuuaucaaaacccauuuucaaaugaugucuuaaguguuguauauuuauuaucuauacaugcaauuuacaaauuauauaucaguaaggagaaugaaauuuucaaaacguucccuagaugauuuugcuacacaguaaggguugauucaaugcuacgcuggcucaguucauaaaaugucucugucuuuucccuucaguuugaaaccuucuuuccuaacauccagguccuuugucugccagcaccauauuucagucucuuguaauuaggaacccaauaacaccaugaacacucaccaaugaugucuuuuuuucaacacaccaaccuuaccucucuguuggacaaaaugaaaucuaaaacaccaggucuccuuucugagcaagggaguuaucaguuggauaaugggaaaaaugacugccauuccagguggauaacuggaagaaucacuucuuguaggagaacgaaauguguaguagcugccgaggaggugauguccuuuggcccuacccucuuaucuguaugcagaaauggguguguucauauuauguuuugggaaagcauuuuagauucacuucaucagaugagcaucuuuuugcuccuaggcuuacugauuucgauguaguugaauaaguucuuauuuaacgugaaguucuguuucuuuuuguuagacguacuucuuuugaauaaaacauaguuuuaaaaauuacuauuuccauucuaacuucucucuugccaagacccaaggauaucugggagaauuuuuuuuuuuuuuuuaccgugauguguuuauauguuuggacuacuuauuacccaucuuugccauauuuucuuaucuguggagaugcugagaccuaauuuagcuuauuuucugaaaagccagugucaaauaccugugagcaacacagaagaaauagaucaccuacucagcagcuuuaacugucuaggacucagcuaauaacugaaaaguaagccacaaagagacccugaagacacaaaauagaugucauaaaauccacacacuuuccucagaggccagcccaucggagucucacucacagucaguuuccucucaccugggacacagguguaacaucuucacagcuugguuagaugcaccaaguuagaagacagaacaaagauggccuuuacagucagguauauugauagcuauaaaaagggacaacugacaggagagaagagagaauccuuuucauccucacuuuauccuauuaaaaucaaaaugagccugggcacgguaggucaugccuguaaucccagugcuuugggaggccgaggagggaggauugcuugagccuaagaguucgagaccagccuggacaacauggugaaagcccgucucuacaaaaaauacaaaaauuugccuggugugguagcacauguguauagucccagcuacgagggaggcugaggagggaggaucacuugagcccaggaguucaaggcuacagugagcuaugauggugccacugcaccccuagcaugggcagcagagugacacccugucucuaaaaagaaaaaaagaaagaaagaaaaauaaauaaugggcaacagagugacacccugucucuaaaaagaaaaaaagaaagaaagaaaaauaaauagaaagaucuagcagcuauuuguuucuggagcacccauguaaaaucacucucaaggagcucuagaggcaugaccacauuugaggucaaugcaaaacagucauugaugguaaugccuuuaagccaccaagaaaaggccgaauguuccaugcaguaaucuuugaaaaaggcagagaaguguguaauaugguuuagaaaggucucuaucaaauugggcggaaauaaaaguuuugacuguuuaagugaguaaggugcaguaucucaaaccuucacuguccuggcauaguggccuugaggacaguucugggguaaugacaauuauggaggcagaaccagacccucucugcuaucuuccauaaccagcccauucccccuuucuggaugggggagugcccuccucuaacugcagccauugcugugugggccucagcuccaguccgccacuccuuguucaugcagcacuugcuacccuucuuccuugaagccucugccaccugccaccccaucuccuccuuggaccuccaaauccaacagacucugguuaucucuggguggacucuucacucuccaaauccaucagaggcucaucucuuaaucccaugaaucugaaauaaaaaguagcaaugcauaaagaaguucuacagaugaaauguuaaugacacuuggaauuuguuuuaaaacaauccagcaggaguggggauaggaaagguguaggcaaaacaagauggcuauugacaacugucggguuugggugauggugucauggggcacacugccucucuuuguguauauuuuuaaacauguccauuuaaaaaggagguuggccacaguggcuuacaccugucauccuagcacucugggaagccaaggugggaggaucauuugaggccaggaguucuugaccagccugagcaauauaaugagaucccaucucuacaaaaaauuuuuuuuaaaguagcugagcauagugguggaccccuguagucccagcuacuugggaggcugagaaagaaggaucgcuugagcccaggaggucgaggcugcagggagccauguugugcuacugcacuccagccugggugagagagugagacucuaucuuuaaaacaaugaaaauuaaaaauuaaaaaaauuuaaaauuuuuuaaaaaguuacaaggacgauauaggaugucauaacgccuaaucaauucucauaucuucauggguuucuggacagagaauguaccuucacuuuaccauuagccuaagaucacucaaaacaucuggaaguuauuauuuuaaaaagaaucucagaaguaugccugccucucacuguuaaauauaugugauggugcagauuauucagagcaguguuaaggcaucaacauaagugcagccccauggagucagggacagaggucaaggugaaguguuucuuuaccuuugaagacuucuggcacccaggcuuacaccuacacuucagcucggcaauccggaugucagggaagugagaggcgaaguuugaacccaugugaacuguacauuuugggacuugaguauucaggaacuuggcucucuuugaugagaaauuacuucccuccuccaucggcucagcuuuucuucuuccaccuucccuuuccucccucucucccuccucuuuccccuuccucucuucuuccucuuucccuuccucucuuccuccuuccuuucuuccuuccuccuuuuaagucaucaccaccaccagcacuacaaaaaccuauagcauguucaugucagaacuucuaaagaguuguuguaaagauuaagauacaaguggggaagaaagaaauuuaaauucauuagaauaauuuugaucaucauaauuaaaacaauuuuucuuuauuauggacacuuucaagcauauaaacaucugacuaauccaaugaaccccuuguacuaaucacucaccuucaguaaaguuggccaaucucuauuucauccuuucaucuuucuccccaaucauguccacccuccuccugaccccaccugagauuacuucagaacaaauccaaggcaucauauuguuucaucuguaaauaauucagcaguauuuauaagagauaaucucucuuauuuuaaacauaaucacaauacuaucauaucuaaaaaaaauaauuuguuaauauuauaaaauauucagucaguucucaaauuucccugauuaucuccuuuuuauucuugguuuguucaaaugaggacccaaauaagacgcacucauugcaugcugcugaaauagcucuugucgcucauagucuguaggcuuccuugcccuccuguuuucuugccguuuauuuauugaagaaacugagcuauuuguuuugcagaauuuuuaccauucugcauuuugcugauugcaucuucaugguaucauuuaacauguucuuguaauuccuguaauuaccuagaauuccuguaauuaccuguaauuccuaucagcugauaguuauaccuagaagcuugucauuauuaguagcaauaucaaaaacuucacuuuugagacuggcaauuucuacgucugacaucuuaccacagugaacaaggcagcaucccaaacucuucugagucaauaagaaaaggguaacucuugcaguaaugccaaguucaguuucuguucacuuugcaaaaaauguaugcccacuacuagacccaugacugucaacuagaaugugcugggccuccucuccugucugugcaugggaaugggcacaaccagguggaaagaacaugaacuugggagucagauagcucuagaugugaauucugacuucagguuuuaugaaguacauagcuugucuagugaauucauaucuccacuucucagauuccuuguauacaaggauaaugucugucuuaccaggcugccaagauguaccugacauguaguauguguucaauaauuguuucuuuuccagcuuagguuaaaaauggga

SEQ ID NO: 17019 - RNA, 43743 nt, Homo sapiens
acuuuucaaaauccuuuaaccaucugguuggcauguuuaaaaacuacaaccaaucauacugauaaaaggguagucucuacauuuguggccuacccuugaaagcuccaacacugggucguuuuuguagacagaguauauaaaauuuucauucuaaguaagcugaccaaacagcugagucugccuaggaaguccuggauuaugcuacuugucccaguaaaauuauuaauagcuuccccuuucagaaucaaaaguguccugguuuagaugauaaauuauauggcuacccuaauuuuaaaugaugcacuuuagucuuuuuuguuuacucugugaguugucaguggccaaaaaagauguuuccagcuuaagaguauuugcccacaugugaauccugucuuuaugaaauaguuguauuuuuucccuugcgcagaaagcaaucguugcaaaaaacucagaaggaauugaaaggcauaaauaagaguuauaagccuauaaauaaguguuaauauuuugauauauauauauaaugccacgcauuaucaauaauauauuuauauaccuuuagauccccaaucuccaaaccaagccaccuuauauauauuaaauaucuagaacuauaugauaacacagccaauauagaucaauauaaucacuuuuuaaauaguugcuuuuagagacuauaauauucuagugauugguucuuaaacuauaauauuuuuaacuaauccccaguuuuggcuuuuagguuuuucuaauauuucuauauguuauugacagugcugcaguaaauguuguguguagcuaaaucuuuuugcacaucuacgauuauuucuuucucuuucuuuucuuucuuuuuuuuuuuuuuuuuuuagauggagucuuguucuguugcccaggcucacugcaaccuccgcuuccuggguucaagcuguuccccugccucagccucccaaguagcugggacuacaagugccugccaccacgucuggcuaauuuuuuauuuuuuauuuuuuuguaauuuuaguagagacaggguuucaccauguuggccaggcuagccucuaacuccugaccccagguaauccaccuaccucagccucccaaagugcugggauuacagguuugagccacagugcccagccuaugauuauuucuuuaggaugcuuuucuguaaauggaauugccaagucaaaguggaugcacauuuacaauuuugaaauugccaaacuuugccaggguguaugagaauucccauuuccucauggccucauaggugcuguauggaugauucuuuuucaucuuucagucugaggagagaauuucaucuccagcuuguuucaguuguaucucugcuuauugaugauuuguauuucauuuuuuuguaaauugccuaccuuucuuuuagaguguucaccuuucucuuaaugaauugugaaagcucuuuauauuuuaaauaaaauaccccuuuauguuauaaauugcaagauuuuucccugacuugcuauuugucuuuuaacuuuauuuaugguagauuuauguguauacagauaagguagauuuauguagauucagaagucuuuacuuuuuauacaguuauaucuaucagucucuuccuuuauagaguuuuguacuuuuuaaaaggaccagguuugcaacaaaauuaaccugugaaacuuuuacagucuuaucugaugcucuaaaacccuugaucuccuuguuucaaacuuuauaguaugggcauugcacauaggugagauaauuuuuguuuccauuuccgugguucauuauauccuucagaagggguuuaggcacuuuagaaauucacagauaagucacugcaaguaagaacuagcgaugagcauucuuuuccucaaccacaaaccacacgugccucuauuuguauaauagaaggcuauaaugggagucaaagggacuaguuuguugagaauguugcugaauauaucauguugucccauugaugugcuuuauaauugcacugauguguuuuccagaaaacuguggcaccaacccaggauucuaauacauagucaagaaaaugcuacagccuguuguagcucccccaaagcaagcagcucuccauggaauggcguccccaggcuucacaccauggucaggagggccugccccacaagugcacauccugcucuagcuaggaccauugugccugaguuugcaucuggguuccuaugcuggugugcuggcuugaaccacaugugaaucucaaccccuucuuugucuuugaagguagauacaucaagagaacuccaucauggguggggugucuuggggaugagcaccaaggagugaauguuugguuuugauaaggaauuaugaaagagcaauaaauaugcuaacuguagaauaaccugcuccaacagcagagaaccagguuucugauccaacucugggguccagaccaggggcuugagaauaguuuuuauuaugaaaugacccuguuagggguuuaauuggccuccucccaagaugcuguacuuuuaugugaagugcaucaggggucccuucuauuuggagaagauaaacuaauuuccuucugucuauccagugccauuuggucucccucucccauccuccuauucaguagccaaagaacuaauuuggcuacaauacaacccucuucagagugcuggggagagagagaaaucaaauaugagcaaagcccacacccucuguagugggcaaagcucauuuguaaauaauuuuagucuuguugcucauucaguaauucuguaucccucccaauagguauuggcagcgugucagauggccaccaguuaugaagagcuuccccauuuccgaaacccccuagcuucucaagggucugugaacuggggaaaccaguuaugcuaaaggagucauagacccauucuuuucucuuuuugagggcugggguggggaaugguagaguggaacaacaucuucuauucaucuacucauucaagaagcauuuacagagcucuccucuguggcaggcccuacccgagagguggaaaagagaaaucuggacacaucguaugucucaguuuuccaaaggcauuucacaaaaugaguaauaaccucuguugggcugaaugguggccccugaagauaucagguccuaauacuugacaccuaugaauguuaccuuauuugguaaaggcuuuguagaggugauuaaguuaaggaucuugaguuggagagauuauucuggauuagccaguuaggcccuaaaugccauuaaauguauccuuguauaagaaggagacagagaaauaaugacacacgcagaggaauaggcgauguaaagauggagcaggaaagguuuaaagaugcuagcgauggagauuggagugaggcagcuacacacugaggaacaccgcagccagccggaacuggaagagguggggaacagauucucccugcagagcugcuggaggagugaggucuuuuggcaccuugauuuuggcucacugaaacagguaugggacuucuggccuccagaacuaugagagaauaaauuuguguuuauugacuccuccaaacuugaagaaaauguguuauacaguagucccaggaccauccuugcagguaaaauggagacgugggucuagaagacagugcaaguaggugucaagguauuugaccaacucugucuguuauucagucacaugggaaauacugacugacuacucaaaucuacagugcuucaggcacuggagcaguggauaaggcagacaauauccccacugacacugggguagggggaaggagcagcuaauaaauagguaaaugaaaaauaugaacaagguaacuuuagcaauugacaagugccuuaaagaaaacaaaacaggauaauguggaauggcggacggggauccuuuuagacuagguaguaggaagcccuuucuggugagaaagccuuggagcugaguccugaagaucaugaaggagcuaccaucuggagggagagcauuccaaguggaaugaguggcaaacacagaggcuuugagaugggaaugagcuuccugugugugagaagcaaacagaaggcccagaccccucuaagucaacagggauaucauugcucagggagggcugugggauucuguccuaggcucugcccuguacaauuuucauuuuuuauaauuaaauuggaagaaaacguaaugcaucauaaaugugcaggcaauauaaagcuuguaggauguguacuggguuagagucagggguugaguuucaaaauaccuugacaggcaugaacaaaacaaugaacuucagcagggacaaacugugaaguccugacuugggucugagaacaaguauuugccuaagucaagaaugggaaccugauuugagugcgguacuggugugaagucccugaagcugagugucagcacguagcaugaugugacugccauaaaaaagucaagcacuuuuacaacuuuuuuaaacugugggguacaacuccagggaggaaguagccaggggucuguuuguggaggacugaguggguaucacauuuuauggggucacagaaacagcucauuauuuguuuauucauucaauuaauaaaugcuuaaugagcacauauuaugugccuggcacugacuaggcuuugggguaaauaacagugaauaggauggaaacauuugaugacuucauagagcugacauucuagggagaagauagacauggcagauuuaauuauacacauaucuuuuucacuguauuagauuuuuucagauuauaaaauuauaguaauaaaauagcaauaucaaauauuacugaaauacauaacauaggaaaaaauaugcccugucaauucauccucccuccccagacguagccacugucaaccaguuugugcacguuuuuguaacuuuuaaaaauauacaugcaauguauuuuuaaagcauaaaaggggaaucauacacgucugaauuuuguuuuuuagcuucauauaucugggauauccucucacaugaacacaaggaaaucuaccucauucuuuuuaaugucugaauaauauuucaugcuauggaugcauuauaguuuauuugacuaauaucuuguugaaaugcauaccguuuccauuuucacuauuauaaggauuugcaaacaauuguucuacauaccuuuuuauauagccuguggucauauuucuaaagcacagauucagagaagugggaauacuggcugggcgugguggcucacgcuggcucacuaugacaucuguaaucccagcacuucgggagggugagaugggcggaucaccugagaucaggaguuugagaccagccuagccaacagagcaaaaccccgucucuacuaaaaguauaaaaaucagcugggcguggugguguguaccuguaaucccagcuacucaggaggcagaggcaggagaauugcuuggacuuaggagguggagguugcggugggccgagaucaagccacugcacuccagccugggccacagagcgagacucugucuugcaaaaaaaaggaaaaaaaaagaaguggaaauacuguaucaaaagguauggaaaauuuaaaugauagauaccacguuucuuaccauucaggauguaccucagugagagugcagaugagaucacauguuuucuugcagccucaacauuccaggcaguguagacagugcaaagguccugugguagagggaaccugguguaucagcaggacugaacagauucccuaggggcagagagcagagagccagguggggagugaagagggaggcaugggccagaccuugcagggccuugcgauucaucuugaggguuuugguccuuaucccaagagaaaggagaagccaaagggaauuucaugcaagcugacaugaugagauaggcauuuugaacagguaccucuggcugcuguacaggcaauggacugggaagauggaaaaguagaugugaagagcaccugggguagcuauuuugggaguccaggugagagaugaugguagccuggacucggguggaggcuggccauggagaggaguggcuacauuuaaccguuuuuuaggccacagaacugauggaagcugaugccuaagugggcuuagguggggacugaggaagaaggcaguguccuggaagaaagauggaaugggaguuaucauugggaugaugagaugucaaaggagcaggugaugauuggccaaaaaagugaagauccagaggagauaccugcuuuagagagcagccuuugcacccuugucucucaugcccgcagcucuaucaaaggcaggcugaccaugggauucugccacccuggccacagcugauuggagugggaaaguaccugagccguggccauaacguggucuggagugaaagccugcccaugaaggggcagugccaaauggagcugaugagauguccuucauggaguuugaaggagaacccaagugaguggcaauguuuggagcuggggagucagaagaaaggccacacaaggagagggcaggaaauggaagucguaaguuaaagucacaaggaaacaaggagagaagagagaagcaggugcaggagaaggggcugaagacccauauagcgcuagagagggauggaugaccucuguucccaguauggcugaaugcuuaagagccagucuuucaagcugagcagaucugaguuugauuucccaccucuugugcuaacuagcucagugaccuugaacaagccacccaacuucucuaagauuguucuguucauagacauuaaaguauuuauuucucggaguuguugugagcuuuaaagagaugugcgugaauaccaaagaagauauucacaacacaaaaccaccagagaacuggucuccagacuuuuuuaaaaaaacaaaagucucuuacaaaucaguaagaaaaaggcaggcagcccaguagauaaacaggcaaaauacuugaacagacacuuaacaaaagaggauaguaaaauggucaaaaaaaaugaaaagaugaucaacaucauuaauaaagagaaacacagugagauuccauaugcaacaauguggacgaauccuaugaacacaacguugagcuaaagaagcaagauagagaugaaugcauaaagugauucaauguauuuaaaguuuaaaagaaccaggcauuaaaacuccaauuaaauauuuuauacucucaucagagaggcauaugugaaaaaucggaugauaccaacugucggugaggauacaguacaacaggaaaucuguaugcugcugauggaauguagguuaguauaaccauuuuggaaaacaccuuggcauuauugaauaaaacuaaaaacaugcaugguacacaacccaguaauuuuguucuuggguguauguauauaagaggaacuuuucauauauaccacguauacauauacauauauguguauguauguguauauacauauacacacauacaagcauguccauaauuuuauugcuaucauggccucagaaacagugcaaauacccaucaacuguagaaugaguaaguagauugugauauauucacauaauggaguacuauacggcacugagggaauuaacuaugcuauagagaacaauaugaaugaaucuuauaaacacgauguugaacaaaagaaauaauauguauuauuuuacuuuagaauucaaaaauaagcaaaacuaaacuauaaauuauauaauauaguuauauauugauauuauauagcauagacuguugaggaaacuauaaaaaaaaguaaggaaacaaugaucacaaacaucagaguagugguuacaucuaggaagggaggggcccuggggccugaagggagugcucagagugagaggacucugcagugcuugagcauuuucuguuucuugacagaccagguaguuacacaaguguuugcuuugugauuguucauuauacuguauauuuguuuugaacacucuaagaguauuuuauuccacaauuuaagcagguuuuuuaaaaaaaaaaaaaaagauagcuaacacuuguaaaaugcuuggcauagugccuggcccauauuaagagcucaacagauggcaauuuuauuuacugguauaacccaguuguuagagccacauuguauccuaagcaaccuuccagcuccugaaccagcucuagucuccaugcggucuggcuuugagguugagauuccagaucccucuguuucccaggcuggccccaaauaaacccuauuacuuaaggcagugcuuuucaauggauaugugaugguuuauuuuauugccuuaaaugcuucccaagugagcugcaauguguaagauguuuuuugggagcauuucuguuguuauacaguucuggaaagcuagauugcuaauugagcaccgcaugaugugggauagagucagagucuagccugcugcaggucagaguucaggcagcagagguggaaccugauggcaauguagugccaaagaaaaaagaccuggguuucaaagacagaggcuaugagggaaguaaagacacacucaaauagcagucauguggauggggaccagaggaaucccaggacaauuguggauaccauuuuaagccuucaaguguguaaccccaaauucuagcauuccacagaaagagugacaaucacugauuuaagguaaucugagaaugucuauuccuugcaagccuaauaaagaaguuuccauuucauagucaucagaaggauuguuguaugcaauagcuaaugauaauacuagcuaauaauuauugggugcucaacagaagccaggcacugugcuaauauuucauucuuaccucaacccuaggagguagguacuguuaucucccuuucaguagauacagcugaggcacaggggaguucaguaacuugcugaaggucacgcagcugguaaaugcuagagccaggaagaaggaucauucuuagucucuaguucuagaagcaaggguguggcccaggguuuaggaguuagauggaaugacauuuugcuaacaguaagcaaaaacaugccaacaggccaauccaacauuggaauggggaguuuuagaaaacagcaaauucucucuaagcagcaugacuaucaaauauguuuuagaagagauuuuugcauuggguagcagguuggacuaaaugccuuucaagguccuucaaagaacccaagauuaaaaguuuagaucuugguagagcuucagauugggagcuggacuguaugcuuuuuauuuuuuuuuuaauuugaacuuccaaacuccaaugcauacccugaugcauaaacuauguacacuuuuuauuuugauguucaugaacuucucagaacucuugaggcaugguaaaauuauuuucccuaugugguuuuuuuuuuuaagucuuuuagcugacgguaguuguguagcaucuuucugaccagcaagaaaaugccuuucuaaucucuagaagagaaauuguuugcauaagguguucucccacauuuaugucuuuaauuucagacgagaggcacugaucuuuucauaaggacuuuccugcuacaccucccacaaauggugugugucuugugaacucuauagguguggcauugauaaugguguuugauaguguuugggcuguucagaaucugcccuuuauacugaaaugguaugucuagcuuuguuuccaggauuacagaaacuucuuuggucuauuuccgugacugcauucaguggagacacauuacuuucugcuuuucagagccugagaccaccuuccaggacaauggaggcauaugguggcauuucuaguuggaguuggcgcugauugagccuuugccauuacuuggcaaaauuaauuugguugugguugguuguuugacccggggguggcauuuuucugugggcagaauaguagagcugaguugcauauaguuguuuuuaaggucuuuggauaauaaccauuuuaaccaaauguguagaggcuuugaaauugccauaugugcaacuuaaguuaucauuucacauacaaguaguucauuaaauauauuaauugaguuuauugaacauaugcuuuuaaaaauagacuuuguauuuuagagcagauuuagguucacagcaaaacugagcagauaguacagagauuucucauauacccacccacuugcauagacucccaacuaacaacaucccccaccagaggugguacauuuguuagaguugaugaagcaacacugacaccucauuaucccccaaaguccaccauuuauauuaggguucacucuugguguuguacauucaguggguuuggacacauuuuuaaugacauguauccaucauuauaguaucauacagaguaguuuacugcccuacaaauaguuuguguuccaccuaggcauuccucccaccguucuaaucccuggcaaccuuuuuuuuguuuuguuuuaccuucuccaugguuuugccguuuccaaaauguugcaaaguugaaauuaacaguauguagucuuuuccaauuggcuuuuucacuuagcaauauacacuuaaguuuccucaaugucuuucuguagcuugagacagcucauuucuuuuuagagcugaauaauauuccauugucuggauguacggcaguuuacuuaucuguucaccuacugaaggaugucuugguugcuuccaaguuugggcaguuaugaauaaagcugcuauaaacauccacauccagguuuucguacggacauaaguuuucaacucuuuuggguaaacaccaaggagcaugcuuguuggaucguaugguaagaaucuauuuauuuuugugacaaauugccaaucugucuuccaaagugacugugccauuuugcaucugcaccgcagucagugagaguuccuguugcuccacauccuuaccagcauuugccauuguugguguuuuggauuuuggcuuuucuaauagguguguagggguaucucauuguuuuaauuugcauuucccuaaugacauaugcuauggagcauuuuuauaugcuuuuuugcuagcuauauaucuauauauagcuauauaaauauauauuuuuuauuucaauaguuuuugggguucaguugguuuuugguuaaauggaugaauuguauaguggugaaaucugagauuuuauuuuaccugucacccaaguaguguacccaauauguaguuuuucauugcucucccaccucccccuuaccuccuucugagucuccagaguucauuacaccacuguguauaccuuugcauagccauagcuuagccccuaauuauaagugagaacauaugguauuuggcuuuccauuucugaguuacuucacuuagaauaaauggccuccagcugcauccaaguugcugcaaaagacauuauuuuauucuuuuuuauggcugaguaguguuccauggggugcaccuguggauagccuuuccugaacacuucagcggggcugccucuccacaggcagcgugcccuccaguugcaggcuugcgcgagggguagagucacaauccaucucaacauggaacaucagccuuccugcagaugaaaagaggugucugucugaucugaauagcugggacacugggucaggagugugacuaggagguggaucacuuucaggggagcugagguguccgucccuuccuucugagaagaccuccgugcauuucacugagagcucccucagcugccucuauuagggcugggaccucuacccaucauuggguauugcauuuacccacuuugcuuuagccaccaauuuuuuuuuuuuuuuuuugagacagggccucacucucucacccaggcuggagugcagugguacagucucagcucauugcaaccucugccucccaaguagcugggauuacaggucuguaccaccaugccuggcuaauuuuuguacuuuugguagagacaggguuucaccauguugccuagguuggucucgaacuucugagcucaagcaaucugcauaucucagccucccaaagugcugggauuacaggcgugagccauugugcccggacaccacaaucgguuuuuaccuguggacaccuccccuucuggcuggaagcucaaccuguucaacccaguaaauaaagugcuagggaaaaaauuaaaaaaugcauacuacuggagaacaagauaagcuuugagagaccucugccauucugaccccacaggagacagugagcacauugcugcuacaaccagcagcugagaaagccaccauacaaagacucucuauaaccaaggaacucacacagagucuucaccccugaaagcaccaggagcagaauuaggugacaauaaacugugucuuuuuuuauaaggugucuauucagaucuuuugccaguuuuucaacuggguuguucguauucuuauuguugaguuuuuaagaguucucuguauguguuagguaaaauucuucaucagaugucuuuuguaaauauuuucucccagucuguagcuugucuucucauucucucgaauauacacuccucugacggugcucuguuagauguuuuaugggcacagaaauuauauuuagcacggaauuucucccuuucaaguugcucucauucuuauuggcaaauaccuauuuccugggugcagaaagauccccauugcuguuuccuauuggcuacucaugaagcuguuaaguggaucgugggagcaguaaacacuccagauaauuuguuuauuugggaaacuugcuuggauaguguuuuaugucagaauucuaugacaaacugugcuuuggugacuuauguauucagacucugacuuaucugggaagacaaaaugucauuagcauucuaagaaauauuaaugacugcuauuuauauaccccauccacaccacuuucacuggcaucuggcauugaugauugugaaguauugaugacuuuuccaaauaagauggaauauggcaauuugguaaagagcaaacauuuuuauuuuauuuaucugggguuaauuuuuuguauuuugaaauauucaaaaauacuuaguagaagggaucauuucuuuuuucuuuucuuuuuuuuuuuuuuuuuuuuuugagauggagucuccaggcuggagugcaguggcaugaucucggcucacugcaagcuccgccucccggguucaugccauucuccugccucagccucccaaguagcugggacuacaggcgccugccaucacgcccagcuaauuuuuuguauuuuuuaguagagaugggauuucaccguguuagccaggauggucuugaucuccugaucuugcgauccacccgccuuggccucccagagugcugggauuacaggcaugagccaccacacccggccacagaagggaucauuucuaaauagcauagaaucacagggaguacaccucaugugacuucacguuuagagucagcauuugcucauaaugaauuacauaucaguaaaugaacaugacaugcuucaacuucaauaauauuaaacaaaacucuuucagugugcuuauucauagaugaaaaacagggccugaaaacccagugugacuugggugucauauaucuucaguuuggaugcacuauaucagugcuaaucaauaaaggccaggaaugauuuuggaguauaauguccagccuuaaaucuuaaaugaaagugaaauucaaacacuuagcccagcaguagaagaacaaacacuagugagacaguauaauuuguuaagacgaacaugggccagauccauuaucuaauauauguguccucgacaguauguaccgucucgaagaggaagaaauagucaagguacccaaaugagccauuccucagagacagccaaagagcucugagagagagcaagugugggcaagaaagaggggacauuugugucucugaccaugaacauaugcugagucacccaacugcagguccauuuuuuuggugagacugauauaaauguucuuccaaacuggccaagcugcaagguuuccaaaagcaaagcuuaaggcuggacgcaguggcucccaccuguaaucccagcacuuugagaggcugaagugggagggguuugagaccagccugggcaauguagcgagaccccaucucuacaaaaaaaaugcaaaaaacaaaacaaaacaaaaacccaaaacaagcaggcacaguggcucacaccuguaauggcagcacuuugggagucugaggcagguggaucacuugaagucaggaguuuaagaccagccugaccaacauggugaaaccugucucuacuaaaaauacaaaaauuagccaggcaugguggugugcaccuguaaucccggcuacuugggaggcugaggcacgagagucacuugaaccugggugguggagguugcagugagcugagaucaugccacugcacuccagccugggcaauagagcaagacucugucuaaaaaaaacccaaaaaacaaaccaaaaccaaaacaaaaacagagcuuaaaaagcaagacuugcagaacauuaggacuaggagguagcuguggccagggcucuguguaaugcaaagauuaugucuauaggaccucugcaggccuggguuuuacuccuagcuguguccuuacuaguuauaucaucuugggcaacuuauguaaaccccugagccucaguuucuuccuuuguaaaaugggaauaacaauuucugccauucaguacuguugccuagaugagugauaauuugugucaaauaccuggcacauacuagggacucaauaaauuuuaaguacaguaaugucacuuaacaauggagauauguucugagaaaugugucauuaggugauuccaucauugagcaaacaucauagaguguaccuacacgaaccuagaugccuacuacccaccuaggauacaaaucuguacagcauauuacuguacugaauacuguagcaacuguaacacaguguuaaauauugauguaucuaaacauguaaacauagaaauguuacaguaaaaauaugguauuauaaucuuaugggaccacuguugucuuuguggccuaucacugauugaaauguuauguggcgcauaauuauaauuuuaaaaaaucacucagaccuaauguaugcauuuaaugacuccacucuaaggaaagcccagaugcacuuaaauauacuucuguuuauacugcuuucauuggaaaugaaaugccaugucaacuaugaugcuuucaguuguaaguagcaaaacugccaacucaaacuagcuuaaaaaauaaagugaauuuauugguucauguaacuggaaagucucaugaaaaugucagcuucaggagaagcuugacccagcagcuucaugauguauggaaauaccuggguuuuuuguuucugcucugcuacugugguaucagcuuuauuccaagucuggcuuccuuuguuguugcaaaaugcuugucagaagaagccuggguccaucuguuaggauuaaguuuacucuguaugcuguaguaguggcuaugacaagauagaaguguauuucuccuccauauaaaagaaauccagagauaggcaguccagggaugguauguggcuccacuaugucauggacccagacauuuaacuugaugcuccacguccuaagguauggcuccuuuucucaaguucaccucaagguccaaaaugacugcuagaguuccagccauuacaucugcauucuaggcaggaggaaggggcagaagaaaggcuugccucuucucuuuuaaggagacucauuggaagugccacacaauccuuugcuuacagcuuauuggcuggcacauaggguaguugccagggagacuaggaaauaaagucuuuuguucccccucccauccucaguuccuuuugcacugugcuaaacaauucuaggacuuuuaacagaacucuucauaaaagucuugaauuuuauuguauuuauuuauuuuugagauggagucuuacucuguuacccaggcuagggugcaauggugcuaucuuagcccauugcaaccuccaccucccacauucaagugacuguccugccucagccuccugaguagcugggacuccaggcgcgcaccaccacaccuggcuaauuuuucuuuuuuuuuucguagagacagguuucaccauguuggccauggcuggucucaaacuccugaccucaggugaucugccugucucggccucccaaagugcuggaauuaccagugugagcuaccaugccuggccaaaaaucuuggguuuuagaucccuucuuuauuuuuuuggaucuuuucugaaucuucuccagucuuuccugauucacaaggggcacagucauaagccaggaaaucccuaaaccuuuauauacuuuaguuuccccaucuauaaaaagauaaaagauaauuguagcuacccuuuuuccuccagagauuaaauaagaugcaugcaugcuugaugcagugaacauuuaaugaauguuaaguaauaaauguaauacuuugugauucacggguccugucuccuauuuguguuuuuaucuaucaugcuuguuucuuuaccugaaaccuccaaaucucuucuugcucaaccgcagcuucugcuucuguaauuuguuuuucucccuuuagaaaugcuucuuaauaaacgccuuugagucuauuucugacuucaucucgaauuugccaagguaguuuuuucagugucugaaaauaugacaauaagagaaaaugauucaggagggcaaagagcagaaaagcagcuauaaagagugggcagaggggaaggggagcguuggccucucccugggagcuccaggcuccaugugcacacacaggcucauccccgcuucugucaagcucuuguucccaggcugaguuacuuagaaaaggaagaagaauguuuccuauuuguucaugugaauucacuuaagaaacacauccucagugauuaggcguuagagcuaauuugucuacaugcagcuuaaaguuaagcuugggaauuuauuuuauuugaaauucaaaggaugaagcccucuuugucuuaagggcugagaaacgcagcucagcugcgucuaagaugguuuguacucacucucuuccucccuucuugcuucggcaaggauggaagggcugggaggauuugcauucaguuucucaugcaaagagcuccucacggaauuccugcccuuugcauaugcuggacaagaccaagauuuuccaggucgcugcuugcaguuguauucauaacuguggggggagauaauagcuaacaucaauugacggucacuagaagcauuuugcauguauaauaacaguaacagccaacacauaaaacggugccuacuaugugccaggcauaguuuaaauuauuuuguauaccucaaccaauuuuauucuuucauauuccucugaaguaguaauuaccauuaccuacauuuuacagaaagguuaaaugugggcucagaaagguuaaaucacuugcugaggguuauauucagcuagugucagagccuggauucaaacugaucauauggcucugugcucuuuuucuuucuuuuuuuuuuuuuuuguuuugagacagagucucgcucugugcucuuaacugguacauucuaccaucuuccuaggaggggguuuuaguauuaauauucuuauaaaaaggagacugaggcagggagagaggaaggaauccuggauuccagcguacgcaggagacuccagagcccgggucuucuuugcuaccuccuccagggacaugcggagacaucuccacauccagcacuucacauaggaaguacccugaggaccacgugggaugacauaacccaucuggaguaacuaguggcauggugcagggugcagagcugugcuugaggugcucccuaaacccuaucaguccugauacugcuucuggggccuggaggggaguaagggaggccaguguuugggggacagaaggcggcagcccugugauaaacaaaaucauguuucuggcaccaggagcagaauucaugugugcuuuuacugcuuccugugcucuuccucauuuuaccccagggccauuggucaugguguccugggacccucugggggcuuggagcaucgauaccacaaccauagucccaccuguuaaguaagagaacuagccagggaagacaucauuuaaaguguaauuuauuuauuuguaucuugccuugcuccccaaagcuuuuaugacaggauacagaaaugcuucacauacuggaagagugccucaguuaggugugugugugacaguguggcugcaaucccagcucuccuucucuccuucccaggagccauggacaagugccagcaucuuucuggcaccggauuuuucugccucuaaugugggaaugaugucuucccaguagaauuaggguagacauuaauaccaguucauguaaauuucuagcacuagccuggaccacagaggugcucaguggauaauuauuauuauuacaaggcauagaauuauuuaacggaaagaaaucaagggguggggucauaaaauagagccaagaaugagguccauacaaaaauaccuacuaugaagucauacgcacuuugucagggccagugugaugagagaaaccugauuauuaaaucacucacgauguucacaagaggaaaacagugggcucaggagaggcaaccgcucagaaagagcucuuuagaggccuucugagaagggcacugugcaacguuauaaacuguucucaacaacuuccucagaauaaacccagugauaagugccaccggcuucccuuuaauagaggcuaauggcaacaagccacagcaucagccaauagaaaccauuccugagagccagcaucauagaguccaggcacagugcuugcaggggcugugauuuaaccaggggcaacaacagcgagugcuuacugagcgucaggagggccagugagagcucugagcccucugcauggaucaccucgcuuaagucuuacaacacccauaugagauuguaauauggucauccccauuuuacagaugaguaaacugaggcccagaaaagcuaagaaagcuucccaaggucacugagcucauuaucccuaagcagcguucaaacccaggcagucaggcaggcaggcaggcaggcuggcucuggagccugugccacugcccucucugguaacugauuaggaccaaauaucccugugauaguccuucauaaaggcuguccuugacagcugagccuuugacaaaucuugggcagcagugaguuuaaggaaaugugugaauccugaugaguuccugaggggccaacauucuggagggcuaguuacuguggagccguaugcuuuacccgugggcugagauggaauaggaccaacagauuuccgcucagggucccaguaugggcucuggcuugaacugaaggugauccaugagcuggguucagaaaaggggguaggcaaauagggaagcaaggccaaagugcaccuagaaaguaagcuccaguccacuccagugcacagacaaauggaugauugagaacccacaguucauguaucagggcugccauaauuuuaaucggaaaaauucuuuaaggcaguuaaguuucuguucuggcuauuuugaaaaaaauaaugaauagggccaggggcacugguucacaccuguaaucccagcacuuugggaggccgaggugggcagaucacuugaggccaggaguucgagaccagccuggucagcauggcaaaaccccaucucugcuaaaaauacaaaaauuaacugggugugguggugggugccuguagucccagcuacuugggaggcugaggcaggagaaucgcuugaacccgggaggcggagguugcagugagccgaaaucgcaccaccacacuccagccugggcaacagagcaagacucugucucaaaaacaaaaaauaauuuuauauguguguguguguguguauauauauauauacauauauaaguguauauauauauacacacauauguauauauauguacguauauauguagguauauauauauacauauauauguauccuauauagguauacauauauguauauauacauauauauguauccuauauauguauacauauauguauauauacauauauauguauauauguauccuauauauauauccuauguauauauauguguauauauguauguauauauauguguauauauguguguguauauauauauguauguauauaguauccauaggauacuuagugcacaucucuuuuauugugauuucugccuaguauauuggacccccaaacugucagacaaaaaacacuuccaaagucuucuccaccccauaaucaccaucccagcagaauuuuccagaaaggcaaauacaguauugugcuauuucugcaugguagacauugcauacuuauaauucugacacagcaggacucuaagccauccagucuucugggcuccucuucuuguguaccaagauuaacgagcagagucccacuccucuucugugaaagccgaguccuccucaagauguccugagacugucucugaggacucacagacuccugguccaggguugucagcauccuggcagugacugcccuuucccugacaugucacccugcuguacagggccccaguuucucuauccuuucugccuuaggcugcauuugccugaaugccaaggaauuggagcacagcaucauaggggcaaucgcagaaggccuaauguucugcccuuuagccaaaccacuugccauguccccuuaaggccuugccuugccauuaccuucuugggcuuugcucuucuccagaaguggcugucuacucaacuaacagcuuccugcaauccccaaauucugguuacuucccaccggaacacaacacagcuuguucuucauuuuucuuuguuacuucccaggcuauacccagagcuugcauuucucaccuacaagucccaucaaggcucaugguauuauuucuucccuauaagagaauguauguccuauuacgugaaaguggcuacagucauggcuuuaaauagcauucucccacugcuacaauauguguauugaagcuuacagaauaguugauaguuaggaauuaagccuaaaaaaguaaggaccaaauaacaauauaacaaaaaugaccccaaacaagagaugcccaagcaguaugaucaagcaaagaauggugguaccaaaaauaagggcaaagaagaggagauggcugauggcggggauggccccauugggcucucacgagagaggugaagguggauugaguaugagggauggaggaugugaugagcggggagagacuaggagggugucucagggaggagaaaccacuugagcagaggcagggagguggccugacacgugacccacuggcuuggaggagugaguaggaguaauccaggcuggcggggaagagcaggaucuuuaccaggccagaaggagaagcagaaaccagacgauggagacccugccaauugucuucugauagcaguucugaagugaacaaguugauugcgguucucugaguguaagacacucaacaauguaaacugcuaggaugcagcucucuaauuaagacuauuuucuuacaacauguguuuguuuauuacagagagcugugaucacuugagggugucaugucaaccuugucucaugcaccagcugaauucagugacacuaacauccuggauccugcagaugagaguauuaugacugcacuaccagggaggcugcccagggcuggagauugcucugcuccagaggugcuugguuugcagugugggcggacucaaccugagcgaaagccacacaaaagcgccuugagcuggagccccaugcuaguguugguuccaccagugguucuuuuuuuuuuuuuuucugagauggaguuucucucuuuuugcccaggcuggcgugcaauggugugaucucggcuuaccacaaccuccaccucccagguucaagugauucuccugccucagccucccgaguagcugggauuauaggcaugugccaccacgccuagcuaauuuuguauuuuuauuagagacgggguuuuaccauguuggccaggcuggucucgaacucccgaccucaggugauccuccuggcuugaccucccaaagugcugggauuacaggcaugagccaccgugaccagccaacaccagugguucuuaaacuucagccugggucugagucaccuggagggcuaugaaaacacagagugcugggccccauccccagaguuugugccuucaguaggucuguggggggccuaaggauuugcguuuguaacaaguccccaaguaauacgggugcugcugguugggagaucccacuuucgaaucgcagguucacucuacagucccauuguuaacuuauaaaacucuuccucucuaguucuucuuuuuguaaagguguguccugaggaaccucagauuugaaagaagagugaauggaagucaaauguggaaaccacucaaauguccaucaacugaugaaugaauaaacaaaucaugguauauccauacaaggaauauuauucacccauaaaaaggaaugaagucuuaauacaccuacaacuggaugaacauugaaaacauuaugcuauccauucugcuucagguuggaaaaaaaaauacgauccuuaccuaaagaagccaucuacaaaaggccacauauugugugauuauaucauaugaccagaauacgcaaauucauagagacagaaagcagauuaaugguugccaggaacugggggaaggggaggaaugaggagugacuaacuguguuuuucccauugugauuaaaaaaaaaguucuggaaccagauaguggugaugguugcacaacauugugaauguacucaguaccacugaauuguacacuuuaaaauggucaguuuuggcugggcacgguggcucacgccuguaaucccagcacuuugggaggcugaggcaggggaaucaccugaguucaggaguucaagaccagccuggccaacauggugaaaccccgucucuacuaaaaauacaaaaauuagcugggcgugguggcacacgccuguagucccagcuacucaggaggcugaggcaggagaaucacuugaaucuggaaggcggagauugcagugagcugagauugugucacuguacuccagccugggcaacaaagugagacucugucucaaaaaaaagaaaagaaaaguuaguuuuauguaaugccuauuuuaucacaauaaaaaauuaaaagagugaauggaguguuguuuuaacucccaucaugggaccaguugaaagguuuauaggauagagguuggaaaugcaaagggccuaaaccagugguuuucagcccugauugagccauccuauccuuggagaguuuuaugucuuauccuugucuuagcugcgcccgagaccaauuaaaucaaaaucucuggagguaaggcccaggcaucaaaaaaauuuucaauacauccccagaugauucuaacauaccaucaguauuucaaacaguggccugaaaccucaagggucaaaugaguuaaugacuuuggugcaaacugacuugacccauaucauaaacaaugugccuucaucuucucccauacuugcuugggaggggauguagaguagaaugaggaggcuuucagaaucagaucugcccaggauuugaaaacuggcuccauuaccaacuagcugugucuccuugggcaaaccacauaacccuugugggcauguuuucuccuaagugaagaacaccauuucagaggguuuuugugaggcacacaugaagcagccaauuucccagcuuuaccagugucagacccuguuuagucaucauuccuuucuuuccaucucauucuagaccggaaaggagaaacagucuaaacugcaugaaaguccugguacugcuguaucucguacuauaaguucaguuuucucccuucaccugaggguaaguugaagaauaacuucauaagccagggagagauacguuuggaucaggaguuagugauaacaggugagcccaauaauaauccuuuuugcgcucaugcucagauguuuuuuaugcaccaagcuuuauaaugauguagauauacucuaagacaaaaacagauaaaacucaccuauaauuuugaaucauaaaauaguuuggauuuuuccauguuucuggguaguccuuacucuuugauaauauaaggaauauauuuuuauucaacuacaguuaaggcauagauauaauuuuauacucugcauuuucuuuaucuucagcauucguuauguuucuauaguucauuauugacauuuuaaugacuacauaguauuugauugaauagccuuacuguaauuuauuuugauauuccucuauuaagccuuuugacugcuaaguuuucaauauuagaaauuguacauaguaaaaauauuucugcacguaacuuuuaauuuccuuugacuucuuuucuuuuuuuuuuuuuuuugagauggagucucgcccugaugcccaggcuggagcgcaauaccacaaucucgucucacugcaaccuccgccucccggguucaagcgauucuccuaucucagccucccgaguagcuaggauuacaggcgccugccaccaugcccagcuaauuuuucuauuuuuaguaaagaugggguuucaccgugucggucaggcuggucucaaauuccugaccucgugauccacccaccuuggccucccaaaguacugggauuacaggcaugagccaccacacccggccuugacuuauuuucuuaaaauauauuuccuuuaaguuacuggaucaaggggugugaacauuuuaagguucuugagugcaguaucaaauugcucugguaaaggauuguaccaauuuacacugcuaccagcaggguguggguguacauuuucaacaacuugccagcaccgaauuucaucauuuaaaaaggguuuacagauuguacauaauuuaauuuaauauaaacuaauaaauuacuguguccaacuuuugagcaugcuuaaaauuuuuuccccauuucuuuuuugguggcaucccuacuauuucguaaacugcuugagggcaguuuacaaaccuugcacauuguagaaaaucaauaauugcuuuuugaaacaaugaauaauucagggaaucccuguucccaauaauucuucaguuuugauaauagcaguggguuuuggguuguuuugguuucaagauaaacuaaauuacacuuuauuucacugauguuggcagccccagaggacucuguuugcaggaaaaaaaauguaugaagauuuuccuaggugggaaguagaccucucccacacaacgagaagagcagcuaaaucauugcucuuuucucccagucucucccugcacucccaucugauuuccugucugcuccugaaaagccagcucaauaugaacuaaggaaaagcuauuuguagugcucaugggaggacaaagaacacaaauaggcucuuccuaaacuauugagcuuagcuuucacucuuuccagcaggaaaagggucaugcauguccaggugauacuacuuguacuuugguacccauugauugggacagugugugccgaugaaaaggugcugugaauucaguaaugcuuuuuaaauacguauuuuaauuucaauaaugucuacauaaauuucaaaaacagcaauuaaaaaauaugcuugagaccaauuuauccggcuacaccuauuuggugcauauuugcauucuuagauuccuuaaauguccucugcacaaagguuaggaaacugugcccugacaauaaagcaguaucuuauuagaacuaagagauuaaccaguaaagaggacuagagaagucguuguuaacugauacuuuauuaguauuuaauacaguaaccugccucugcuagaaguaaggacuccuccucaacuuuuaaagauagcuaauuuuauaacucugcuuccuaccuguucaccuuuuucucauuggugacagcaacaaacaauuaauggcuuucuuaaaugucuugcugucugaaauaagaucuuuuuccaauuaaaaaguaacaaaggcugcaucucuccucuguuuccuucuuuggcuguaacaucuugacaucucucucucugucuccuguuuuauccaagaccgaguuacaugaaaacaaaaugggucauaggcuuccauugugggggcggggcgggggggcagauuauuugugacuuugguuuuaaagaaaauuuaugcuggugguuugcagaaaguugacauauauccuaggguuuccuugucagagggcagcaggguccccauggguucacaucguugccuggacaaggagucuuuguacccuaguggugccuggguugucgcagggaugggguaacucauuuauucacacucuuucuccuuuccuguuuccuucaaagauacccugguccuaguugacucuacuuuacuguucaaaauucagcucaacauaugucaagcuguacguucuuaaacucaaggaaacagaaagguuauaaccccgugguuuccaagccuggcuuuucaucagagucucuuggugaacuuuuagaaaauccauauucuugcccccacagccauucugauucauuaggacugcuuggggccauggaacuuauauuugaaaaagcucuccuuguguuucugaugaucaguccaguuucagaacaccaagcuagccaggcucccaggguaagaccuccuugaguaucaucucuggcaggugguucuauaaccuccacuguaaaaccuccagccaugggacgcucaccacuuuuuaugaguggccugaguugagacauucuuccuugugcugaguggaaaggcauuuccaccacaauaauuucuaccuguugauuucaauuaugccuguuggagcaauaccaaaaaaaguuauucuuccccauaauaaacuuucaaauauuucaaccucucaagcaguuauuguuuccuucucaggaucucucuucccuuuuccagacucuuaguccaggguccuucucugauuaugguuggagugagaguguugauuaugugccaagugcuuuagaccugucuuuuagauaaagucuugagggaaauuuauggugucacuaucuucccaguauuugggaugagaagaccaagggcuagagaagucauaugaccugccccagcucccacagcuaaguagcuaaauugaaauuugaacacucuaucugacuccaaauucuacauccucaacuaacauguuaugcuucagaauuuuucuuucuuuguuuuuaaaugcgaaauaacaaaugcuaaaugugcauuaaaucaagguauguaaaaguaaaaccguccaguuuaaaauucuacucuagaggcugccacugccaaauuugagaaggcccucugcagcccaccaccacaagcuggaaguuauagucacagcagaggggagccuucgccuccuuugcucuggacaccaucugcagugacugcggccuccaacugcacugugggcuuggagcagugaguagguuucuuuugaccuugaagcaacuagacccugaguuuuuuguuugcuuuaaauaaacuuguucagauggcacucauuuuauauccuugcaaauguguuucuuggucuuagaaggacuuuauaucuaucuccauuauuuuucuuguugguugugauccauuauaucaacuuauauagaucuuucaguucuuucaauuugaucaccgauuaaauuaucucgcucaaugucauucucagaucuuaauacaugugaugccucucuuuguccaaauaauugauaagagcuuuguuaaagguaggaccaaggacagagucuuugagcacuuguaggggaauuaaucaauuaauacuccugggcuacaguuuuucaaccaaauaugaacacaccugauuguauuaucauucagucuugucuauaagggcaugaaaaauuuggucaaaugccuuucuggccacagcauuuuccugauuaauccaguaaguuuauucaaaaaaggaaguauucaauuuuauucuuggcaaaccuaugugaguuccuacauaccaucaccuuuucuucuuaggguucagaaaauauuucuuuuauggucugugcaagaacuuugcuguggauugauaccaaacuuacauuuuggcugggcuucaagugacucagaaaggggcuggguucaggcugggaugucuggagccuguagugguggcaaggcaaaggccagcagggauagugaauagaggccucagugaugaggugggugcguugguuaauugcacaggugauagggcuggcuaauuaggguagggaauugacuagcugucagugaggugaacugaagaauccacccuaugaaggugucaaggggcagggaaagaacaagaauggaaucaagguagaugucucuucagagagcagccaacugggcagagaaaggcuggaggcugaagcuugauuaauguacacuaugguagaaaccaugaaagcccaaggauccaggaggugaagcugauguaagucaagggugagaaacggucuuggggaacugaggccucaucggggcuugugaugagacaacuguauucccugucucagcaaaugaugccaacuacccaguuguccaaaccagaaaccugguguccuccuggaguccuacugcucccucagucuccccauagccacuugaauuaucaagcccuaucauuccuaccucccucuaauaguucucagugcccauuucucuacauuguucuaccacccuugccacugucaucucuucccugaccccccauuuuuuuauugugguaaaauauaaauaauauaaaauuuaccaucuuaagaauuuuuuuuuuuucuuuucagacagggucucacucugucacccaggcuggagugcaguggugcuaucuuggcucauugcaaccucugccucccggguucaagcgauucuccugccucagccuccugaguagcugggauuacaggcaugcgugccacaaugcucagcuaauuuuuguguuuuuaguagagaugggguuuuaccauguuggccaggcuggucuugaacuccugaccucaggugaucugcccgccucagccucccaaagaauuuuuaaguguacaguucaguggaauuaaauacauuuaccauguugugcaacuauuaccaucaucugucucuggaacucuuuucaucucauaaaacuggaacucugugcccauuaaacaguuauugcccaguuuccucuuccucaaccucuggcaaccaacacuccacuaucucuaugauugugacuaauucuaaguacuucauauaagugcguucauauaguauuuuucuuuuugugacuggcuuauuucacuuaacuugucacaacauaucuuguaacauguuacuuaacauuucacuuaacauguucauccauguuauagcauaugucagaauuuccuuccuuuuuaaggcuaaauaauauucuaguuuauguauauaucacauuuuguuuauccaauuauucguugauggaugcuuggguuaguuccauuuuuuagcuauugugaauaaugcugcuauaaauguggacauaaaaauagcucuuugaaaagugggauuaauggaucauauagcaauucuauuuuuaauuuuuugaggaacaauaauacuguuuccacaguggcugcaccaugugacauucccaccaacagugcacaagaguuucaauucuccauauccucaccaacacuuguuauuuuccaauuuuuugauaguagccauccuagugggugugaagugguaucucauuguaguuuugauuuacauuucccuaaugauuagugauguugagcaucuuuucaugugauuauugguuauuugcauauauuuuaggagaaaugucuauucaaguccuuugcccauuuuuuaauugggugguuuuguuguugaguuuuagggcuuuauauauucugcauuugaaucccucuugagauacaggauuugcaaauauuuucucccacucugugaguugccauuuuacucuuaauagugucuuuugaugcacaaaauuuuugaauuuucaugaugucuaacaugucuauuuaaaaauuuuuguugccuaugucuuuggugucacauccaaaaaagucauugccaaauccgauguuguaaagcuuugccccguguuuucuuugaagaguuuuaucauuuuuagcucuuguguuuaagucuuugaugcauuuucaguuaauuuuugcauauguuguuaguuaaggauccaacuucauuauuuugcauguggauauucagauuuucuagcacuauuuguuuaaaagacugucuuuucccccauugaauggucuugcauucuugucaaaaauaauuugacucuugucaucucacucuugaaucacaaguccucuagccuccagauguggcuucccauucagucuguguauuguaguuacagcccuuauuuugaaauaaacuugaucauaucucucucgggcuuaaaaagucuucagugguuuuccuggcaccuucagaauaaaauaaagcccuucagcaugggauaccugccccuuccuagggaggccucacuucucacgccccccugcuucaucuugcaugccucagacucuggugguccgucuacugguugaucauagugcucuuuuaugcuauuggacauguuacuccugcugccagaaauaucugccucccaccuaacucccguucaccuaacucccauucaccuacuugcugcucuacucaguaugucuccucugucuaccacaaccugcuccccauuaugagaaaugugcccuucuuugaaugcccuuaucuuauuucuuucauagaacauaauugcucuguguuggaaugauagauuuaucugcuugucuccucucuagauugugagauccaugagagcccagaaaauaucuuaggaucccuagugcuuagcacagagcuuggcauauggagguaagcaaaaagauuuuuuaaauccaguuguccauccacucauccauucaauaugaaugagagaacagcccuuuuuuaaagagggauggccuuuucuuaaaagaccucuaucuugaggcauuauuuucccuuauucaagucccaguuuauuagguccugguacuuaauggugauaaaagggcauuauuauugaaagguuggguaugucaggggcacaauauuaguucaaacagugaacugaagcuuuuuugccuggaauccauuggcuucuuugauggggauaggaagcagccugggacuauugcugugacaugacaucaaucuugguggcuaacgggaagggguuaugaagaaggggguggacuugggggaugaagaggaccuguggcuccaguccaccagaaugaaugaccuaggccaugggaaguaagacugggaaguguuuuucaucuucuuagaguuugggauauauggaugaauugagugaaaugaggauuuuagugaguaucucuacuagguuccugacagggaugguuucuccagggauucaacugaaucuuauagguagaucugaucuggugaaagauaagguauaaauuggccugucaacaggacauucguacugguaguuauuacuaccaugauggcuuuaagagauuuugggggcuggcaagaaguagaguaaauguagcagaacagauggauguuauagggaaaauauagcuguaaggaacagugagagcuuagugaugguggcaguagagcauaaaagacaaauuaucuuuaacuuuggcuuugcaaaaauugggguauaaaguggggcuauauuacugaagcaguccgauuaggaggauucauaaaaaugaaaugcauuucauaugcacaucugggcagcuauagccacuguagguuucuuguaggucugauagaaaaugagcccuguuggugaauaccuuagccaauaugaugaauaccuuagccaauaugaugaauaguagugaaaggcuguaccuugggaggcucaggauuauacugaugcacccaucacucacaguuacuagacauguggcagagacugaauaaaggguugacccagggacacuccuugaauauguccccuuuuuuugaucagcauauccuucuaaccuccuagaaguuccaauuuacaaaauguaauggugggaaugaacaaagaaguaaggcacaauuacucuaucuggguguuagggguacuuggccucugugguugacacagcaaggcugaguugugguaaauucuugcacauucuugcccauugauccugccgccuugagcagggccagguagccaguccuguggucuagaacauaacccccgugguuuuggacgcucagggugcuguguguguugauguugaaugaguaggcuugguucuuaguugagcuuucagaacucuggaaaugcuugaguuugcagugacucgugcacaguagaauggaaugccuaguauuccaugguguauaugugccacauuuucuuaauccagucuaucauuguuggacauuuggguugguuccaagucuuugcuauugugaauagugccgcaauaaacauacaugugcacgugucuuuauagcagcaugauuuauaauccuuuggguauauagccauaaaaaaugaugaguucauguccuuuauagggacauggaugaagcuggaaaccaucauucucagcaaacuaucgcaaggacaaaaaaccaaacacugcauguucucacucauaggugggaauugagcaaugagaacacauggacacaggaaggggaacaucacaccccggggccuguuguggguugaggggagggaggagggauagcauuaggagauauaccuaauguuaaaugacgaguuaaugggugcagcacaccaacauggcacauguauauauauguaacaaaccugcacguugugcacauguaccguaaaacuuaaaauauaguaaaaagaaaaaaaaaaagaauggaaugccugauucugcaucccucuagaugggaucaacaggaucaaaacaugaccuugauggccaagccaaguucucuuuuucccaaaggguuuaaaucugcccuauuuaauaugguagccguagccauauguauuuauauuaaauucaaauuaaucaaaauuuaaaaauuaguuacuuagucacacuagcuacauuuuacaugcucaguagccacauaaagccaguggcugcuguauugaacagugcugauuauggaauauuuccaucacugcaaaagguucuguuggacagcaguaauccagaucuccuuuguagaagaauuggcaccuggggcugccugaucuucaaggggcacaucacagagcaugguguugacccaucuggauaccauguuugaaguugacauggcccagaaauuugacuuccaccaguuaaaaauguacuucgacaguuuuguauuuaaccuguaaauccagaagcaugucagggccuucuggauggagcacugugaaauuagcauacacuucaaacccucuucccuaaaagaucaugcacuacugugcuguacaugguagaccuaucucauaguguaggcuucagcaaauacucuuugacaaauaauugguucugugcugaugauaagccuaauaggugaaagauggucuuucccuuaaaaaauugagauauaugauaccagucucauaaacucuaauucacaagcccuggcauuaugagaggcacuuaaaguaugaaugguguuaagauuauccuuuaauuuugcaguaggcaaaugaccucccaaagauauucacuuccuaauccccggaauuugggaauacauuaccuuacaugacaaaggggauuugcagaugugaauaagugaaggauuuugagauggggagacuauccuggauaaucccagugggacucauguaaucacacaaguucuuaaaaguggagaacuuuucccugcuguggucacagagaaaaacgcaaccaauguaagaacggucagagagauucaacauuguuggcuuugaagauagaggaagagaccacaagccgaagaaugcaggcaggcucuagaagcugggaaagagaaggaaacguauucucugcagagcuaccaaaaugcauacaucccugucuacaccuugauuuuaaccuggugagaccuguauugggcuucugaccuauagaacucuaagauaauaacuauauguuguugaacaugcuaaguuugugggaauuguaacaguagcaaugggaaaugaauacaccuuuuauacaguggaggaugacuaaauaauuuauuuugaaaauacaacugucacaaggaugaaauauucaugaucacaaauuggugcauucuuaacuguggauaauuauguaugaagccaaauuguaauaaaacuguuauuugccaaacauagaaaccuugcuucgugacuaggcugagcccagaguguuauucucuucuucugccuguuauguaucugggcaauuguagggccuuugcaggugaauccaguagagaacaugcuaagaaugagcagcagucaugcaugacuguaucauugaaagccuucuagccauuuuacagcuucaccuccgugguuuuauuuuuucagaggggacugaaggagaugaauggauaauaaacuauggcuaaaaacuuggucuggaugaacucuuugaugcggggcaucaggggggugggggugaugggugcguaccaugggaucaguagcccugcaccagcucagagguauaauugugaggcugguggaaaugcucaucggggagaaggaaaucaggaucacagcuucugaggacugaacaugcucucaaauauagaaucauuaauggccuuggcauucaugguguuagccuugacucaaaugagaaugccucgacccuucccagguucuccgaggccccuaaguagacugucacugggacuuggggacauggagcucaguuaauggccucuuauuuuuacuaugccauagcauccaccugauuucuggaaggcauugcuucacuuucauagacagaagauguaacgacugccacgaagaucccuggagcucugccuggcgauucucacucccacuggguagcugacaaauuuucccugagaagacaugguuuccuccagcagcagcagaaggagucauggguuuuucuguuucauggcucaaacuguugugacucggaauuauacuaggacagggcccugacuuauucuucugggcugggcugaguaaggccuggcugaguguagcuggguacacagguagggguggaaucaaagcuggagguacccauaaugcugguuaggaggauaacuagcuagaauaagguuggcaagaacugggugagcagggauaggaauuaagacugaggacugggcugaggguaggucagggguucuggcagcaacacagcuggaaugaauggagaagcacacaaacaaaaccaagcuaagaagagccuagaucaagcuuguccaacccauggcccacaggcuccauguggcccaggauggcuuugaauguggcccagcacaaauuuguaaacuuucuuaaaacauuaugagauuuuuuggugauuuuuuuagcucauaacuauuguuaucaucuccagaagguguucaauuuaccuugucuagauccauuagaggaaucacugucuaugacagcuguagcuuuaugaaauguauuauauuucuuaaauaguaaaacuugaaaguugaaauuauauauugauccaugggcugcagaaugaauguuguguuagcaaguaugaaaacaucauuaaucuccuuacacaucuccaucagagcucuuacguaaccagugcauugucaaugaacaguaauauuuugaaaggaaucuuuuuuucugaguaggucucaacaguggacuuaaaauauucaguaaaaccaugcuguaaaaaggugugcugucaucuaggcuuuguuauuccauuuauagagcacaaagcagauuuagccuaauucugaagaucccuaggauuuuuuaaauagugaaugaacauuggcgucaacuuaaagucaccaguugccuuagccuauaacaagagagucagucuguucuuugaagucugaagccagguauugacuucuccuuucuagcuauacaaguucuagguggcaucuagauggcaucuucucccaauagaaagcuguuuugucuaaguugaaaaucuguuguuuaauguaaccaccuucaucaaugaucuuagcuagauauucuggaucuugcacuuuuaugugcacaaagaugucuuuuauguuaacuagaugacuucuuuccuuaaaccucaugaaccacccucugguggcuuuaaacuucucuucugcagcuuccucaccucucucagucuucauuguacugaagagacuugcucugaauuaggcuuugggcuuaagagaaugucguggcuuguuugaucuauuuagaccacuaaaacuuucuucaugucaacaacaaggcuguuucacuuucuuaugauuugugugguuacuggaguagcaauuuuaauuuccuuuaagaacuuuucuuuugcauuuacaacuugguuaacaggagcaagaggcccugcuuuuggccuguuucagcuuugggcaugccuuccucaacuaagcuuagucauuucuagcuuuugauugaaagugagagaugugugauucuuccuuccacuugaacaguuagaggccauuauaggguuauuaauuggccuaauuucaauauuuuugugucucagggcauggggaggccugaggagaggaaagagaugggaaaauggcugguuucuggagcaggaagcacacacauauauuuauuuauuagguuugacacuuuauaugggugcaguuugugucacccccaaacaauuacaauaguaacaucaaagaccacugaucacagaucaccauagcagauauaauauugaaauauugcaagaauuacaaaaaugugagccagagacaugaagugagcacaugcuguuggaaaaauugcacugauaggucuugcucaacacaagguugccacaaaccuucauuaaagaaaaaaugcaauaucugcaaagggaaauaaagugaagugcaauaaaacaagguguaucuguaguugugcugcugcaaaaauuaucugugcucugucuauucauccuuucccccucccaaucccuggcaaccacugaucuuuuuccugucuccaucguuuugccuuuuccagaaugucauacaguugggauaauaaagacaguacguagccuuucagauuggcuucuuucacuuaguaguacacauuuaagcuucuuucaugucuuuucaugucuuuucauggcuuggcaacucauuucuuucuaguacugaaugauacucuauuguccggauguaucgcaguuuuuaaaauccgcuuaccaacucuuaacuuuuaauccagugauuuucaaacuggggccuuuggagaucugggcugaauguguauucuugaggacucaagaguuuuagaauuugagagauaacuagccaagcauauaguaugugcucaauaaguauaaucauuagugacagaauuacgacuauuguaaaagaagcuacaaguguugugaagcagggcuggguggggcauguguucacaagcguuaucccagagaggagaggcaugucaacgggauuuguagucaaugcuguuuauuugcagcuggagaggguuugaacuuccuggacagcugccuggggcugcccaggcuucaagggccacauuccuggggcagaugcuggacacugcuguggccugacaguuucugacagccccauuuuaaaaaccuggaacauuuucuuaccuugaguuuucuggcacuguucccuugcucagugauuuucagagauuacggugugauuccucaauuaccucugaaaggucuuccuguucccugggcuguaauucauggggccuggagaccugaacucauuugggcugcucggggcucccuaaaucucuguccauccaucuuuagcuucuguucucucuuaaccaucuguguucugcuccacuaauauuggagauuuugcuuccagauggcaaggcuagaguaaaauugcagcugggcagugucaucaucuguuccaccaucuaccccaggccaucaccuuccuuuguucaucuucuuaccugaaacacaauuuuacaagguccauguuuugcuaucugagcacugcacaggccugaggucagagcugugaccaugacccagccucuccuguacuguccuuugucugugcuccccucuaccugcauagugaaaugcucccugcacugacacacagcucaggaguuuaaguaccuccucccuuguguucaucuggauuaugccuuacuguauuuccagaauuucauuuuuuuagagcccucugcuucuuaagucauauuuuguuuuagggacgggguucucaacccuggcugcacauuaaaauggagaaaucaaaccucuaggguaugguuuuccaguuaaucauaaaaaaaucucucauguuuauguucuccauauaaucauaaaagaaaaaaguauuaaaaugagcuucaucaaaauuaaacauuccuguucaucaaaagcuacuguuaagaaaaagaaacaaaucacagacuggcagaaaauauuugcuacacauauaucugacaaaggacuuauaaccaguauagauuagcaauugcuacaauugaguaauaaaaagaagaaauugaucaaaaagcuugaacaggcacuucacaaaggaaaauuuguaaaugaucaguaaauacauaaaaaggcauuuaacaucaguagucauaagggaaaugugaauuaaaaccuacuaacauggcuaaaauuuaaaaaugacaacaccaaauguuggcaaggaugcagaccaacuggaacucucauuuguuucugguaggaguauaaagugguacaaccacuuuggauacuguucuggcaguuucucauaaagugaaacauacaccuacccaaugaccaaaaacacuacuucuaggugucuacccaagauaaaugaaaauagacacaaacuaguagacuuaaaagcuuuauuaauaauagcccaaacuggaaaccauccaaauguuccucaacuagaaaacuaauaaacaaauugugguauaucucuaccauaaaauacugcucaguaauagagaaggagcaaacuacugguucccaugacaacacagaugaaccuggaaaacaugaugcugaggggaagagaucacacacaaaaggguaccuacuacauaauuucacuuauauaaaguucuagaacaaguaaacuaaaauacagagaaccagagcggagguuguuucuaagacagggcaucuaugagugucuggaaacugccagagagaacuuucuggaaugugucugaugucuugauaaugguggguuguuacaaggcauaggcauuuaucaaaacccauuuucaaaugaugucuuaaguguuguauauuuauuaucuauacaugcaauuuacaaauuauauaucaguaaggagaaugaaauuuucaaaacguucccuagaugauuuugcuacacaguaaggguugauucaaugcuacgcuggcucaguucauaaaaugucucugucuuuucccuucaguuugaaaccuucuuuccuaacauccagguccuuugucugccagcaccauauuucagucucuuguaauuaggaacccaauaacaccaugaacacucaccaaugaugucuuuuuuucaacacaccaaccuuaccucucuguuggacaaaaugaaaucuaaaacaccaggucuccuuucugagcaagggaguuaucaguuggauaaugggaaaaaugacugccauuccagguggauaacuggaagaaucacuucuuguaggagaacgaaauguguaguagcugccgaggaggugauguccuuuggcccuacccucuuaucuguaugcagaaauggguguguucauauuauguuuugggaaagcauuuuagauucacuucaucagaugagcaucuuuuugcuccuaggcuuacugauuucgauguaguugaauaaguucuuauuuaacgugaaguucuguuucuuuuuguuagacguacuucuuuugaauaaaacauaguuuuaaaaauuacuauuuccauucuaacuucucucuugccaagacccaaggauaucugggagaauuuuuuuuuuuuuuuuaccgugauguguuuauauguuuggacuacuuauuacccaucuuugccauauuuucuuaucuguggagaugcugagaccuaauuuagcuuauuuucugaaaagccagugucaaauaccugugagcaacacagaagaaauagaucaccuacucagcagcuuuaacugucuaggacucagcuaauaacugaaaaguaagccacaaagagacccugaagacacaaaauagaugucauaaaauccacacacuuuccucagaggccagcccaucggagucucacucacagucaguuuccucucaccugggacacagguguaacaucuucacagcuugguuagaugcaccaaguuagaagacagaacaaagauggccuuuacagucagguauauugauagcuauaaaaagggacaacugacaggagagaagagagaauccuuuucauccucacuuuauccuauuaaaaucaaaaugagccugggcacgguaggucaugccuguaaucccagugcuuugggaggccgaggagggaggauugcuugagccuaagaguucgagaccagccuggacaacauggugaaagcccgucucuacaaaaaauacaaaaauuugccuggugugguagcacauguguauagucccagcuacgagggaggcugaggagggaggaucacuugagcccaggaguucaaggcuacagugagcuaugauggugccacugcaccccuagcaugggcagcagagugacacccugucucuaaaaagaaaaaaagaaagaaagaaaaauaaauaaugggcaacagagugacacccugucucuaaaaagaaaaaaagaaagaaagaaaaauaaauagaaagaucuagcagcuauuuguuucuggagcacccauguaaaaucacucucaaggagcucuagaggcaugaccacauuugaggucaaugcaaaacagucauugaugguaaugccuuuaagccaccaagaaaaggccgaauguuccaugcaguaaucuuugaaaaaggcagagaaguguguaauaugguuuagaaaggucucuaucaaauugggcggaaauaaaaguuuugacuguuuaagugaguaaggugcaguaucucaaaccuucacuguccuggcauaguggccuugaggacaguucugggguaaugacaauuauggaggcagaaccagacccucucugcuaucuuccauaaccagcccauucccccuuucuggaugggggagugcccuccucuaacugcagccauugcugugugggccucagcuccaguccgccacuccuuguucaugcagcacuugcuacccuucuuccuugaagccucugccaccugccaccccaucuccuccuuggaccuccaaauccaacagacucugguuaucucuggguggacucuucacucuccaaauccaucagaggcucaucucuuaaucccaugaaucugaaauaaaaaguagcaaugcauaaagaaguucuacagaugaaauguuaaugacacuuggaauuuguuuuaaaacaauccagcaggaguggggauaggaaagguguaggcaaaacaagauggcuauugacaacugucggguuugggugauggugucauggggcacacugccucucuuuguguauauuuuuaaacauguccauuuaaaaaggagguuggccacaguggcuuacaccugucauccuagcacucugggaagccaaggugggaggaucauuugaggccaggaguucuugaccagccugagcaauauaaugagaucccaucucuacaaaaaauuuuuuuuaaaguagcugagcauagugguggaccccuguagucccagcuacuugggaggcugagaaagaaggaucgcuugagcccaggaggucgaggcugcagggagccauguugugcuacugcacuccagccugggugagagagugagacucuaucuuuaaaacaaugaaaauuaaaaauuaaaaaaauuuaaaauuuuuuaaaaaguuacaaggacgauauaggaugucauaacgccuaaucaauucucauaucuucauggguuucuggacagagaauguaccuucacuuuaccauuagccuaagaucacucaaaacaucuggaaguuauuauuuuaaaaagaaucucagaaguaugccugccucucacuguuaaauauaugugauggugcagauuauucagagcaguguuaaggcaucaacauaagugcagccccauggagucagggacagaggucaaggugaaguguuucuuuaccuuugaagacuucuggcacccaggcuuacaccuacacuucagcucggcaauccggaugucagggaagugagaggcgaaguuugaacccaugugaacuguacauuuugggacuugaguauucaggaacuuggcucucuuugaugagaaauuacuucccuccuccaucggcucagcuuuucuucuuccaccuucccuuuccucccucucucccuccucuuuccccuuccucucuucuuccucuuucccuuccucucuuccuccuuccuuucuuccuuccuccuuuuaagucaucaccaccaccagcacuacaaaaaccuauagcauguucaugucagaacuucuaaagaguuguuguaaagauuaagauacaaguggggaagaaagaaauuuaaauucauuagaauaauuuugaucaucauaauuaaaacaauuuuucuuuauuauggacacuuucaagcauauaaacaucugacuaauccaaugaaccccuuguacuaaucacucaccuucaguaaaguuggccaaucucuauuucauccuuucaucuuucuccccaaucauguccacccuccuccugaccccaccugagauuacuucagaacaaauccaaggcaucauauuguuucaucuguaaauaauucagcaguauuuauaagagauaaucucucuuauuuuaaacauaaucacaauacuaucauaucuaaaaaaaauaauuuguuaauauuauaaaauauucagucaguucucaaauuucccugauuaucuccuuuuuauucuugguuuguucaaaugaggacccaaauaagacgcacucauugcaugcugcugaaauagcucuugucgcucauagucuguaggcuuccuugcccuccuguuuucuugccguuuauuuauugaagaaacugagcuauuuguuuugcagaauuuuuaccauucugcauuuugcugauugcaucuucaugguaucauuuaacauguucuuguaauuccuguaauuaccuagaauuccuguaauuaccuguaauuccuaucagcugauaguuauaccuagaagcuugucauuauuaguagcaauaucaaaaacuucacuuuugagacuggcaauuucuacgucugacaucuuaccacagugaacaaggcagcaucccaaacucuucugagucaauaagaaaaggguaacucuugcaguaaugccaaguucaguuucuguucacuuugcaaaaaauguaugcccacuacuagacccaugacugucaacuag

SEQ ID NO: 17020 - RNA, 2171 nt, Homo sapiens
caacucccagacaccucgcgggcucugcagcaccggcaccguuuccaggaggccuggcggggugugcguccagccguugggcgcuuucuuuuuggaccucggggccauccacaccguccccucccccucccgccucccuccccgccucccccgcgcgcccuccccgcggaggucccucccguccguccuccugcucucuccuccgcgggccgcaucgcccgggccggcgccgcgcgcgggggaagcuggcgggcugaggcgccccgcucuucuccucugccccgggcccgcgaggccacgcgucgccgcucgagagaugaugcaggacguguccagcucgccagucucgccggccgacgacagccugagcaacagcgaggaagagccagaccggcagcagccgccgagcggcaagcgcgggggacgcaagcggcgcagcagcaggcgcagcgcgggcggcggcgcggggcccggcggagccgcgggugggggcgucggaggcggcgacgagccgggcagcccggcccagggcaagcgcggcaagaagucugcgggcuguggcggcggcggcggcgcgggcggcggcggcggcagcagcagcggcggcgggaguccgcagucuuacgaggagcugcagacgcagcgggucauggccaacgugcgggagcgccagcgcacccagucgcugaacgaggcguucgccgcgcugcggaagaucauccccacgcugcccucggacaagcugagcaagauucagacccucaagcuggcggccagguacaucgacuuccucuaccagguccuccagagcgacgagcuggacuccaagauggcaagcugcagcuauguggcucacgagcggcucagcuacgccuucucggucuggaggauggagggggccugguccauguccgcgucccacuagcaggcggagccccccacccccucagcagggccggagaccuagguaaggaccgcgccgcugcaccccuucgccucucagguggcagacggcaggccggccaggccgcgguucccaguccaccucgauuuccuccccucucccacucuccgcucagccuucccaccucacuuggcaccguugccucgcgcccccagcguccccggaaggccggucugaccccgcuagggagagcagucuccagggggaugcgcccuggugaggggugugugugcgcgugagugugcgugacaggaggggagacagagacacccagggucacggguaaggaccguuuugucagcgccacccuuucuuucggcuuucaauuuuuguucuccuuaaaacaaauguuuuaaaacaaauuccaccuccuccuccuuuccacccacccacuuccucuugcccuugggcugaaauccuuccagguuguucagcuuaauuucucagugguggugauaagaacagugcucacuagucuuagaaaacagccgcagagaccuaaacaauaaccgacuccccccccccccucuggguuuuugcagaugucauuguuuccagagaaggagaaaauggacagucuagagacucuggagcuggauaacuaaaaauaaaaauauaugccaaagauuuucuuggaaauuagaagagcaaaauccaaauucaaagaaacagggcguggggcgcacuuuuaaaagagaaagcgagacaggcccguggacagugauucccagacgggcagcggcaccauccucacaccucugcauucugauagaagucugaacaguuguuuguguuuuuuuuuuuuuuuuuuuugacgaagaauguuuuuauuuuuauuuuuuucaugcaugcauucucaagaggucgugccaaucagccacugaaaggaaaggcaucacuauggacuuucucuauuuuaaaaugguaacaaucagaggaacuauaagaacaccuuuagaaauaaaaauacugggaucaaacuggccugcaaaaccauagucaguuaauucuuuuuuucauccuuccucugaggggaaaaacaaaaaaaaacuuaaaauacaaaaaacaacauucuauuuauuuauugaggacccaugguaaaaugcaaauagauccggugucuaaaugcauucauauuuuuaugauuguuuuguaaauaucuuuguauauuuuucugcaauaaauaaauauaaaaaauuuagagaac

SEQ ID NO: 17021 - RNA, 4301 nt, Homo sapiens
agcaauuacccuuauacauuuauucuacaauuuuugcacccuuuauacauguuagaggcaacaacaauaacuuuuagcaguguuuauuuuuguuaaaagaaaccaauugaauugaaggucaagacaccuucugauugcacagauuaaacaagaaaguauuacuuauuucaacuuuacaaagcaucuuauugauuuaaaaagauccauacuauugauaaaguucaccaugaacauauauguaauaaggagacuaaaauauucauuuuacauaucuacaacauguauuucauauuucuaaucaaccacaaaucauauaggaaaauauuuagguccaugaaaaaguuucaaaacauuaaaaaauuaaaguuuugaaacaaaucacaugugaaagcucauuaaauaauaacauugacaaauaaauaguuaaucagcuuuacuuauuagcugcugccaugcauuucuggcauuccauuccaagcgagggucagcaugcaggguauaauuucauacuaugcgaccguaaagagcuacagggcuuauuuuugaagugaaaugucacagggucuuucauucucuuucaaaggaagaucacucauggcugcuaaacuguucccaugaagaguaccaaaaaagcaccuuucugaaauguuacugugaagauucaugacaacauauuuuuuuuaaccuguuuugaaggaguuuuguuuaggagaggggaugggccaguagauggaggguaucugagaagcccuuuucuguuuuaaaauauaaugauucacugauguuuauaguaucaacagucuuuuaagaacaaugaggaauuaaaacuacaggauacguggaauuuaaaugcaaauugcauucauggauauaccuacaucuugaaaaacuugaaaaggaaaaacuauucccaaagaagguccugauacuuaagacagcuugcuggguuugaucaaagcagaaagcauauacuuucaagugagaaaacagcaguggcaggcuugagucuuccaagcaaucaaaucuguaaagcagaugguuacuaguaagucuaguuaugggagucugaguucuaacucaugcugugcuugcuggauuugcuggcucuuuuccgcucucugugaugcuggacuggcuuggcaggugacaugcucucaaaguugugacuggacucguugugcugccggguguaccucuugcacuugcaggcagugacuacugugauuuuguaggugcgugugcugccaucuuggcacugcagcuggauucucuggguacggguuuugucauugacacaccgccacuccugggagcuccuccugcuccaguacuuuguuccauagccuccuccaauccaguuagggagcacuggcaggggcaagcacucgccagcacacaccagcuccuucagagggcugaugcuggugcacuggccaucagagauguauuugguggaacgcaguucccggcaacccacuugaacccgagcugcaggaaacaaaaaagaaugugcaucagagaaaaaaugcaaaugaagaccuuuuaaaaagugaucugcaaugacaaaaauaauaggcaaaugauagcaaauugccaaauagaaagugagcaccuacuuuauuuucacagugaaaaaaaucugucuggauaguauagggacacuuucaugaaaaucaucaguuuacauggcuauaacuuuuuugggaaaaaaaauguaggccugauuguuuuuauauauaacauuagcuaauugcuuauuagaguguuugaaaauccaauuuccuuagucugacucuccaauaagggguuagcagcucuuccauuuauguguaaauauucauuauucaaugaguuaagaguauacuuuaauauucucuuucucaagggucauauuggcuaaugucugcaaguguuuuuaauuaggcuuuuuaaaaaucuguugagaaaaaaugugauagccauuuaaauauuguguauaaugcauaugcucucgguaauauuuuauuucaauuauagacuuuagcugcagagacucagacauacauguguacaacaucugacauuuugcauaucaaacuuaauaacuauguuuuaaacauaaauucccaaacuaucuuuuaaaaaauacaaacaguaacauguuugaaauguaaaaugccacuacaacucaagacucaaagaauauaaaagccccuaaaucaggaacguaugguugccauaacaacuuggcuacauuuccaugaauuuuauggcagaaaaaugccuaacaugucugauuuacaacugcaaaaggaaccacgguguucauuuccugaauauuggucauggcaaacuuuuuguuuuaguuauuuggauuugauagguauguucucuaauuggcuguuucuuguuacaugccuuauguaauuaaagcaaaaauuaaucuuuaaauauuuuaaguuuuccuuacccuugcuuuguuaucuaaacuugaggagaauugccuauaacaagcuugaaaagaaaucaaggcuugccaaccaggaaaaaaaaaaaggauguuuaaaaguacaggcugcugacauuuuacaaauaaaaaugauaagggacacugaagugguuccacaaaaaguacugaaagauacgucgaaguagaacugaaucaggaguuucacuucaucucuguaugcuaguacuucugagguaagagauauagcuuaaggggaacgugauaguuguggaaaaacuuauguauauagacaugcaugcauagaaaucuagaauugugggauuaaaauguaaagcguaaauuguuugguuggacagugugcucagcgugccugauucugccuccagcucaccuuccugcagcugccucaggaaugcaccuggaaauagccagaaauaauuuugucucgucaagcuuucuguuccuguguauauacagauuuggcauuuuugcagugacaguucauugacaacgaauacccaccacauugcucaguaaucuaauaauaaucagauauguccuguguacuuaaaagcaaccagcuucgugaaaguuaaaacauccuagcuuucuuagacauuaacagucaaauuugcuuugacuuuucaaaagucaaaacuacuuuucguaguugaauggagugaagaaggagaggcaaaagauuuguguaagauuuccugcgcaguguuucucucucucucucucucucucuuaaaaccugauuauuagcauauggccucuucuaaaggaaaagauagaaacaaaaguuagggguaauuugaaucccccuaaccaguggucaauuagugugucaacuaagcuguuguuuuacaucucuuaaguuacaaaaauguccccagucugucacagaaauacacaauuaucuaaauuuugaaugggacaacaaggaauuauuuuagaaaaaugugauucuccaacauuuuuaguuuaucccucuuuuacauugagcaucaucaaaacuuuugacuaucucacuagacauauuuuagaaauccaauguaaacaaauuuuuucuccuggaagcuuccuuuuuucccuugugauucccuauauuuauuuguggaugguaacuaauaauauauauuaguuacguuuauacacuuuaccaaaauugcauaugcccugaaauaaauugacaaaacaaccggaacuugagcuaucuaaaacaauacuuuuuaaaauggucauuuugcaugauuuugacaaaacaauaguuuaauuccuggaaauguuuucuuuguggauguuugauaaaacuucagucugugcuugcacuauuaaaccacuguuuuaguuagguuaacuuuaaaaucacuaccuagggaagaaugccaaccugcacaugcagcagauuacucccaaauuguuucacaacauauauacgguucagguuaguuaccaauaaaacaauucuacaggaaugugagcuaaugcuaccagaaaagaaaaaaaaaaacuguacaaguaaaacacacuuacuguuccgauccaguccaguguuacugaaaugccugccuccauuucuggcuugauucaacgugcuguugcugcuggggugugcuggaacagguuuaaccacaugugaauaaaggauuucuguggcaucauuuuuaaaagccaaacagcuuuucauuaggaugcaugcaaggggaaggagauagaaaugaauggcaggaggaagcauggugaguagaggauuugcuugacugaagagcugguuaauucuuuugcuucugcuucugcacuguaacugugaaauuccuccucaagcuucccuuuauauauccauaga

SEQ ID NO: 17022 - RNA, 1958 nt, Homo sapiens
uuaucuucacugcuguuugcugucucuugaugaugacauguuaauacccaauagauuaauugcaacaaacacuuauacucaaauaacuaaguaaaaauaauuuuucuuguuauguccaugaaaagugcuucagaauaaaaauccacaagacugacagugcagaacauuuuucucaaaucaugggcggaucuuggaggucuaguuucccguagaugcuguaaccaauuaccacaacuucaguaauuuacacaaauuuaucuuauaguucuggaggcagaaguucaaaagaagccuuaagagacuaaaaccaagauguccuuaggucugguuccuucuggaggcuccaggggagauucuuccagcuuucacuucuagagucugcugacauuccuuggcuccuggcuacaucacuucaaucucugcuuccauggucacauacucuucuacuauagucaaauuuccuuccugccucuuauaaggaugcuugugauuacauuuaggggaugcucagauaauccaggacaaucucuccaucucaagauccuuaacuuaaugacgugugccaagucccuuuggcuagauaauuauucauaggucccagggauuaggacauggauguaaggggugagggcagggcuguuauucagaacaccgcacggaggaggaagacuguguagcaaagacucuaauugauuuacucaggaacaguggaguucugcugagggaucuaggauuugaaaguacuagaguuugcuuuuauuuaccacugagauauuuuccccuuauucugcauaaauaauuuugaaaacuuucuauauuaaauuucaacuauuccacuaaaaugucugguaaucacaucaagccuuuagauuauucaaauccuuccccagcccccaggaaaacacuaagucaugaaacagaaaaacagaagguaugauaauaauaguaauaacaguuaaaucaguggucuaauccagauuuuauuuuuuaauacauuucuuuugguguuaauauggguuacuaugugaucuuaucauuugcuagugauuauuacuuauuagguaagaacaauguguaaaauaugucuauuacucaaaagaacaauugcaaaaugagucaacuuaucuuuauauaaccaggaaagaaauauauugccagaagcuacagaauuuugccagaugauagggauuucuaaaaugagccacuuugucuaucaugcagccuuuucagagcuuguaaugagaaaacauuacagaggagaaggucauuuggauguuuguuacuuggaauccuagaaaacaaaaacuaaaauuuaaaaauaagaagugaguaagcuauuuuccauuugcgauuugguauggagaagagaggaaauagaauuauuaaaaaaauacaaauuggguaaaagugaugguggaaaaaauauaaagaaggcaaauguacauauuaagcaauucuacuaagaauuggaaaaaucaaguuucaaaaagaugguaauaguugggcaugauacuagaaaauuucacccaguuuauucagagcucaacuaguacuuuuaggacuucuuuuuuuauauacaugagacucacuuugacauacuuaaaaaaaaaacaguuuauggaaaguacaguuuaagaggagaauuugauuagacuaaguggauaucuuuauagaaauauuaaugauuucagaauuuucaguuacaaguguauauaccguggcuauuguuuauggauucauauguaagguagggucuuuuuugcauauagacuccaguauuaguuacuuucauucuaaaauuauauuuaugcuucuauggggaagaaaauuuuuaauucacuugguuguauuaaaauuauacuuacgguuugagaaaacaugcuaugaaaaucaugauuauagcaaauuaaauaugcucaaaauuuaaaucuaaaauaaaagcccagaaacugaaaaua

SEQ ID NO: 17023 - RNA, 3632 nt, Homo sapiens
guuuucucagcaucucuguuucuaguguucuaaaauugcaugauacugugcuuuggugggauuggcaaccuggaaaauauuaaguucuucaucucuucucuuccuccucauuuucuuuguucuggaacucuaugacauaguggagcucccaaauugaaucuugggccuuauuuauuuuuuuuuuuucugucugggauauuucucuaagacaauuuuccaauuuguauugcauuuuguuuuuggcuagcauuaaauuacuugccucuguguagcuccaugccacacucuugccucuaaauccuaggccugccugaauucugcaggaucaguccuacugucacucaucugugauagcccugcuaaggcagauaccacucuucuuaccauguucaauacauuuauugagcucuucaguauuguuucuuccuauuuuaauuuuucugguuuuguaauuuguacuccugcuuuuuuacugggcuuuugggaggaagaagguauagaguguuaaucugcauguugaauuuauaugcaggugacuuuauucaugaaacuugugguaacugcuagacaaggguggcuggguguucaauguguaagaaugcuuguguuuucuugaaaguagaaaaauguuguguuauagacuaguuguucauugcuugauucuugauuaauuuugcccgcuuucauuauuuugaggcucaagcauuuugaaguauucauugucugugacuccucuuugauggguacuaaauuuccugggagugaauuuagauacccugagauguaauauaugaaagaaaaagcaaauacuugagaaugucccuagauuagacacuucaugugagaauaucucuuuuugugacccaaaacucuuuuuuuuucuuuugagaugaaguuucguuuuuguugcccaggcuggaguccaaugguauaaucugccucagccuccugaguugcugggauuacaugcaugugccaccacacccggcuaauuuuguauuuuuaguagagaugggguuucuccuuguuggucaggcuggucucgaacuuccgaccucaguuaaucugccugucucggccucccaaagugcugggaauacaggcaugagccaccgcacucggccccaaaacucuucuuaaagguggucuugcagguauguuauaguuaaaaugaaguagguugucuugcuuuguucuuaaguggcuuuccagaagucuaacuggucuaaaggcagucuuaucccccucacugguguauaguucaauucagacuugaaugcgagguauggguuuacaucucaucucugccacuuauaaucaguguaucccucaacaauuaaauuccuuagucuccauuuccuuccuccuucaggggaaguuaauauuccacaaaguuagaaguuacaggagaggaaaaguaguaaacgccccaaaaugaggcaguuacuucuauuauaucuucaaaggauacauggcucaaggcagaucagguaguugggagauuucuuaaaaacagcauaauagcuaacaugaacauuuucauuauucagagaaauuugacauagcuuuuuaacguauguuucugagaaaaguuacuaguuauauugucuuccuccaagaauuagucuuuggguacagaugaggcuugaaaaaaugacauucccucuuagacuagguagugugaagggaaaaaaaaaaugacauuccucuucccccaaagcagagugagguccguaugggauauagguguaaagaaaauuuugggccgggcaugguggcucaaguuuguaaucccagcacuuugggaggccgagguggguggaucacuugaggucaggaguucaagacuagccugaccaacauggugaaaccccaucucuacuaaaaauaaagaaauuagccagcuaugguggcacauaccuguaaucccagcuacuugggaggcugaggcaggagaaucuggaagcaggaaggucucaguaggcugggaucaugccacugcgcuccagccugggcaacacagcaagacucugucucaaagaaaauuuuguggaacaccuauuuucucacugacaugaaaaauguuucaaagaugaauaauguccaucaagcuauggcaauggaagugaggaugauaaaggauugcacaguuguucacaaccucacuguuaguauccugcugagauaguuggucuccucaucacuguagcaucuuuuauguacagcagagggcagaagcuccuuggcauguaugugagggaaccacauauauggaaggcuguuauuccugagaaaggaggaugugcagacacucacagaacaaagccuuuguaaaggaaaggcggccgaugagauggagugcuuccuucaccuguggugggucuguauccaugaaaucgcccacucacaaucgcuuuuuguagcuacuggaagcacuaggcgucugaccugccaucauccuuguuaugaugucauaaucauauucuguccguguuuauugcaguucucugguuugucuggaguguuugcaagucagucaucauaguggcagcuuccgccugcuacaggauauuuauauauggaagcauaccauggcaggagugcuggaaagguggugucagcuaacaguugcuucagccagauaaggacgguaacuucaguccaauaaaaaccucaucaguuaccaacuaaaucagggcaugguguuuuuuuguuguuuucuuuuuaaagcauaguuuuaguaauauauuuacuaaaaaccuuagacauuaugaaaaaagucaggauuuggaaucuuacacugcuuggcuaaauugacacaauauagaccaacaguuucauccuggggcuuaugggucucauaggagcacccguaugcugaagaaaggcaaagagagaacuacagaauuuguagaaaaguuuuguuguaguugcuucugaacaauuaguuuuuguuuguuuguuuuguuuuguuuuguuuuucugguaaccuagcagucaaagcucacauuuuuguaaguaauuugcaugcuauuacucuacugagacugaauuaugauucucgagucugggaaguuuuuguugcaugugcucuguguuuuucauuuuugauagaaaugauuuagacuugauuuuaaaaauuacuuccugaaugugaagaggcauugacugggaaaugaaauuaaagaacaaauuaccaugacucauucaauaacacugcuuauuagcuuugaauuaugcccuauuauaacaauucugauuuuguggcaagcaauacuggugugaguuauuucugugguuugauaccaagcaccugccugguuaaaaaauaaagcaccaggcaauuuuucauagacaauuaucuuuauuuguuggaauauuuauuuguaaauagucaaagaauucuuaaaugacaaaaaaucaacuguuagcagugaucuaaaccagaggaaaaugaaauuacuuacauguuuccagucaagguauaagaaaggguucuguuaaagggaugcugcuuuagccaaucuuggugaauaagcaaauuugcacacuggaguugaaaggagggucaaguuagugugaugaagaauugcuaguaacacuggcuucuccagccuugcugguuguuccua

SEQ ID NO: 17024 - RNA, 72786 nt, Homo sapiens
uuucagaaugaaaaagacagauagguagaucccaaaauauccaauacagguucauuuuaguaucacguggaacagauguuuucuuuagucaguugaaaugaccaugcauuugggugcuacacagacauaaugugaaaucuccuuguugcauuaaaagagacuccacacaguguagugggcggucacaaagcugacuuugcaggugggccugccuaaaacuggaggaaaucuugauuccugaucaaaaacagcagcaagugggcacaguggcacacuguaaucccaaaaacuugggaggcugagauaggaguaucacuugagcacaguuccagaccacucuggacaacagagcaagacccccagaaaaugaaaauuaaaaaauggcaaagucagaauacauguugaauuuaaaagacuacguuuuggagguguagcugaucccaagcuguuaugagcaacccccuaaggacugcagauggccuggauccagguucugagcagagcagcagacagucuagagcuauagccacacagauggcuggggauugcgcagcagggucuagacacgacccugccacaguaggucgucucccucuguuggcacaaacagacaugacauuguuggcagagucaugucugaaagauuauaauuaaaaguauaaaguuuuaaaaaauuagaaguaguuuaagagucauaauuuuaaagagaguuuagcaaauuggaaaacugcauuagcaaauagaauaaauuuuguuaaaaagucaauuagaauaaaucaaucuucuauaucauucuucuuuuaaaaauagcuuuccuggguauaaauggcauuugcuucacaaugaaagagaagggucccccucuguugguuucuaaagggcacuacacucuucagaauccuggagccugaccuuuuuuuuaaggaaucagauucuagucuggucuuggauuuaaaagcaaacaaauaucaacauuaaaaacauccuuuuggccaggcacaguggcucacaccuguaaucccagcacuuugggaggccaaggcaagagaauugcuugaggccagaagucuuuuguuguuugaucaauuuccaagauaauuuuuagcacucaaauacauuuauccacuuuuaugaucuaaguagggauuuuuccccucaugaaaaacggguuauuuagcugggcacgguagcucaugccuguaauugcagcacuuugggaggccaaggccagaggaucacuugagcccaggaguucaagaccagccugggcaacauagugagaccccaucucuacuaaaaguuaaaaaaaauugccagguucgguggcgugcgccugugguuccaguuucuuaggaggcugaggcaggaggauugcuugagcucaggagucaaagcuucaguaagcugugauugagccacugcacuccagccugggugacagugagacccugucuccaaaaaaaaaaaaaaaaaaaaaaaagaaaacaaaacaaaauggguuauuuaaagaauauuaacgcagaaguucuacuucuauauacaugcuuaagaaaauugaaaauauauauuuacacaaauacuuguaucugaaucgucauagcagcauuauucauaauagccaaaauguagaaacugcccaaauaucuauuaacugaugaauggguaaacaaaacacagcauaucuaugcaaugauacucagcaauaaaaagaaaggaaauacuuauaugugcuacaaaauggaugaacuuuaaaaauacuauguuaaguaaaagcuagucacaaaaggccagcacauuguauaauuccauaauaggcaaauccauagaaacaaaaaguaguauugugacuggcuggaggaagagaaaaauaggaaguaacugcuaaugaguauaggguuucuuuuugacaugaugaaaagauucugaaauuaaauuuuguuaauguuugcacaacucuauaaauauacuaaaaaccacugaauugcacauuuuuaaaagguggauuuuauuguaugugaauuauaucucaauaaaucuauguguuuuuuuagaaaaaaaaagaguacugauaaggaagaugcuuuauuucuuagagacccaaauaucagacccaaaauuucauuuuauuuuaaaauggcuucuuaauaccauugaaugccuguauucuuagagcaaaugccccgauuuuuacaaacugucauauauaagcauuguuuguuuuaaaauauauuucauuuacuaggauauucaaauauuuauuugggggcuccuguaauaggcagagagggauguauuguguuuuauuuuaccaagcaaauuaauuaucuuuugaguagaauuuuuaaaauacagcaucagaaauuguaacuuuuaucuauaaaguuuuaaaucuagaauuguaugggguccacaauuauagguagagccugcccuaaccuuguguuuuucaaaagaucaugauauauuuagggguuuguggggaaccgagguagguuauccagcccaguuccugcuguauuuccucuaccugccugcagcugcccuuucccugcggaagaacugagccucugcccaugacuuguuucucacucccucucuguggccuggagucccucuuuacggcguuuuacauaagaaccucauagagcggaaaaacagagaaaaccuuggaccucagcuccucuaggccccaaacugaucuccccuuaacuugaagaucuccagggccugagaucccacaaguuuuccuggucuugguagcuccuagguguuuuuccugcauacacuaggccauguucagaguagaaagagcccaggguuuggacucagaccagaauuucaaucuaguacacguggacaaaguauuucaagacauuaagccauggccaggcgugguggcucacaccuguaaucccagcacuaugggaggccgagacaggcagaucaccugaggccaggaguucaaggccagccuggccaacacagugaaaccccaucucuacuaaaaauauaaaaauuagcugggcaugguagugcacaccugucauucuagcuacuugggaggcugaagcagaagaauugcuugaagugggagacggagguugcaguaagcugagaucauaccacugcaugccagccagggcaacagagugagacuccaucuuaaaaaaaaaaaaaaaagacuuuaagcccugguuccccaauuauaaaaugggguguuguagggggcacugacuaccucucaagcuuauaugaguuaaauaagacaugcagugugcuucaucaaugacugugcucaauuacaacuucauuaucauuaaaaugucagagauccgucauaucuaaucagaucauucagguacuuuuuggaaaccuucccaucuuuccagcugucuuaaccuaccucagaaauaaccuucaccauucuuaacugaaggagagcaucaugaacggcagaauacacacacacacacacacacacacacacacacacacacacacacaaaaagcagacaacaaauuuacuuuuccuccaaauugugaaauuacccacaugaauuugauauguacuuuauaaaaauaaucuuuacacaugugcuuauuaacauuuagagggauacaauuguuuuguuuucauacuuuggugcucugagaauccaccucuuugcaccucaugcaagugaaccgggaagagugaggcauucuauugggccuuauuaaaugcaguagagagugaacucaugaucuuuaucugcauuuuuaacaauugggcaaacuuuucagauuguuccagcguaauuuuuguuauagugucuugguauggggcauguggucaguuacugccagugucauguuuuuuggcucugucuguaauccacucaguuauauagcccuaauuucuuuuuugcuuucaucuccagaauaaggaguuugugugucgagggcaugacuacgagaggcuggaagccuuccaacagagaaugcugaacgaguucccccaugccaucgccaugcagcacgccaaccagcccgaugagaccaucuuccaggcagaagcucaguguauccgcaccuacaagggcuggacucagugagauugcacuggcucuuagcugcagagcauuuccaugcaagguuguucagccaccagucccuuuucaauagccacaucguuacugcucccucuuucccaucaucuuaauuuuagcuuaacuccuucugaauagaacuuaauuguucuauuuauuacgaugaugucaguugaaagaacucucuugaaagaauuuuucccuuuuaauuaaaccucuuguauagcucaacccugccuuuaaagcucuuuuuuagugacauccuuuagaauaaacuuccuuugacauauccuguggaaacugcuuaaguucaagaaaaucauaguauuguguuuacuggcacauauuauucaccccuccccccacccugauuauuuguauucuggaaugaggaauggaagagaaagagcuacuccaguaucuuuugggggcuuuuagcuauggcauccugaacagccuuuaaucauugcuguauaauucaugcucuuauugucuaaacacaaacaacugagcugaaauuauauagguguuagagacaaaggcaguucaccccagcacucuuuucugaaccccucugccuuuuccugaaacugauggucuuaaaaaacacuuuuaaaacuuccacugacaauuaugaauaccauuucaaagcagaaaccaaaaugcaagacaugcaagaaaguacauaggaaaaauauuuugcuaucuuucuuuaaauaagaagagaaggagguaaauauacaaguuaauaugauacuccuuuaauguaauuuuuaaaaauauaaacuauaacuaaacacccugcauaugaauacaagauuugggacagcaguuaucacagaugugggaaggcuagggacacagauaaucacacagauaaauguaagucaucgucaguguucuaguuucugucuuuggucaugguugcauagguauuuacauguuauuauaagcaaacaauaaauuuaaaugugucaugcacagacuaauagaugucucaugaacaaggauuaggauuauccuaauucugaguaucuaaggcccaaaccauucccaucuaccuacacacacauacacacacacaaguuagugauaucuaaauucauaggucaugaaaauuuucaagucauggaaauuucaagcugauacuucaccuaccuagaacuaguucaagaccuguaguuugagaagugauuugcuagaacugaguuccuggcgucuucuugguaauuuuuuuaaugacuucaacugaaauggaaacagaagauuguuacccauccucuucucucugccauagcucagcccaagccagacuuccauggaguuugccaagucagguucucuccuugacucuugaauccuagauuugcagauauaugcugugacucccauuccagagagccaggagguccugcagagagaggguguuccggacaacaucaaaagcuucuauaaagugaaucacaucuggaaauuccgcuaugaccgaccauuucacaaaggcacaaaagauaaagagaaugaauucaagguaccaugcaauucuuauuacaugcuaacuccucagauagacugcgagccccuuggggcacagcccuugguaaauauuuacucagaauagugucaagugacagaaacagaagggacuauauaaaucauuuagucuagugguucugcagcuccacgugcaucagagugacauggagugcucccuaaccaagcagauuucuggugcccagcucaggaauucugacucaguuggucugggaggagguccuaaaaucagcuuuuuuguaacaauucuaaugcuggugguucuuagaccagucuuugagaacuccuggcugaagucaguccucuuauucauuuauguugaaccaauugugggaaucuugggauguuuauuuucacguaaaguucaaugaauaaagaauacauaaugaacagagaaaaggaguuccugaagacagagaacaguuggguagacugcugguacguuggguaaguuaugugccaucuuugcugcuuguucuuguuagaacaguguguaauuagaacuucucaggacuccgaguaaaagcaaauuuuggauucuuuguguguguugaguucucugcucucaguaguuccaacacgccuuccuacuucagcacccucagccagaaugggacaagguuucucauagccccacugcagaaaagaggcaagauuguucaguagagucugccccuuucuuugcaaacaaugacauagugacaccccccccaguuaguauuucauaucuaaacaaagaaugcaaaauuagcuuauuuuugugaguuaauuggcuuagcauuuuucgucacagauguucccugcuuaagcuaggaaaugugcuccuaacacgauugucucauguuaacucacuuggucagcucugccggugucaguucccaguacuccccgaaguauuuccagggaucauucacaaccgagaggagaucagaaggggaagguuuugcagaguuaugacaggauugaauaaagagcagucccuugugcccagagauuugaugggcuaaauaucaaggcaaggaggccacuggaaaacaacaaugggauaguauuaaaaagauccaugaucauguucuuguuuuuucuggaaacuuauucuuugugccuuccaaaaucaauuaaagaagauauagcuaguugaugauauaguucuucuugcaguugcuuuuagugaaaucauagucagaaaucacugaaaucaggcaauugacuuguucaaagucaccuucuaguuaccgguagcuccaguccuagaacucacauuuucugccuccuucuccauuguuuuuuccaccguacuacauuucguuguggcugucacuuuaaaucuguaucaguggcgcagcaaucucccuaaaaaauaauaauaauaaaucuggcuccugauuccucugcuuuauagcccucagaaucuggcuccaaacugcccuccagaagccucaucuccaccacaacccacucaccccuccucccucucagccuccgcgacacucagcuucucucuuccucucccgccaagcccuuucgcaagccgcuccuccugccagcgcugcuacccccacucuccuccuggcaaacuccuacucacuccucagaaugcagcucacgcgucacccccucugagaacugcuguccuccucccgcaggcuggcgugugugccugcaucccccucuguuggcccccaaagccuugaacaucccuuucucuucacucugagcucuuauucaucugcuuaccucccugucaccaccagaacacugcgagcucuugucacaagaucucugcccuauucaucucagcacagcuuggcuggcucaaagaaacucuuccauuuuuuuuuuuguugugguuugaguaaauggcacuauuucaggaauuuuguaaaguguauuauccucuugggaauacacuugguuuaaguaagaaagaugaggcguagauacuaaaaccugguugacaaaaaagaaacgugucaucaacagcagcucauaccaaaggcagcaugguuucacauguccugggguugcucgucccggccagaggaagcccuggcucuaaaauacagauuugccucuauuaacagcaguucaaacaagcacaagaaaauguggcacaguagauuuagcaacugacaaggagucagagguccuaguggguagguucuaaugcuggcucuaucgguaguguagcuuuugagcaagucacauugcugcuuuaagaccuagugucuucaaaaaaaaauaauuuuuuugagaaggagucucgcccugucgcccaggcuggagugcaguggggcgaucucggcuuacugcaagcuccaccucccaaguucacgccauucuucugccucagccucccaaguagcugggacuacaggugcccgccaccaugcccggcuaauuuuuuuguauuuuuagcagagacgcgguuucaccauauuauccaggauggucuugaucuccugaccucaugaucugccugccuuggccucccaaagugcugggauuacaggcgugagccaccgugcccggcuguguccucauccuuaacauagaucaugcugugugguuccuaaagccuuugcuucccuuaggacucuguuguucuaauucuacguugacaggcugauacauugacuggcugacccuucuggauauaagugguuagauguuaaggagugaagagaguuugaauuagaaucuuggagaaguagcaaagaaaauaacaugauagccuauuuuuguauuuuuaagcuugcuguuugaaguaggagcucauuuauuccacauggaaaaaaguuugaugacauacaguggaauuguuaaaaucagcuucagcaaucucucacugugauaguuucaugagugcuugaaugaagacuaaagaaaggcugacaggaauaagcaaagccugguaacagugaccgacaaacacuagucauggaaguagcuagaaagaagggcaacuugggagacuuaauguguuuuguguuuuguagagucucuggguggagagaacgucauuauacuuggugcagaguuugccuggcaucucucgcugguuugaaguggaaaagcgugaagugguaaggaucagagcuuguucucaagcacuuucucaucacaguuguucacuuggaguugugccguauauucauuacuucuccuucgacccagauucucuggaagcacucauaguaaaauagugaauguuuauggucuugaccgcuauuaccaaggcugagaaggugaauauuaauauuauccuaauguguccagauggagggauuccuugaaaacaacucaauuugcuacauguaaaaaaacuauucaggcccuugaguuagaagacuuggaauuccagcucuccuaauuacuauagcugugugaccuucagugcuuaguguaucauaccagugcuaauacuaccugcuuuaucuuauuuaaucaucauaucaaagcuaugagguauauauucuuauuccuguuuuugcaauuuuugacaagaggucaaaagccuuugccaaagaucacauagcaagauguugaagagagacuccaacccagauauuucugauuccaaagccaauuauauuacucucuucuagcaguagguuucuuacaggcugaaggaggcuaaugucaagucucugcacagugcccgaugcacaguaaguccguguuguuacaguucccaguagaaaggauggcagcguauuagucucacugagcaguccuggguggagcacccacuguagaucagugggugccacuguagaaccugguaaccacagcucccaagaacccuccgguuguaaaaugugaccccagcuccaggccccaguuguggacagcagggagagcagcagcugaaggcagccacauccagggugggaccccacccagcugucugugcuguucuuccagcgacagcaccucgaugucagccauagcccugcagucucacagccucccuugcuacauccauuauagccauuuauuaacuuuauuucacuuagugugaauguucauuuguuucacugcagaaauaauaauguguuuguuuuugagccugggucucacccuuucauugccauaguucucugauaggaagugugccaauugugcaaauauaauguaauucauaccuuauuuaggucacaagccuauucugucaauccagaagaaagaacagcuccugaccaaauuguuuuucaagaauuguuugucuuaccugaaaugucucagcauugaaacuacucucggccuaucauguucaauuaagcuaaggauuuaaaaguuaaaauugaacucuauucagcagauuacaucagugcaguuguauucuuguccagucugagguccagaguccccaaaagcuggcugcuuacauguugugcccugguaccuuccauggaaguggggagacugcuaaacgcagugcucaaaaagucuuauuaugcuucccgcugaauggcauggguccaacuuguagaaguguuuuuagucauccaugcugcauuaaugauucagagagccuuuagcuacuuacuacccagagcauuaaauccugugaagucucaucaaugguccuagcccuuggaaaugucauauacacauacaaugcuaauaaaaaauagcaugcugauaaugauaaaaggagcauuacuaaacacaaccuuucaaacaucagcugccuacuuuauuagaauauguaaucuuauguucugucaaauggaacaaaucaaauucagcuguuuuguucccugaacacagcccacucuuaacagcuuuuguguuuuucucuuguucuugcugccuagaauguccucacugucgauuaaagcuauugguuuccugguuuaacuccuaguguagaaggucuucaagaacagggacagguaguaggugcucaauacaaauacaucacguugaauugaaauuccucaucugcagaugucagcaucugaaaaccaagagauguuuucauuuguucggcuccaaagcucauuugcuaauaauacacccaaccuuuucuaaugcaaguccauuuauuaacuuuauuucacuuagugugaauguucauguguuucacuguagaaauauuauauuuccuuuuuguuuuugagacugggucuugcucugucacccaggcuggagugcagugauaugaucauggcucacugcagccuugaccucccgggcucaagugauccucccaccucagccucccaaguagcugggaccacaagcaugugccaucacaacuggcuaauuuucugauuuguuguagagaugaggugucacgauguugcucaggcuagucuugagcuccugggcugaaacaguccucuagccuuugucucccaaagugcugggauuacaggcauaaaccaccaugcccagccuuauuaauguaaugcauuugauuaaaggaaccugcccuagauccugcuagggguuacauaauauaccauauauggcccuauacugccuuucuaaaaucugaaaaguucuucauucugaaacauguggcaccaaagguuucagaugaaauuggggaccuuuauuuucuaaaucacagaccccccccccaauagcuuaucaacuuuuguuaagauaucaaugccuuugaacuauuguuuccucuguaguuuauuauuuucaaaacccaaaaaaaguguuuuuguccugauuaaaaaauuagcucauuucagcugggugccauggcucaccuguaaucccagcacuucgggaggcugagacagguguaucaccugaggucaggaauucaagaccagccuaaccaacauggugaaaccccgucuguacuaaaaauacaaaaaaguagccgggcaugguggcacgcaccuguagucccagcuacuugggaggcugaggcaggagaaucgcuugaaccggggaggcagagguugcagugagcugagaucacaccacugcacuccagccugggcaacaagagcaaaccucugucucaaaaaaaaaaaaaaaaaaaaaaaaaccuaagcugauuaaaaaauuuuuaaucaagacaaacauuuauaguuuagaauccauaaaugauuuuuuaaaaauccaacuaaagauuacgagaauauuuucauaccacauccugcccaucagaaaacaaugugccucuuucuaaauacuguauacccagaaucuaaccacuccucagcgcccccaccgauagcgccaccuagugccugauuacugcaguagccuccuaaaagauuugcuuucccccuuaucccuguagucuccucuguacauggcagccagugaccuuuuuaaacuuaaguuauagcauacaaaaauagagaaaauguauaaugauauaaugagccugacuuacccaucauugcuucaacagccaucaagccaauuuuguuucaucuacaugucuaccugcucccucucaacuggacuauuuuugaaguaaaucucagaugucauaucacuucaucuacaaauauuuuaguauucauauuuauuuuuaaaaaccugaaauauugucacauuaaaaauuaacaauaauuacuugaucauaaaauguacaguguucauuccacacuuuaccaagucuuuuauucugcauuuuagaccagccugggcaauguaguaagacaccgucuaaacagaaaauuuaaaaaauuagucagcaugguggcauaugucugcaguccuagcaaccuccuacuccagaaguugaggccagaagaucacuggagcccaggaguuugagguuacagugaacuaugaucauaccacuguacucuagccucggugacagucucaacccucuuuuuuaaaaaaaaaaaauuauauauuuuuaggccaggcauggcggcucauaccuguaaucccaacacuuugggaggccagggcaggcagaucacuugaggucaggaguucaagaccagccuggccaauauggcaaaacccugucgcuacaaaaaauacaaaaaguagcugggcaugguggaucacgccuguaaucccagcuucucaggaggcugaagcaggagaauugcuugaacccagaagguggagguugcagugagccaagauugcaccacugcacuccagccugggcaacagaacaagugagacugucucaaaacagaaaaaaaaaaaauauuuuuacucuauuauucgaauccagauuuaaauaagggccaugcauugcaauugauugaaaugucuucuaagucucuuucaaucuguaaguuuccccuugcaucacuuuccuuauuuuuuuauugaagaaacuaaagacuguuuauccugaaauguuuccguauguguggauucugcagacugcaucccagugaagucauauaacauguuucucugucaccuguauuccuuguaaauugguaguuagaacuagagacuugauaaaauguuugcuuuuauuuucacaagacuacuucauacuugguguuaugugcuacugguugucgugugugugugugauguuggcagccacuggugaucauugaccagauccauuaaucuuuuauggguugcaaaauggugauauuuuauuucauguuuauuuacucauuggaauacucuguaaagagaaauguccucucacuaaauauuugauuacccugagguacaggaaagauaaugcuguauucuacaaaagcgacuggagggguuuuuguuugguugguuuuuggaucauuaguaacucauggauauaaguauauuuguuuuguuuuaauccauggcaguuauuaaauuuaaaaauguuccaucuuugccuguugggagcaucuucaaaauggcuccugagucuguuuucacaguauccaaguaguguuuguuacugagcuaacacacaggaucugauugucaaguucgaugcaggacucagcgaccccucccagcaucaagcuuuacuaguaauuucaaggcaggcaggaugcucagauaaagcagcgagauuucugagacauuacacaucgucugcuagguccuucuuccccacaucaguaauaauucagaauuauagguggagucccugagguucacaggguuccucauucagaagcacguuuaaauuaugaagugucgauuaugaaacauuccauuuucuacuccagagaguuaguuguaaagcuucucagggacauucuguaaucaugccucauggauucugguuuauuuauuuacuuaaagaaauccuuugacuggggacuuuagggcauucuguagauaacaucucuuccuccuagcaauuacuuuuagucuguuuacuugaagguucaauugacaaagagauaagacauagucaccugucuuuucugucccuuaaggacauuccccaguaaagaaaaugaauggaucacaggccagauacuuucauguuuuccucccauccuuaccuuuaccauccuuccugguaagacgagguggucuaggaucacuugaacaucuccugccccagaccugaaagcagcuauuucuccaaugacuccuuauucauuuuaguggugaacaauauuuagagauuguaaucugaaggauagaggaaaguaauucuuggugaacacucuaucacauaucuuugcacacuucuuugaccguccccuuauauuucccuagaagugaauuaaucaaaaguauccccacuguaaccacugauucauggcucagcaaugggauauaucguuuacacccugucuagaggggauaacuagucuuaggaauacuuauuuccccagcaucuucuccaacacuaaguguuguauauuuuaaucuuuccaaauaauagaccaaaauuauacugggguuggauguuuuguuucagcauuuuuugaaugcuaagugaagauauguuuucauauauugaugaacucuauaccaaucauauccuuugccccuuuucuucaguauuuggcaaauauuaacauuuuaucuauccuucauguuggaaauauuuuccaagucguuuguauuuugccuguguuuauuaugucuuguuuuauuuacuuuuagaaaauuugauuuuuaauagcauuugaauuuauaaagaugaagauugcuuuuuucuuauagccaaaagcacauaaaaccuacuauuguaaccauuuuuaugugugcaguaugguaguguuaacuauauauacauuguugugcaacagaugucuagaaguuuuucaucuuggaaaacucaaacucgauauucacugaacagaaguucuccucuccccuuuccccuagacccugggaaccaccauucuauguucuaagauguuuugcuuacuuuuuaacuuucaguuacucagagcucucagacuuuuccuuuaugguuuagguuuuguguacauaaaacaaagguuuaguguuacaaauaaucugaaaguaaauacccguuuuccaccauucagguaaagaaacagaacauugccagcaguauccugcaggccuccugugcaccucuucucaauuauagcuccaucuucaccauaaaaguagucacuauccugacuucuaugguauccauucccuugcuuaguguaucaccuauuugccucucuaaacaagucgauuugguuuuaccugguuuugaacguuauauaacauacuacuuguguucuauugagacauauuugacucaguguuguguguaauauuuuuccauguuauugcaugugauugaaguuuguuucauugcuguauacuauuccauuccaugaacauaucacaauauguuuauucucuugucaauggacauacggauuuuggagauuaugaacauuuuuguacauguuuccugguacacgugcacaaaccuccuaccccacuuuuccuuauaugccuagaauuucugaaucgauauacacacacacacacauguauauauaucuucaacuguuuuuccaaagugaaugaaccaacuugaacuuccaguagcaguaauugagaguccguugcucacagucucacucucaucugcuguugucauuuuuaccauuucaguggguguuuaguaguauguuauuguagcaguauuuuucacaucuuugaucacaaaugaggcccaacaccuuuucauuauuuguuuacuggccauuugaauguauuccuuuguaagugguuguuuaauucauuugcucauuuuuuauugggucguuugccuuuuucuuccugguuuuuaagaauccuuauauacccugaacacgugcuuuuugaugguuacacauguuacaaaaucuucuauguucuugcuuaucuucccuucucuuugucuuugaugaauguucagucuucauauucuaggauuuuucaguguugguuuaagaugauccaagugaccuuuaaaaacucuaauuuguuuccuugccugaaugaaccaauauuuaaauaugcuaauuguaguccugaauuacuugauugcugagagcuuggcagaccuucucuucaaggcaauagcagucccaaugacauacauuugaagagcacuuuuaucauuuucacaauuagguccuccauacagccuggaauuuuuaagucauuaugauucuauuuggcucuccaacaaauagauccugcaguauauauuaucuuguuuucuauaauucccaacugugugccauccugugccaccuuauggugcuguuauauauauauaugagguucauguggcauaugucccaucuucccaacugggcugaaagcuccuugacaucagaggauccauaaaugcaucuuuauaucucccauggugcuuuguaucaaauaagcaugagaaaggggauaauauucagggucucugaauauuuaacccuucaaaagaaaaaaaaaacuaguuuuaaaagacaugagaugcuuggauauuauuuuaaggauuaaauugguuguugcagugcuaauguagaauugaugauuauccaaaccacauuucaaugaauaaguauaauuaccugcccuuuccaaaccuugcuaaugaacaucccacuugacuuccacauccuugucuauucuacggaauggccccugguagagauauugauggaagccaagggggagcacagauaauucagaacauggauaaacuacuuugucuuucuucuugaaugucacaaauucaauauauauuuauguucauuugcuucucagguagaaaugaguccucuggaaaaugcaauugaagugcuagaaaauaagaaucagcagcugaagacucugauuagucagugucagacaagacagaugcagaauauuaauccccugacuaugugccugaauggaguuauagaugcugcaguuaaugguggcguuuccagguaucaagagguaaggauuagguauuguuguuucagagaaaguuuucaauugugacuucuuaggguuucaugaaucuuuuuucagacuauguacccauaucagcacgcaaacauagggcugcgauugacacagaguccuuuguuaaauagagcaaacauacagucauuuguaauugcccaguaacuccauuuucccaacauguuauauuuggauaauaaaaauguguguguguguguucauucuugcaugaauaaaaguagaaaggacauuaggacuguuuaauaaauauccgucuaaaauaauuucucuaagcaaagaaguucaugggcauagaaaagucugaucugggcugggcucaguggcucacaccuguaaucccagcacuuugguuugagaccagcuugagcaacauaggaagaucuuaucucuuauuuaaaaaaaaaaaaaaaaaaaaaaaaaaagauaagaccgaucuugcuuagaugauacuuuaaguggaccuuucaucugcucucuuaaacagaaagauauaauacccuggaagguaaggccaccaucuaggucacacugaaucuuaaggcaguuuguuuuaggauacaagccauauagcuuacugauuugggcuuguucuuuauuuuagcaaggguacuuauuguacaaucacugaucuuccuuuaacaauucuuuccuuauguucccauucugaccaaccaccuacacuaguaaucagcccaucugucccaaaaugugguuuguaauggugucauuuccauaaagaugccaggucuuuaaaaacaacuugucuuugacuugccuuguacuccacuaaaguagacugauucuccuuucccuuacuaggcauucuuugucaaagaauauaucuuaagucacccugaagauggggagaaaauugcacgauuaagagagcugaugcuugagcagguaagggaagcagaagccaacccccuucuauuuugccuggauaugugcuugcuuaccuagagcccccucugcaugguuuccugcaucaguggucuaacagaagcuggcaagcaagggugacagauuccuguaauauaucccagcuugcuaauuucuacuucuucuucccacuccgaugcaaaaauuaauuuaacaaugaguagacuauggcagccaguuacagguugaguauccuuuauccaaaauacuugggaccauaaguguuucagauuuugaaauauuugcauauacauaagagauaucuugggggagggacccaagucaaauaacaaaauuuauuauuucauauauaucuuauacacauagccugaaggucauuuuauauaauauuuuaauaauuuugugcaugaaguuucgacugcaacccaucacgugagguuggguguggaauuuuccacuugugggauguuggcauucaaaaggcuucaaauuuuggaggauuucugauuuucaguuuuuguauuagggauguucaaccugugaaacaaacaacuucauguggucucuuaaaacauucuuugaauguucucuuccuagagacuugcuguaggcuugaugccaacuuuuuuuuuuuuuuuuuuuuuuuuuuuaagacggagucucccucugucacccaggcuggagugcaguggcaugaucucugcucacugcaagcuccgccuccuggguucacgccauucuccugccucagccucccaaguagcugggaccacaagugcccgccaccacaccuggcuaauuuuuuuugcauuuuuaguagagacgggguuucacuguguuagccaggauggucucgaucuccugaccuugugauccacccgccucagccucccaaagugcugggauuacaggcgugagccaccgcgccuggccgaugccaacuuuucacucaaaauucugugcucagaaaaguucaggccaacuccaaauaugaggcaugaaugaaauuuuuacuuaagcauuguaauaaggaagugggcaaucaguagaucuugcuuuaaagcagugucauauuuugcaaaguaaaccuauagguuacaugauauggacaaaacuacauacaacucaucauuuucuacccccagagaagcgugguuuauuuauuuggaaccaucaaguacaaagaacuggaaugaguaaucuguugccuacugugucccuauugauagccugaaaugguuugaaaaccucugagguaggagacaugguuggaagccuguguuaaacaggaaauaaagacauuugcuuccugugaaaaguggaauaugugugaugaaacaugacaaaggcauuucuuucuacccaauaaugccaaauuaauaaguaaagcaugcucuuuggauuagaaaaugaggucgugucugguuuucauccaucuuuuaugcucuguaggcuuaguccacaaaaccuaauacuacagggagagagguggccacagaagagagagaagaauuacuugaagcugaucuguaaggaaauaaagaauaagucaaguucucaaugugacucuggguguuuguagauacuagaagugagcaguugaggucauccauuacuuaggauuaugcaaugacuuuaaccuucauugauuuuuaaagaucuguguuuuaccucuuaugaaugguucacuccaccccaggacuguaucugcuggauucagccugacugaauuauuuccccagaauuaaaugguagcucagggucaagaagacugccaagaaaaauaaaaccagggaaccuuuauuucuucuacguccugcuuauguuccugaaaccuuguggaaagagccauggccuagaaaaugugagaucucuguuauaagacaagcagugcacgugacugucaaugugcccuuggccaagucucaucaucucuguggggagguggacuggagagggcaccauccuucucuggaccucugcaaaguaguucagauaaacucucuagaggacagagacaugcaccaccccagugcuccuuccaggacagacuuacucugccucagcugcaggaaauguggcucucaacagacaucuccagcugucaggcccuucagggauugccuccacugcagagagccacuuggcccaagguugcuaccuucucaguggugcacaucccauacugaggaagcaauagaaagccuggccauuugggaccaacacaggacaacuuugacagaccauuaaagguccagagguugagguaggaguaucaucugacaccaggaguucaagacuagccugggcaacauagcaagaccccaucucuacaaaaaccuaaaaacuagcugggugugguggugcaugccuguaggcccagcuacuugggaggcugaggugggaggaucaccuuagcccaggaguucgagguugcagugagcuaugaucacaccacugcauuccuuccugggcagcagagugagacucugucucuaaaaagauuaaaauacagauaaauuuuuaagaacauuccagaggucccuuggguuuggcaguagcugacaggacugcugugcagcucaacuucuuuucuugucaaguccggcuucugucccucccccugacaggcaucaaucccaagguacacccugauaaacauuaugaaauccaugcuggagucuacuucccagagaacccaacuugcaacauucugugaacaaaagggaagucacccaacgcuaguguuuaaaauggagaagacugggggccucugcguuuagauccaccuccuacaucccuuccauguccucaucacagauguagccucucccuuuaugccucauacacacugcacuccaagugugccuuucaaaggcauccuugauauuuguuaugcaaauaugcuggcagugggcagcauccagagccccgucccuuagggaaggugcuggaugccccaacccgccagggucaguccuguuugaccugagcuuucaaccuaaaaucuucacgagcugcaaagauuaaaaauagcaacaauaacaacaaaaccuuguggugauauaggauucguuuuccucccagucuauggaauuuguccuuuugaccauguuagcauggggggcauuuuuaaaauacaaaagacagcugcugcucgaaucaaaggaaucacacacuguugaugguugcacaaaggaagguugaauguuuaccuucaucucuucggauccucacugcaggaaaguuuuuuaaguaggaccugcucucucguugaauuauaagugaauaugaauaauguuuuuugggauuuuuuucuuuuuucuuuuuuuuuucuuuuuggagacagagucuagcucugucaccuaggcugaaaugcaguggcaugaucuuggcucacuacaaccuccaccucccggauucaagcaauccuccugccucagccacucgaguaguuggaacuacaggcacgugccaccacaccuggcuaauuuuuguauuuuuaguagagacagcguuucacuguguuguccaggcuggucuugaacuccugaccuugugaucaacccgccuuggccucccaaagugcugggauuacaggcgugagccaccgcgccuggccaggaauaaucuuuuuaaacaaaaacaagaagcauggaaacugucauagaauuccuuuuuguuuuguuuuuuccauccucccuggcagauucugaaagucugugggagggauggaugagcacagaggaaccuagugggagagggaaauguggggggagagggugccaugcaaagaagagaucuuuaagggagaauugccggcccucuuaacagugagcagcacaugccccuauuccuucuccacccuggggagagaaggaaggggccaaaaggacacauaacuguuacgaggcauuauaauuauagaucuaaaauacaugggaaagaagccugggggaguaggaaaauuaagucugaaaucagaaccaaguucuaauccccauuugucuuuuauccaugcaggauuuuucagauccucaguuuuucuucaccuguaaagugacagcuguuccuaccuugucagaggcagaggauuagcaauaaugcaagcgaaaugcguaguaaagugcucggcccauagcaggcacuuagugagagguagucauugaugugagguuuuuuccuuauguugugaauuaaggcacagauucuggaauuugguuuggccgugcaugagaaguuuguaccucaagauaugagaccccuucacaaaaagcugguugaccaauucuuugugaugaagucgagcuuagggauacagguauguauacuuagguguccauggcggggcagccugaucacugccguuugcuuguuaaagggaugaugauguauccaauagugacaucuugugguuuuucuaccaaacugcacuguuuuaccagggagcccucaaauacaauugccuugucugcuauuugcgaggcuuuccuuuugggaaaacacaaauguaagugagggaaagccaaauaauacuggaacuugcuuuaauagcucccuaugugaagacuugauggcaauuaggaugugugccuaguaugcuaaccugucucauaaguuauuuugcccaaaucauuacuguaaugagauauuuccuuuacuacaucuuuaggaguucucugcuuguaugcaagccaguccuguccauuuuccuaauggaagcccucguguguguagaaacucagcaccugcuucugugagcccagaugguaccaggguaauuccuagacgcagguaagucauauuccaaauuaucuuacaauuuggccucacccgcaagcugaucuggaaugguucucucauucuuuauggcacaauuugucaaauacgcuauuucuuaaugaaauaacuaacccgcgaggcagcugcagaccucugccaccaguaaaacagcaacagcaugagaaauaaauaaacucaaacauuugauuauauugaggcaaacaggagaaaacaaaacggaauguauuuuccccccuuugguuucauagcauucuagcacaugauaaaguacaauuuggagacugaguuaaugaccuuuuuuuucccccugaaacagcccguuaaguuacccagcugucaaccgauauucuuccuccucacuguccucacaagcuucugcugaaguaagcaauauuacagggcaaucagaaagcucugaugaagucuuuaacaugcagguacuuaauuagcuuuuugucugguuguguuuauuccuuuucugucucaaucaugaguguuucuguucauucugcugugcugaugaacagaccaacaagcaagaacuuggcuuaaggacaaaccuuuaaacacucuucuugcuuuaugggucucuagagucuacaaagacguuucucuuaaaacugccccaucgcuuuaagacgacaucagcaagcgauggaaaagccuaggcacgcugcacaagguucagcucugagaccugccccaaguuccuucugcaguccaggacucucagaguguguugccacucacuagcugccucuuagcuugccuuuuuuuuuuuuuuuuuuuuuuuuuuuuuuuagcgagucucacucugucucccagucuggagugcaguggugcgaucuuggcucacugcaaccuccgccucccgggcucaggcaguuuucgugccucagccucgugaguagcugggauuacagguguguaccaccacgcccgacuaauuuuuguauuuuuaguagagacgggguuucacuauguuggccagguuggucucgaacuccugaccucaagugaucugcccaauuuggccucccaaagugcugggauuacaggcaugagcuacugcgcccggccccucuuagcauuccaaaauggcuuuuuuuuucuuuaagaagacaugauuuggcuaggugcaguggcucaugccuguaaucccaacacuuugggaggccgaggugagcgaaucaccuugagaucuggaguucgagaccauccuggccagcauggugaaaccccgucucuaucaaaaauacaaaaauuagccgggcaugguggcgcaugccuguaaucccagcuacucgggaggcugaggcaggagaaucgcuugaaccugggaggaggagguugcagugagccgagagcaugucacugcacuccagccugggcaacaaagcgagacugugucucaaagaaaaaagaaaaaaagacaugauuugagggucuguuuuaaaauuaucuuuacuuauguacauaucagaaaguuuccaaagguauuuuuuuuauacaagaaaaauguaguuuuuagggauuuuagagccaguauaacuccugcaagcaaacauuuuauuuaaacacuacuaauauggcauuuaugauaguucaguaagacuaagcugaaauuuuccucaccacuaucuuuggaaaggagacauaacacuuauuuccaaauucaugcuuugaacauacuuguacagauaacaagaaggcauauuuuaugccuuuuagacgcacucgccuguuuuugggcccuaggcuggaagucauucuacuuauaccucaaugaaggaaugcacugcuaacugguacgaagucacaguguauagcugaaucuaacacgaaggcauuccuuuggcaggagucaaaaucucagacuuuucauuaauucaugcagacuucuuugucaaucuaaguuauuaagauuuucuauauuguuaaacggacuuuuuguugcuaauuugaaaaaaaguugaugauuuuguuucaaauacgucagugucgugggaagccuuuaaucaggguaugauaauagcucccuguguguuuccagccaaguccaucuaccucaagcuugaguucuacucacucggcuucaccuaaugugacaaguucugcuccaucgagugccagaggucagugccagaguguggggaagacugagggugcccagagaaccuucuaguccugggaacuguggccagcugccacacguucaggcucucgccuccaaacaggugcagcaccacuaccaugcugaugauccucucucuccuucucuucccagcuucuccuuuguugucugacaaacacaaacauucccgagaaaacucuugccugucaccaagagagagaccaugcagugccaucuauccaacaccuguggagccuucgcagguacuccuuguaggguagagaaacuagaaaacaaggacaauucuggaauugcuuaccuaucucugcagaaacacgcgguagcugccaaaagcaagcagcugggcagugucagaccaauccagcuggugaagauugcaccucuguuuucugcccaugguuagaaauuucugccugagccaucuuuuuuuuuuuuucuuugagacaggaucucgcugucacccaggcuagagugcaguggcacaauccuggcucacugcaaccuccaccuccuggguucaagcaauucuccugucucagccucccgaguaguugggauuauaggugcccaccaccacacauggcuaauuuuuguauuuauaauagaaaugggguuuugccauguuggccaggcuggucucgaacuccugaccucaggugauccaccugccuuggccucccaaagugcugggauuacaggcaugagccaccacucccggcccugagccauauuucugauagggacacaugguaguugcuuggcagugaugcuaaaagggaaaugggaaguuuacccuccuugaucuauuucauugcugcuucuuaaacauuaugcaaaguaguugggugaauaaagugccuguguuugcaugcccuguguauguaacagaagucugggggaaccucuuaaacuaggaaaauacccuugaagagaagcauucuccugcccagcagucuuugccuuugccuagaccuauuuaaaagagcugcaaucgauuccuaucuggguacccaugaguauaggagcaauuuguuugccuuugccauucuugaaugcaugagaaaagagcgguucaguccucagccuuucccugucaacugcucaugcgaguaagggagcuuggcccucacccccugccugaacuugguuuugaagugaucccuguuuuucugagagcagaggcuugggcucagcccuugggcacuucaggagccuugaagggugguuucaaaguugaagauucauggguagcccugaguuuuaaagauuugggaauaguuuaggagcagagaaaaauaguuauuucuacuccagcuaauuucuguuuuucuacaccauccuggcagaagucuguagccacauccggaaguggaugagagagagugggauuuggcuucauugguuugucuuugcugauugugugauccucccgaaagucccaggguaccgccucugcacaacgcugaugucuugcagaaauuauaucugagugcauuuggcuggacuagcuauuucccuuugucacuugaugaugcugcaagggaauuucucaguuuguucugcuccaggagaacuucuugucagcaugggcaacucugaaagccuucucugauuagccucccaaguuuucugguuuuaguaaaauuggaagcaguauauauguugcuaaauuucaauagugugcacugccguaguacaucuacuuuuaaggacuugguaccuucuauuuaauauauuagguaaaaccauguaaaacuggcauuuuuauaaguuaaaaauuguagacuaucaauuauuucauauauuuuuuaccuaauaaaugauuuuuaacaugcagggguuaaauuucacucacuagugauuuuuugaacuaauauuucuccuuuaauucuuauuucuguuuuauaucaccacuguagcauuuguauuuacaaagaacuccacacaggccaggugugguggcucaugccuguaaucccagcgcuuugggauuggccaagguuggaaggacugcuugagcccaggcauucaagaccagccugggcaauauagugagauuccaucucuaaaaagaaaagaaaaaaaaagaacuucauagcacaacugcuauuuacuauuuauuuuuuacauuuuauuaugaacauuuaccauuuauauuuaaaauauaauacaaacuuuuccaacacucuuuucuuucucaaaaccuaaggcucuucccacccccuuuuacuuaaauauaauuaaauuauuuguuccuaggcucaucauaucacacaaaaauuauuuugaacaaaaaguuuuacugaggagauaaucgucucauuuucugaaagguuucacaugcccguauaucacaucauaaaaaucaacccuuguaacuuugcagaggaugcuguuuaaucauauuggagacggggccuugccacgcagugacccaaaucucucugcaccugaaaaagguaaggccagccccauggucaguccuggaauguguaagggcuuguuuuauccucauguucuccagucuucugugugucuguguggaaagcagugcucuagcucuuuaaugaucaggacuaguaugcucuuuaagggauuaaugaaagacaguuauucaugaucauucuucaaaagcuguuuuccuauaagauuuuaacagcagaaucugagcaagauaggaacgccuauguuuaauggcuuuuuguuaucauccagugagucacccaggcaaugccuccucuuccugaagcaaaguugccaauuaggcuccuuguucagcacaaugaaaauagcuucacccggaucgauucgguggucccauccuucgucucccuuacaaagcucauucagccaacucauguguuguuuguugugacucagauacggcucuuguacaauuaaauaccauuuaagaauugcaauccagugcauaauggagugugcccugccucaaggucacacaaaaugagaaccaaacacauggacagcaguaaauagccaauuaggaucagucugcaacacggcagaagaugaagagcagauuaaacacgauuuccucagcuacggggucggggcuugcagcaagucacccauucaccucucucagggucaagccucaaaaauaagagcaguuccccaggccaauaaaucaagagucguuaaugaaauagucugggaaagugccuuuuaauugcccucauuaagaaguaaacuauugucauuuggguacacugcuacauuagaacuuuccuugggagauggaaauuagugaagucuuaggcaaaauuauuuuaaaacacaaauuuagcuuuaauguuacaagucacauguucaucuuugucaguagaacuaaggaaugugguauuuuucucaccccuucuacuaaagaaaaccacgaugcaaauuuaaaagaauagagaaaaagaauuuuaagagugguaacuccaucccauuaagugaaaauggucgagugguaaaauguugaaauucucaacaugcccaccagauggcagugucuguacagggagugagucacuggaacccagauuugcuguuguaaaccucauugcauaguggcuauuuacaaccagcguguccugcccuuauuccugccaggauugccccauauuccugcaucuuaucgaagcacagagcagacaaauuacaaaauaagaaugacacuguccauauuccaaaucauuuuuuaaggacauauuucaguguaauucauugauuucagaaagaguuaucaaugagauaauauugcauggcuguucuuucccaagaauucugccaaauaguuaaaauauuaguaugucauugccuucuccauuuuuaggugucacuuguccagaaaugucuacuaaaagccaaguuuuaaaauagcccagugacuacaucuuccaucuguuauccagcaucuaaacacauuuguaauucucagcaaguuuuacaccccaguguaaagauuuguaguucccuuugacagcauuaagggaaauaaagagacuuguuagcgcccaguuaaaugguaacuauaacuguuaggcagccaauuaaauaaagguuuaguauucaagaaguuuccuguuuuguuuuucauccaguuaaguuuuucauucuggauaauucugacuuucuucuaagaucucaagcauuggaagggcaaagcuggaccguguguuuuuagcuguguuauucccuuccagcugugaaccccaccccuagcagcuggagccuggacagugggaaggaagccaagaacaugucggauagugggaaacuuaucucucccccugucccuccaagacccacacagacugguggguauuugaagaauuugaaugaucacuuuuauaaaauaacuuuuauugacuacuccaguuuguccugaauuccugagagaaagguaggcguuugauuucugggauaaaaaccuuaguagcugcauaauuccuugacaauugucucccucuuuccugaacuucuauuacacggggucaaacaguggucuguuccaaguaagccucucggacagauuuuauagagugcucuuuaccaagccaccauucucaaauucggggaggcacccuaaccuugguaggccacuagcaucuucucuaaccuucacuuugaaccacuucauucuuaucaaccuccgcuaacucagcuacuuucuucagucuuauucaggacugaugccaaaguuuccaguugccucuaaauagccauugacuaacaguuacgcuccauaagcuuaucagagucauuaacuuuguauccauaguuaucuguugcuuugagaggucuuuaugcaaggacuauauuucgcaaaggguugauucaggguaccgcauccccucagguggucguuuaagcagcaaaaucuuggccagguguuuuggcuuaugccuguaauaccagcauuuugggagaccaaggugaguggaucacuugaacucacaaguuugggaccagccugggcagcaugacaaaaccccgucucuacaaaaaauauaaaaauuagccagguguggugguacacaccuguagucccagcuacuugggaggauggcuugagcccagaagucagagguugcagugaaccaagauggcaccacugcacuucagccugggccaaauaagguaguucacaccuguaaucccagcacuuugggaggccaaggcaggcagaucacuugagcccaggaguuuugagagaagccuguacaacauggcaaaaccccaucucuacaaaaaaaaaugcaaaaauuagccaggcaugguggcacacaccucuaguccuagcuaguugggaggcuuaggugggagaauugcuugagcccaggaagcagagguugcagugagccaagauugagccacugcacucuagccugggcaacaaagugagaccuugccacaaaacacaauaaacuaugugccaccuaguuuacucuauacuugucaaagccaaaagucaagucaccaauaauuuuugagagacauaugaggucuucaaagaaaacaagaaauaacuuuaagcuuauugaucaccugcauuaguauaucaguauguguacagaggccuaaaacuuaucggccaaacuauuuguaucucauucacgauguacauauauucaggcagucuccaauuuaaaccugguugugucccuaaaguugagaaccugaaaagcauuuuuuaaggaauaauauugaugcaaauaugcugugguugcaggggccaccaugguggugucagcaacugccugagucaggaggaagaggguccuagggaacaaucaacuuucuaccaccguuaaggcaggaacauaguucuccgucaggaucagcuucuccauacagaugugauuuucuuccauaaucagcacccacgaucaacaggauaggagaacuaaggcugguauuagaaugugacacgugcugacagcaugccccagcauucaagagugcaagagagaggcugcacacuaccagugugaucauggagcacucucacugaccccuuaggacccagagcacacagaugaccuuaccccucccaaguuaacuggcagggcugccaucccuucugcacugauugcucucauggucuguucuuaugucaucaucuguggucacuguuguggggcucuguaacugucuuucuuucuuacagccuuucaguaguugugaguugcaaaccucacugugacagcugggagaguagcagcuaaucacagagcgacauacccagaguucaccgaaacgucucuguggaauugagaaauguggcugacucucacccuguugacugugucacgccagccuuuaccauacagggcuaugcuuuagagagcuggauuugcuauacaagcaugcacacaggaacagugcuaucacacaugcuguguuccagguguaggacuugaaaaucuagugagaaaaagcaaacaguucacucuucuuggccacgaugaugaaauccauagagacccaccaccaggggauaaugggaagaccugaguacaagcauuaggggaagaaauggaaaaccaugcaccuguuguauggccauggccaaggguuuucuaccuauuuggggaguacugggguuguuuggggggagcugauuaaauauguucccguagaccuguuccaggcugcugggguggccaugguguucccauuggugcucacgccaaagucaacagcuguuccccaagaacugcucccuagcaucucacaccuaaaagcaccuuaugagacagaucaagcagugcagaagcaccuggacuuuggggaaacggaaaggacauuggaucaguuugggaaccugucaauagucaaagcaucauauaugccaugauaacuuuucacugaugcucccauaucuuggcagugccacccuuugugagaacccauucuagacaggcaucauuuagcuucucccccauccucaccacccccuuugcuuagaagguccuuaugcacuggaucaucuguuuggguuuguaacacagagggcaugugcagauagucaaucgucugguuuuucuuaauugaaauguuaucucucuccccauugacagcuucaccagcaagacacacgacaucaguaucccccucgccugccgggcgaucuccauugaagguaaaggcccuucuuucgacugaggcuagagacuggcccaguuuucuuuuucucuaagacucaucccagauauaucaaaaggugcuuuaauuugcagggaccaggcaaagaacuuaucaaucagggauaggggaagcugguugagaaaaacaacacuggacuuucccuucugggugccuccugcacaaacgcagccauuuguuuuucgauuauuagccucauucuccaaaugguagcagugagaacuugcagacugaagucagugcauauacugaauuaggaaaggaaugugguccuaauguaccuccuaggaaacuuucagccuggccuuuuaguuuaagguacaucaaacacacacacacacacuuagauugagaaacaucaguaucaagaucuacuaaauauucugugucuuuuugccuuuaucgucagccaaacccauuuugucaaagccaaaccuaacauucucuguuaauauuuuauaccaaguuucucauuuacauuagaaauacauacuugaucaugaaaaacaaggcaguaauauggauuuaaaagauuucuagggaacaaacuggaaagcuguaaaggucagacauucgaauugguuuguagacaugggcuauuuaacaucuuuaaacauaaaaaaucccucaugaagauaaagaauaauauuuagucuuauccaaauugaaucagaccggcuucaaggauugucaguacgugagagauugguguucagaacugcugcaccagaggcaaauaugaagugugucgaaagaaugauuuuguaccugagugacuuaggauuuacacgcuccauguccuuugugugaugagcuaguucuagcuaaugugcaaaagacaaauuagccucuacaaacacauaggggcagguugcgauccagugcaucuguggugcuaacgauaguugcugauagaaauugagaaacgggaaaacaacccgccuccccccgcaaaauggagaaaauugaaagaagugugauucccuugcauugccagaauuucugacguagaaauucgcggguaagugcaagugauuugcucguuuuguucucauucuguaaugcagcuguuauuaugaaguaccugugacagcauucacucuggaagucauagccugucaccucgaugugauagaaaggaaagcaacauggcuuuuccgcacuuuuacauuugcccuuacucacacagagcucccacacguugcuauggaauuaucaucuguauuuuucaacuuaaauuuuguuggguaguaagaaaauaagucuuaagagauuaauucuuaaacauuaaaaagaacccaagagcuaaaaauguuugaauagcuauaaaauagucuuagcaagcugguauauacugucucucagcagaccuguguacauuuuuacuggccauaugcaguucgaagccaugucuuuauauguaggguuugaaggaagagaacauagaucgaacauuuguguuauaccuccuggguuacauuagggggcacacugcuaccauguuacuagccuugcagugugcugccuuaacugauaagaguuuagugggguuuuggguuuuuuuuuuaccccagccagccaucaaacugugggucuaacccuacagcgaagacugagcugaccugccauauuuugaauuucaggucuaacuuuugacagagguagcagugaauugggaacucuuaauuggccuuaauguuaggcuccuacuaaaugacaggauguguaucuaccagcguuauuuuguuuacaaagagaaaccaaagucaaguuagcuuaagaagauagcauuucucaaaguguauaccauagaacacuaguuuuccaggacauuauguaauaagcgggggagaaaaggucuauagucaaguaaguuuggaaaacacuggacugaacaaaauuauuuguauuccuuuauucuaagccuugaaaaugcgaauauguuuugaauauacacaaggaguauacagugugcagcauuucccagcggaacccucuuuucacagagcaucuaucuuaggacucguuuuccuugggauacuaguugggaaaguaacaaacucagaugccaaauggggccagacagcugacacaaaugaaggaggccggguguaguccccacguggcauaguggggacuggcaaagugaaaagggacagcccuucucagcuuuuaaagauuaucucuauuaagagaaugugugccauuguggccagaacuccuaguucuuuaugaacugccagaauucuggaguuucaugugaaauuugaaauguuaaaaauuaacuaaauuagguuuuuaaaaaacugcugaggaaacagcucacaucacaggcuacagccccgagggcugccaguucgccaguucagcucaggagucuggagucuggagugauggcuggagaaaucaggugcagaaccucgggugccucugcuccuccuccugagcucucugggucuucugagcugagugugcucagcggcccuggcuccuggccugcagcaugcccugcugagcugggaaagugaauagcgcccccaaagguuuuauggcguuuuuagguuuuugggguuuuuggccaguucccucucuuccaaacuauaggacuaaugugugccuccagauuaucuugguggauaccuuuauuuauuuuuugagacagggucucauuguguugcccaggcuggagugcacugguggcuccacggcucacugcagucucaaccucccaagguucaggugauccucccagaggaacugggauuacaggcaugagccaccacgcccagcuaacccuuuggauuuuuaguagaaaugggguuuugccauguugcccaggcuggucucaagcuccuggccucaagugaucccugcaucggccuucuaaaguauugggauuacaggcgugagccaccaugcccagcuccuuucuccucuaucugaaaaugauaaggaguaaacugggcggugaacugaacucgaggacugguggcccucgcagauaaacgucuggugugcauuuucagugcuacaaaggacaacacucaaauuugagugugaguguauucgucugcucgggcuucccucacaaaauaccacaaacuggguggcuuagacacugggaauguauuuucucaauucuggcagguagaaguccaggaucaaugcguggcagccuugguuuccccgaggccucccuccugggcuugcagaccgcccuuccugcaaggucugugugugucgcauuccugacgucucccuguguguccaaaugucucuuauaaggacaccagucagcuuggauuaggauccaccauaauggccuuuuaccuuaaucaccuccuuaaaggcugcaucuccugcugcagccggcuuugggggugcugggggccggggccuccgcgucggggcguacauuucagcgcaucugcguucacgacucaaugcugugucucccucucguuuccuucuccccggagcagggcucugugcagucuuucacccccucuccaguggaguaccacucgccaggacucaucuccaacuccccugucuugucgggcagcuacagcagugggauuucuucucucagccggugcagcacgucggaaaccucaggcuuugaaaaucaggugaaugaacagucggccccccugccggugccagugccggugcccgugccgagcuacggcggggaggagccagugcgcaaggagagcaagacuccgcccccguacagcgucuacgagcggacucugcggcgccccgucccgcuaccucacagccucuccauccccgucacgucggagccgcccgcgcugccccccaagccucuggcagcgcgauccagccaccuggagaauggggcccggaggacugaccccggcccgcggcccaggccccugccccgcaaggucucucaguuauaagucacuuuucuauguaccugcgaugcauucuuugcccguuuacaaaauaagaaguaugaugagaagacauuuaguguaggcacuuuaauaacuuacucagcuccuucgaugaauggaauuaaaacuugcuuauuaaauaucauguugcacaauauuaaaaguugcugaucuaaaacgccagauguuaaaugaaguauggcugaauuucauuaaaacguuucucauuuggaagugguaaauagugauaaagacuccuuuuguaccuuuuuauguucacuuuuuuuuauauaguuuaaucuuaaaaccaauacgauauugucaaacgauacaaugugugacaauguuguaucguuuuuacugaauacuugauacuuggagaaagcuuauuaagucagugcacauccuaacacagugguccuuauuuuagaagacuucuguaaauaaggcaagguuuaucagugcagaucaucagaauuaaaguucaagcaggcgagcaagacaguauacuuaagggguugcaaagcuugggacuggaaauuguuuuguucuugaaacaaaauacuucuuuaagguugcuuuugcuguuugacugcugucuacauucguaaaauucuauuuugugaauugguagcuaaaucccuuacuacccugacaccgugguaucuacuguauuucuuuucaaggugcaauuugcuucagaguuccaaucagcuagauuaagcaagaggcuccagaagaaauguuuacuugaauuuugcgcuuccuuucuugauaguuuccuauauaaaauuugucauugaacaagagcaaaugcugaaguauuaaugaggcacaaaugacugugccccauuagcaagaauucaggaaucaauacagacaguauuaaauuaauagcuuaagugaagaaaaaaaaaacuuagugaaaauguauuagcacgauuaaauggcaaaaggacuuauaaaaggcaagggcauuaacuuucaguccugcacaaaauaaaaaauuccucacgacucuccacuuuuaccaguggaguuugucuuagcugaccugucgucuuucucuugaaggaggauugcuguagacuucucuagcuugaauauugcaacauagcaucuuaggucuagauagggaugcuaaugccaguuguagaagugugaaaaaagcaccuuguauguaguaauguauuuuauaucuuuguuuuuucuuuuacugacuguuuauaacacucaauugacaauagauaugaacuguauuuuaaaucauacuguuaaauauuuucccucuuuuguugggaagcucauuuuaguuuaaccauguuuguuuuguugguagcuuaccuggaaggcagugaccacuuuuuuauauucucuuaaugaaaccauucagcagguauaugcuguugaggcugguuauagagguuuucuauaauaaauguucaaguauuuuuguauauaacugguuaauuuuaauaagagauaccauuauguguaaaaaaaaguaaaaauaaacgcaaacaguuguugaugcaguaugauuguuauaauuaugccaaauacuuuacguauggaaaaagaauauuuguacauaugugcuuuuaacaauucugccauauugacuuuacaauuuugaaugucggaaaaauuaauauauguuaaauauuuauguuuagugaaaguguucauaauugagaaaaggaacauaugcauuuuagcuuuguaucuugcaaguuuugcagucagaaauuuuuugaacuagcuuuugcuuuugauaacacuucguguuuguaaccacauucauauauauauacauauauaugugaagcuccauauuucuguugcuuuaaagaaguaaaaccuuccauuuaaauaagaugacaugcauaagauaacaaagcuuccuugauuuccuuuuccuguguaauuuaauagauuuguugacuagugcuugggcacauuauaaaucaguguuauuugcucuuggagccauuuuuuaaaaaaaauuuuggcagugagcaguugaauuuaucuugaauuuaucauguguguguauuucugaagcagcuacauagcagaacauuuuaagagauucuguuagcccacauguucauguugguugcugcugaaugguaaauauuaaauaaaauuaccagauuaaucuuaauauuucugucuuuacuccuaucaucagcaugucuuuacuuguaauagaagcggcucuugaucuuauuauagugagauuuccagacuucuuuuuagauagauccuguuuguguuguccugccacguagaugcauuucacacucacuacggcucacuuaugccauagggaacaaucaccagaaagguaacaaacaguauggguuaauaucccauagaaaggguaacauuuacgugguuggcugaccauucauuggccuaaccagagccaacuuaacaagucaaaccaucaaaauguguuugcaucagaaaacuugacauaaaacagauaacuuccaagcauauaagggcaugguuaaaugcugguuuugacagcugugguaaaaaucuaucugcaugccaacucuucucccugguuuucauaaaaugauagaaaauauacaugugacauacacugaaaaacccacugacuacaagauuucgauuaauaaagccuggcuuuuaacuuggugaaaugugucaauauuguauaagguugaagacauuuauguaacucagugccaagaaaaccacugucuacagcuucagccucguagaauacaaaaauccauuuaaaggccauugucagcugggcgcaguggcucaugccuguaaucccagcacuuugggaggcugaggcuguuggaucaccuuaagucaggaguucaagaccagccugaccaacauggugaaaccccaucucuacuaaaaauacaaagauuagcugggugugguggcgggugccuguaaucccagcuacucgggaggcugaggcaggagaaucgcuugaacccaggaggcggagguugcagugaacugagaucaugccacugcacuccagccuggguaacagagcaagacucuugucucaaaaaaauuuuaaaaaaaaggccauugucaguguccuccugauuguuucucaacauuaacuaagugacuucagaauauuuuuggguuauuuauauuacaacugaacccaucaguauuuggauucuacaagcacaauuacaauaagaagagcucaguuuccuacauaaguagguuucucccuggauuguuacuaauuguucuacaaaacacaacaaagagaauaacaaguugcauagcuuugccucuguuuuaucuguacacauugaaaggugguuuguacugaaaugaauucuuacuuauuaagcccaacccucauuauguaagaauaccauauuaauccccacacuuugggaggcugaggugggcagaucacaaggucaagagaucgagaccauccuggccaacauggugaaaccccaucucuacuaaaaauacaaaaauuaggugggcauggugcacacgccugaguccuagcuacucaggaggcugaagcaggagaauugcuugaaccugggagacggagguugaguaagcugagaucgugccacugcacuccagccuggcgacagagcgagauuccaucucaaaaaaaaaaaaaaaaaaaagaauaccauaaaaauagguuugaaauauaacaaaauaccaauccccugacauaacuauuaauacuacuuuuuacauauuccuuuugccuuuuucuacacauauauauuacauaguuuuucuaaauuguuaacugcuaguuccucaaaaacacaaucaucaacacaaucuauugacgauacagggcugaguucauuguucccuaccauaaaggagagaaacccaccucaacagagcuuugguagugucuuauggcaaagggcaagaucagauuuuguugaaauucuggaguuuuguuuaagguggaucuuuuaaugagcaggcuuugaguaggauugggugcaaaucacaguauaauuguuuaggaugaauagaaacagccaggcaaggauuuuaagugagggggguucagagagucuuauuucaguuuuagugccaccaguaauauauuuuuauggcaauuuuuucaagauuggauaucaauguguguuuacuuauuuaauauguugguggggugggggggggaauacugcuaccuuaccuaaaguuugagaaaagguuaauaagugaaugaaguauuuuauuuauagaaucuugugcuaaggauauugauauccugauaaaggaaaugaaaaggggagaugaaaagaaaaguaacaggcuuuaaauuuaggauggcaccuacuaaaacacuucaucccagagaagagauugcuaagacauuuuagauccuauuucuauagaauacuagaaaauccccaacauucugaacccauguaucacuuaucuagaguuuaccucugucauucacaaucaauuaaggagccaaaagccuagaagugaggaugaugaucugaacaaccacacuaaacagcccagucugcucacagaaugaacagucuccauccaagaagaugaaggcgaugaagugcucauuguguuugaaccuuacuaaagggagacauacacuuuuguaacagaguuaagggaugggugaguuagguaccuagaaagcugugcaaguggaaaaagcuaauaacuccagaaagaacugaaaccuuuuauacaagaaaguaaauguaacuauacuauacuauaugagucagccauuuaucauaucuacauaguuacggaaauguaaaacauaauugaucuagccccaaauuaucauauaauuauacuggaaggaugagaguaaaggaauucauguauguggagaauaaaauaaauucucauguuccauaaagggauauuaguagauaaugcauaaaacuuaaugacaaucaaaaaguaucauaaaagauacuuuuuuauuuagagauauaagguaaacauuaagaaauaauuuuaaaaauugaaaauaguugucucugaggaguaaaaauggcuggugaccugggauguugcaaggggcuccuauuuuaugcagaggcuuuauagaacuauaugcaaguaugaugaugaugcauuuuaagagauugaaaaagaauuauacaauauuuggaugccacuacgcugguuucacuucucuugcuuauuuuuuucuuuauauaaaagagcaaaucuggaucuggaccugguugcaaacuccggaugugguuuucaaggagguccagauccagaucugcucuuuuacuuguacuucugcacuacuagugcagaagugauuagcaaugagaccagcuacuuuuaauccuauaaguuugugaaggguuaaacagucaagcucuucuucuuuaguagcagcaguaaggagccaauagaaacaauuuuuauauagaauucuaaaaggaauuuuacagguauuauuaacaguuuacaagucccuuuugugucaauuauguaaauuuucucauuuugauaaaagcccgggaaagucuugauaugucuuagucuagaacaacaguuaacagucccaguuuauuuccaaggggggaaaacacuaguaauugcauggugaguguuaagagagcuugggucuauaauaaagaaauucggcaaggauguccuaucacacccauucucccuccccucacucucuagauggcacuaccucagccuucugccucaauacacaauuuauccaaauccuuguucaucuaaacccagagaaagaggugcucuucucuucagaguugagcucucuacucaugcauugauccugucucauacggcuuccuccuugaggagagcuggcugugaccguugagcauauucaucuagcuaacacaauggcuaggccugaagacaagaacaaauguaacauuuaccaaccucagacaauaggaaaauuuucuccuuucuuuccuuucuauuucuuuugguuaggcaacuuuuuaaacuuaagcauuuauaaaaaguagacagaauuagcuguauuaaauuucaaaacuucucuaagucaaagauaaccaaaauaaaagaacaggaccaaaaaaaaaaaacaauuggaguaaauauaacaauguuaaugucuucauucuauaaagaacucacccaaauugauuuaaaaauaugcuauuaagauacauaguauugcaaaagggagaaaauauuuuaauagauaauuuauaaaagaugaaccagaaacaaauaauggaaaaauaaccauucuacuaaucagggaaaaaacuauagugaaauaacauuuguuauagcauauuaaauuauuauuaaauuagcuaaauguguaacauuagcuaaauguauuuuuaaaaaaaaauuuuuuuuuuuuugagauggagucucgcucugucgcccaggcuggagugcaguggcacgaucucggaucacugcaagcuccgccuccuggguucacgccauucuccugccucagccucccaaguagcugggacuacaggcacccgccaccaugccuggcuaauuuuuuguauuuuuaguagagacaggguuucaucguguuagccaggauggucucgaucuccugaccucgugauccaccugccuuggccucccaaagugcugggauuacaggcaugagccaccacgcccggccgcuaaauguauuauuaaauuagcuaaauuuauaacaugacagcacccaauuguagaaagaguauugugaaagucguacuaauugauacagcugguggcacuaaauuaggauagcuuuuucagaacaaaauguggcaauauggaucaagagucuaaaaaauaguuauguccuuugagccauauaacuccauuacuguaaaccuaugcuaagaaaauauuucaaaauggaacaugaguauuuggauaaacaauaggcaaaaaauucaagucauagaaauguuagucauaaguucuaggagccuuugggcagagacuaugggauuuucuagauauagaaucauauugucuaugaggacagauaguuugacuuccucucuuccuaucuggaugccuuuuauuucuuucucuugcccaauugcucuggcuaagacuuccagaacuguguugaauaagggugguaaaagugggcauccuugucuuguuccaguucacaagaggaaugcuucuagcuuuugccuauucaguaugguguuggcuauggguuugucauagauggaucuuacuauuuugagguguguuucuucaaugccuaguucauugaggguuuuuaacaugaagggauguugaauuuaagcaaaagccguuucugcauguauugagauaaucaugugguuuuuguuuuuacuucuguuuauguaaugaaucacauuuauuaauuuguauauguugaaccaaccuuguaucccaggaauaaagucuacuugauagugguggauucacauuuugauguacugcuggauuuaauuugcuuauauuuuguucaucaggagucuauguucaucagagauauuggccugaaguuuuuuuuuuucaucgugucucugcuagguuugauauuagaaugauucuggccucagauuguuagggagaagucccuccuccuaaauuuuuuggacuaauuucaguaggaaugguaccaacucuucuuuauauguuuugaauaauuuggcuaugaaucuaucuggcuaucuggcucuccguccuaggccuuuuucuaguugguagguuuuuuuuauuacuuaauuuuggaacucauuauuggucuguucaggauuucaguuucuuucuaguugaaucuugggauguuguauguuuccaggaauuugucaauuuauucuagguuuucuaauucguaugcauagagauguucauaauagucucugagggauuuuuguuauuucuaugaggucagugguaaugucaccuuugucacuuuuuauuguguuguauuugggucuucucucuuuuuauuaaucuagcuagaagucuauuaaucuuauuuauucuuucaaaaaacuaacuugguuuuguagaucuuuuguauggauuuucacaucucaauuucacucacuucaguuucaacuuuggucaaguuucaggauacaaaaauuaauguacaaaaauucauaguauuucuauacuccaauaguguccaugcugagaguaaaaucaauaaugcagucccacucacaauagccacaaaaaagaauaaaauaccuagcaauacagcuagcaagggaggugaaagaugucugcaaugagaauuacaaaacacugcuaaaauaaaucagagauuauacaaauagaaaaauauuccauguauauagguaggaauagucaguacuguuaaaauggccauauugcccaaagcaauuugcuauuucuaucaaacuaccaaugacauuuuucacagaauuagaaaaacuauucucaaguucauaaugaacuauaaaagagcccaaauagccaaagcaauccuaagcaaaaagaacaaagcuggaggcaucauacuuccugacuucaaacuguaccacaaggcuacaguaauacaaacagcaugguacuuagaaaaacagacggaccaauggaacagguuagagggccaaaaaauaaagccacacaccuacaaccgucuugucuuugacaaagucaacaauaacaaacaauggggaaaggguucccuauucaauaaguggugcugggauaacugacuagucauacgcaaaagacugaaacuggaccccuuccuuuuaccauauacaaaaaucaacucaagauggauuaaagacuuaaauguaagaccuaaaacuauaaaaacccuagaaaaaauguaggaaauaccauucuggguauaggcuuuggcaaagauuucaugaugaagccuccaaaaacaauugcaauaaaaacaaagacaagugggaccuaauuaaacuuaaagaacuucugcacagcaagagaaacucucaacaaaguaaacagaaugggagacaauuuuugcaaacuauguacccuucaaaguucugauaucaagaaucuauaaggaacuuaaaucaacaggcaaaaaagcaaaccaccucauuaaaaaguaggcaaaggacaugaacagacacgucuuaaagacauacauguggccaagcagcauaugaaaaaaugcucaacaucacuaaucauuagagaaacgcaaaccaaaaccgcaaugagauaccaucucauaccagucagaauggccauuguuuaaaacacaaaauaacagagguuggugagguugcagagaaaaggggaugcuuaaacacugcuggagauauuaguucagccacuguggaaaacaguuuggagacuucucaaagaacuugaaauagaacuaccuuugacccagcaauccuaucacuggguauauaccgaaaggaauauaaauuguuccaccacaaacacacaugcacuuuuuauguucauugcaauguuauucacaauaucaaagaccugaaaucaaccuagaugcacaucagugguggacuggauauagaaaaugugguaugaaugcaccauggaauauuauucagccauaaaaacuaacaaaaucuugugcuuugcagcaacagggaugcaacuggaggccauuauccuaagcaaauuaauguaagaacagaaaaccaaauaccacauguucucacuuacauguaagugggagcuaaacauugaauacacauagacacaaagagguuaacaauaggccaggugcaguggcuuacaccuguaaucccagcacuuugggaggccgagguggguggaucaccugaggucaggaguucaagaccagucuggccaacaugguguaacccuguuucuacuaaaaacacaaaaauuagccagaggugguggugcaugccugcaaucccagcuacucgggagucugaggcaggagaauugcuugaaccuggaaggcagaggcuacagugagccaagaucacaccauucacugcagccugggcaaaaagagcaaaacucugucucacaaacaaaaaaauaaaggggaacaauagacaacagugccuacuugaugguggagggguggaaaguggacgaggguuaaaaaaaauuguuggguacuauguucacuaccugugugacaaaaucauuuguacaccaaacuccagccacacguaauuuacccauguaacaaaccugcacauauacccccugaaccuaaaauaaaauuugaaaaagaaaaaagaaaugugauauaaagaugguuccauaaaauaugauacagucaaucaauggaaugguauauaacacuauuuuuaagaauguuuuugaagacuguuaacaaggaggaaaaacuaauauaugaaaugaaaaaaggaagauuugaaguauauguaugcuaugauuauggcuacauuuuuaaaauugcaugcuuaaaaaaauacaccaagcugauaauaauuaagugugaaauuaugggugaucauuuauuuugaauuuuccagauuuucagccaaauaacuaucaguuuuacaauuuaccuuccccaaaaaacaucguaguggaaacggagagacagguaggccuaggaaccaccaagugaaagcacucccuagaaaccggaaaauccugggcaaaaauaagcaggaacagccucaggaguggauuaggugagcuccagcagaaccccagggcuggguagaccuugccaaucuccucagguguuuguggaugugaacugggugggcugauccugcuacuucccuucucucacacucagcaauggugaaacccccuaagaaagagguauaaucaggauaucugggauauaauuuaaaggagcggacuggagagaaaugcaaguaagagguaagaaggcagauguuggcccauaauggagucagaguuccguggggucagaggaaaagaauagcaggaggaagaaaaggaugagaguaagcaggggaagcuaggugccuggggaggagaucaggaggagaaugugcccgagaacagacuggaaacagaaaugcagugcuuugaggcagcaguccccaaccuuuuaggcaccagggacugguuguguggaagacaauuuuuccauagacaggguagggggauaguuucaggaugaaacuguucuagcccagaucaucaggcauuagauuuuuuuuucuuuuagggcagagucucacucugucacccagcuggagugcagucgcaugaucucggcucacugcagccuccguguccuggguuaaagcaauucucaugccucagccucccaaguaucugggacuacaggcgcccaacaccacgcucggcuaauuuuuguauuuuuaguagagacaggguuucaccauguuggccaggcuggucuugaauuccugaccucaggugaucugccugccuuggccucccaaagugcugggauuacaggugugagccacugcacccagccuaagauucuuuaaaaggagcacgcaaccuagaucgcuugcaugcgcaguucaccacagggcucaugcuucugugagaaucuaaugccacagcugaucugacaggaggcagagcucaggcaauaaugcucuguggccuagucacucaccuccugcuauguggcccaguuccuaacaggccaaggaccaguaccauggccuagggguuggggaacgcugcuuuaagggauguguuugggaaacauggaaaacaugcuguuacacacuaaaggaguguuucccaaaugccaguguugccccauuaugaaguuuucacacauuuuuuguaaaauaagaaaaaaaaaagagcaacaugauagggauauauauguugucuuaaauucccaauugccccaaguugagaagaacuucucuucagucuaccuuucuaggacauuacaacauccucugcuuuugaacuauagugauaguacaugagaggauuuuuucccaauaucuuuacuugcacaauuaaaaguuaacgaccuacaacugucucauuuuuuuuuuuuuuucacuauacuacuuccugaaaucucagccugggaagcaggggaaggagaguagaaguagaaucccaacucucccaguagagaguggugugggagaagaccuagggccuggggcauccguuacucuuaaagugagauggaacauuugcagaaacuauuuuuaauauuuuucucugcaagagucaaaacauuuuacagaaaugagcugauuaguuaucaccuuggccucaaguauuucaugggauauaauuuucugguagugauuuuacaucauuuaguaaguuugaaccuguuuuaauucuucuccaucucaucaugcucagcugugauugcagacguuuuaggcuaagagccugggguucaucuugaacugugagccuugagugcuugauugcugcagaacucaagucaaaagucuuugaacaacccugauguguggguagugucuccagacacuaauuuccuuuuccccauauuccuguuacuagcuuuuaaagaaaauuccaucauccuuuaaaguuguugggaagcugugugucauucagaaaacuuccucaaaccagauguacaaaauauuagugauauagugcugaaaagaacuccuggguggcaauagcaaaugugcauuuucuugaggugcugaaauggccuuugaccuuccauguuacaaugccuacuggcugccacagccaagaccauccugccaccugugagugaugcugagcagagggaagucaccuucaacucuguuuuacaagugugcugagggcuccccauggcaggcagcugauucucuuagcuggcccuuuaucagaggaugaaaacauuagcagaaugagccccugucccuccuucuaguaguuuuaugaugaagacuagacuuaucugggugacuaaggcauuauuuagggcuugccaagagcacacacuuauaggcauucauggaaguauaaugcuugccauuuuccaggaaauuccucuuaauugugaaaaauggagacauguauauuaucuagugauauauguauauuaauaucacaagauaugucucuaggugaucaaaaauuuauuaaucaccaaaugagugacacaacccauaaagguugacuucacauaauauguacccauucaacacauagguucaaacacugcuuuaucaugcuguugggcugauuuauuuucucgacaauaguagaacaaaguuuggcgcuggugauccugaaguccuauuuuauguuucccuauucuuagagaacagcagucagccagauggcaugaaucucugacaugcuugacucugacaugaggcagugauacuuaaaguguggucccagggacauagcaacuaacacaacguuuccaccuugcagguggcuccagacuaaugggaaggaagagaaacagaccagcaucuaaauauagugauucuucuauuaggcaaaauaucucccaacaccaucuaaaauucuccuugacccagaaauuccaccucuaagaguugauucuaagaaaauauccuuaucaaauaugcauacaaauauuuaugcauaaucauugcaauguagauuauaauaaugaaacuuuguaauauucuaaguuacuaacaauggagaauggcuuuaauaaaauauccauacaauguaaugcugcucagcagcuauuaaaaauuaugauguguaugugauuugugucaugaaaagauauuuauaauacuaucugaaaauuuuaugccauaaaauaguauuuauaaacccacuaucaaagaauuauauguauauuagaauauaggccaaaauuuaguguuguuaaaucuagguagaaaauuauagggguuuuuugggguuuuguuuuguuuuuuugagacagaguuucacucuugucacccaggcuggaguacaguggcauaauauugguucacugcaaucuccgccucccagguucaagugauucuccugccucaguaucucaaguaucugggauuacaggcaugcaccaccauaccuggcuaauuuuucuguuuuuaguagagacgggguuuuaccauguuggucaggcuggucucgaacuccugaccucaggugauccaccugucucagccucccaaugugcugggauuauaggcaugaggcacagcacccggccaguuucaauuuuucuguaguuaauuugcauaaagaaauaaacagcuuaauagaugaauaaaugauacaggcaugauacagaauagaaaagaaucaugagaaggaugcuacuguaaugccaaggcauuuaaccuagaguagaguguuauaaggugaaguggggguagagaaggcagcacagaggugguagccuuuuaugaaagauuuugaccaaucaggaaugacaagacagggaaaagacaucucaggaagagauuaccugcauaagcagagaccuggaagauaguaguaugugggggagagaaagaggguuuugauugcagaagcaucagguggcaaacagcgaagagauagagcuggagagguuagggaaagacccaguuaugaggggcaugauaugccagggaguuugaacuuuuuuccuaauggugauaaggagccucuaaaggauuuuaagaauggaagaaagacugcucaggcuuauauuuuaguauugcuaugcaagauuacucauagguuacgaggguggauugggagaagcaaagaauggaggaggcgggaagaccagcgagaggcuccuacaggucugcaguaaggaggaucuuacuaaaggcagagaagcagagaggacaaauaagagaucugcaguagaaauaauaggaugugucagggagagaaauagccuguaggguagaugaagauguuccugaggaugugaaugggauucaggggacaggaaagagauuggucuugaacaggaagagggaugccucuuucucuggagcucuuggcguugaauacagaucaacauuuuuuagagauauggugagaguuuaaaaaguucauuccuggugacccuauuuuauccauguagcaggagaagaauuauuugcugagaguaagugaacugguaaagugggccuaaggagaguugugaagggugggccacccuuguuggagcuaaugaugucuaaacauauauaagaauuccugggccauguggaaggccagcugagauuggagaucaugaaucugugauagcaccauuuggugugauuuugcaacuuucuccagcagcauucaguggccaaagucuagcuuccaggaaggcagaugaagguugccuucaucuugguucaaaacuuuggggcucugauagacuuggaggaaugugacuggagguuuggauaaggccagauguggaaggauaaagggauauggaaggagugagagcuggaaggaggaagugaugggccaggaguggaacguuauguauugucauuuuggaguaguucugggugaucaguaguccagacagugccauggaaaugaguggcugauguugaggggaggugaaaguuagaaaucagaacacagggcagcacaugacuaugauguuuauuguaauguaacuugcuguaauggccuuugauguauuuuucuuuggaauacauguauuuauuauuuuaccuguuuuauugcuugcaauuuucuacacuaaaauauucuauugcuuauguccuuagagacuuuugauuuuuuuguuguuggucaaaacacucaauuguuucuuagagucagaaucuacagaaaaaaaaauaaaaaggugaaguaagguccccuggcucacucacuggcccacagugugaaguagucuucuucagaccuuagccuucauuugggagguuucaguuuaaggccuuuguggauuucaucacaggacccuuguuuggcguggcucaaaagcuuuucugcaauagaaaggaaccgaauuuucaaacauugcugucuccaaagaacugaaaaugaaucagauaaacugugauugacucgagcccauggaggcacaaccucugagauaggaccagcggaugaggaaagcuaagugggcccuucuguuuauuuuuaagucucuaaauaguaacuugccauuucuuucuaccauuuuuuucugcugcuuuuucuucacacuccaguacuuuuucacugacuagucaucacuccacauauaacaagaaaaaaaaagacguuucauuaaaaacugcaaugagaagaugaaaauauuucuuucuucucccuaguuaaaaaaaaaaaaaaaguaccagggaggcuaguaucaccaucuugggaaccuugucaaauguaaugagccaagcaacagcuggugaaccagauagguggauuaaaaccagggaauggugccggucaggcaugaguggaugcugaguagcagaaguggccacaaaaggccucgaagguuggauuuuacauuaagccucuuucguauuuuccacuacaagcaguauccaggucauuugugucacauuuggaauuacuagcuuaaaugccaagauaacuguuuuuuuccguguaacuacuggacacaaauuguggugcuaaucaaacaagacagcacuggaaggaauuaaagucuccuauuuucauuaccaauuacaagcaggccacacucccugaagcuguucagaagacagaaauaugaaaagaaagcacuguuguuauucugaccuauagguuucccuggacuuagugacucauuauccauucauucaacaauuauuagacuauuacauguucauaaauacccucucagaguucacuuuuuaaaaauuuaaaaagagaauuaacuaacccucagagucucaaugguauuauuaaaaggacaaaccacaaaucccaaguaacuagaauuaucaaaguuucaaaggauuuauagcuaagaugugaccauuuucuuguaaugagacaagacaaugggacugcuaugacacuagaaucaccuaccaggucagaccuucugcugggguaacugagcagcuguaagagcuaacagcugagcauagucuagauuuuaaacacacacacaaagcccaaaucuuauggacaucuccagucauggcuuaugcaugguuuauccaugcuuuggguucaggaugagaaagcagggggucaccacaggucugcagggaaaccaaagagcauggaugcucagaaggcuaacacuggugucucuuaggcauucucaaggggaaaagagugccagccuuuagaccagggucagagacagccaauguccagcaggagucaggauggggagcguaaaaaguccaguucuauaaacugacacucacauggaagacuugggcuuaaaacaaagacucagaagcuuauucacauaaaauagguaagagguggaagugaucuuuucagagagcaacugagaagcccauaauucuccccagaauaucacaucucagaugaaagaugaagcagguacauugaggaugcaauucuggagccucauguagagugcuggguaaccccaugccaggucaggccaauugcuagaguaagucaaugcuagagucaggggugggaucuaaagcaggaauaaauuuaaaguauuuucugcuuccaauauuaacucuggaaccaaauaggacagaaauuucaccugaggugggagggacacaggaaauauguggaaaugguagauuuaucagcuggaaaugcaaagacaagacaaaugaagagucagguggcugcuggcauuuguuuacugacuaaugaugccaauaggaacuccagcucuuuauuuucauuacaccguccuuaacgagggugcuuuuuuccuccuguguauuucuucaugggcacaaaauuacugcugcaguuucagauaucacagguccagauuauaagaaaggugggggugaauggggaaugguagaaggaagagcaaaacagcuauguuuacaaagucucucugagcccucuucuuuuugcuuaggauagcuuuggcuauucugggucuuuaguggcuccauauaaauuuuaggauuccuuuuucucuuucuguguagaaugucauugguauuuugauagggauuguauuaagucuguagauugcuuugggaaguauggacauuuuaacaaccuugauucuuccaauucaugaacauggaauaucuuuccauuucuuuauguccucuucaguuucuuucacuaauauuuuauaguuuucauuguagagaucuuucacuucuuuaauuacuggguauuuuauuugcaguaauuguaaaugagauaaauuucuugauuucuuuuucagguuguucccuguuggcauauggaaaugcuacugauauuugcauguugauuuuuuauccugcaacuuuacugaauuuaucaguucuaauaguuuuuugguggagucuuuuuccaaauauaagauaccaucuguaaacaaggauaauuugacuucuuuccaauuuggaugcccuuuauucauuucucuugucugauugcucuagguaggaauuccgagcccuuuuuucaacuagguccuugcuuuauuucaacuagguccccugauaucucagucugaucaaaaaguccucaucacccauccuugauaucugaucacccuggccugucuucagcaacaaugcugucaggucaguuuagcaagaaucccccuacccuugagaucuucucugaguuauuuauuuuccauccaauaaccguucauccuucucauuggcuguaaguccccaggugucuuuacuguauucagaguugagcuugacaaagcuccccuauugugauuguguuggcacccauuacaauacuccugaauaaagccugucuuacuguuuuaacuagugucaggauaauuuuuuuaacaaugucucccuuuuuuauagguaaaaauaucccaaaucccuaaacagacaccaguacaucucauuugccagaacuguugcacaguuaucucuagcugcaugguaggcuaggauaguaaacauuuuacuuggugaacauaucacugccuugaauaaaauuggguuucuaauagcaagcaaaagagagcaguggauauuugggaggcagguaacagugucagccagagagaccagaaugccauauaaacuaguacaagagaggaugguuaaaugggcaucuccaauguagggaagccugaggugcuccagcagugggaguagauaagaguugcuuggggaauaauuugagaugaaagugugaaaaaguugugaguaugaacugucuggaagggauugaaaggaagaaacagaaugagccaaggcaggaagcagcuagguguugggaaugaaaagaaucacaggggaggaguaagaagaaaugaaguuggaaaaguuucagaagaugagaggugaaaucaacucaacagggccacgacugcucuuugaaaaguacuucucauaguagaacgauacuaauaacaguuucagaauauuucauuaaaaauauuagcuaaaaggaauuauuaauaauuacccucaguagauaaaauaaguauuaacugagugaauccuauaacccaaacccuauuccaacuacuuucuuuccuaucauccuaaugaggaaacugaagcacacgaaaagcaguuuacucaaagucacagagccaguaaauaucaaagcuuggauuauaaacccacauaguucuuauauucuuucuuuguccccauauucuugauucuaucuaaugccuacugccucucuccucugaaaggaacaggaagagguuccuuguucaacaagacauuccucuuuauacuucauugaaacaaagauugaguuaacuguggaaaaacuaguaaacuuucacacaucagaugccacugauuugguagagauugcuaacccccuaguauccauuuucuccuuccuuuuguacuagaaucccuguauuuuagcugggcucauggcagagacuauuucucagcuucccuuuaaacugggaauggccacgugacuaaauucaggccaauagcaagugaucauaagcgauguaugcaaauucugggacaacucauagcugcuugcccugcacuaaagccuuuuccccucacugccagcugaaaaugaauugcagcugcggucuugggccuagagacagaaguuacacauugaaggcagagauaacuaguuauguagcagagccauuuacccauccuagaaccuuuaaauuaucgugugugugguagggggaaggaccuucuaucaaauuuauucuacaguacuuaagcaguuuagaaugaauccuaaccauugcauguagaauuugaauuagaaaauugaugcaaggugugucaauaaaauuaaaucauguuugcaagggcuucuuuuuggacuuuugugccaguaagcuguacguagaaaaugauaaaccaacacacuugguauauuuuuacauauauaugaaagaauauuuucagugaguguucugugcguuuaugugcaugcacacgugcaugcguugaaaauacuuaagaauuacaugaugccuuaaaaacauuuuugaaggcuauauucucccaaaauaucuaaggcugauuagaucaaauucaugucuuaaaccauccaggccaaacaugcacauguaaaagugauagaaaaucaggccacgugcaguggcucacaccuguaauccuagcacuuugggaggcugaggcaggcagaccaccugagauugggaguuccagaccaggcugaccaacauggggaaaccccaucucuacuaaaaauacaaaauuagcugggcgugguggcacaugccuguaaucccagcuacuugggaggcugaggcaggagaaucacuuaaacccgggaggcagagauuauggugagccgagauugcaccacugcacuccagccugggcaacaagagcaaaacuccaucucaaacaauaaauaaaauaaaagugauagaaaaucaggccaggcucaguggcucacgccuauaaucccagcacuuugggaggccaaggcggguggauugcuugaggugaggaguucaaggccagccuggccaacaugguggaaacccaucccuaccaaaaauacaaaaauuagcugggcaugguggugggcaccuguaaucccaacuacucgggaggcugacauaagagaaucacuugaaccugggaggcagagguuguaguaagccaagauugcaccacugcacuccaaccugggcagcaaaacgagacuuugucucaaaaaaauaaguaaauaaaaauaaauaaaagugauagaaaaucagauauguggauuugauguugaaucucucgccuagucuagaaaauuuuaucugaaaaugucuuuuaaaauagacacaaaaauuugaccauguauguagguagcagauuuuuguguuuuggggaaaggguauuacccagaauccaauccccacugccauuugagggaagccuccauugugggucgugugggggaaggugaugcuuuucccacuuauaagcugagagugcuagaccuugcuucucuuugcuccuuggcaaucagaggucucuagcuggcuguaucaccucuggacuuugacucuuguucuagugaugcaaagacaaaggauuguuaagaauguauuccugagucuucacaagauggcugaauaggaacagcuguggucugcagcuccaagcgagaccaacgcagaaggugggugauuucugcauuuccaacugagguaccuggcuuaucucauugggacugguuagauggcgggugcagcccacagagggugagcugaagcagguuggggugucgccucacccaggaagugcaagaggucagggaacucccucucccagccaagggaagccauuagggacuguacugugcacuccagcccagauucugcacuuuucccauggucuuggcaacccgcagaccaggagauucccuugggugacuacaccaccagggcccuggguuucaagcacaaaacuggguggccuuuugggcagacaccgaacuagcugccaggagauuuuuuuuguaccccagcggugcccggaacaccagcgagacagaacuguucacuccccuggaaagggugcugaagcccgggagccaaguggucuagcucagcgggucccacccgcaugaagcccagcaagcuaagauccacuggcuugaaauucagacugcugugcuggcagugagaagucuaccugggacacuggagcuugguugggggaggugcacccaccguuacugaggcuugaguagggguuuuccccucacaguguaaaugaaauccccaggaaguucgaacugggcagaacccacuguagcacagcaaagccacuguagccagacugccucucuagauuccuccucucuaagcagggcaacucugaaagaaaggcagcagcaccagucaggggcuuauagauaaaacucccaucucccugggacagagcaccugggggaagggguggcugugggugcagcuucagcagagguaaacauuccugccugccagcucugaagagagcagcagaucucccagcauggcaauugagcucugcuaagggacagacugccuccucaagugggucccugacccccaugccuccugauggggagacauuucccagcaggugucgagaaacaccucauauaggagagcuccagcuggcaucuggcaggugccccuuugggacgaagcuuccagagcaaggaguaggcagcaaucuuugcuguucugcagcuucugcuggugauacccaggcaaacagggucuggaguggaccuccagugaacucuaguagaccugaagcagaggggccuguuagaaggaaaacuaacaaacagaaagcaauaacaucaacaucaacaaaaaggacacccacgcaaaaaccccauccaaaugucaucagcaucaaagaucaaagguagaugaggaaaaaccagugcaaaaugcugaggaaaauuccaaaaaccaaaaugcuuuuucuccuccaaaagaaucacaacuucuugccagcaagggaacaaaacuggacgggaguaugaguuugaugaauugacagaaguaggcuucagaaaguggguaauagcaaaauucucugaacuaaaggagcauguucuaacccaaagcaaggaagcuaagaaccuugauaaaagguuaccagaaaugcuaacuaaaauaaccaguuuagagaacauaaaugaccugauggagcugaaaaacacagcacaagaacuucaugaagcauacacaaauauuaauagcugaaucaaucaaguggaagaaaggauaucagagauugaagaucaacuuaaugaaauaaagugugaagacaagauuagagagaaaagaaugaaaaggaaugaacaaagccuccaagaaauaugggacuaugugaaaagaccaaaucuacaucugauugguauaccugaaagugauggggagaauggaaccaaguuggaaaacacucuucaggauauuauccaggagaacuuccccaaacuagcaacacaggccaacauucaaauugaggaaauacagagaacaccacaaagauacuccucgagaagagcaacuccaagacacaucaucaucagauucaccaagguugaaaugaaggaaaaaaucuuaagggcagccagagagaaagguuggguugcccacaaagggaagcccaucagacuaacagcagacaucucugcagaaacccuacaagcuauaagagagugggggccaauauucaacauucuuaaagaauuuucaacccagaauuucauauccagccaaacuaaguuucauaaggaaaggagagauaaaauccuuuacagacaagcaaaugcugagagauuuugucaccaccaggccugccuacaagagcaccugaaggaagcacuaaauauggaaaggaaaaacugguaugagccacugcaaaaccauagcaaauuguaaagaccaucaacacuauuaagaaaguacaucaacuaaugggcaaaauauccagguagcaucauaaugacaggaucaaauucacaccuaacaauauuaaccuuaaauguaaguggacuaaauuccccaauuagaagacacagacuggcaaacuggauaaaaagucaagacccauuggugugcuguauucaggagacccaucucaugugcaaagacacagguagucucaaaaauaaagggauggaggaauauuuacaaagcaaauuuaaaugaaaaaaaaagcagggauugcaauccuagucucugauaaaacagacuuuaaaccaacaaagaucaaaaacgacaaagaagggcauuacauaaugguaaagggaucaaugcaacaagaaggacuaacuauccuaaauauauaugugucaaauacaggaacacccagauucauaaagcaaguucuuagagaccuccaaagagacuuagacucccacacaauaauagugggagacuaacaccccacugucaguaucagacagaucaacgagacaaaauuaacaaggauauucaggacuugaacucagcucuggaccaaguggaccuaauagguaucuacagaacucuccaccccaaaucaauacauucuucucagcaccacaucacauuuauucuaaaauugaccacauaauuggaaguaaaacacuccucagcaagugcaaaagaauggaaaucauaacagucucucagaccacagugcaaucaaaguagaaugcagaauuaagaaacucacucaaaaccacacaacuacauggaaacuggauaaccugcuccugaaugacuacuggguaaauaaugaaaugaaagcacaaauaaagauguccuuugaaaccaaugagaacaaagacacaacguaccagaauuucugggacacauuuaaagcaguguguagagggaaauuuguagcacuaaaugcccacaggagaaagugggaaagaucuaaauucaacacccuaauuaaaagaacuagagaagcaagagcaaacaaauucaaaaacuagcagaagacaagaaaucacuaagaucagagcagaacugaaggagauagagacacaaaaaacccuucaaaaaauuaaugaauccagggccaggcaugguggcucacaccuguaaucccagcacuuugggaggccaagguaggcagcucacgaggucaggagaucaagaccauucuggcuaacacagugaaacuccaacucuacuaaaaaauauaaaaaauuagccaggcgugguggcaggugccuguagucccagcuacuugggaggcugaggcaggagaauggugugaacccgggaggcagaccuugcagugagccgagaccacgccacugcauuccugccugggcaacagagugagacucugucucaaaaaaaaaaaaaaaaaaaaaaaauucaugaauccaggagcugguuuucugaaaagauuaacaaaauagacugcuagccggacuaaugaagaaaauagagaagaaucaaauagacacaaaaagaaaugauaaaggggauaucaccaccaaucccacagaaauacaaacuaccagagaauacuauaaacaccucuaugcaaucuagaaaaucuagaagaaaugaauaaauuccuggacacauacacccuccuaagacuaaaccaggaagaagucgaaucccugaacagaccaauaacaaguucugaaauugaggcaguaauaucuuaccaaccugaaaaagccccaggaccagacagauucccagcugaauucuaccagagguucaaagaggagcugguaccauuccuucugaaacuauuccaaacaauagaaaaagaacuccucccuaacucauuuuaugaggccaacaucauacugauaccaaaaccuggcagagacaguaaaaaaaaagaaaauuucaggccacugucccuaaagaacaucgaugugaaaauccucaauaaaauacuggcaaaccaaaucaagcagcacaucaaaaagcuuaucuaccaugaucuagucagcuucaucccugggaugcaaggcugguucaacacaugcaaaucaagaaauguaaugcaucacauaaacagaaccaaugacaaaaaccacaugauuaucucaauagaugcagaaaaggccuuugauaaaauucaacacccuucuugcugaaaacacucaauaaacuagcuauugauggaauguaucucaaaauaauaagagcuauuuaugacaaacccacagccaauauuauacugaaugggaaaaagcuggaagcauucccuuugaaagcuggcacaagacaaggaugcccucucucaccacuccuauucaacauagcauuggaaguuccggccagggcaaucaggcaagagaaagaaauaaagcguauucagauaggaagagaggaaguacaauugucucuguuugcagaugacaugauuguguauuuagaaaacuucaucaucucagcccaaaaacucaagcugauaagcaacuucagcaaagucucaggauacaaaaucaaugugcaaaaaucacaagcauuccuauacaccaauaacagacaaacagagagccaaaucaugagugaacucccauuuacaauugcuucaaagagaauaaaauaccuaggaauacaacuuacaagggaugugaaggaccuuuucaaggagaacuacaaaacacugcucacagaaauaagaaaggacacaaacaaauggaaaaacauuccaugcucauggauaggaagaaucaauauagugaaaauggccauacugcucaaaguaauuuauagauucaaugcuauucccaucaagcuaccauuaacuuucuucacagaauuagaaaaaaauacuucaaauuuuauauggaaccaaaaaagagcccguauagccaaaauaaucccaagcaaaaagaacaaagcuggaggcaucacgcuaccugacuucaaacuauacuacaaggcuacaguaacaaaaacagcuugguacugguaccaaaacagauauauagaccaauggaacagaacagaggccucagaaauaacacaucuacaaccaucugaucuuugacaaaccugacaaaaacaagcaauggggaaaggauuccuuauuuaaucaaugggguugggaaaacuggcuagccaugugcagaaaacaggaacuggaccccuuccuuacaccuuauacaaacauuaacccaagauggacuaaagacuuaaacguaagaccuaaaaccauaaaaacccuagaagaaaaccuaggcaauaccauucaggacaugggcauguccaugggcaaagacuucaugacuaaaacaccaaaagcaaccggcaacaaaagccaaaauugacaaaugggaucuaauuaaacuaaagagcuugugcacagcaaaagaaacuaucaucagagugaauaggcaaccuacagaaugggagaaaauuuuugcaauuuauccaucugacaaagggcuaauaucccgaaucuguaaagaacuuaaacaaauuuacaagaaacacacaaacaaccccaucaaaaauugggcaaaggauaugaacagacacuucucaaaagacauuuauguggccaacaaacauacggaaaaaagaucaucacuggucauuagagaaaugcaaaucaaaaccacaaugagauaccaucucaugccauuuagaagggcaaucauuaaaaaguaaggaaacaacagaugcuacagaggauguggagaaauaggaacgcuuuuacacuguuggugggaguguaaauuaguucaaccauuguggaagacaguguggcaauuccucaaggaucuagaaucagaaauaccauuugacccagcaaucccauuacuggguauauacccaaaggauuauaaaucauucuacuauaaagacacaugcacacauauguuuauugcagcacuacuuacaauagcaaaggcuuggaaccaacccaaauccccaucaaugauagacugcauaaagaaaauguggcacauauacaccauggaaugcuaugcagccauaagaaagaaugaguucauguccuuugcugugacauguaugaagcuggaaaccaucauucucagcaaaguaucacaggaacagaaaaccaaacacuguauguucucaaucauaaguggaaguugaacaaugagaacacauggacacagggaggggaacaucacacaccggauccugucgggggguggggggcaaggggaguaauagcauuagaagaaauaucuaauguagaugacagauugaugggugcagcaaaccaccauggcacauguauaccuguguaacaaaccugcacguucugcacauguaucccagaauuuaaaguauuaaaaaaaaaaaagagaauguauuccccucccucgaagugacucaaucuaucauacaccagcuccccaacccuucccuauaccuucucugacucccaaacacugaucacuaaacuauucugucuuuaaccucuuuucugaauauucgucuuaccuaaaagcucacauccccuaugaacgcuucccaugcaaguugcagcccauuccaauggaggcuguguuuucucuuagacuccauguaccucagguccaagaguugauuuauguguucucuuuaggcccucaugauucacugcauuaggaguucaaccccaaaacuuuauaaaccuucuuccagaucauaaguuacuuccaucaccaaauuugucuuuguuucucugucuucacuuuacccagucuugcagaauucaaagcaaaguugaccaugacaccagaagcacagcaacaaaauuaaaaauagauacguugcccaucaccaaaauuaagaacuuuugugcuucaaagugcaccacuaagaaaguaaaaagacaagccacagaaugacagaaaaauauuugcaaaucauaucucuggcuagggacuugagucuagauuguauagagagcugaaaaacacaccacacaaaaacauauacaugagcggucauagcagcaucauuuauaauagccccagaaguagaaacaacccaaauguucacugacugaugaauaauaagcaaaaugugguauaucuauguaacagaauauuauuuggcaauaaaagagaaaugaaguacggguaaugcuacaaugcgguaaauccugaaaauguaaaugaaagaagccagccacacagggcuacauauuguaugacuucauuuauaugggauauccagaagagacaaauccauagagacagaaaguagauuagagaaugccaggggcuggggagagggagaauggggaaaugacugcuaaugaauacaggguuucuauuucgacaaaggaggaaugcaaauguucugaaauuagaugcacaagucuuugaauucugcacuuuaaaaggguaaacuuugugguauaugaguuagaucucaauaaagccaucauugaaaaggaaaaaaucacacaguugacaaccccauccuucuugaagcacccuggcucccaggauaccauacuguccuaguucucucucuggcugcuccuucucagucuccuuuguagguucuguaucuucucccaggccccuaaguuugguuuauucaagcuuacccuaaacccucuuuucucucucccuagaugaucucauccuacucuugugguuucuuauagcaauuuuaugcuaacacuguuucuucugaguucaaaauuucauuaucaagcagccaaauugauaucuuugauugaauuuuuuuuuuuuugagauggagucucgcucugucccccaggcuggagugcaguggugcgaucuuggcucacugcaagcuccaccuccuggguucacaccauucuccugccucagccucccaaguagcugggauuacaggugccagccaccacgcccggcuaauuuuuguauuuuuaguagagaugggguuucaccauguuggccaggcuggucucgaacuccugacuucagaugauccacccuccucagccucccaaagugcugggauuacaggugugaaccacugcgcccagccuaguugaaugucuuauaagcaucucaauuuuagcuugcccaaaaccaaacucuuaugguacacaaaguaauuugggggauaaaccuauagcuucugagaauagcuaggaguuacaguagaggaccacuguaggggaaggaaauagaagaaugcuccaucuaacuagagaagauauggacagcaagcauugcuaagucaauucaaagucaauucaugcccugaagcccuugacugaauacaugaguguuuuagguaugucugauaugacaauacacacugaaaaaguaugugugaguacuuccaaugaaauguagccuuuccuuuacuguauccauaaugaagugcaggauaaagccacagucucucucuuccucauagaaaagacacauagaagugugaaaucagucuuaaggcacaaaaaucaguacaaucuuuguuugcaagcaagcucugugucaucacuguauguuguagcucggguguccaggaaacagacucugagaaagagauuugcuugcaggaugguucuuggggaacucacaaacagcauugugaggggugaggggaaaaaagaguagguagagagaaaagguaaauugagauauucuuaccaaagaagccucagugaucccgcagccagcuuggagcacaguuggccucucacaauugucucaguuugagacaaggggucaggccuuucuaccccugcauugaccaaucauuagauggcaacugcuggggcucaggguguagcuagggugauguagcccagagugaggcagcucccugggcuaaggauaaauaauggggguaugggugggagugaggacacaucugugaguuauuugugcccacacugccagcaacagaugguucaguccugaaggggaccucagccaggcacagcagcuccacuacucugcuuguguuuaccugggucacuggcauuaucacaccaugucacuauagcugccaacaaucaugacagcaaagcaagcauuucagguucuagacuuccuugaugugaagccauuauugacuggacaaaagagaaaggggccuaauuuucuuucuuugguuuggagcaagaaugggauuguuuagauccucagcaacugguuuuggaaaauuguuuuuuggucauggugcuaucauggacuauaaauagguacucaaccacuggccauacugacagaugaauuguaaguucugugcugagcaaaugaaagggggcugcaaugaagaggacucguuccuaugcaaggaauggaaugaucuacccaggaagagaaauaacagcagauggugaggucagcuuguuagcucuacuuauuuaauuaaaaccuuuacacauauugucagguaaaaaucagcugucaaaaaguccaccuggucauaauugaucaucguuaauaagucucugcuagccacugcugccaaaaucuuaguuauaaucacauaaucucaauuaauuaagaauacaacuccaacaacuaaacuugguauucauuacuuccccaaagugaaaugcaauaaugauugacggcaaagaggggaacagagcauguuauaugaauauaucucaacucuagagccaggcaccaccauuaugauuaggcuucccuguucaggcugaauuugauuaugacauauguaucguggguacagcaaaauauugaugaaaacaaaugagucuggaguucuuauuugcccuuugaaaccaaaucccauuugggaccuucucuugaccucuccuugagacaucuucaucugaaauaucaauuugcauaaaucuauugagugaaauuagcuuugacuugccaagagagaaaaccugauuucugcucaugcuucagaaagguaaggaagacuggaagacugguaaggaagacuggcauuuucacuggaaaggaaccaaaagagcuaaugggcuguauaucaucaauuuuaaaaaauauuaauugcugaaguacuuugguauagcuucucuacuuuuuuacaugacccauacgugcaauuaaaaagugcuuuccuagagcagcagagcaaaaacaauauaugcaucuguucaucaugccagugcuauggaccauauacugucuuauaaaacacacucccuaguauuuuaaauacauauugaucuauuuuuaagauaauuauaucuaucacaaugugcaauuucucgggagcaugccaacauaauuuuucuuaaaagcuacuuaaacaguugaagcgaaggggagagacauuaaugcaaacuagcauggaaguugcaccacuaauauccaucagaauuuucagacaucaaggaacucaaaaguauagagaaaaaggggaucacauaaggguaauaugacuagaaacauaaacugcuuucuaaaggucggcaaaacucccuuugaagucaaaagagaguuuuacuuaccuaagaagcaaaggauuuaguucucaaggaguauuauuugaaaugauguuaguuuaaauuaggucucaguaaguagagagcaguuauggcuguaauugacuuuguuauauaaaaucauaccaacucagaccuuagagcucccuagauuuuauuuucucauacagcaaauuucucagcuucugggcccauuuuaacuccacugggaugguauucacauuuccaguaaaggauuuacugagaagugauggaugauuuuagguaaaaauaucaaaguuuaucuaauacuuuccaaaaaggacuucaaagaugaaacguguuaaacaauucuuucuguuaaaaaaaaaaaaaauuugucaccaugugggagcaaauucaaaauguuuaagcggcuuagccuauauuauuugaccacaaaucaauguuauaucuugggaacugcauauuaaaucuucggccuuuuucuuucuuucuuuuuuuuuuuuauuacaagugagauguuugggagagaaauauugugauuacaauaaaguucugacauuacuggguuugaaaauaauaauuuugacuuauucaucaugucccuaaaaguuugugauaaaauuugaaaguuagcuaagacacaaauuugaauucugugaacuucaagucaccuugcuagcauaugagccugccacccaucccuaggcagaaugcauaucucaaguccaauauuuuguucucuauaauuguaauuaauuuaaaucuaacauuuauuuagcaaucacucugugccaaguaaugugauaaaacuuacuaagucagccagguguggugguucaugccuguaaucccagcacuuugagaggccaagguggguggaucacuugaggucaggaguucaagaccagccuggccaacauggugaaauccugucucuacugaaaaugcaaaaauuagccgggugugguggcauaugccuguaaucccagcuacuggggagacugaggcacaagaauugcuagaaucugggaaguggagguauuagugggcugagauugugccacugcacuccagccugggcgacagagugaggaucuugucuaaaaaaaaaaacaaaaccacaaaacaaaacaaaguccucucaauaaugccuugagguaaguuuuguuaucccuauuuuauaaaugagagagaggcaagaaaaagucagggaacuugcccaacgucacuaagcuguuaaagagaaaagucaggaucugaucccagcaacuggcuccagggccuaugcucuucaccucaccuccaccuccacacuacugcauucagaaucacauaugacaugacucaucccaugcuacgaguuguacuucuuugcuaucuccauuauaugaggacacaacauuagugaaaguuaaaauuugugauaaauauaacccaugagaaagucaggccucuguacaaacauuccuguagcuucaaucuugagggcaggcaaagaccucaggaaaagucuuuacaaauaccaagggugugcuguauuuagauuagguuuuuuuauugcuuuagauuuaugugauacguuuuugaaacugccauccaaaaguaguuaauuuuuuucaugccacugaaggaggaaggugaaauuaucagggaaauccauuuauguacauuaccucauuuccaauaaugucaauauaaaaacauuacuaaaguuguacauauugauuaggaaugguaaaaaauacaacacggaucauguucaugguucuugauuuuauucaguauuuuuauuggguugaaguccuagcaaaugacacuucggucugcaucuucuaauaugaauuaguauauguuaucagugugacacuaccugaagagcugaguagggagcaugucuaaugcacacagcugaauuaacaguuuccagccccaccccaguuuaucuacagaaugacuaaauaagaaguggucgguccaauuuagucauuaaggugguugaaauagcaaaacaaguaugaucaauugcuugccaguugguagcugaugugaaugaaauagucaaaauuuccagaguaguccuaucuggccauagauauacgcacagaugaacuuucauuuugucuauugauuuugcuccguagguaagggcauagaagaucaggaaaaaaacaaaaagaaaaacaaaaaaaaaaaaacaacuuuauaaauuggacugauucagacuugaaaauuaguaauuugcucuuacuaggaucuggacaaugaccaugccagacagugcaucuacacgauagaaacuagacaaacccacaaagguaaggcauguaacaggaggagaccaaagauaugguaguaagagauccaagccaucugccucagggaacuccagcuguggaugccuggaguugcuagaacgaaguauagggaaguaaauuaugauucuauuuuacuuuuaaguuugcaaaguccuuucacauauacugauuugguuuggcucuguguccccacccaaaucucaccuggaauuguaauucccauaauccccacgugucacagguaggaccaggagagguaauugaaucaugggggcaguuucccccaugcuguucucguuacagugcgcaaguucuccugagaucuaaugauuuuauaagugucuggcauuuccccugcuugcacaucuccuuccugcugccuugugaagaaggugccuugcuuccucuuugccuuccaccaugauuguaaauuuccugaggccuccccagccaugcugaacugugagucaauuaaaccucuuuccuuuacaaaauacccagucugagguauuucuucacagcagcaggagaacagacuaauacauauaccaucuuuaugauuuucacauacuaaaugagucaugauauuguuuucuaauuuacauaaaaaacugagguucagaaauaaaggagaggaaacuaacauuaacuggaugucuaugggucacauguucuauguaccuuacaauaugugauccucauaacccugugaguuagagguuugccugaaaauguucagaguaucaguucaguucauuagcugcucuguuucucugaaaucuaccuucuaccuauagagacaaacccugagacuacauuucuaccuccugccacugauaacuggccaugcacagcaggcauggacacuugauccaagcucagagcaucaagacacuccaccaggaauuuggaaauggcuuuaagcaugcacauagaccugugaggcagcacugcauguggaagagugaaggaagcucaucugcagagagaagaaugaaacuaaugggcugauuaacaguauuaaaagaaaccauguagccacagagauugagacauccugagagagacaaugagguagagagaaaucaagaguagcugccugaucacuuucccagucuggauuccauguggcucgacugugcuuccugccguaggauuuugugaaacagcucuguuaaauccuaagauaaauuccauaguuuuugcuuauucugguuugaaguaguuuucuaugauucauagacauaagagccugguucuccaagcaggagguuacauggcccccgcugcagaggccagaaagccgaagugucaggauaccauuuugauucucacucauagaucuguaaagaagguuuaaauauuuuucccaagucuugagucacagcuaauauucaucaaagagcagagaauaaauggaguccuuguugaagcgucagugcuuaaccuagaucacuuuguuaauuuaauugauaagcacugucacugagucagugaguuucagaaguggaagagacuuuccuaugacuucccuagcagauggucaccuugccaccaugugauucaacucacccccacgugagacaucguauucucuuccagaggagcccugggauacuuugauggagccaaaggcuuuuuuccugcaacauuagcccuccgaaaaaucuagcucuuuggaacauacuucucucucuucccaagaacaacuuuuccuauguuugaagacagcuuggucugcuuuguaucagacuaaacauuccuucaaacauccuauaggccauggauucaggaucacuuacuacccugacacagggcguaguagucauucuccccugcagugugcucagaaccaaaagugaggcuccagugugcugagaggauccagaguaucuuauacaguugagcacacuuuagagggagacuuauuuacaaugaucugaaccccagacauacaugcaacuuaugguucccuaaccacucuuuuuuucaaugugcugaauuuacugauuuauguauuuuauuguguuaaaaacacaugagaucuaccuuucugacaaaauguuaaguguacaguacaguauuguuaacuagaagcacaau

SEQ ID NO: 17025 - RNA, 5066 nt, Homo sapiens
cuuuauguaaaguuucugcuuuuucucaaccacgccuaaagaggaaagaacuggcagcaggaacacuugcuccuaggaaacaaauacaacaaaauuauaauuaaaaagaucuucaagcuaucaaaauuugugagagaaggaugguaagaaugcaguagaaauuaccaaaugacaaacaaaauccuaucaguuuucagguuggucaaaaguaacuucaugaauauagccugugaucagcauaugucccauagcuuauaugcccucuauaccuccagaguugcauaauaaacuuuuaacaauaaaacaacaacgaauaucagguuguaaauauuuauauuucucucacauacaauguuguaugagacacuuguuuuaauauguauccauaggauuaauacucauauggaguauaauguggaaaagugcagaacuaaagaaauaagucuauccgaaaacaaaagcacacauuucucaggauuuaaaaauauugcacauaguaagguugcacagaaauuacuggcugguuuuacaaacagaaugagguaucagucaaucucuagauaaagaugagagagaggauaaacuacacacacacaaacacauaaauccauacuaagaccuaagagugccaacaacuaagaaagaaauaugaaaaagcuauguaaguagcuaugauuucaacacuacaaaaucauuuuuaggcuggaaccaaacacauaacaaucucuuggcaauauuucguuaaguuuucaacuuuuuuccagccuaaaugacuaugggcaauaaaaccauuuccuuuaccccaguucuacuguagaaaggcacagcgcugugguaaauaucaaaccauuccuuucucaaccuuucaguagcaauuaaccaagauacuguucuccuuuacugaaugacucaauuauacaguuucauguacacucugcaacgcaagucacagaugucauagaacaugcaacuuugaauuaguaaagguuucacugcaaaaaucauuagguucacacaauuuaaaucuacaauuaacuuuuaaaguuuaaucagguaaacucaauauuuucuugguaauaauacuggugauauuagugagcccaagggcagguagagaaaaagcacuaggcaaaauuacguguuuuuuaaagaaacuuuccuaaucagggaaauaauuagcauuuugucuacucguugaauguugaauuugucaaaaaaaaaaaacccuuaaauauauuuaauagcuauaucaaauuguuuaaagugaaaucaugcacuugucaaaauaguucacagaaaauuguuuagcaucaaagauaaugaggaagagucaaccaguuggauuuagugagaauagaauaagaacuacuguccugaacagucaguguauguaguaaccauauuuccucuucguugagugacaguccugcagugcuugcuagauccaugaaaucuauuuucagucuguacuguaugcugauugguagagucaaaaccacuaaaagaaaacauuuucuccauaucuucaaacaugucaucaaauaauccaccuccaaaagaaaauucuuggaaaugaugccuuugucuacuggaaccaccauccuggcgugucuggaaaugauuuucaaaacgcuucuuggauccaguguuuugguuuugaccaaaaaagccaaagucuuuaaauaagucaucaaaauugaaguuaaaugacugcucaaaagaacuuccacuaccucuuuguccuuuaccacuaguaaaagcacuguguccaaguguaucauacucuuuucgucuauuagcaucugagaguguuucauaugcugaaagugacaaaaauauuuuuaguaacugaagguaaaauauucaaaauuacauauauucaaaucucuucaagcaagugaacugaauacuauuauuuuagggaagaauuucgcaucagaaauaaaagcaaaacacuacaaauauaagcaucaaguuaaucaaaauuauaaaauaaagcagaaacugucuuauuaacugcugaguuaucagcaguuggcacaaugccaucugcaauacucaauaaaguuauuaaauguuaccauuacuacaaauaaacaugugggcaacaaucagaguucuuuaaucuucauauuauucgugugaaaucauuaauuguauuaaaaaauuaaaccaucaacuauaaccaauuaauaggaauuaagauuuugcaccuccuuacuaaaguaaacuguuuaauucuaacucccuacucaguuaccuccauccaacaauaauuacugaaugcucagcaggugcaauuuguuuuagagcuagucugaagucaaaauuuguuccaauuuuuucuuugaagacaaauauggcuuugaaaagcagaucaagugaauaaagcacuuuagagucuaguuuaauuuuuaagucuuuaauguuuaaaauguaaaauauucuguuucauaaguuaguugauaagaauuuuggguaccuaaaauucuuuuuugucauagaagcaacagugaucuuauaaauaauauagaauagauuuucaauauuuuuagauacguauaccaauaaaauuaucuauuauucuuucauauauuuauucaggaaucaaagcaucugugauaagaaaauaaucucagagaaucacccaauauuuauacauaaaucccacuccaccucccaucuccacaaaaccuucaaauacaaacacuucuuagcuaucauucuccuuacuaguuaauacccaugacacuucagagauugucauuuauuuaccuucugcaaucucucugaauuuugcuucagcauccgggcucuuauuuuugucagggugguacuucauggccaacuugugaaaggccuucuugauuuggcgcucugaugccgauuuuggcacaccuaagauaucauaguagcuuuuugaggccagaauuaauucuguuaucauuaaaaugcagauugcaaagaugaaaauugacuggggaguagccauuucuaauauccuaaaacagaaaagaaaaaaaaauguuauggauggagcuaaucuuaaaacguuuuucuuuuaaaagaaauccaacacaagguaaaccuaaugcaguaucaaaauaguaagcauacaguaucuauuaccuguccacauguaauuucacuuuuaguuuuauaacucucaaacuggcuuaaccuuauugagaacaaaaauaauucuuggcuuugucugucuacuaauacucuggccauacacagaggagauagaaaauuaucaauaacugacuuuuaaccaguuuauauugaagauucaucauaugcaagcauuguaagaaaaaaaaagaaaaccaaauaauauaagaucccaacuuuccuuucaagacuucauauccugaaaguaauaauguauuuaacuucacagaaaaaaaaaacauuaaaaaaaaaagguggcgcaccaagguaaauagcccaguauaucuaaauuaguauuauuaaucucgcuccaaaaauucagcuuucauuucagcaggugagccaaggacugcaaauagagaaucuuaauaucacaauacuaauacugacaauacaauagaauguugucuuuuucccaaauguaagaucccaaauguuuaaccaggaagcauggcuaaauauuguuuaaaacucaugaugaacagaauuuaagauuucugcuaaagcugccagaaaaaugaacuuugauaguuuguacugugguuaaggcagauucuuacuuucacaaacucaguaguuaaaauauuucuuuuaccuuuaaaccauuaaagaaauguuaacuuagaauucuugacaauauguauucaaugacuugagauucaaaacgaagggauggauccuguuuuuugaauacgggaccaccagaguccuuaguaaccuauaaugccauaauaaggcugacgaaaaacacuacgguuuguggaaauugccuggcuuccucuccagcggccuuuccugagaguaauuagcaggcagguagauuacuuauuuccagagaguuacucguagucacggguaccaagaaucaagaaccacuucucgguuuaaggaacacaacagugugucccauggacgcugcgucaacugcagguugcucccuagucaaagggcggaucuaaaacugacagggaggcgccucacugguucagcagacguuauuccacggucucaagguggacaucuaaugauuuuuuuuuagcagacuaguuuuguauuguacagacuucucauccccaagacggccccgccagccagcagcccgugccuuauuccccagccucggugggcggcugggcuagacccuccaaccuucaccuaaaggcgacuggcacuuucccugcccgcccaggccccgccgcagaagcugcccgagacccgggcucuaauccggcgcccgugaaagccggcgccacaacccaaaacacgauucugugaugcggcugucuccguucuuccauucucucggccaaaaacaugcagcccauugucccugcggcgaccguggcggacaccgaggccaagucagcucacaaagacaggccugggcuacggggacccuccgaacuccccuccccacgaccccggccucgucccucaccugcacccuccgacuacugcugcuccuccacagagcugaggcgcuggcgacccugacgaucggcucgggucggcagcuugggcccggccccucaccgcggccucccggagcuggcacgcacccuaaucucggucguacaccgaccuagcgcuccuccuuccccgccggcgcccaguccccucucagccagcuccucacaggcaggagguagccgcuggcgccaccaccucagaagaccuacacgaaacgcuuccccauuggcuucugccuccccacgugaucccggcgcccuacgcgcacguggaaaacuguuguugcugcuagggcugugcgccacuuccggcuucaacccccgaaaaggcggugcuuaaaccggaggaggcggaagugagucgacagacgaggcggcuuucccggcagaaugcuagcgcaggcgcaggggcucgagagg

SEQ ID NO: 17026 - RNA, 5066 nt, Homo sapiens
ccucucgagccccugcgccugcgcuagcauucugccgggaaagccgccucgucugucgacucacuuccgccuccuccgguuuaagcaccgccuuuucggggguugaagccggaaguggcgcacagcccuagcagcaacaacaguuuuccacgugcgcguagggcgccgggaucacguggggaggcagaagccaauggggaagcguuucguguaggucuucugaggugguggcgccagcggcuaccuccugccugugaggagcuggcugagaggggacugggcgccggcggggaaggaggagcgcuaggucgguguacgaccgagauuagggugcgugccagcuccgggaggccgcggugaggggccgggcccaagcugccgacccgagccgaucgucagggucgccagcgccucagcucuguggaggagcagcaguagucggagggugcaggugagggacgaggccggggucguggggaggggaguucggaggguccccguagcccaggccugucuuugugagcugacuuggccucgguguccgccacggucgccgcagggacaaugggcugcauguuuuuggccgagagaauggaagaacggagacagccgcaucacagaaucguguuuuggguuguggcgccggcuuucacgggcgccggauuagagcccgggucucgggcagcuucugcggcggggccugggcgggcagggaaagugccagucgccuuuaggugaagguuggagggucuagcccagccgcccaccgaggcuggggaauaaggcacgggcugcuggcuggcggggccgucuuggggaugagaagucuguacaauacaaaacuagucugcuaaaaaaaaaucauuagauguccaccuugagaccguggaauaacgucugcugaaccagugaggcgccucccugucaguuuuagauccgcccuuugacuagggagcaaccugcaguugacgcagcguccaugggacacacuguuguguuccuuaaaccgagaagugguucuugauucuugguacccgugacuacgaguaacucucuggaaauaaguaaucuaccugccugcuaauuacucucaggaaaggccgcuggagaggaagccaggcaauuuccacaaaccguaguguuuuucgucagccuuauuauggcauuauagguuacuaaggacucugguggucccguauucaaaaaacaggauccaucccuucguuuugaaucucaagucauugaauacauauugucaagaauucuaaguuaacauuucuuuaaugguuuaaagguaaaagaaauauuuuaacuacugaguuugugaaaguaagaaucugccuuaaccacaguacaaacuaucaaaguucauuuuucuggcagcuuuagcagaaaucuuaaauucuguucaucaugaguuuuaaacaauauuuagccaugcuuccugguuaaacauuugggaucuuacauuugggaaaaagacaacauucuauuguauugucaguauuaguauugugauauuaagauucucuauuugcaguccuuggcucaccugcugaaaugaaagcugaauuuuuggagcgagauuaauaauacuaauuuagauauacugggcuauuuaccuuggugcgccaccuuuuuuuuuuaauguuuuuuuuuucugugaaguuaaauacauuauuacuuucaggauaugaagucuugaaaggaaaguugggaucuuauauuauuugguuuucuuuuuuuuucuuacaaugcuugcauaugaugaaucuucaauauaaacugguuaaaagucaguuauugauaauuuucuaucuccucuguguauggccagaguauuaguagacagacaaagccaagaauuauuuuuguucucaauaagguuaagccaguuugagaguuauaaaacuaaaagugaaauuacauguggacagguaauagauacuguaugcuuacuauuuugauacugcauuagguuuaccuuguguuggauuucuuuuaaaagaaaaacguuuuaagauuagcuccauccauaacauuuuuuuuucuuuucuguuuuaggauauuagaaauggcuacuccccagucaauuuucaucuuugcaaucugcauuuuaaugauaacagaauuaauucuggccucaaaaagcuacuaugauaucuuaggugugccaaaaucggcaucagagcgccaaaucaagaaggccuuucacaaguuggccaugaaguaccacccugacaaaaauaagagcccggaugcugaagcaaaauucagagagauugcagaagguaaauaaaugacaaucucugaagugucauggguauuaacuaguaaggagaaugauagcuaagaaguguuuguauuugaagguuuuguggagaugggagguggagugggauuuauguauaaauauugggugauucucugagauuauuuucuuaucacagaugcuuugauuccugaauaaauauaugaaagaauaauagauaauuuuauugguauacguaucuaaaaauauugaaaaucuauucuauauuauuuauaagaucacuguugcuucuaugacaaaaaagaauuuuagguacccaaaauucuuaucaacuaacuuaugaaacagaauauuuuacauuuuaaacauuaaagacuuaaaaauuaaacuagacucuaaagugcuuuauucacuugaucugcuuuucaaagccauauuugucuucaaagaaaaaauuggaacaaauuuugacuucagacuagcucuaaaacaaauugcaccugcugagcauucaguaauuauuguuggauggagguaacugaguagggaguuagaauuaaacaguuuacuuuaguaaggaggugcaaaaucuuaauuccuauuaauugguuauaguugaugguuuaauuuuuuaauacaauuaaugauuucacacgaauaauaugaagauuaaagaacucugauuguugcccacauguuuauuuguaguaaugguaacauuuaauaacuuuauugaguauugcagauggcauugugccaacugcugauaacucagcaguuaauaagacaguuucugcuuuauuuuauaauuuugauuaacuugaugcuuauauuuguaguguuuugcuuuuauuucugaugcgaaauucuucccuaaaauaauaguauucaguucacuugcuugaagagauuugaauauauguaauuuugaauauuuuaccuucaguuacuaaaaauauuuuugucacuuucagcauaugaaacacucucagaugcuaauagacgaaaagaguaugauacacuuggacacagugcuuuuacuagugguaaaggacaaagagguaguggaaguucuuuugagcagucauuuaacuucaauuuugaugacuuauuuaaagacuuuggcuuuuuuggucaaaaccaaaacacuggauccaagaagcguuuugaaaaucauuuccagacacgccaggauggugguuccaguagacaaaggcaucauuuccaagaauuuucuuuuggagguggauuauuugaugacauguuugaagauauggagaaaauguuuucuuuuagugguuuugacucuaccaaucagcauacaguacagacugaaaauagauuucauggaucuagcaagcacugcaggacugucacucaacgaagaggaaauaugguuacuacauacacugacuguucaggacaguaguucuuauucuauucucacuaaauccaacugguugacucuuccucauuaucuuugaugcuaaacaauuuucugugaacuauuuugacaagugcaugauuucacuuuaaacaauuugauauagcuauuaaauauauuuaaggguuuuuuuuuuuugacaaauucaacauucaacgaguagacaaaaugcuaauuauuucccugauuaggaaaguuucuuuaaaaaacacguaauuuugccuagugcuuuuucucuaccugcccuugggcucacuaauaucaccaguauuauuaccaagaaaauauugaguuuaccugauuaaacuuuaaaaguuaauuguagauuuaaauugugugaaccuaaugauuuuugcagugaaaccuuuacuaauucaaaguugcauguucuaugacaucugugacuugcguugcagaguguacaugaaacuguauaauugagucauucaguaaaggagaacaguaucuugguuaauugcuacugaaagguugagaaaggaaugguuugauauuuaccacagcgcugugccuuucuacaguagaacugggguaaaggaaaugguuuuauugcccauagucauuuaggcuggaaaaaaguugaaaacuuaacgaaauauugccaagagauuguuauguguuugguuccagccuaaaaaugauuuuguaguguugaaaucauagcuacuuacauagcuuuuucauauuucuuucuuaguuguuggcacucuuaggucuuaguauggauuuauguguuuguguguguguaguuuauccucucucucaucuuuaucuagagauugacugauaccucauucuguuuguaaaaccagccaguaauuucugugcaaccuuacuaugugcaauauuuuuaaauccugagaaaugugugcuuuuguuuucggauagacuuauuucuuuaguucugcacuuuuccacauuauacuccauaugaguauuaauccuauggauacauauuaaaacaagugucucauacaacauuguaugugagagaaauauaaauauuuacaaccugauauucguuguuguuuuauuguuaaaaguuuauuaugcaacucuggagguauagagggcauauaagcuaugggacauaugcugaucacaggcuauauucaugaaguuacuuuugaccaaccugaaaacugauaggauuuuguuugucauuugguaauuucuacugcauucuuaccauccuucucucacaaauuuugauagcuugaagaucuuuuuaauuauaauuuuguuguauuuguuuccuaggagcaaguguuccugcugccaguucuuuccucuuuaggcgugguugagaaaaagcagaaacuuuacauaaag

SEQ ID NO: 17027 - RNA, 4997 nt, Homo sapiens
caggacucuuggaaagcagugaucuaugcuguaagaccaugagucacagauucuuuuuuucaguacuauuuaugauuagccauauuucuagaaacauccugaaagauggaauuaugacgaaaaagugaagauaaucuacauucgggggcacaaaugagcacuuggaucaguguuuuaugaaccuaagauacagccggaguaguuauggucagucauggagaauaacuugaaaacuugucccaaagaggacggugauuucguuucugauaaaauaaaguuuaaaauagaagaggaagaugaugauggaauuccuccugauaguuuggaaagaauggacuuuaaaagcgagcaggaggacaugaagcagacagacagcgguggggagcgagcgggccucggugggacggguugcagcugcaagcccccggggaaguacuugucugcagagagugaggaugacuauggcgcgcuguucucccaguacagcagcacccuauacgacguggccauggaggccgugacccagagccuccuuuccagccggaacaugagcuccaggaagaagucuccagccuggaagcauuuuuuuaucucuccccgagacagcacuaaagcaauaugcauguacugugugaaggaguucagcagaggcaaaaacgagaaagacuugaguaccaguugucucaugaggcacgugaggcgcgcacacccgaccgugcucauucaggaaaauggcagugugucugccguguccucguuccccucucccucacuccugcuuccaccacagccugcggacgcgggugaccucagcaccauccucucacccaucaaacuuguccagaaaguggcgucuaagaucccgucccccgaucgaauaacagaggagucugugucuguaguuucuucugaagaaaucuccucugacauguccguuucggagaagugcggcagagaagaagcccugguggggucgucuccccaccucccugcucuccauuacgaugaaccugcagagaacuuagcggagaagagccuuccacuuccaaagagcaccucuggguccaggagaagguccgcugucuggaagcacuucuaccugucgccacuggacaacuccaaagcugucugcauucacugcaugaacgaguucagccgggggaagaaugggaaggaccugggcacgagcugccucaucaggcacauguggagggcacaccgcgccaucguguugcaggagaacgggggcacgggcaucccgccacuguacuccaccccucccacucugcugccuuccuugcugccgccggagggggagcucagcucuguguccucgucuccaguaaagccggucagagaguccccuucggccuccuccuccccugacaggcugacugaggacuugcagucucacuugaacccuggagaugggcugauggaagacguggcggccuucucaucuuccgaugacauaggggaggccucggcguccucuccugagaagcagcaggcugaugggcugaguccuagauuguuugaaucuggcgccaucuuccagcagaauaaaaaggucaugaaaagacugaagucggaggucuggcaucacuucucccuggcccccauggacagccucaaggccgagugucgguacugcggcugugccaucagccgggggaagaagggugaugugggcaccagcugccugaugagacaucucuaccggcgccauccagaaguugucgggagccagaagggcuuccugggugcaagucuggcaaacucuccguaugccacuuuggccucugcagaaaguuccucuuccaaauugacugacuugccaacaguggucacaaaaaacaaucaaguuauguuuccuguuaauagcaaaaagaccucgaagcuguggaaucauuuuucuauuugcuccgcagacuccacaaaagucgugugcuugcacuguggccggaccaucagccgggggaagaagccgacuaacuuggguaccagcugucuucugagacauuuacagcgguuccauagcaacgugcugaaaacugaggucucggagacggcucggcccuccucuccggacacccgggugccgcggggcacagaauuaucaggcgcuuccucuuuugaugacaccaaugagaaguuuuacgauucucacccaguugccaaaaaaaucacaagucucauagcugaaaugauugcacuugaccuccagccauauucuuuuguagacaacguuggcuuuaacaggcugcuugaauacuugaaaccucaguacucccuccccgccccuuccuacuucuccaggacagcuaucccagguauguaugauaaugugaagcagauaauuaugucccaccuuaaggaagcugagaguggugugauccacuucacgucuggaauauggaugaguaaccagacccgugaguaccugacccucacggcccacuggguuuccuucgagucgccagcccggccgcgcugugacgaccaccacugcucggcgcuguuggacgugucgcagguggacugcgacuacaguggcaacagcauucagaagcagcuggagugcuggugggaagcgugggugaccuccaccggccuucaggugggcaucaccgucaccgacaacgccagcaucgggaagacgcugaacgagggggagcacucgagcgugcagugcuucagccauacggugaaccugaucgucagcgaggccauuaagagccagcggauggugcagaaccugcugagccucgcccggaagaucugcgagcgggugcaccggucgcccaaggcgaaggagaaacuggccgagcugcagagggaguacgcgcugccucagcaucaccucauccaggacgucccguccaaguggagcacuuccuuccacaugcucgagcggcucauugagcagaaaagggccauuaacgagauguccgucgaguguaacuuccgagagcugaucagcugcgaccagugggaggucaugcaguccgugugccgugcgcuaaagcccuucgaggcugcgagccgggagaugagcacgcagauguccacccucagccaggucauccccaugguacacauccucaacaggaagguggagaugcucuucgaggagacgaugggcaucgacaccaugcugcgcucucugaaggaggccauggugagccgccugucugccacccuccacgacccgcgguacgucuucgccacgcugcuggauccucgcuacaaggccucccuguuuacggaggaggaggcggagcaguacaaacaggauuuaaucagggaacucgaacucaugaauucuaccucagaggacguggcugccucccacaggugugaugcuggcuccccgucgaaagacucugccgcagaggagaaccuguggucacuuguggccaaggugaagaagaaagacccaagagaaaagcugccugaagccauggugcuugcguaucuggaggaggaggugcuugaacacagcugugacccgcucaccuacuggaaccugaagaaggcguccuggccggggcuguccgcgcuggccgucagauuuuugggcugccccccaagcaucgucccuucagaaaagcuguucaacacacccacugagaacgguagccuuggccaauccaggcucaugauggaacauuuugaaaaacuuaucuuuuugaaagugaaucuucccuuaauauacuuucaguauugaaacucacgacggcaccacuaggccagaggcguggcugccccagcguuagcagccuguaccaggucuaugacccgcucugcccacggcuguguacgacaucagaccaggcacucucagggccgcucuccagcucaccacagugucuccacgugccuuaccccuucuccuucaggccaaguuucgcgggguguuuuauuaagacguccacuagaaauagcuuguccugucaacuaugaaauauggugacuagauuuuaauucauaaccguaaaguuuuuuaaaguuuuggguuaguaauuuguuuuacuagaaugacaaagaagauguaaaccauuuuauucuguaggcuuuuuacucaauuauguacaaaccacaaaucagguacuguauuuuagugaagcauugcuuuaauugcaacagaauagcuuuuguggcuaucaaaugaaaucuguaaauaggagguggagggcaagccauccugacugagcaguuuuuaaccgcagguucuaaagugucccgcggaguacagauaauauucuggaagguaacuguuuacuacgacagagacguggcauuuggaaacgaaacuuagauguuucauggagcuuauuuugagaacuuucccauuucagguuucugcauucaggcuuuacauggucaguuaacucagagauaccccagcuguuuaucaucagcuccucugaaaugugaucccuuuguaacugugcucaucacuucgccagugcguucaaugacacgcugauggcagguggucccugcugaaacccccacgccuccgcuucagcaucuccacgcucugaagcugucuuucaaaaugugugcacugacccccuuguuugaucaaauuuguguaaaauuuuuuuagaagagauggcuuauuaacagggaagaagcuuguuauauuccaguuguaagaauagccuuaguguuuagauuuuuuuaugauagggaagaugcggccaucacugggauauuuucaaaucccaaggacaucagagugaagugucaguugucagaugauuuuaaaaguuaugucuucagagaaaaaaagauucauuuucucauuuuaaaccaauuaaauauucugagugagacuaaucacucauuugccuacgaccuuuuagaaaaguuguuuuguugaaauacuguacguacgcuuaaucuaaauuugcauugacuauguuuuaguguauuuauaaauggugaacucaguuucugaaauuaaacuucuuauuugcaauuuucua

SEQ ID NO: 17028 - RNA, 2763 nt, Homo sapiens
augaaauaucagaaauuguuaccagcuuuucucacuuccaaagccaaacuaaacauucuccaauauugagucaaaugaucuuuguuaauuucuugcacuaauuuaccaaacagcaaugcaggagugacccugucuucuguugcagguacuucuauucuauacagaacauggaugcaagguauuuauucuaaauauaaguugcugcaugcuccaggcagggcauccaccuaggggaugucuagcuggcagggucacagguagguaaacgugguauggauugggccugagcugcuuugcauuuucuguuguuagcucuugagcugaugugcauggaucuguuuagauuguuggggcaggcugggguggaugaucaauaugguuaacucagauacaugugcugauuccaccccuaguccuacaccaguacaauuagacaccagggcuuccucacaagccccagcauugcuguccccagugacaggcucagcaccucaucucaacagucucugcuaagcugucaaccccacugcucucaucacugcuucccugacacauuuacccagucuucacuccuccccucaccucaaagccauccaucugcuuccugccacuccacuaaaucccuuuccauacuauauugcuucauucuccaagggaguagagugggagugcaagaccaucagguggucuguggcgcugcagaucauaggccagagucagauucaacucagccugaagucaaccaagccacaguguagcucugaggaauagggaaagggccaauauguaugcagcaugcaauuguccuaacaaggaaaaauaauugaaucauuugacagacucaacggugccuaaaacaguuauaucauuuuaguuuuuggucagagacaguucauuuguuacgacaaaccacugagacucuaacaaaugcaucauuuuauccuccugaaagaaugugacaccccugccaccgugagggagcauguauaaugccauuuuagugugguuuuguuaaaaugaacuguauccaugugacguaggugaacaugcauacauaugugccuagagagauggugagaagagaagagagggaaggagagagagagagugugcaugagaaggagaguaagagcacagccagagagaaaaagaaaaaaaacucaaaggauucacugcaaugcaguuuuacauacaggccuguaggagcaaccugaauguuauuagaccauaaaagcacaucaggcugauuuaugguuucugaucaagguuucugugaaaauuacucugcaucaccagcucaaggugacugcuaccauuaauguguggaaaauaaaugagauggggaggccgauagcagaggaaggaaaggaagcgcugaggcaguuuauacagcacagaauccccauuuuguuuuacagugcagagaagccugucaucaaaaugauugcuguggggcaugaaaggcaauucuugguaauuagaucuuauggcauguagcuggugcuuucuuauaucgaaugcaccaggauauuaggacaaacgccugccuucugcauaccaucuuuucuguuuucuguucauauucagcuaugguagucuaaauuuaggaagaagaacacgguaauauuguuuuccugauucuauuucuuuuuaaugguauugcuucccccuccacuguuuuccugaauguuuucuuauaacacauaguauucaccuccuccaaauaaucuuccauauuugagacuuucuaauagagccaauauaugcaaauauuuuacauauuaucugauggccacaauagaacuccacuggccuuucuauuccuuccuuguuuauaauucacuaaagcauuucauagauggaaugccauacugcuuguuuagauguaaacaaauagcacauaucacaagacuuucguaugagauaguugcugugaaaaguauaaaagaugauugcuggaaagauucccuucuccuccuccuuuugcuuguauaguaauucucccugauccucggggcauauguuccaagaccccuggugagugccuaaaaccacagacaguacugaacccuauauacaguaugcauuuuccuuuacaugcauacaaaugauaaaauuuaauuuauaaauuaggcacagcugggagguggagguuguagugagccgagaucacaccacugcacucuagccugggugacagagugagacccugucucaaaaaaaaaauaauuaauuauuaaauuaggcacaguaagugauuaacaacaaaaauaauaaaacagaacaauuauaacaaugugcuguaauaaaaguuaugugaacguggucuccuucucucucuuaaaauaucuuauuuuacuguacuccccuaucuuuggaccacaauugacagugguagcugaaagaaacugcaaaaaguacacccagggauguggggaagcuauuguauugcguaucgccauauugauuuagaauuugaggguuauagucuguugcuggauuuugacucuauaugcaaguagagaacccugcauuuuggaaugcucaagguaaaggugaauaaauuaaaauguuuucaaaucauuuuacugcaucccuuucccuggugcguaaaacuugcccucuggugcuucugcauagcauuccacaucuggaacaugucggugucugcugucacagcuggcugcugcugcagggauagccauuaaaaaacauggcuuuaagaaaacucacaggcaggagaacacucaccucaucuagcca

SEQ ID NO: 17029 - RNA, 1296 nt, Homo sapiens
acuuuuauuccacauuuggaguccuuaggaaaaaaucuggauggaaaacuacaagugauucacugugacuucuuuaaaauagauccuagaagugguggaguaauaaaaccacccgcuauggcuucucaagggcucuuucagaauuugggaauagaagcaguuccuuggacagcaggcagcccuuuaaaaguaacuagaauguucucaaguagaggugaaaaaagggccacuuuggaaaccugcauaugacguauuccuguacuucuagauauaaauuuggacgaauagaacuaaauauguuuauugguaaaaaagaauuccagaaacuaacggcagauccccgaaauccagacuuguaucauguaugaaguguuaucuggcaaguagcuugugagauuaagguucugcacauggaggcuuggucgucauuugauguauacacccaaaaugggcggcuggaaaacccaaaguguagggaauuauuggagcuauuacaacaaaaucuguaucuuacucgaaugacuccucauggaaauuuauuuaccgagaacuuaacaccuauuaacuguaauauauuuuuucacaugugaaagcacuguuuugggaggugcagugccaaucuaauagaccacuuaaguucacugacuccacuuggugcaauggauauauugaugcaaauaggaaaaaaggaagaagagaaaauaacuaacauguacccucaagacuucaaaaaacuuuuugaaacuauaguguuccaaagauugugcuuauaaauggcuauaugaugaaacccugguaaauauguagcaacuagacugucguuuuugguggagcaguuuauuuauuuggaaaccaugacaugaaaaccaaauuugaaagcucacauccuuucagcagaagauaacuguucuuguuuugcacaugacacguagaucauuucuccugaaguugauaucauuggcauauuggaugaaacaguggcugcuauuuuauucacaauugaauaaagugaaaacuucaauuaauuguggauuugaucagauugaauuccuuuuguuucagauuccuauuuaaauauuucacuuucacuguugcugauuuuugcaucuucuugaggagcaagagucuguacauuauuaagcuuagaaaguaaacaaaacugauuuacugauuuguuuugcauuucaguuuguugaaauguauugucaaguacuacagaaugaaauuguuuaaauuuuaauaugauuuaaacuuuuuuagaaauuaaaauauuuuaaauaaaaauaaauauauaaa

SEQ ID NO: 17030 - RNA, 548 nt, Homo sapiens
gauggcggacauucagacugagcgugccuaccaaaagcagccgaccaucuuucaaaacaagaagaggguccugcugggagaaacuggcaaggagaagcuccugcgguacuacaagaacauuggucugggcuucaagacacccaaagaggcuacugagggcaccuacauugacaagaaaugccccuucacuggugaugucuccauucgagggcggauccucucuggcguggugaccaagaugaagacgcagaggaccacugucauccgccgagacuaccugcacuacauccgcaaguacaaccacuucgagaagcaccacaagaacaugucuguacaccuguuccccugcuucagggacguccagaucggugacaucgucacagugggcgagugccggccuugccggccucugagcaagacagugcaccucaacgugcuccaggucaccaaggcugccagcaccaagaagcaguuccagaaguucugaggcuggacaucagcccgcuccccacaaugaaauaaaguuauuuucucauucuccaaaaaaa

SEQ ID NO: 17031 - RNA, 26874 nt, Homo sapiens
gucucccggagucuggccgcagucgcggcagugguggcuucccauccccaaaaggcgcccuccgacuccuugcgccgcacugcucgccgggccaguccggaaacgggucguggagcuccgcaccacucccgcugguucccgaaggcagaucccuucucccgagaguugcgagaaacuuucccuuguccccgacgcugcagcggcucggguaccguggcagccgcagguuucugaaccccgggccacgcuccccgcgccucggcuucgcgcucguguagaucguucccucucugguugcacgcuggggaucccggaccucgauucugcgggcgagaugccccugggacacaucaugaggcuggaccuggagaaaauugcccuggaguacaucgugcccugucugcacgaggugggcuucugcuaccuggacaacuuccugggcgagguggugggcgacugcguccuggagcgcgucaagcagcugcacugcaccggggcccugcgggacggccagcuggcggggccgcgcgccggcgucuccaagcgacaccugcggggcgaccagaucacguggaucgggggcaacgaggagggcugcgaggccaucagcuuccuccugucccucaucgacaggcugguccucuacugcgggagccggcugggcaaauacuacgucaaggagaggucuaagguaggacgcgcucggcgcccugccgcagcugcucccgcggggacgggaggcacucggaguccguuguaugucgacuucccagggccguaagcgaacuuuguuuuuuaaccaagaagucagccugguuugucucuacucgcugcuuccccccaccccucgccccagcuccucugagcgaaagucaacguuaaggggcucaggugaaccaugaugaugaccuucuguugacuuugaaauauuggcucuugugggugacaaaagccagacaagcuguggcugugguccgauuuuaagacgagguucucaaagauccaaaggagggaaaggguauuggaaacacuguguaucaucugagacacacguguccucaugaucuuaaaugccuacuuuaaagccaccuaauacugcccuucauuguggucagaagagauuucuacaaaagcacucagaauucuggaggcaguugugauuuugccauguggcaguugguuuguggaguugggcaggugugaaaggguaaaacuccacuucugaaugcugcuucugcccccugggacccagcacauuguuagaccaucuucuugacugaaaauucucuccugaugcugagcccugcaccaccaccuuccuuuuccuaacuaugaauugauggcaaaguccacucaaaacaaccaguuaagugcucacgagagaguagucaagcaccuccagaaagaaaccggguuuuuguucacauagcaggaagugacucccugggugguaauuuaucuuggaaacacagguagauuggcagaaaaacgggaacauguagguaccgcgauguuggugcauguccauuacuuugggauaggcuuucucagucuuuccucaaaugauaguugagccaguuuuccaguggcaauucugagugacuugcgcuugucuuaugguguggucaagggacguucagaacuacggaaaacuuuuacugaaacagcgaagcagaguauaccggcaugagagggaagaugaacacucaccuauguaccacucuuugacaauaaauauaguauuucucaaaucagucucaagacugauccugucucagaacagaccauuguucucucauuucucuaauacgcugagaggaacacucugaauaaaggcuaaguggugaggauuggaaacgugugggagugaagggguggagguggaugagugcaguggggagucacaguuugccguacaacuuccaagccaagaggccaugaauagaauaucugaaagcaucguuauuaaugcacccaaguaaaguaaaucuuagaagauacugcuuucuaaauuuuacuuuggggaaaaaaauuccgcgugagcugaacucuguaggagauugaugcuaaaguguuucuuuauucuucuuccaucauguuggugguggauuagucacucgucuuugacuaguuugauuuuugcauuaaaugaccuugcugucuucugugguggaggugugucggggaggggaagggucagccucaguguugcugagaugcugguaguuucuaccuggaagagcagacggcuucuuauuggguuuuuaaauguuucuuguaaauuuagguguuaggaguuuuucuucaucauucuaggagcagaauuugcucugagggaggucaggauuaauugguauggaaagaggccacuaacauugaaaguuaaauauuuuuauuuagcuuugacuuaauggauagggauaggguuucagacuagaauuuaacucaaauggaaggaaaaacacuguguaaguuaggguaagggaaagaaagauccuguagauaugauucaucaauuuuagguuaucuuuuggguggaaugaaaaacuuuccaggugacccugucagaaggugaucgugaauugaaaauaaaauuuauccugucccacccccagauuuccagguuuacuuuggcugguuugucacaaagcucccugcccuuuagauaaaucaccuuucgauuggaauauucccuggccaauuagaaccaaaugcaaaccaggcuugagcaaacaacuaguguaguuaaauuuuuuuuaagugugcuuugcuuguauacagaagucuccuuagugaugucuuguggucuuggguuucuuguuugaaguucauuauuaaagucaugguagaaacacuuuccauuucuacaugauuuuuauugguuucacauuaauuuauccuucuuuuucuucacucacuuuuuaucccucagcugagcuccucauuuugugcugcuuuccagagcagugauagagacccaguuuaccgguucauccuucacccguguuuucaagaaaaacuaaaguuuuaaauuuauuuauuauuauuauuuuuuugagauggagucuugcucugucgccaggcuguagcggcucacugcaaucucugccuccuggguucaagugauucuccugccucagccugcugcauagcugggaccacaggcacgccacccugcccagcuaauuuuuguauuuuuaguagagacgggguuucaccauguuggccgggcuggucucgaucucuugaccucaugauccacccgccucggccucccaaaguucugggauuacaggcuugagccacugugcccggcccuuaaauuuauuuuuaaguuuuaauuaaggaaauuuucaaacauacauaaacauaagaggcuaauauaaugagcucccaucacccaauuucaacaauugccaauauguacauuuguuuuagaccaauuuuuuuuagcuacuuuaaauuucuugagguuaugcuuauucaugcacuuacccaaauuucauuucuuuuuuuguucuuugcuagacuuggaaagaucauugaauaauauugcccuuuaucucaaugaaacaauagcaaagauauugggaguaaaacagaaagauacacuggaccuaaaauugaaauuguggaagaauauagaaagaaauauuagaugguucugcuuccugccaagaaaguuguuaauggucagaauuugucuaccucaucuuugcuggagaaaaauccaaggguguugaagaccccuugggaagugguuccuguaauguacagcuguauggcccccccuaacuucaagcaugaucauugcuuucaggcuagcaaaggauuuauccgcucgcuacucccuuuuggagauuuuagaccauauccaagauaaauauuggucauaauuugcuccuuuuucuuuggcugccuagaucuugaaaauggcuguuuuccagagaauguauaauuuuuagaaccaaaagucccucugcuucaaacagcucacuguagacucacuaguuagugacucuaauaagaagaacuaccuuuuauugagcaguuuguauugucuggcacugugcuaugcacuuuacaaauacuaucuugcuuaaucuucagaaacacagucuuaaacauauugagugauuaaauacugugcccaaaguuucaaagucagugguaagaaacaguuuaaaugggggcugggagcucaggcucaguguuaacuaacuucguggcuuuaggcaaguugcuugguuuacaccaggugcaaaaugaaaggaaauaaugccguaaagcuguuggaggaagaagcauuaaauaagaugauguuuaugaaauguuuagcagaauuccgagccuucaucaguguuuuaagucuccagaggggaaauuugggauccuaaccuagauuuguguaacuccagagacuguguuauuuccuuuuauucucuccuacuuccgaccuuucauuuauucagcaaauguuauggaguguucagccugugugggaugcugugcaggggugguggugccaugaugaacgaauuuauacuuucguauacuuugaauuguaggauggucucauucacacuugacuaauucuuaggcuuaagaaaacccucaaacauugaagugggucaguugaguacauuugaagaaaaaaauagaguacugugcugauguuuuccuacuguuuuauuuauuuauuuauuuauugagacagaguuuugcuccuguugcgcagguuggaguucaauggcgcaaucuuggcccaccacaaccuccgccuccuggguucaagcgauucuccugccucagccuccugaguagcugggauuacaggcgugcgccaccaugcccggcuaauuuuguauuuuuaguagagacgggguuucuccuuguuggucaggcugaucucuaacucccgaccucaggugauucgccugccuuggugccucccaaagugcugggauuacaggugugagccaccgcgcccggcuucuacuguuauuuuuaggaaaacauuuauugauaggguuuguucguaggauuccugaccagacuagcucuggaagguggcauugugaggacugcauugugaacagaccaauugguccuccccuggaaacaauaaggaggaaugaugaaacagcaaaacauuuaugaauuaaagaagauguguugcaaggugguguguuuauuccuugcuguugagcaauaacaguuuuggcccacccuucucaugugaggucaggaauauacauuauuuaauggagcuuaucaugguugcaaacuacuuuaagggaaaaaugaagcaauguacuaugaagugaucucgcaggauccaagugcaagaaaugcagucaggguucucagaagcuuagagguaugaacuaggaagcagaaaguccuuaacauccaggacagcugguguguucuuuucucaggagccucaugaccuccaucuuugcuucccugcuuuugcucuucauuucuuauccucuuuucaauccagcuuuugcugccuucccaugcacauggcucaagauggcugccccacaauggccaccucagccuuuaguugcagaugagcagagacuucaguaacauuccuggaucccuguuuucaucgccugggagaaagucugauugucucaccuuggcucaagggaucuaucagccguagucuggcacagugggaggcauguggaaaccaugcaucacaaauaugguugccagggcccaugagaguuauagcucuuagagcacagaguuugagagcuggauaccauaaaugguaucucugcaauuagaaucuuagaaaucuaccugugaauaagguauuuuggggaggagugcugcugaguuugaagcucuggaacacugugaauaagguauuuuggggagaaggagugcugaguuugaagcucuggaucaucuuucuguaaggauguaagggauuccuauaaaagcuuuuguauuaaaaauaacuuagcuccuguaggaaggaaauuacuccacaguaauaauuuacagaauacagucccagugacagugaaacaagucucuccaaugggcaaguuuucaugggguuuuuugucuauuuugugaaugacauuuggaaacaaaaaaggcaggaggguguguguguuuaauuuguaauuucuuuugcucaauuuugggccacuggccacuucacuauaaccuuaucugcuucagagaaguggauaauaaagggauaucgauuuaauucauucacagaucacucagugcugcacacugugggagaccuguccguggauggggaagggaagugcccagugauuacaaaaccaccugaagaacuaagcugagaguugaguguagugugcagugguugucaccaauucuuucucuuuuucugguuaaaaagugcacguuuacgcucauuagucauuguuucucuuuggguuuucuccaauuucucuguuaauuuaaaaugaagcaaccagaacaagugaucaaaacuauacaggauguuaauaauauggguuuuuagggcuagagagauauuagaagucacaucuauccaaugucucagucauucagcaguuguuuucauauuuggagagaugauaucuugagcagauccuugggaagggauggauaaaagguacuuuaauagagaaaggguggcugggugcaguggcucacaccuguaaucccagcacuuugggaggccgaggcgggcagaucacaaggucaggaguuugagaccagccuggccaacauggugaaaccccaucucuacuaaaaauacaaagucuagccgggcauggugguuugcgccuguagucccagguacucaggaggcugaggcaggagaauugcuugaaccugggagguggagguugcagugagccgagauugcaccauugcacuccagccugggcaacagaccaagacuccaucucaagaaaaauaauaauaauaauuaaaaagaaaauagagaaggggcuacgcuggcugggucagacagacugggaccagggucaguagguuaauucaguggcaucaccauuuuauuugggaauuuuaaauauaauucugacugaaaauugauaaacacccuuaaguggaguuaugcaagccugucucugcauaagguuuuggaguaucaugaaugauuucccuuucuaaccuuucugcuucagcucaagcaaaauugguaaaauuuuuccugauuccugaaucuccuggaaaaacuuguaauuucauaaguaacaaacagcccuccauuuuaugacccuaucccaagaacacaccauguaugaaagauuucucugaggaagcuuaaaggucaggguggcguucuacccaaccucuaaugagcagaguuuaagcacugccagcaucuuguguacuuccggauaaagcuuggaaggcugcucaccugugggccauguuugguuuggcaaggccucugcuuuugacccaacuuugcagcccuagguaaauuaaauuacauuuugaucugugcccacugaagaccaagaaguagcuugcagguuaacauuauggagaagguuauuaacuuuuuguuaauuauuacggcaacagacuccacaauuccuugguagcagcacuuuguaguuguuaagugauauugcucuaagaaacgggugucgcuuuucucuaguguuugucaaaugcacauguucugacaguaaugauaguucagaucuauuuugcugggcaucugccaggggugcccaguggguagcugaauccagaggcacuggaauuguaaauacaacagacaaaucauuugauggugccagacuaaggaguucagcuuuggcagauugccaggagccguugauugggcucagauucagugcuaugugucuguuugccaagcaagauuaguugucuugguuaauuauacauagaauuuguacccccuuucucucgauuauuuccaucuuaaaccgguaugacauuuacuuuaauuuugcaucuuguuuugauauugauuugugggugaguuucugucccuguuuuuggugagucuguagugacuacguuuuccugccccgguccuaacacaaucccagccuuacagacccuggguuugcugguguauaaugcaggcuuucacaucuuguauuggauucauuugguaccuuguuacuuaguguucuccguguucaguacagugucaauaccuccuuauuaaaucaagcuaauuuuugauucuuuagaagguacaaugauucucaaguucuggaguacaugugccuaucuuauauuaaacauuaguuuuucuuuacaaaaugaggccaaaauacuuauuguugccauacaaaaauaauuccagaauacaaagaaucaaauaauaugauaguaaccucaauucuuugucagugggaagaaaacaaaaugaaaaacucaauuccaggugucaauaacaucuauuuuuuauucuaaugugagacccugaaguuccaucuuuuugaaguugucaggauaauuucauuugagcauugcuuggaagcuguaaggauauacuguuugggacccuuuuauuuauuuuuauagagaugggguucugccauguugcccaggccucccaaaguacugaaacuacaggugugagccaccaggccaggccaacaaaaccccuuuuaaacacaaaauauugaagauucaggcaagaacaugcaguauugcuagagaagggccuauugugcuuucuuuguuuaguuuuacuuuuuagguucacuauagaaccucaaguugucuuuuuuuuuuuuuuaacuaaacuuucuuuccuuucuuaguagaaaaauccuugaggggcccuuucuuaguagaaaaauccuugaggggggaaguuuuuuaaaguaacuuacuguaaccauaaaucacuugccguugguucuuguucuuccuguaauccauuuuauguacuuuugcuagaguguaguagucccaauuccaauucuaaucauguagucucugugcuuaaaacaaaauaauccaaaaauccaaccaugcuccuucuucauuaucuacuauacaacacuguaaagacuguaaacuuagccagcuuugacagcccucuacaucugaccacaucugaccuuucuacacuuaauuucccaccacugccuuccuuuccucccagucccugaaaugcuagaaacuaauuugccaggcauaaugagcuuccccauugucuuccacucaucaaaaauccaucucuaccgccuucuagugccuguucccugaagucuucccuucugcuccccagaacucugucguggcucaauccaggcugcccaguacauggauuuauugggcuguuuaugcuguccaccgugugcuuagaaauuccuugaaugcagagacuguuaagcuuuguauauacuuuuagugccuagaacagucccuuauacuucauaggugcuuguuggcuuaauuucaucuucaaaaggaacuuugauuuugauggauauuugaauguuaaaaaaaaagcuagaauuuuuuuugggggggauagaggggaaugacgggggaagauggguggcugcagcuuagucucuaauucgaugccuaaguauuuaaauauuuuauuagagugacauguuaugugagaccaucucaauggaggaccuuagcuuuguaaguuuuuuuuuuuucucaguuucgaaauccuagguuucacccuagaaauacccgagucacaccuggauccuggcagcucauaccuacaggucuggcucagagacgccagggccacgaggcuuagggccccagguucugguccuagcucagccccuggcaaguuucaugguccuccauuuccacuucuuuauggaugaguuagauacuuguuuucauuuuugaacuuaaauuuggucagcaccuaccacuugacacuaggauggacacuucagauuuuauuucaucuuccuaugaucuugggcaagucaguucucugagcccacuuucaucaucuauaacauaggcacaauaauacuguaugucuacuucuaggauuauaaggaauuaacauugagaugacauuuccauuugagaaggaaaauaguugcuuucagugccuuuuauuugauuccuggagagagcagacucgcaccgacauucaaccccagcgcugauaugacaguaauccucagaggcagagcccagcacaaaacagcaaugcuagaaaguuacaauuggaaaguuuccugccagcuucgggaaugacacugcaaagcugaugccagaaacugccagaguaauucuccucauuacugcucuacccacccacuuucagcuccccaaauuaacuagugcaguugacuaauuccucuuuaccuuuaucauuuagggugaggcauugcacaaaaacucucgacuuugccauauaagggcugugguucucuguggucccuggauaagaggcaucaccauuaucuggaaacaugcaguaaaugcagauucuucaucuucuccccagaccuccugaguuagaaauucacaaguucuccaggugaucucauacaugcuaaaguuugagaaccauugaguaaaguuaaugcauuaagaagagauuagauagggaugguggcguaucuuccuacaguuucccuguuaacaagaaagucagaggucaguugaucagacauuagauuauuuauugcuaaaacuaaaaaaaaaaacaaaaaacgauuuuuaguucacauuuauagccuauuauuuguaccagcauauuuaauuuuccagaacuagaauugaagcaaauuuuggaaccaguucccuccuguuauggugaauggaggugaaugucuggccuuuggcaagacaacugcauuugaggccuauguggacccugcaggggcuacagagauuuuauggugggcuugagguugaccugcacugggaauaaccaaagcaaagacaagaugacuuggacaaguagggucaauuuucuuggccucuugccuuuguuaaaauucccccuuuggaucuuugaguuuacagacugaauaccaagcacacucuuuuaaaaaaauucuugcaauuguuuguauuuugugauuuuucuaucacucuggaagggugauaggcaaggaugagguagguggagucaaauauuucaaguagaaccaaagaucuuaguucccucaaaaaugaggugggggugaauuugcuaaugucagacauuagauaaacugaguugguaaagcacgucuuaagaccucacacucuucagccagaccaacuggguucaaaaaggcaaguuaccuaagcucucugugccuccauuuccucaucgguaaaauggagauaauguuccuacuucaugcgguuguuagggagugugaaggagguccgauuugugaagcacacagaacaguguugggcacauaguaaaugcuuuacaaauguuuguuuaguaaauaaauauagccacugaauuucaugaguucuaaucuacgcuaacuugcugugugucauuucuuucauucagcagaucuguuuuuccaagugcugaaaugcauauguagguuucuccuguuuuaagauuguuucggccgggcgcgguggcucacgccugcaaucccagcacuuugggcggccgaggcggguggaucacgaggucaggagauagagaccauccuggcuaacaaagugaaacccagucucuacuaaaaacacaaaaaauuagccgggcgugguggcgggcgccuguagucccagcuacucgggaggcugaggcaggagaauggccugaacccgggaggcagagcuugcagugagccgagaucgcgccagugcacuccagccugggugacagagcgagacuccgucucaaaaaagaaaaaaaaaaaaagaugauuguuucaaggcauuuuucaugacauuuugauugguaacuucguuuuuucauauauuauccauuauuaaagucuugucuuaccaauuauuuugaguuauggauucuuuaaguacuuuaggauuaaguucagaugaaaauuucaaauauuccauucucugaugagccugcagucacaaguauuccuugucucuguuaugcucaaagccuuuagagagccauaggugauguuuuauuauucugauaaggcuguuuucucauaucaaaggaagucgaauauuauguuucucuauagaaauaccugugauaacuucuagguccauaggguaacuucuaggguuaaugacuucuaccaaggacuuggagcggugugacucagggcacacacugcugcucaccuucccaguaaccaggaaauuaaacaagauaugugcaaaaugccaccgggcuacaugaauucucaggaaacagcagcuguuaauauuuggggaaaggcaucagaaaggaaaugguuaaaugcgucuugauguccuuaucccugggcuggacugaccuuugcugauuuuauaauugugaggaagcccgguugaaaacauuucucuggugacugggguagagaugggggagggggaugguucccaguguccguucccagcucaggcugccuggcggugugcucgggugugggcuggcugccacccucacgcagcgcacguagcccugucacucagccaucacccugcuggcuuagagccaguccuccacgggaagggcggccugcccaaacccaaacacccuguauuaauauggcgauguugccgggccuguuuacugugccuaauugcaugggcucuggcugaauccccuccaaggagaagaauuaaccacaaugcagaaaggaaugacaauagucucuuaaauuccuggccucugagccuuucaguggcuucuugggggagggcgauucacucagaaggucgugcaugaaaugcgggaucuccuggaauagaaucuugaucccgcacaguucaacuuuagaggccuuugaacccccuagaauuucgugcagacuucugugugugcgugcauauuucuuacauccuuuuaauguaagaaucucaaagggcuauugugccugguagaacuaucaucacugacccaggagaacuagauggaugcuuccacgcucuggguaguuaaugauccugaagcuaggaccaaguucaucugaggacagguuuuaaagugagaaugguaaauucucugcuauucaggcacggugcucucaccuggccaggagggugugggcagacccacuucacuagagcaaccgagagucgguuauuacuucuuauuuuuuauuuucagaaguucugaaguuucuacaauauuagaaaauucagguguagguaugugaugaccguuguucuaccuugggagagaggucauguguagcaguguucuggguaaguagguucugcgagaggaauuauuuuuaguguggauuuaggacaaaugaggagggcagaaguagucugcauuguggaaguagaguaguaaaaaacauuuucaugaauaauuugggguuuauugaaaggauuaccuaccugacagguauuugucugguauucugaaucuuccaaauggucuggugagaugcugaagcuuuggaaaggugaacacgguggcuggacacagcuuguguuauggcccaccaaaaguguauuuucucuuucccccucauuuuauuacaucagucuguaacuagaggcacuagaagucaggaaauagaauagcuaggcuugcucuuaaccaacaacaaagaugaccagcaagaugccaagguaacugaugacaguuuacacaaaauuucuuacuuuucuaagagcucacguuugcuuacaacuauuuucuucaugcccgucuaggugaaguuugaaugucuaaaaauucuaaagcacuuuuaauacuuacaaguuagcacugcuucaucaucacauugagaccuuuuuuguucaauucuguauaaaggauaagaccagcuggcagcaaaugugaacuuuugcagugacauuuucuuaaaacuuggagaaagcuuugcauaguugccaucgucuuguaaagaggcccugugaacauuguucuguaggaauuuaauuuacuugacaacaguagaucccacaaaauguccuugaagaucacauaucccugaacaagggagaugauagaagguugaaguaguaauuccaguuugcuuuucauguccuccggauuuaaguugcaaaugauuuuuugaguucuuuucucucacuccuugucagagccaaguggaaaauaauggaauuggacauuuuggcuuaauuugucuuuagauuuuuuuuuuuuuaaauaaaacuuguaaagggcaugucucuuucagguuuuguuuuuuuuuuucuccagccuuuccuccaguaugccugcauauagcaguuugaauaccuaaacguuuuuuugguuuuucuuucuuuuuaaauaggagaauuucagaucuagagcugcugcuagcacauauagugccuuuguuccagcuacuaauccccuuuccccucccucagaugaauuaccaaauggggccccuacaucagcagggugccuugaugaaggcaggaccuaaaguaugugaucauggggaugcccugcucacuggccacagucaaggcguguguuaaaauaugugcugaacauaaaccaccuagaaaaauagcccuggaaguguagccuucagcuccucuacccacagcugacuaaaaacauuggcaaguuugucaccuaggcuguugucacccgaauauaaaugagacccauuucuggccagaaaacuucagcuaucacagucuacauugugaugaguugcuuggcuguuuuuccaagcaaaagaaggugcauggucucauguauuuccucccaacucuuauuuauuuauuuauauuuuuugagacagcaucucgcucugucgcccaggcuggagugcaguggugcgaucucggcucacugcaaccuccacuucccagguucaagcaauucuccuccucagccuccugaguagcugggauuacaggcgugcgccaccaugcccaacuaauuuuuguauuuuuaguagagacaggguuucaccauguugguuaggcuggucuugaacuccugacauugugauccacccaccucggccucccaaagugcugggauuacaggcgugagccaccgcgcccagcccccaacucuuuacacaucuaguugucuguguuguugugccugugucguugugccuuaugguggagaagggaaggauccugggccucuguugcucuguacuggguggacaugggggaaggacuugauggagcgaggugucaggaugcaauuggaauguggauggcauucaggaugaggcauugucuuuggauaggauguguuugagucugguggagagagauggggaaggugcccacucagcagcugucucaaaguagcuuuacuucuuggaaguccucacacagugaucucaaaauauagccugauauauguguguguauauauauauauguguguguguguguguguguguguguguguguguauuuauuuauagcccugauuaaaaaauugggaucaacaauauucaggagaguuuacauaaagaucugauugccugcuacucucauaaaaucugaagauuugcucucauugaaaauaacagcaaguccccucaguguagguggcauaacacacaccagaguucugacucauguauaccggauuggcuucaaucauuuguuacucgcaaacaucgaaagcuauuuuaguuugccaguccuggguucaaaacuacaaaacacuuaaguagaauugggucucugaagaagagacguucuacagcuucaguugaggggaagacaaacauaacacaucaucuuuaaaaauagcuaacauuuauuaagcacuuagugugugccaggccgugcauuaagcauuuuacauggauuaucucccugagucugcauaaacccauuuuacagaugaagaaaccaagguguaaaugagcuaaaugcagauuaucccguacuuagguugcauuuuauucaaaguacgcuuugcucaagaccaugcuuaauucaaaaugaauccuuacaaagguuggcugguauuucuacuuagcagcuggaggggaucuagcauuugucgguagaucagaauacuaguuuaaagcuccuucaaccagauaguuuugaaaucacgcuuuucucaacaaaucuuaaacaauggauuuucauuuauuggaaauuuugcaaauaaaaugagaucuaauuaguacuuuaauuuggugaguuaaauuuuguauaaaaugccacuuuauuauaacuuguucaagaucgagucauacuagugaaucugucucaaaucaugagcaauguaaaauacauuucuaugaaaauacauguugcaacuguuagcagagaagugguaacggcaggguggguguauccccuucucaccugugggucugaaaaaugaucaucauugccuaguggaugguggaggucacugaugccaaguuuuugaaaugguuuuuacaugcagucaagcugcgguugauggcauucaagagcauucuguuuaggcauuggaauggaaauccuggacuuuuauuuuucaacuuuaccuuuggacuugaugagauagguuuuuuuuuuuuuuuuaugaagucagcucacugguaacucuuaacagaaccacuguuuccuuuuccaccuguggcauuuggggaccacuuuuuuauacuggguuuugacuguuacgguucuauauaucuguguauaucuucaaaggauacauauacguuuguugucuggacauggcugcauacgugucuagagcacauauucuggucuagagccagccugggccggccugauucaccucuccacucauuuccuauugcuacagagcuaaggagaggccucugggaauggggauggugggaggugggguggguacacuauauaaugucaguggacagagcgguaaauguguaaggggacauguggauuuaucaguauauccaagaauagaacuauaggacuauacuguaugugcugcuguagaugacacuacuguguuaaacuugcguaaacuucaaauauuaaucuagucaggaaguuuuagaaaauaaaaagccuguacuaaaguaggcauccucuugauaugugucaguuuauugcuuggcauguuuguuauaugaucauuaaauuacucuggcccguucuuuuaacaauaaagcauugaagacuucucuucuguuaaacacuaaaucccuuccccggcuugaugagguuuagauagcaacucaguuggacugaucuguuuccggaguuuguuacugccccgugcacaaauuggcacagaagugaauggcuaguuauugaagucaggcuugcuucucggugcauccuuagccucaugguuuuagacccugucaaagacgagcaaauaguugggaaugugcccaagcaaagacccaucuccuauggcacucauccagaaaacacacugauaaaauuggccaaauguagccucaacuggcccacugaugcucgaaaugauuuccuuccauuguuuccaacuugaugcaugugguuucuggaaccaggagagagggugaauguucacucuggccagaaaaauuaucucuuugccucccucuuaagcagucggauacuuugcugacauguagggguuuuguccuaauaguaaguccucuggaauuggcuuugucucuguguguuuuauagaugcggcauuugguagaggauuuacuuuugugaguuuguauccaucuuuuuuuuuuuuuucaauauuuuaaucugagcugaguucugaggcagagaaacacuccuuaaugaccugaagaacuauguugcuuuuucaaggguugaugcuuagaucaagucuuagaucuucuugggccuuugacagcugcguaacccaauccccucuuuauaggaaagagacagccugggaucacaguuaguugcagagugaacuauggcaggcauccagaccacugaccuuuuccuuagagaagagcuguuuaagcauauaagauuauagcauugaugucauacuuuuucuuuucagacacacucaguggggggagccugagauaauagggaauccagccuguaauuguuuguggcuuaagcgacuuucauuauuggcucugugguggcucuuauaauccuaauagcugcuuccagggguggguaauucuuuagucauuauaggugacuuuauuugucucuucuucucuugcuaggcccaucaauucuguuugcuaccaaucacccuuccucaagccaugcuuugcuuagugguaccaucauuuguuaaaucuucauugcugacgucgccucacaguuucaccuucugaaagauguucaagcuaacagccuaacuugagcucuaaggaugacaucacauugacauuuugauguucaaaggcaggauauggggauuguuugcugcaugaggauaugaaguuugagagagauggugauuuaagcuuuaaaauuguuguaaaguccaguuacuauucagccuuauuauugaucuggcaugcaagguguguuuugccuaguuccguguuuucaugcuacuauugagagugacucggcagccacguugaagcugauucauugaaccacuagcccauuagcuuggggcucuacucaaacggucauuuuaccaaugaagcaacgcugccauuuaucaggaaauauauggccuggaucuuuacauguauguuugaagauaggucuuuuaaaaugacagaaauagcuauugaucuagguaaaaugugaacuuacucuuuagagaaagagccauucgcuaguucauugauuuauuuaucacauuuuagauggacaccuucuguaugucaggcacuguccuaggugcuaagaauacaucagugaguagaacaggaaaaaaaaucccuguccucaucuuguguugcugguucuaauauuuuccuugcaccuacugcaucccuauaaaaaauauuuuucaaacauggcgguauccugugaagaaaagaacuggcuuucuauacuuugcuuucuucccccuccccacucuguguuauaauuuuucccuuggaacaauuagaggucuguuuacucuaaugguaauuuucaguaggauuuuugguacgguuuucuacuuuauucuuccaccugguugauacagguagcacuuagacaaagagaacuucagauuaucaccugauuacauaauuaucaggaagaagacacauauuaagauacaugcauggcuuuuuuccugaaaggaaucucccuguguugucuguguuaacaaguuagggugcggcuuccuauugaucuuccucuauucuuucuauccugagcauuuuauugaguaagccugaccuuuuccuccuuuggugauuaguucugucacuuuguguaugcaaauaccuuuagccauuguucugaaacagugugagugauucagcagcacuugcuaaacagucauaaucccuaaacuccacaccuagugacucugauuuuguagcaugggaaacuagaaacugcuuuuccaaaaaggaguauugaagaaaggcagggcauacaaacagguuaugcaaacagggcaugcagauagguuacuuuaagaaagacuguguaaaauguucuagaacugugggaauauuguugaacuacuuuccacugggcagagccauaguaugaccuggccauugugcacagaagaguccaaauuuauguaccauacaugaaauuaagaagccagcaacuaccuguaaaugucacguaacacccaaggagacuguguuacuuaucugcucaccagugggaggagaagauugucugucucagcuuuguuaaccagcuuucuugggauuucuccauaggcaaugguggcuugcuauccgggaaauggaacagguuauguucgccacguggacaaccccaacggugauggucgcugcaucaccugcaucuacuaucugaacaagaauugggaugccaagguacuuuugaauaaugggaguagagugugggguuagaaacuacaggaaaaugauucagauaacuuagaggagaguuuauauugaguucauaguugccguaucucccacugaugaaacauuucuauuuccauuucauaaccuccugcgacaauggaauuaguccuaaaguuguuaagaagaaaacaaugaaguuaauuuggagugggguagguagggugauuauuaacccuaccucugggaagggugguugaugaagggaagguaauuugauauuaggauuaaggauuaauuuuuuucaguuuaauucagaguuguucugacucaaugcagaauaggauauacacuuuucccucccagcagcagcauugagaaaguuccacaaaaauagaacuguaggcuauaaaaccauccccaagagagauuucccacacaguccucucccucggggugguaugucucauugauggcugcuugccauggcuuacuaugguuugugaaugccaaaggcuuuguggcuuauuuuuguauuauagaacuuauagauagauggagauaugaagccugguuccaugcuuacagacauucaucuggacucuguaugcuuuccgaaaguuaagaaugauuuaggagucugggaagucagauaacuuuucaagcuuauuuggcuuuugaaccuucugcaucucaauuuccuguucauuaggcaaauacuggcugucauaaagcaauaauauuuauccagagucagaaaaacgaaacuugggaaaccauugaaucagugaaaaggccuaucucuucucccuguuugguaacaugacuggaauacauccauuaagucuccuuuaaaaucuugagaggugcugauagagacaagagaauaaaguuaucagacugguaauaauaaauugcaaggucuggaaucauuuaacaaauauuugaguuccugcuagugucaggcguuguauuaugaagaaacauugaugugugaggccugaacuuuacucugaauaugguuauucuaguaggaugaaauagguugacauguaaaaaaaauaauucaaggaagagagugguguaugucauaaaaggugcagauuagguggucugagaguucaguaaaaagagcauguaacuuccaacuaaugaggucagauaggagcuaagggaguucagaagagcuguaaauucuaauugaaggggaaguuacaugugaugauuuucuuagaaaguuguuaaugguuagauggaaccaugugagaucacugggcauuuuuuuuuaagucaaaaacacucaaauauuggcaaaucgguaugauucaaucuaauaguacucuauuuuacguccaugggcuuuaugacuguggggggugggagugcuuuuuuugguuuaaggugaauaaggagauaucucuagcuaaguuugauauaaaauuugguacgaaguggcugggcgugguggcucaugccuauaaucccagcacuucaggaggcccuagugggcggaucaccugaggucgggaguucgagaccagccugaccaacauggggaaaccccgucucuacuaaaaauacaaaauuaacugggcaugguggugcaugccucuaaucccagcuacucgggaggcugaggcaagagaaucacuugaaccagggagguggaaguggcagugaaacgagaucgugccauugcacuccagccugggcaacaagagugaaacuccaucucaaauugguacaaacuaugagguugaaguaaaaaucugggguaccaugcauuuggaguggugguuagcagauggcauguuucuaaauggagcugaaauaugguuguugauaaacuacaugagagguaagaaauaaucccccuucuuugugucuuucagcuacauggugggauccugcggauauuuccagaggggaaaucauucauagcagauguggagcccauuuuugacagacuccuguucuucuggucagaucguaggaacccacacgaagugcagcccucuuacgcaaccagguaauagccggagccaugauuccucuuccggagcuugguguacaaacccuaguuccagagaacucuuuaaacguguguccugugcaugugggggauugaccacaccccauagcugauagcaaacuuguuuggagucuacaaaaauuaaaggggaaacuuugcguucuuuagcauaucaaaccuaaccucaguuugaaaguacuauuaacaaguuguuuucuauuagaugagcauauuggauuccaauuucucaaaaguauuuuucucuucucuccuuuccucccuucucuuaucucucuuucccuuuuuuuaaaaaaccuaauguugaacuaugccuagagaauguuggcugucacauaucaggaauucugucugguuacuuuggaugaguuuacaagcugcuaauugcaagcagagaaagagccuugagaagagaaagaguaauuuguuuugacuuucucuuuuugucuuuuccuugguuugaaauuggcuugggcuugcuguauccaugguccaacaguuggauguuuuauuaaucuuuucuuuaucaugugcacaugaagauucucagaguaacugaacaccuuaguauuguuuaggaccaaucuagacaaucuugacaaaaaaucuucauucucaauucugccucucauuuaccuuugucugugucuaaagcaauaagccgggcagcauuggagggcuauggagugcagcuuauacugagacuagcauucaggggcaggaggagagaauuuugguaggaugaugauuaaacccuaacaagccuaauuaaauuaagaucacaugugcccuccuccggaagucacacagcuuagccccaaacccaguuauauauuaacugccaaaucggaaugucuucuagaugagcagggaacgaauucuaccacugaagucagcuuuuguguuuuaugggguauguaacuaaacccuguuguuuguggcagaagucuuugguuauuccccaaucucaugaugacuggccuuacagggaaaacauuagcaaauguugaugagaagucccuugaaaaaaacucaagugcuauagaaauuguuagcuacggaaguagcuaacaaucauuacaaaaugaaacuuuaaaaaaaaaccaagcaugaaauggcucccauuacagucuauccaaugaaugggauaaagcaaauuaguggggaugcaguagaaagcucuggggcauuauuauuauucaauugcaauuuugccucaauguccaaaacuaaagaaagcaagccaagaguuuuaaacauacugugauuuacauaagucguuuuucaaagcuucacucaaaugucaucucuucucuauguucucgccaccaacuugggucucccagucuuuagcagaaugacucccuucuaguccuuucuguagaggcuauguuuaccuguugcauuauugcaaaaucaccugucuccccuacuuggagccugagaucgcagaggaagaucugaucacagggucauuugaauuccuaaugcccaagauaauuucuggcacauaccuggaauuccuuaugcauuuuauuacauugaaauagaauuaaaaccagagaaguuaauuuuaaauuaaaaucagcguagacaggccgggcaugguggcucacaccugcaaucccagcacuuugggaggccgaggugggcaggucaagagaucgagaccauccuggccaacauggugaaaccccaucucuacuaaaaauuuaaaaauuagcugggugugguagcgugcaccuguagucccagcuacuugggaagcugaggcaggagaaucgcuugaaccugggaaguggagguugcagugagccgagaucacgccucugccuggcaacagagcaagacuccaucucaaaaaauaaauaaauaaauaaauaaauaaauaaauaaauaaaucaggguagacuucuaauaauagagaaaacuuuaaaacuuuuaaugugagauuuauaggacauuuguguuucuaguaguaccauuaaaucucuuuccuuauaucugcuuaucuuucacagauaugcuaugacugucugguacuuugaugcugaagaaagggcagaagccaaaaagaaauucaggaauuuaacuaguauguguuugauaauuuucugugacuuuugaucaaguuaauccuugacuuuuauucaauuuuauguaguuuuaaacauguucuguucaaucuguuacggcuuagcuuuauauauaaugacaucuugauggguuuuauccugaaaccuuggccuuagggcucuuagaaaaaucagaaacaaugcaaggggcuuccccugagaaugcccacugaauguaugaugguuuaugauagaugggaaauaguuaacuuuuuccuauuaauguuaaccagucaaauguaacauuaaauuuugcccaugauuuuuggcauauugcaaaggaaauauaauggaacccaguuaugauggcaaaauuuauuauauugggugagacugugacucucaguauaacagcagggcucauguaauauaaacugaauauaacagcacuacuccuaucccuuccaaccaguauuagaaggcagcauuucccaaaauacguugcauuaaaacacaaauccugccaauuugguaaauuccuggucccaaaaaugugggaaauguugcaugcuguaugccugucuuaaaaagagucacauugcucacuagcauauuaaauuaaggcgcuaagagauccugcaguaaggaaacauauauaauauugccuagcccauaacccauuuggacuguauaccucucaaauaccaaaguggucuccaaauugcacccaggaaaucucaguuuguuuucucuuccagauggccuacacugcuuaacucugauaugugagugaggcuacacuucauacaacuuaugcucagcauuagcccaagaggugccaaugcuggauguaaacccaaaguuccuccacagucugugaggcauaugggaaagaucccauugcaaagucaagagagaauccuuuggcagagcucuauuaggaggcuuauauaagaugggaaguguuuacuggaggcuuuuuggugacauuugugacauaaaacucaucagagcugacuccauacccucuuuauucuccuuucuguccccaacccagggaaaacugaaucugcccucacugaagacugaccgugcucugaaaucugcuggccuuguucauuuuaguaacgguuccugaauucucuuaaauucuuugagauccaaagauggccucuucagugacaacaaucucccugcuacuucuugcauccuucacaucccugucuugugugugguacuucauguuuucuugccaagacuguguugaucuucagauacucucuuugccagaugaaguuacuugcuaacuccagaaauuccugcagacauccuacucggccagcgguuuaccugauagauucgguaauacuaucaagagaagagccuaggagcacagcgagggaaugaaccuuacuugcacuuuauguauacuuccugauuugaaaggaggagguuugaaaagaaaaaaauggaggugguagaugccacagagaggcaucacggaagccuuaacagcaggaaacagagaaauuugugucaucugaacaauuuccagauguucuuaauccagggcuguugggguuucuggagaauuaucacaaccuaaugacauuaauaccucuagaaagggcugcugucauagugaacaauuuauaagugucccauggggcagacacuccuuuuuucccaguccugcaaccuggauuuucugccucagccccauuuugcugaaaauaaugacuuucugaauaaagauggcaacacaauuuuuucuccauuuucaguucuuaccugggaaccuaauuccccagaagcuaaaaaacuagacauuaguuguuuugguugcuuuguuggaauggaauuuaaauuuaaaugaaaggaaaaauauaucccugguaguuuuguguuaaccacugauaacuguggaaagagcuaggucuacugauauacaauaaacaugugugcaucuugaacaauuugagaggggagguggaguuggaaauguggguguuccuguuuuuuuuuuuuuuuuuuuuuuaguuuuccuuuuuaaugagcucacccuuuaacacaaaaaaagcaaggugauguauuuuaaaaaaggaaguggaaauaaaaaaaucucaaagcuauuugaguucucgucugucccuagcagucuuucuucagcucacuuggcucucuagauccacugugguuggcaguaugaccagaaucauggaauuugcuagaacuguggaagcuucuacuccugcaguaagcacagaucgcacugccucaauaacuugguauugagcacguauuuugcaaaagcuacuuuuccuaguuuucaguauuacuuucauguuuuaaaaaucccuuuaauuucuugcuugaaaaucccaugaacauuaaagagccagaaauauuuuccuuuguuauguacggauauauauauauauagucuuccaagauagaaguuuacuuuuuccucuucugguuuuggaaaauuuccagauaagacaugucaccauuaauucucaacgacugcucuauuuuguuguacgguaauaguuaucaccuucuaaauuacuauguaauuuauucacuuauuauguuuauugucuuguauccuuucucuggaguguaagcacaaugaagacaggaauuuuguauauuuuuaaccaaugcaacauacucucagcaccuaaaauagugccgggaacauaguaagggcucaguaaauacuuguugaauaaacucagucuccuacauuagcauucuaaug

SEQ ID NO: 17032 - RNA, 720 nt, Homo sapiens
caacaucucucgugcaacacguucuaaaggagcagcugggaaucagguuuaaaucuuggauuuucagcauaacugaguuaaaaaucccugagacaucuuuugucuaugggugccagggagagaaagcaaacaagagagaaagaaggaauucuuaguguguuugacuuaaaagcucggacggcuucuuucagaaggcacuggugugucaggcuaauuuuuuaaauguaagagaauccuguuuggggcuuucaguggguagauuuagcuauuaagaaacaaaaacaccacugguuuuuuuuaaguggggcagggugggcuucuccaaacaacaguuccuagucaaacucuuguagaaugucaauuucaagcucagucccaccucacugagagacacaggcuuucauucuuuuccuacacagcgauuuaacccuuuacuaggguaaaggauaguuauaggauaagaaaaaaaaaaucuccuuuuuaaaacaggauccaucuguuaucaaaagaucccacuuccugauggacaccuaaccaccauuuacugggggaucccuggggaggccacuguacuaagugcuuugcauauauuaucuauuccguucccccagcaccacuguuauccccauuucacagaagaggaaacagagucagagaaacugagugauuugcccuaaauuguagucauuggcuacucgagccuaggucugagcaacuaca

SEQ ID NO: 17033 - RNA, 4255 nt, Homo sapiens
cugcggcccgccgagccccgccaccucccucgggcugcagcucccggcgugccccgcacucuccgcugcccacccgcucgcccgccccuccuucuccucccagugccacagagccgaagcccgagcugccgccgcagccacagccgagggcacuaugguaagacgagcgcgcuggccgggaggccgcggcgaggcgagaaaagccccccgcacggccccgggagugaggccgccauuuuaaccugauuuuggccuccaaggugggcgcuucugcucugcggcuccgcugcucuccagccgaccggccugcccuccggccgucaggcccugcccugcugcucuuuggauuuuggggggcggggagggcccgggcgucggcgcagguugggggucggggccgggcgggcgggggcgcgagagggucugcggacugcagccgcucgcgccgccuuugcccuucgcuuccuaauuuuacuuaacacgcgaggcuuuaaaauugguacgugcugcgaacgcugugugggucagggucuggacggccuguaauaaaacccuuacggggagauuaaggaagagggaaaacacuuuuuaaaaugcuuucucgccguaaaagcuuuuacacucgaucaguuaguuuuggagugucugcaugugagcugugugugggccgugggcgguuuggaguuuacacuugauucucuuuccuuaugaggaaacgucaguggcuaggaugacuuuaaagaaaaaaauaguagaagcauuaacugaaauccaaaaguguuuuuuuaaggccagccgaguugacacaauacagaagguauuuuugcugccacuccugaagcucugacaucacccagugaaauaggaaacauuucagggaugggacaacuuguauuugucccuuucgcuuccacguccaaaccccuuuaagaaggaugaaugggcaggaugaguuagacuccuucgcuguaucgucuacugauucuuaaaaugugacaaaucugauuggacgacuuacaugguacggugcaauuuuugauguccagacuaaagugagucuucucuaggcaaacaguaauuuugguuaaaaccaaaauacguguucugaauuacuguucuguguuuauuuucaggcuucuggaguuacagugaaugaugaagucaucaaaguuuuuaaugauaugaaaguaaggaaaucuucuacacaagaggagaucaaaaagagaaagaaagcaguucucuucuguuuaagcgaugacaaaagacaaauaauuguagaggaagcaaagcagaucuuggugggugacauuggugauacuguagaggaccccuacacaucuuuugugaaguugcuaccucugaaugauugccgauaugcuuuguacgaugccacauacgaaacaaaagagucuaagaaagaagaccuaguauuuauauucugguguguaaaaacaaaagaaaaaaguacuuuuaaaaugcaaggauuauuauuaucauagucagucuuaccuuuguuuuucuuauaaaugggauucaauaauuuuuuuuuuuucuguagggcuccugaaagugcaccuuuaaaaagcaagaugauuuaugcuagcucuaaagaugccauuaaaaagaaauuuacagguacaaacuugaauauuuggggcagagaaauuauucuuuauuaauuauaauaaaguaauaggauaauguuuuuucuuuuuagguauuaaacaugaguggcaaguaaauggcuuggaugauauuaaggaccguucgacacuuggagagaaauugggaggcaauguaguaguuucacuugaaggaaaaccauuauaaaaugacagucaagugccaucuggaucuuaaggagcuuccauuucuccagcucaguccauuggaauaguauuagguuuugguuuuuuguuguauuucccccuuuccacugggcccuuccaacacaaugaaugaaggaaauaucauuuauuuaagcagccuaucagugauugccauuagacuguugaauacuguuacuuuuauauagaacccaaggaaugccuuccugucauauuuuagccaaaacaacugguuauaugccucccuugcagcaagcacuacaauguaugugaucgucaaugugaauagcuuagaauacugcaaaggauaagcuaauugaaugccuugaaaguauuauccacuggucagauggucaacuuuuuucaguauuauuuauaguuggcacuugauugcaguucugugaggcuugagcauucauacaccucaccugccuuggcaagccuauuuuagugauauggcagcacggauauaacacuaugcauuaaaagcacuuuuuguaauaaguuuaauauccuaaaaggaaugccaauuaaguuuuguuaacugugucaucaacuuauccuaguaccucaguguucauuccuguuaccugcauaucuucuuaaaagaaauagcuguuauuaaugccuuuuuguuuuccauugaguguacacuacugaauaaguguaggaguuuuauguuuaccaugugaguccugcaacacuaaagauauuuugaauaucagucaugauggcaauuucuguauaaaagagccuuaaauggaacauuguuuugagaucaaacuccccacccucacaaaaauggccacguugcaauaaaaauuguggcauauuacagaacguugccuuguuuuccuuggaaauuuugcaaaauguuaugugaaacaacuucuaggguaaaaacagcuauuacuaaucucugcacuggucauuugagaauuuuuuuuguacagcauucaugugugauauuuuccagauuuguuggaucuauuugguuuaaaaaguauucuaucuuaaggccaacuaauauaaaauaccauuguuaaagaaugguacuuuuauaaacauuaguguauuuauuuccuauguguuaauaugaagaucagaaauuauuuuuugcacuuuggcauaaauacuuuucaauaucugauuuguucucuggauaaauuagcauaguuauuuuuuuauucacauuuacauuucuaaguaguuguauaguagaagcaggaagcucuuauugcuuauuuggucguaaugaaaauaauuuguaaaauguccuuuaaaaguuuaaugauacuucugauguuucggaacagucauuucaccuacuauuucugaauauauuuugcaaauugaauuggaauaggaauugauaauagcagucuuaaacauuaguagugggauuuggcuaugguccagacugugcuccuuauagagaauuugaucugcucagugugagcgguuugcuguuagccagggcuauuuauggcaaacacaugcuuuuguaucuugucauaguuauccacaaauggcaaaacuggacuugauucuacugguaugcaaaacaggcaugcuaguaagcagucagucguggcucagaacuuaaccccauagcucagaggaaugcuuuuagcagaaaacaggaaagaaaauaucccuuaaaaauuuuuuuugaauguguggaaguaauuuuaguauaauuagauuuuuuccauauuuuugaaagauuuuucagaugugaacauuaaaaauagggauuaaaugucuaggcuuccauuuaaaauuauaugaaugguuugggaucuuuuugcacugagcaauuuuauuucaggcuuccagcugucccugugaguuauccuggacauuucgaugguuuuugguaaggccaaacucugauaagcaaaacagagaauacugacguauacuuaaccauauguguaacugauacuuggcaccauggaauuuuucauugaguuauuuccucauucuuuuaaaaaauaagggacuauaaaucaguuauguaguaucuuuuguuuuuguagcugauuccuuaacuuucuuguaugccucuaguaauuucagagauuaaauauugcuuuaaacugugauacuuugauuugcuagauugacaaaacugauacuaauauaauuaaguucaucuuugaaauacaucuuugugcguagagccaaaaaaagagauaaaauuaauaauaguucacuuguuauuugagauuaauuuggcauuugaaaugaucauuuuauuuuacaaucauuuauaaugaaucaauguuccaguuagcuuuaaaagguauacggugcuaauuaguaaaauauugaaggcaauauuuuacugcuagcuugcaaaguuaugagaguuuaaaaaauaaaauauaugaaaauauguaaag

SEQ ID NO: 17034 - RNA, 3885 nt, Homo sapiens
cuucuaccuggcgggggugcgugggggggugggggcgaagcuaaaaguuccuuugcugcaaagagccugguauaggcagaaacaccggcgcggccugcagcccccuaaccacagugcguccuuccccuuagaagucuggggaaagcaaaucccuacgcccagccaucauuuccacucuugcguuuucaaaagaucaaaaaacggaaaggaccggcagguuggcaaaccccaaagagggaccgcccaucaggucggcguccuugggaucucagcagccgacgaccccaauucaaaucgaucgugggaaaccccagggaaagaaggcucacuugcagagggacaggauuacagggugcaggcugcagggaaguaccggggggagggggccuggucggaaggacuuuccagccacucggcgcucaucaaaaaguucccuguccgugacccuaguggcucaucgcagggaguuucuccgaugaaccccagcucaggguuuaggcuucuuuuucccccuagcagaggacgaagccaguucucuuuuucuggucugacuggcuuggaaauuccccgagccugaccccgccccagagaaauccccagccagcguuuauagggcgccgcggcggcgcugcagagcccacagcaguccgugccgccgucccgcccgccagcgccccagcgaggaagcagcgcgcagcccgcggcccagcgcacccgcagcagcgcccgcagcucguccgcgccauguuccaggcggccgagcgcccccaggagugggccauggagggcccccgcgacgggcugaagaaggagcggcuacuggacgaccgccacgacagcggccuggacuccaugaaagacgaggaguacgagcagauggucaaggagcugcaggagauccgccucgagccgcaggaggugccgcgcggcucggagcccuggaagcagcagcucaccgaggacggggacucguaaguggcggaggcccggggcugggggucgucgggagggcgggacgcgcgcggccugggggugggaggcgccgggccuggagcccgagccgggggaccagcgaugcagccgggcgggcgccgcggcaccccggggcuccugcaccgccccgaacgcugcagggcugcagggccgcgcggggcaccggcccaacucggaggggcggcggcugggcccugguggauggcagcgucgccacacgcccccuccccccagacccguccucuaggccgggggcggggcggcagcggggacgcgaaguccccgguugcauaaggcggggcgggaguuucuggccgcuggcgggcgccgagcagccgggaggggaaguacagggcguuccgagcuggcgggagggcggggcggucuggccggcgcccgccggggccgcggggggaggggggcggaaagucccugggcgccugccaggaacacucagcucauaauaaccucgcggaaaacaccgcggccucggccuccagaaaccccggccuugcgcaaucccccgcagcccgcgccucccugggccccacgcggugcacucaccaccccugggguuuuucccucucuuccccacagguuccugcacuuggccaucauccaugaagaaaaggcacugaccauggaagugauccgccaggugaagggagaccuggccuuccucaacuuccagaacaaccugcagcaggugcgccgcuugccuggcccggguucucucugacccugggacguagcugauguagcagagucaccccagauccuuucugaauucagggccacugagcacuauuuacccucaccuuuuacuucacaucagcccacauccuagagagugaaggaaauuccacugauuuggugaggucuuuaugacccaccuggagccucugcuauuugccagcccuccccaccccccugucuaggaggagcagcacccaaccaggagacacggguugaggggaacucgggguguggguuugguccauggcuuacuuucucuggucucucuugcauucguagacuccacuccacuuggcugugaucaccaaccagccagaaauugcugaggcacuucugggagcuggcugugauccugagcuccgagacuuucgaggaaauaccccccuacaccuugccugugagcagggcugccuggccagcgugggaguccugacucaguccugcaccaccccgcaccuccacuccauccugaaggcuaccaacuacaaugguaugucugccucccugcccugccccacccccucggagggcaggugacguggagaaggggcaggugggccaacuuaaggaguccaggcaagagcuuaaacuccuaacauuuggaagguugagaaaauaugugugcaaagugccuauuggaugccuuuauaaaguucuuucagaacccagacuguggguucuuaaaauucagaagauaagacuacuuguuccauaaaagaauaggugaaaggagugaggguugaaacaggugguuauacuuuuuuccuuuuguucuuccaggccacacgugucuacacuuagccucuauccauggcuaccugggcaucguggagcuuuugguguccuugggugcugaugucaaugcucagguuggugcuuccugcccccgacgcacugagucaggcuccucgugcuuauguugugagcagaaauuccaaaugcagccauaagcaucucaaauuccuuuugguuucaggagcccuguaauggccggacugcccuucaccucgcaguggaccugcaaaauccugaccuggugucacuccuguugaaguguggggcugaugucaacagaguuaccuaccagggcuauucucccuaccagcucaccuggggccgcccaagcacccggauacagcagcagcugggccagcugacacuagaaaaccuucagaugcugccagagagugaggaugaggagagcuaugacacagagucagaguucacggaguucacagaggacgaggugagucugugaacuccuucggcgcucuaacuaaugaggugccauucccuucacccucccaggccccuagagcugcuccuuaucagagggguaucuacauaaugagucucucaaauuucugugcauaaccaguaucccaagaauguaccugcccccccucuuuuuuuaaagagaagcauuaaaggcaaacucucucagccuguaaaguucauuauauuugggcuauggagaauggaguccaagaguuauuuccaguaguggccuccccaucccgguagcuuggcagagcuccgcuccggaagcuuaacgugucuuuuuuccccuuguuuucagcugcccuaugaugacuguguguuuggaggccagcgucugacguuaugagcgcaaaggggcugaaagaacauggacuuguauauuuguacaaaaaaaaaguuuuauuuuucuaaaaaaagaaaaaagaagaaaaaauuuaaaggguguacuuauauccacacugcacacugccuggcccaaaacgucuuauugugguaggaucagcccucauuuuguugcuuuugugaacuuuuuguaggggacgagaaagaucauugaaauucugagaaaacuucuuuuaaaccucaccuuugugggguuuuuggagaagguuaucaaaaauuucauggaaggaccacauuuuauauuuauugugcuucgagugacugaccccagugguauccugugacauguaacagccaggaguguuaagcguucagugauguggggugaaaaguuacuaccugucaagguuuguguuacccuccuguaaaugguguacauaauguauuguugguaauuauuuugguacuuuuaugauguauauuuauuaaacagauuuuuacaaaugaguuauc

SEQ ID NO: 17035 - RNA, 2351 nt, Homo sapiens
agggagaaguuguuggaucaggaaggugguaaaggcuuaaggcaguuuccccugcaugccgcuguauuugcuauuuugucuuggguguaaauucauucugaguuuagucaggguaugaggauacuuagcacuagggaacuuccacacaagagccugguacuuggcaggggaugagacauaaaugauaugaggcccuuguucuuuggcacugaaauuaggugaggagcucaugauccuucucagagggggccuaagcuguauccaccaacggaaaccacauggagagguagauccuuuccccccuacggucuaaggucuugggaaucauuuaggaaaaaggaaaacagaaucagagcugcuaagagauagauucauauuacagaguaaggauuuaggaagcuuguuccugagcccuuucuuguaagugcuaaaauaaugccuuucucagacuuccuuuuagagccucuauuaucuggaguaaaacaccggagugcuuggaugaguauuagaaauugagauuugucucugaggcuauuaguggggaacgguaccacaaaaauauaguuucugaaaguuuuucuuagguugauuuuuuuuuuuuuuuuuuuuugagacaggaucucacccugucacccacgauggcgugcaguagcacgauuauugcucacugaagucuugaccuucugggcccaagcaaucuuccugccuuagccucccaugcagcugggauuacagacaugugcuaccacaccuggcuaauuuuuguauuuuuaguagacaugggguuucgccauguuccuggccuccaacuccugaucucaggugauccaccugccucagcuucccaaagugcugggauuauaggcguaagccaccacaccuagccuggccagguuuguuuguuuauuuauuuauuuauuuugacacagagucucgcucugcuccccaggcuagagugcaguggugugaucuuggcucacugcaaccuccgcuuccuggguuccagugauucucaugucucagccucccuaguaacugggacuacaggcgccuaucaccacgucuagcuuauuuuuguauuauuuguagagaugggggguuuugccauguuggucuugaacuccugaccucaagugauccauccaccuuggccucccaaaaucugggauuacaggcgugagccaccgugcucagccuauuuuuuucuuuucuuuucuuuuuuuuuuuuuuuuuuuuuuuuuuuuugagauguugucucacucuguugccaagcuggagugcaguggcgugaucucggcucacugccaucuccgccucccagguucaaguggcucuccuacuucagccuccugaguagcugggauuacaggcacgcaccaucauucccggcuaauuuuuguauuuuuaguagggacaagguuucacaagguuggccaggauggucucgaucuccugacuucgugaucugccugccucagccucucagaguguugggauuacaggugugagccacgguugcucggccuauuuuuaaccacugaaagcaaaugagaaacagagugagaaggaucacaaauagaagccaugagcagaaaaaaagggagaaauuggccuggaacauuuuuucuuuguuaccaggugucagcugucagaguccagucccaugacugugacacaauccauuuggauaagccacuuagcuuggcuuaggaauauucaucauuucuuauaucccagggcuguucauaggcuaacguguagugauuauuuggccaaaaacacugauauuuucagaaagugaagcagauuaaugcaucaccaaaucuuuaaaugcuaauauuugaaaauugggccaguuuggaggagugugagaaaagagggaauggggugccccuguacucauugauugaaacucaagaagcuagguggaaaugggugagguugacagcacagguauggguuuugcuagaaaucuaaaugaacaucaugaauagagaguagggaagcacacagauaacccagucucgauguuggcucuuccgccuuuagggaucagguucaucuccagguugccagggcaucaggaaagcaccucgcuggauuucagggcaggaggaggggagucacaggguaaagggaagaggcuacacacagagcaggagcaggggcuaugggaguuagggagggagccgagggggaauuuucccuucacaaauggcagggcagaacaccaacaugaggaacacaguauaugcauggugcugucugcagugacaucuucuggccauuuguggaagaaguuuucucugaggcaucaccgauucuugagaagaggaauuuaggaauguuga

SEQ ID NO: 17036 - RNA, 2351 nt, Homo sapiens
ucaacauuccuaaauuccucuucucaagaaucggugaugccucagagaaaacuucuuccacaaauggccagaagaugucacugcagacagcaccaugcauauacuguguuccucauguugguguucugcccugccauuugugaagggaaaauucccccucggcucccucccuaacucccauagccccugcuccugcucuguguguagccucuucccuuuacccugugacuccccuccuccugcccugaaauccagcgaggugcuuuccugaugcccuggcaaccuggagaugaaccugaucccuaaaggcggaagagccaacaucgagacuggguuaucugugugcuucccuacucucuauucaugauguucauuuagauuucuagcaaaacccauaccugugcugucaaccucacccauuuccaccuagcuucuugaguuucaaucaaugaguacaggggcaccccauucccucuuuucucacacuccuccaaacuggcccaauuuucaaauauuagcauuuaaagauuuggugaugcauuaaucugcuucacuuucugaaaauaucaguguuuuuggccaaauaaucacuacacguuagccuaugaacagcccugggauauaagaaaugaugaauauuccuaagccaagcuaaguggcuuauccaaauggauugugucacagucaugggacuggacucugacagcugacaccugguaacaaagaaaaaauguuccaggccaauuucucccuuuuuuucugcucauggcuucuauuugugauccuucucacucuguuucucauuugcuuucagugguuaaaaauaggccgagcaaccguggcucacaccuguaaucccaacacucugagaggcugaggcaggcagaucacgaagucaggagaucgagaccauccuggccaaccuugugaaaccuugucccuacuaaaaauacaaaaauuagccgggaaugauggugcgugccuguaaucccagcuacucaggaggcugaaguaggagagccacuugaaccugggaggcggagauggcagugagccgagaucacgccacugcacuccagcuuggcaacagagugagacaacaucucaaaaaaaaaaaaaaaaaaaaaaaaaaaaagaaaagaaaagaaaaaaauaggcugagcacgguggcucacgccuguaaucccagauuuugggaggccaagguggauggaucacuugaggucaggaguucaagaccaacauggcaaaaccccccaucucuacaaauaauacaaaaauaagcuagacguggugauaggcgccuguagucccaguuacuagggaggcugagacaugagaaucacuggaacccaggaagcggagguugcagugagccaagaucacaccacugcacucuagccuggggagcagagcgagacucugugucaaaauaaauaaauaaauaaacaaacaaaccuggccaggcuaggugugguggcuuacgccuauaaucccagcacuuugggaagcugaggcagguggaucaccugagaucaggaguuggaggccaggaacauggcgaaaccccaugucuacuaaaaauacaaaaauuagccaggugugguagcacaugucuguaaucccagcugcaugggaggcuaaggcaggaagauugcuugggcccagaaggucaagacuucagugagcaauaaucgugcuacugcacgccaucgugggugacagggugagauccugucucaaaaaaaaaaaaaaaaaaaaaucaaccuaagaaaaacuuucagaaacuauauuuuugugguaccguuccccacuaauagccucagagacaaaucucaauuucuaauacucauccaagcacuccgguguuuuacuccagauaauagaggcucuaaaaggaagucugagaaaggcauuauuuuagcacuuacaagaaagggcucaggaacaagcuuccuaaauccuuacucuguaauaugaaucuaucucuuagcagcucugauucuguuuuccuuuuuccuaaaugauucccaagaccuuagaccguaggggggaaaggaucuaccucuccaugugguuuccguugguggauacagcuuaggcccccucugagaaggaucaugagcuccucaccuaauuucagugccaaagaacaagggccucauaucauuuaugucucauccccugccaaguaccaggcucuuguguggaaguucccuagugcuaaguauccucauacccugacuaaacucagaaugaauuuacacccaagacaaaauagcaaauacagcggcaugcaggggaaacugccuuaagccuuuaccaccuuccugauccaacaacuucucccu

SEQ ID NO: 17037 - RNA, 3158 nt, Homo sapiens
ugcuacuaccagcaccaugcccuaccaauauccagcacugaccccggagcagaagaaggagcugucugacaucgcucaccgcaucguggcaccuggcaagggcauccuggcugcagaugaguccacuggugcgggcaggagacagaauggguggagggugcaggguugggaguggcaggcugauccccuaauucccaugugacacucccagggagcauugccaagcggcugcaguccauuggcaccgagaacaccgaggagaaccggcgcuucuaccgccagcugcugcugacagcugacgaccgcgugaaccccugcauugggggugucauccucuuccaugagacacucuaccagaaggcggaugaugggcgucccuucccccaaguuaucaaauccaagggcgguguugugggcaucaagguaaggggagggccuccggacgugagguuugagauggaaguggaggaaggaaauccagguuagugaggcagggaaugaaugcuggauugguggccuagagacuugcauggagccugcuucaggcuuagggcauuuacucgacauuuuuaauccucacaauucugagagaacaguaucauucccacuuuacacaugaaaaucucagaagcucagggaagugaaguguuuugcucagaguaaguggcagagccccagucugacacccaauucacucaacauuucuguugucaaauaacaucccaguguauccugucucagaggauuguuacuaagugaacuaagugaaaauauuuuaauuuaauuguaacuaaguauuugaguaacuaaacauuuuaaguaaauuuuuuuuuuuuuuuuuuuugagauggagucucgcugucucccaggcuggagugcaguggugcgaucucuuggcucacugcaaguuccgccucccagguucacgccauucuccugccucagccucccgaguagcugggacuacaggcgcccgccaccacccggcuaauuuuuuuuguauuuuuaguagacacuggguuucaccauguuagccaggauggucucgaucuccugaucucgugaucugcccaccucggccucccaaagugcugggauuacaggcgugagccaccaugcccggcuuaaguaacuaaauauuuuaauuguaacuaagugaaaauauuugccagcccugagaugcaguuuaagggauuaaguaaaugugggggaagacuggggcuaaagaagaggaaagaggggcacgcccagcuaccuaggaggcugaggcgggaggaucacuugaguccaggaaguggaggcuucagugagcugagauuccaccacuguacuccagccggggcgacaguggaaagggugcuagaggucauuuccugugucuuaauguuguuacccugaccccaacagguagacaagggcguggucccccuggcagggacaaauggcgagacuaccacccaaggugagaacuguuugauucucugcccuacgaacccaaccagagcagguuugggugcugggaggaguggaaaccacaugccccuccccaccgugcucugaccccuuccucuucucuuaggguuggaugggcugucugagcgcugugcccaguacaagaaggacggagcugacuucgccaaguggcguugugugcugaagauuggggaacacacccccucagcccucgccaucauggaaaaugccaauguucuggcccguuaugccaguaucugccagcaggugggccugcagguccucaauaggcaaccuccuaccucauuugguuccaguguuguuaauuugccuauuaccugccaugaugccuaccuccccaaaagcaagcauuagcuuuggcccguggaggacacucaagggcuguugaaggcagaggggccaaggagggaugguggguggaucugaggcggcucuugucuccuguaaucugagggcuuugaagccugagucccuggcaucaucaagauacggucuugaccaguggcuguggagagauguaggugggacucuggguuaggaggccucacagugacccugucccucgcccugcagaauggcauugugcccaucguggagccugagauccucccugauggggaccaugacuugaagcgcugccaguaugugaccgagaagguaaauggcuaccugccugaccagugcaagguggcuggccggggacccuggggcuaaccccuauccucuccuccaccccacuacccaccgugcgccugcucugcuccaggugcuggcugcugucuacaaggcucugagugaccaccacaucuaccuggaaggcaccuugcugaagcccaacauggucaccccaggccaugcuugcacucagaaguuuucucaugaggagauugccauggcgaccgucacagcgcugcgccgcacagugccccccgcugucacuggugaggcccacacucaucuugaucucuaugcaguagauaagcuccacccacaacccuaugcccauuuggacggauuuccauggcaacuuccaccagcuccugccagcuuccugggucucugaccacagccccucucgccucaccccugcucuacagggaucaccuuccugucuggaggccagagugaggaggaggcguccaucaaccucaaugccauuaacaagugcccccugcugaagcccugggcccugaccuucuccuacggccgagcccugcaggccucugcccugaaggccuggggcgggaagaaggagaaccugaaggcugcgcaggaggaguaugucaagcgagcccugguaaggauaggcaggaggugggcagggugccuggguggaugggacucggagaagagcccuucucacuccaccccucucccugcuuaggccaacagccuugccugucaaggaaaguacacuccgagcggucaggcuggggcugcugccagcgagucccucuucgucucuaaccacgccuauuaagcggagguguucccaggcugcccccaacacuccaggcccugcccccucccacucuugaagaggaggccgccuccucggggcuccaggcuggcuugcccgcgcucuuucuucccucgugacagugguguguggugucgucugugaaugcuaaguccaucacccuuuccggcacacugccaaauaa

SEQ ID NO: 17038 - RNA, 3158 nt, Homo sapiens
uuauuuggcagugugccggaaagggugauggacuuagcauucacagacgacaccacacaccacugucacgagggaagaaagagcgcgggcaagccagccuggagccccgaggaggcggccuccucuucaagagugggagggggcagggccuggaguguugggggcagccugggaacaccuccgcuuaauaggcgugguuagagacgaagagggacucgcuggcagcagccccagccugaccgcucggaguguacuuuccuugacaggcaaggcuguuggccuaagcagggagagggguggagugagaagggcucuucuccgagucccauccacccaggcacccugcccaccuccugccuauccuuaccagggcucgcuugacauacuccuccugcgcagccuucagguucuccuucuucccgccccaggccuucagggcagaggccugcagggcucggccguaggagaaggucagggcccagggcuucagcagggggcacuuguuaauggcauugagguugauggacgccuccuccucacucuggccuccagacaggaaggugaucccuguagagcaggggugaggcgagaggggcuguggucagagacccaggaagcuggcaggagcugguggaaguugccauggaaauccguccaaaugggcauaggguuguggguggagcuuaucuacugcauagagaucaagaugagugugggccucaccagugacagcggggggcacugugcggcgcagcgcugugacggucgccauggcaaucuccucaugagaaaacuucugagugcaagcauggccuggggugaccauguugggcuucagcaaggugccuuccagguagaugugguggucacucagagccuuguagacagcagccagcaccuggagcagagcaggcgcacgguggguagugggguggaggagaggauagggguuagccccaggguccccggccagccaccuugcacuggucaggcagguagccauuuaccuucucggucacauacuggcagcgcuucaagucaugguccccaucagggaggaucucaggcuccacgaugggcacaaugccauucugcagggcgagggacagggucacugugaggccuccuaacccagagucccaccuacaucucuccacagccacuggucaagaccguaucuugaugaugccagggacucaggcuucaaagcccucagauuacaggagacaagagccgccucagauccacccaccaucccuccuuggccccucugccuucaacagcccuugaguguccuccacgggccaaagcuaaugcuugcuuuuggggagguaggcaucauggcagguaauaggcaaauuaacaacacuggaaccaaaugagguaggagguugccuauugaggaccugcaggcccaccugcuggcagauacuggcauaacgggccagaacauuggcauuuuccaugauggcgagggcugaggggguguguuccccaaucuucagcacacaacgccacuuggcgaagucagcuccguccuucuuguacugggcacagcgcucagacagcccauccaacccuaagagaagaggaaggggucagagcacgguggggaggggcaugugguuuccacuccucccagcacccaaaccugcucugguuggguucguagggcagagaaucaaacaguucucaccuugggugguagucucgccauuugucccugccagggggaccacgcccuugucuaccuguuggggucaggguaacaacauuaagacacaggaaaugaccucuagcacccuuuccacugucgccccggcuggaguacagugguggaaucucagcucacugaagccuccacuuccuggacucaagugauccucccgccucagccuccuagguagcugggcgugccccucuuuccucuucuuuagccccagucuucccccacauuuacuuaaucccuuaaacugcaucucagggcuggcaaauauuuucacuuaguuacaauuaaaauauuuaguuacuuaagccgggcaugguggcucacgccuguaaucccagcacuuugggaggccgaggugggcagaucacgagaucaggagaucgagaccauccuggcuaacauggugaaacccagugucuacuaaaaauacaaaaaaaauuagccgggugguggcgggcgccuguagucccagcuacucgggaggcugaggcaggagaauggcgugaaccugggaggcggaacuugcagugagccaagagaucgcaccacugcacuccagccugggagacagcgagacuccaucucaaaaaaaaaaaaaaaaaaaauuuacuuaaaauguuuaguuacucaaauacuuaguuacaauuaaauuaaaauauuuucacuuaguucacuuaguaacaauccucugagacaggauacacugggauguuauuugacaacagaaauguugagugaauugggugucagacuggggcucugccacuuacucugagcaaaacacuucacuucccugagcuucugagauuuucauguguaaagugggaaugauacuguucucucagaauugugaggauuaaaaaugucgaguaaaugcccuaagccugaagcaggcuccaugcaagucucuaggccaccaauccagcauucauucccugccucacuaaccuggauuuccuuccuccacuuccaucucaaaccucacguccggaggcccuccccuuaccuugaugcccacaacaccgcccuuggauuugauaacuugggggaagggacgcccaucauccgccuucugguagagugucucauggaagaggaugacacccccaaugcagggguucacgcggucgucagcugucagcagcagcuggcgguagaagcgccgguucuccucgguguucucggugccaauggacugcagccgcuuggcaaugcucccugggagugucacaugggaauuaggggaucagccugccacucccaacccugcacccuccacccauucugucuccugcccgcaccaguggacucaucugcagccaggaugcccuugccaggugccacgaugcggugagcgaugucagacagcuccuucuucugcuccggggucagugcuggauauugguagggcauggugcugguaguagca

SEQ ID NO: 17039 - RNA, 22062 nt, Homo sapiens
ccgugucuuacgucaucgccaagcgacuaaagcuggaagggagggggcgggguugugagcaaaucuugguggugguggugguggggcggccugagaagauaucauggcugcugccacggagcuuaaucgcccgagcagcggugacaggaaccuggagcgaagaugcagacccaaccucucccgagaggugcucuacgaaaucuuucgcucccuacacacccugguuggacaggugagagguggccugagggacugggaauauggaaaccauccggucccuccucgccauucuuuuucucuagcagaggccgggggcagcuaggccugcagaggugugggaugcggucccgaagccgagguguggaaggagcccgggcccagccuccucggucggagugaggaggacggcgguaccgguugcagagucguuuaccuugcagcuguccuccccaagagugggugagguuggccuaagugaaaacccggcuccgagagaggcaggcuuggagagaaugaauguggaaaagcuucacugcgaguuuaggaggcgcuuagcguucaggguccuuuuuccuccaacuuacucuuuaugggaauugguuggucaguaggccugagauuuauagaaaagcgcgcgcuuauuagcuuuuuuuggugggggagggaguaauuuguucuuaugaguuacuugguuuuguuuauuucuuuuuuccuucgggcuguuuugcgcaucuauaauccuuucaaauggggagaaaaguaaaaggaauucauuuaaaauacuucuagcguaaaaugcuguuggcguuagaacugucguuauuuaacuauuaacuaguuuaacuggcugauaaaucgcuuuugcagaaaugucauaguaaaauugguuuuaaauugaaaugggcuucuucgaucaagucacuguuucguuucaugguguaaaauucaaguuuuaaaugagaaacaauuuaaaaguaugcuuguuuaccugccuuuuaaaaggaaauauuuucuaucuuacauagaccauuuucuagccguaaaaguuuguuuuggggcugguacuagcgcaaguggacaaagcaggcauuugugucaaagauaaugguaaauuccuaugaaaauagaacauuugucugauuugugaaaauuauuuuuaaagccuugaguagauggagaaucagucuuuuaagaaguuacuauuuuuaaaaaucguaguauguugugucuuacaaagaacauuacuguaaguuaaacgguuuuaugaaaugacgcaguuauuaauggagucugcuuaaagauauaacuuuuaaauucaguuguuugccaaguacuuaccaaaaacauuuuuuaaagacuugggguguuuuguuauuaacauuccauucuuaagacccaagacguuuaaaugguuuaaaaguuagagaacuuuuuauggcgacguuggaacuuaaguuuauuuauuuuauaaugucaagaugaaaaaaguuuauucucaccuguuaacagaagauggaauauuuuuaaaaaauacugagcaaugauuuaaacauuucuuuugaaauauuuugcauacugaauuuuucaaacucauuagaaaauuuuaaacauucaaguacuguacaaguaaagaagugauuacaauuuacuuaugucaccugucaaaaauguucacaguaaauauuugguuacuuuaccaugacacagugaagggaccuccuauacaagugucaaaaauaugauuguuucaucaauuaaauacaaacuguuuucauaauacucuauauuuugagaaguguuaagagugaaaauuagaguuccauacuuauaaaauugcccccagagaaaucaguauuuucuuuugcaaccacuuuaaaggauauuuagaauguauguuguaacaugccuaacuucauccugugucaucccuaaguaucguuguauuauuagaucuccucaguaggaaacauaaaacugaauguuaaaaauaauuuuuuacuuaagaucacaaaauuuacuaauuuuaaccuuuuugcuugccucuggaugguccaucuuaccaagcuaaacaauuauuuauuuuuagcuuggauuuuuguauuaauuuaguaaaguuuuuacugaaaauauauauuuaaauagucuauauuaauagcagacuaauagagauuuucgagugagugguuuacucuuccaaguucuguagggcaaaaugcauagaguucauauuacuaauaaugaauuuguugaaugaauaguuagauguauuaggacaguuuuaaaauuaauuugugacauuaugugguuuucuuaaaagacuaauuauucuuaauugcacuugaagcuuauguaauucugcugaauugaaaugagaauaugaaccaaacauuaagacuuauuuuucuauaaguuauuuucucuagaaaaugugauacuuugcuuugguugaggauuugccugcuuuauccccaagcuguauucuuaaguuuucuauaaucaacuauagaucuccuugaagacuaugaaaguacauuaauggguuacuuccauacauaauacagguuguugucuaacaaaaucuuuauaggaauuaaaguaauauaaauuaaugcauuaacuuuaauguacaaucuuaauauauucuaaucuuugccagugcagccuacaugaaauuucauaucucuuuauacuugucuaauauggacuuuuaaaugcuuccauucucaucuucaaagggcaguaaauuucugucacauaguauuuauucaauauauuaucuuuuuauugguaaccuuauaucuuuuugaucuuuguacagugauucaucuuuuuuauuauaauugugacucauaaaaucuguauuugaacucacguaacaccuuuauuuuguagaaaagaugacucauuuugaauaaauuauguuaacuugauucuacuaugaaguauagucuuauacuaugcuguaaacacaugucccuagaaaaguuuuugaugguucacuuuuauucauucaaaagacugcagaugggcgcucucauuguaaaauuuucacucauuuugauaauaaucuuauauucagguucuugguaguuuucuggauaugauuuuauucuauuagaucaccaacugauagaaauuuccauauaaugagcugucacaucuuagcauuuacaaaagaucuggacauuucauccagucugacaacuuauuucacugugguggagaagucuuuguuuuucagcuucagacuuccauugcuaaauaauaguuuuuuauuugaaauaaacauguugccauuuaucccuacacuuuauauguaugaauaaucuugacuuuuaaauuaguuuaaaaaucgguuaaaaguuaaaaaacuaaaaaugugauuuggaggacaucagaauaaugauauauuucugauauguauuuguguacauacuuaaagagaaagaugcauguuaaaacuuucacaaaacacuuguacuuccucuguuuaaggcucugagcuagaaguaguaggauucugaauagggcaagccuauauuggacuccauccaaagguuuguauauauugaaguaucaaaagagccuucaucuuuucaucuuucaugaaugguuuuaccucuaaaauggucccauuacacagaccuaagaauagaauuugaacgacaugucauuuuguuuuuguuuuuuuaugaaaaucuguagcuuucuuggccuuuugaaaugguaacuggguagagcauuucaguguauuauuaaaaacuugauaacuuagagcaaaauagacccguuacucuagaaaucuuauuuuugugacaauuccauauguagagcuuaaucguguaauuuuugugauguugcugguuugccccuuugaagcuugaccucagagaugauguggugaaaauuacaaucgauuggaacaagcuccagagccucucggcauuccagccugcauugcucuuuagugcacuugaacaacacauuuuauauuuacagguaaauuucuuguuagaaaugauaacccgauauugaaaauagaaauugauugugguuaaguuaguuggaguauuugacaguucuaaacacuauauuaauaguguugcuaauaaaacguuauuuacauccggauuuaaucuaaaucuguuaauuucaguagugaucaggacaguuaagggaauauagcccaaaagaccaauguggguaugagugaaugaaugcaauucuauucaauucuagaccugcacugaaaauucaauacaguuccaucuaugguggguuauaauuaagcaauaagacacggcaggugugugucaugcuaugauaaugauuccaugccuugggugaguuuggaggcucauggagugcuuucagugguucaagaaggggcauuaucccagcaugacacauccuggagugucuauugcaauuaaacaguuucagcauaguuuuuaaaaagaaaguaauuucuaugacauuaaugucucaucuuaguaaguagccagucacuauuuuaucauuucuuuuccuuaacaguuugaaauaauucauucuuuauauuagaaguuaauauugaauugguauuuauaauaguguuguuauauuuuuaaauauuucauguuaauaacugaacaguauuaugaccuugcugguuucuaauugaacaucuuugcaauuauaauugauguaaguuugcaguuuaucucuaaucaaaguguaaaaugugaagugucaaaaagauaaguggaaaaacuggauuggucaguuuacugugauuaagguguuauaagauuucaaaagaguaguauagcgaacaauggaagcaaaauuguagguaugaaaaaaauaauuggaacguuauuaguguuaguguguuuugacuaauggaauaggcauuaauuuucagcccuccauucauugacuuugugggaaauuuuaacuguuucauguuaaaaguaauaguuaacccuguuuuuaaagggcagagcagugagcucuagaacucaaaugagaccucauuguggggagugggggaggggaacaguaaaugaguaauauaguuuaaauucuacaacagggguuuucccccuguaguauagugauaggccucugccuguuuucagcuauagaucuuuuuuuuuucuuguucguuuucuuuuuuaaaauuuaauuuuaugaccaaaagauaucuugccaugucaggaaaagucugaguguucacucagccuaacaccuauauauuucaugucuaugcuuccucauucacauuggccaacugcaguuucaaguggagaaucuccagugauacagugauaaugcagggcuuugcugagugagagcacuagcucucguguuaaggaggaaaaauacuaagccuuaguguucugaggaggcauuugaaugacauguuaauuaaguggcauuggugccagaggcugaaggcuuugauuuggcacaaaauaaaagaugagugacagaaugauucucucaaagaaaauuuuaaauuuccuuagguuuucuuuucuuuuuucuuuucuuuuuuccucucuccuuuuuuaaaaaacaaauuuauagcaaaugauaaugguuacaauagcagagaauagugaguacuuauauguggucagaucuauguguccugguauaccaacuuuuuauauuuauuaacugauauuaaguauuucauuuacuuagcagaaauuuauguaaauauauuaaguguguaauuaauuuuggucagauugaaccucagcagauggaauuguguuguucucagccuuuuuuagcaaaacuucagucuccgauuaaagaggagaauacaacugcuguugaagagauaggaagaacagaaauggggaacaaaaaugaaguaaaugacaaauuuuccauuggcgaccuacaagaggaagaaaagcacaaagaaagugauuuaagagaugugaaaaagacacagauccauuuugauccagaaguaguucagauaaaggcuggaaaagcagaaguaagaagguuuuuuggcgggggcgagaggguauuauuuuaaaaaaucuuauguuuacacuguuaaaacuuguuguuuguagauugacagacgaauaucugcauuuauugaaagaaagcaagcugaaaucaaugaaaacaacgucagggaauuuugcaauguuauugauuguaaucaagguaacuaccuggaaauuaauuuucauaggguuuuaagcacaauuuuuauaguugcucuaaucuuuuauuuauuuuuuaaaugaauagcuuuuagaacacaauucaauuuauuucauggauuuaguuaguaauuaagacaguagaguuuccuucugcuuaauaauagacuauauugcaaacugguuuucauuuugguuacacaaaguaaaugcuaacauuaaaaaguguuuaucacaggugaagauuauuuuaaaguuccuuuaggaaaugaaggugagguacgagugagaagguugaucuaucucacuaguaaaaggaacugagcucuaugaauuucaaaccuauacauguacugugaaaucaugauguuaauacguaagugaacuuaguaaaguuaauauuccuccagagggagcaguuuucucacuacuccugagcuguuugaaauguccugugucacgauacaaccaauuuaucaugaagaccauggugucuugcuuuuuuccuuucugccauagugcauacauuugcuguuuuucaucugauucaccuuuaccucucuacuugaugcuauaguacauuuacaaaucugcaaguaugcugcagaauacaaaauauugcaaugcagugccauagauuauacucaggcaccauaguaauaaucagaacaaguaguucuuaggaaaaauuauggagaagaguucauaauuggaaugaacauguuucuuguugccucuaauaucucauggcuaauuauuaugaacauagaauugucagaugaaccuagaaaugacucauaucacauugguacacugauucucuuaaugaaauaauauaggcugguauuggguccugaauuuagcugugugcuacuauuaacauuacacaugugcaucucuaaauuugguauauuuuccuguuagcuuuucagaacaggugcaacaauggcaaaaucucagguacuacaaccaacuacaagcgacuaugagaaaggguuuguugagagagcaagcacaugugucacuaauguuauuccucuguucucccugcuaacucuauuauuauaaaccaccaggggauagaaauugacgagaauugaaaugcucagcaggauuccuuggcccauucaauucuuugcuggcucaaaacagugcuagcaagaauugcuguggagagugacuagcagucauacacucacaccaugcugaauuucucacugauggucaguuaaucuauauguuuggaauauaguucuggaauggaugauagcuucuuuuuuuaacccuuagccccaugaaaugguaggaagagaauggagaaaggauggcccuuuaagcauauuuugaggugccuccaaaaaaaaaaaaaaggaggaaagaugucuauuuagucucuagauauaaaagcuaaguggauuuggaauuuuaugcauacuauuugauuuaucaacagaacuacuaaggaaaguucaacugaaaaaaauacaaauguauuuuaauauguuaguguguuccuuuuaauaccuacaaauuuaaccuaacuauaagcaguggaauuuuuaaaaaucaaauuucauaggggggaaaaaauaauuuuuuuuaaagaaucucauuuaccagccauuuuuuacaaaauauucaggggaauuuuacaggagauuuacugccaauguguggccuuuaaacauuauuucaaacauaaguauauauuauuacuauguaguaucguauguuaauauauaacaauuauguuaauuaguuguauuauauguuaacaucuuuccaauuuuccccuuuuguaauuuaugcauugauacuuaauuugaaagaaacuacuuuucagcuuggaaaaaaauagggacaaauuuucacaauagaccuuuacuaaaaugaaacuuuuuugaaaaguggugggauaagaagaaguagaugacuuuugugaugaaggguuuuuaaaaugagcacuggaaaucuagguagaguggaaauguauguguacuugagguuuugaggucaucuuuguguggaguucugaaauaaaaauguuaaauaauucuuuuuguuggauguucacuaauuuggucauuaaaauaaaaaaugcugaauuaaaagaauucuaguaaaaaugaugaguuuuauuucuacgaugaaguagaauuuaaauacucuaugguagauuauuuucuccaguggcccaaauagugacauugguuuucaaaauuguaucaauuugugccacuuaauguugauggcuuuucuguauauaaaucugaacauuagguaagaauauuagauauuaugauaaauuuugacagguaaagaaggucacuaaauucuauccuaugugugauaguaauuuauuguuacuauuauuuauuaaaauuauuaugaguaaaauguuaauaugaauuauugaaaguuuauuaaaaucucauacauuugaagggaagaauauauuuaaacuuauauuuaucuaaauucuccuuagaaaauaguugugcaagaacugaugcgauuuuuaccccuuaccccggauuuaaaagucacguaaaagguaaguaaccaccacaugacaucugagucacugacagaagucuagauuauuagcaaaauggaauagaaauaacuuucccaucuaaauuuuauuuuaaaacaaaaacaucuugccguccuucauacuugugguuagauggucuuuaugaaaaaaauauaaagugcuguuaaggaauaagaauuucugauuuuugaaauacaaauguauauaggcucaaaaguuucuuaauuuaguuucuagaguugugaauacauacggaccacagacuagaccugaaggaauuccagggucaggucauaaaccuaacagcaugcuucgagacugugguaaucaggcuguagaagaacgacuacaaaauauugaggcccacuugcgguuacagacagguaagcaaagugcuaaguggcaccucauaaugaaccuuugcaaaugguuaaaaaauugcaguucauuuagucaccaaauuuucauuuagcuccuaacauuucuugaacaguaagugccagucacucaggaaguguuauguguaugucaauucacuuaaaaggucauaguacccuuuugagaugguggugguguuaucacuguacagauaaauaaauugaaguuuaaagagcccaagcaaacaugccuaagauacuaagugacaacucuaaaaaaaaaagaaaaaagagauaguccagucuugcccagguuguacuugaacuccuaggcucaaguaaugcuccugcuucaaccuccugugucagugggacuacaaucaugugucacuacugcacccugcucaaacccaaguccucacugggugcagagacugagucucccucuccauuuagucaccaugucuguugauucuguuuucuaaauaaauaucucucaaaucugcccacuucugucuuaucucuacugcuacuacuagaguugaagccacugugaucucuggcuuggacugauggaaggauauuuacugguuucuuugccacuggacuccucuagaucaucucuacccuguggccagauugcuuuuucuaaagcucaaauuugaucuuguuucuucccagcuaaaaauguggagauugggauugaaggggguuuguaauuuuaaauaguauuguccacaucuguaguuccagcuacaccucugggcuucccaucucccacucguugugcugcuuuaggaucuuuauacucaugcccuucuguccaugcuuuuucuuccuaauccuagaccagugcagauucaccuuuuguauaaucuuauauagcaccugguauucccugcuccccuuuaaagcaguuaucaugguucuguuuguuuaaugucugucuccugcuagauaguccgugagagugcaacuaugucugucauauucauuucuuuguaccuauuacagugccuggcacaaagcaagugcucaaauguuuauugaauggacaguugcuuauuucaccuuugcagauguauguacggagggacagaaaguuaguguuugacucucucaggguaggucaagggaugauggcauccuaaugaagugacauuugaggccuugaaggauuaguaggaauuuuccagagcaaagcauuccaaaaagaagaaacaccauuugcaaaaaaggacaaaaacacaaaauaugguucaggagauaucugaauccaguauagcuggaguauacuagcuaucugaagcuaugcuagccagaugaagguagaagaagaaaacagaaugaguaagucuuugagaguaauaagacacuggcauuaagaauuaaucucuucccucagaaguggauggguuuaaaaugccacuguauaaaaggauugacugguuaagucucuaauaauaguaugaaacaguuaaguuuuuggaaaaauaucuguugaauguuuacuaugcuccaagcacuauuuuaggcacaagggauacugagaugauauaaucauaguccccagcuucaaggacuuuauaauccaaaugagagaaagauuaauagugaaguagaguuuuaaaggaguaaugaaaggauggguguaguggugugugccuauaaucccaguuccuugggaggcugaguggggaacagagcuugaguccaggaguuugagaccagccuggacaguauagugagagucugucccaaaaaacucaggagcacugaagaauggugggggcacaaggagccuuuaugcgaaugaagagguuucggcagugccugcguuacccagugaagcuugaacuggcucuugaaagauacagaaguaaggcagaggacauuguagguaaagggagcagcaaaagcaaagucaaaugaacaaguuaacuuauuuaagaacaagaacaaccaagguccuaagauuucuuaaaauccucaaaauuucuagaauuuuuacauaacaaguugacaauuuugauauagaaauuuacccguauucuuuaauugcauaaugauuggcuaaucauguauucauucagucaguaaauaucaagcaccagcucuuugccaugcauuguagucuuaugaacugaugcuuccuagguuugugcagugcacaagcugcacagcccuaccuaaugaacaaaacagauaaaacucuguccucuuggagcuuauauuagaauggggaaacaaauaauacagaaagaaaauauacugaauguugggugguaguaauggaauggagaaaauuaagguaaggaggauaagggagugcuggguaggggagugguaguacugguauuuuuaacagaauagucagagaagguguuacugauaagguaacuuuugagccaagacuugaaauugacuugggauuauggcgguagagggaaccagcugaagcuuacagggugcuuggccucuuugaauaacagaaaaaaaguaaucaaguggcuggaaccaugugggcauagggagaauauccacauuguguauggccuuguaggccauugugagggcuuugguauuuaaucugagugaaaugaucagguauuggaagguauuuaaccucagugaaaugaucagguauuggaagcagagaaaugaugugaucuaacuuauauuuuuagaggaucacuggcuccuguguugaaaauacacucuacggaagcauggcagaaacagggagaccaguuugggaguugcaguaauccagggagagguggaaguggucuggaccagaaaggccacaguguggagggggugagaaguagaaggauucuugauauaaucauaaauuuaaaauuugaguggccauaauuuacucuuccccuccucagaaaguuuguuaguuuagaauuaugguaaagccccuuuuuuacauucuuuuaggucaaaggaaaaauauggcauguagggagaaauauuaauugaagaaaauaauaugacauauugcaaccacugcauugaauuaucgucauuugucacuaugcauuuuuguccucccauguaacuaucaaagcauaucagaaauauaaauuguucuacauggaagcuauucaauaucuuguaaaaugaauuuaacaugaaacuccuagaauauaggaagcauaaaugggguuuggagagaggaaguguaguacaauauguccgauaguguauaauacaaaaauacgaccuaaggacuucauucuguuuuacuuuuguuuuuuauuuucuuaaguauuuuccauuccuuugcauaagugucuuugcaugguauuuuaagaauaaaaauugugaaaagaaagaauuauucaauaguaucucagauuuuuuuuuaauguauuuaggugguccagugccaagagacauuuaucagagaauuaaaaaacuugaggauaaaauccuugaauuggaaggcaucucuccugaauauuuucagucuguagugaguauaagugucuuuuaaaaauaaaugaaaauguuauuguauucuggauucuuugugguuuaacagucacucauugaucuauaagcaaaacacuauuuuaauaauucaaagaugaaugaacacaguccuguauaggggauauaucuaauuccuuaaaaucucugguucugaauauuuuuaaaauuuagaauuuuuaaaaagggauacuucuauuauauauuacccacauucucaaacuuaggccauuuucauggcauaguaagucagccuggguggugguugggccuguuacucugaacuugcuaccuuguaaaacagaggcuuccucuguaaccuugcucuuucagugaucccucugccucuuuaaucucucuuccccaacaggcuccuucucucagcucauaugcaguuaauacuaaacaaacacacaccucaagcugccacucuuauucuuuaccuuaaccaccagacuuucuauguuuuuguaauuccuuaacucuagcauucauucauucuuaccccguuuuccaagaaccuuaagaaacaguguugugcugguaaguuaguaucuuuggcacaucaacauuuuucagaaaaaugauccugagcucauuguguuuuccucagucuucugaggugauuauguauaauaccugccuucucuaaguuuuguuuuuuuuuuaaagcaguaccauauuagaacuaaaauaauaucaaagugagauuauaccaaaacuccuauuucugaaaaauuaugugagauagcccauuuuagcauggaucauauaaguuaguggugaaaauauauuuaaaauuuauuuuagguaugacagcaaucuuccaaaguuauagauugaguauaagagugaguuacagaaaagaaguauuuccagaagaagaaggcaggucacguaacaaaagggagcagcaaguccuaaaugacaaaauuucagagaagaguuuuagugauuuacuacucucaaauguaaaaugagguuuaugaaaauacuaagggcugaagcaaagaucaaaugagauaaugcugaucaaacacuuagcauacugcuuagcacaugguaaaaaccucauuggcauuuauuuaguuuuauaacuacaaaguagcuguauaaacguggaaaagucacucuauuccucugaucuucaagaugucuaauuuuagaaaauguauugguuguacuacauaauuacaaaggucuuuucacuuuuaggauuauucuuugaaugucuuccuaggagacuucauaaagauuuuuaaugacuuuuccuacaguagucuaccauaaguuuuucccauucuaacugccuucauuaaagaaggcaauaaccuaggaaaguuauuuuucuaguucaauuucauaccuuguuaauauaauucuuauuaacgauagaaccgaucuuacaauagaguaugguaaaaucagaugccuccaaugagaacuugcugcagcaucauuccucucuucucucugauucugauuuauaaaaacuuaacagaggccggaugcaguggcucacgccuguaaucccagcacuuugggaggccaaggugggcggaucaccagaggucgggaguucaagaccagccugaccaacauggagaaaccccaucucuacuaaaaauacaaaaaaauaaaaaauaaaaaaaauaagcugggcaugguggcgcaugccuauaaucccagcuacuugggaggcugaggcaggaggaucgcuugaacccaggaggcuuagguugcgaugagccaagaucacgccauugcacuccagccugggcaacaagagcaaaacucggucucaaaaacaaaaaaaacaaaacuuauagauguguuuaacaaaaaaaaaagcccuccacaucauaaucuuuuuguuuuguuuugaucuguuacagauaggauagaguggguaaagagguagaaguagccagauuguuaggaccuuaagugcuaugcucagaaguuuaaaaucuauuuuccaggcaggcagcagggggaaucuacugaaagcauuugagcagagaagugauuugugaacacgauauuuagaaagauuuaucuaauacaguugugggagacaaacgagagaaacuaaggauaaggagauaguauuaugcuagcuuagaugugaaguuaguuccuaaaauagggacaugagugagaauggaaaagauuaaugcaaguaggaaaaaaaauggacaaauacugaugauuggauguggaaagagacagagaacaaggauagaguccaguuucugguuggaaaaaugauaccaucauugauagaaauaagaaaaucuagagagagagauacuuuugugggaaaugugaauuugaaggcagaggagguuaugaagguaaaaacaucagguaagcuuuuugagauacggcacuuacacuugggacaauugggagagucuguguagugugagaguccauugauggauaggaacacagauugucugaggccugaagucugaagcuuggugacugccuaauuucaggggcaggaagcauuuguaaauguaaacagaggauuggcauauauguauuaagcauucagaaaaggauggaugguggcaaccugugauaaaacaggugauuuuuaaaaguauuuccaaauauguuaaaaaaaaaaacuauauaucuuuuagaagaacugcaguucuucuggauuaguguuguaagugacacauuaaauuaguagugagcuacaaggaagaacaaaacacuggaaaguuuaaacauucagacucauucuguccuuuaggccugugaacauacaugacacaagcccuaugggaaagaagauuucauacucaucacccuucuauaauaggaugaaugagccaucuuuaggaaccucacuuggaauacagucagcucuaagaguguccuugcaaacaggagaaguugagcacauaccuuacagaggacauaguacauuauucaucacccucaccaucaugcugggaguacaugcaugguaauugcauaauuuuacauauuuaucccucaaaaguauacagaagaaacuacauauguagcacaguccuauagcuucuaaagauaggaaaggaaaguugagcccauucaguuuauuaaggauugaacuuuuguuggaacuccugaacucugaaaagauuuucauugaaauguguuuauucagauucacauguagaugaauucuaaacaugggggagcuucuuacaauuggauagagauugauuaucauggguaacauugaagcguagcauagaaaaacaaauauuuauggggaaaaaagaugucauuuguauuuguuuuauaaaauguaaucagauuauguaaaguucucauuuuacgaccagacauaaaacuccaaaauaaguuauauguguauaaaacaggauuuaugacaaaaguuaauaauacuuguuggacauuuugauauaagaguucuaaagaucuuuauucuucacauuagccauggaaagcuuuaaauguaauguuuucaaaaguuuaagggcauggccuuaacaguccauuuaaaagaacgaucuuagaguauuuccaaagacuuacugauuuuaaauuaugauacuugaaaacaguaaguaccaacaugcuuuuacaaguauauuguuuaguuuauagcauuuaucacucauauguuuauacauguuuuucacuuuauauuuugaaacucucaagggcaggaacuaugucuuguucaucuuugagacacagaauguagucaauaucgaguagaugugcaaaugaauggauaggacuuggcugauagcucauuauuggacuuugaagguguguuaacuuuguucaaagcacugacugagaguaauuuuuagucuguaacaguaacuccugguucuuaagggaaguaucgggggaggggaaugcugaaaaucaggucaacaucauguacacaggccaugugcgugugaacguguggugggucugaagcaugagugaacaacuggauucagcuagaaaauuagauuguaaacauauuucagagggccuugaaggucacacuaaccaguuugcacuucuaguaucauuggagcacaauuaaguuuuagagaaagagagaaacuuguaauuuaggucccugucugguggcauuaugaagucugaguuggagagaaauuggagucaaggaaacuaguuuaggaaacaugucauuauccaagccagagagaaaugaaggucugaaucagggcucugggacuagaagggaagaaaaacauuuuagauacugcacgcauagaaucaguugccuuuuacaacugaaagaaagcaagccagucauggaagaggccuccuuacccuugaguuuccuuagagcacugguucccuggauucauaugugugugugcaugugcgugaacguguguaugacagucaugcucugcauaaggauguuucagucaacagucaacugcauauauuacagugaucccauaaaauuauaguaugguauuuuuacuguaucuuuucuauguugagacguguuuagauacacauauaccauuguguuacacuugccuacaguauucaauacagaaacaugccauaagguuuauaugcuaggagcaauagacuauaccauauagccuagguguguaccaucuagguuucuauaaguauacucuaugauguucacacaaugacaaaauuaacacauuucucagaauauauccccaucauuaagcggugcaugacuaggaaccugguaagguaaaauaaugggugaggagagacaauuuugcauuaccuuucuccagcucuuucuuuagugugcugugcucucaaguauuuucucucagguaccaaaaccuguuaaaauguccaccuuuuauacuucuauacagaugggguuaugucccaauaaacccaucaaaaacugaaaauauuauuaagucuaaaaugcauucaacaccucuaaccuaccaaacaucauagcuuagccuagccuaaaacauguucagaauguguacacuggccuaucauguacaguugaggaaagucccuuggcagcacaguacacuguagaguaucggguguuuacccucauaccccauggcugacugggagcuuugcucacugccacugcccagcaucacaagagagcaucguaucacaugucacuagcccaggaaaagaucaaaauucagcauuugaaguacaguuucuacugaaugucugucacuuucacagcauuguaaauuugaaaaaccuuaucuagccaucauaagucaggaacuguacugagauuuccuuauaccuaaaacaaacaguaaaguuaaucuaguguauccacgguagauaugguauuucuaaguguucuuuuuaucaaaauauucugcucagagcuaaaacaaguccaaaaggccacauuuuacuguuuuuaagucacugagcgacugaugaccuuauuuuccucauucuaauauuucuugcuuugguucuaugauacaguaguaaucugauuguuuaauagcauggaaacuaucaauauauuacagguuaaacgauuaggagaacaaggggaauuuuuuuuuuuuuuuuuuuuuuuuuuuuaagauggugucuugcucugucgcccaggcuggagugcaguggugcagucucggcucacugcaaccuccgccucccggguucaugccauucuccugccucagccucccaaguagcugggacugcaggcaccugccaccacacccggcuaguuguuuguguuuuuaguagagacuggguuucaccauguuagccaggauggccuugaucuccugaccucuugauccacccgccucggccucccaaagugcugggauuacaggcaugagccaccacgccuggccaagggcaauuauauuugcaucaaguguauaaaaagccaccucuuaggaaguuaggagacugaucaaucgccaaauuaaacauugauuccuuauuugcccauaggcccuaccacagguauccagcuugguuuggcaaaggaaggagcauaauuaucugagcucuauuauuucuuaauuacuaauucuaauacuuaaugauuucccauuuauuguaacuugauaagcauaccuagauguucuuugaaucaacuuuugacacaaaggaaaaugugaguuuuaaugcugucuuuaaaaucucaguagucagaaaugcucaugagaacauuuugucuuggacauucacaguuucuuugucaaauauacucauuuacuaauuugccauucaaaagcuagugcuugugugaaacuaagaaaaagucuagaaagaauucauuaggccaaaguuuaaaaggcucauuaguggaucagugagaauguuguuagcuucaacuaagaaauuugaacucaaaacuggcuuaaacauuauguaaauuauaaaauaggaaguccaugguagcacaagcuucagauuuaauugauucaguggcuaaaucauaauugugagaaaacagguuucuuuccccucuuaacucugcuugguguuaacuucuuucccaggcagauggcaagauggcuacagcacuuucaggugucuuacccaauacggcaguauccugaggaacugccuucuuuaagggcuuucucucaaaagaugugaggaagcuuuuuccagaagcucuccucuuaaucuccagcagaccucuccuuuacucauuggccagaacuggacccaugcccauuucagucacugacaagaccgggaagccauuggcuugggccacacagagaaguaguggauagguagcugcuugcauaaacaaccacagugucuacuauagucaguccaggguguguguauguguguuuucaccccuuggccucauauaccagauuccguuuuuccuuugucuguugucacuucacuuguucaauacccuaggauggaaagguuaugaaaaaaaacuaagcagaaaauccccagagcaccucuuuccgaaaucacucaggcucauuagcagcggguaguugaugggaaaauauguauugccaaggaugagcauguugcugcaauauuacuauuauauauuguuaacgucauccucuuuagaggguaacuugcagaauauaagguagauguugguuacagacaguaauugguauugguaaauugguugguuuuuuuucugucaggguucccaaggcuguacauaauuuguacaguauuuuauaaagaaaaaaaaaugaugcuuagauuuuucuaaacauuaccuuuuuuuuuuuaaucuagagcuuuucuggaaaaagaagaaaaguucaaccaccucaaguaaguuacugcauuuucauuuugguuucugaaauaguuugauuaguuuuauaccuuucuuauuaauaaaaguuucuacuaugguugcuuuuaggucauacccugguaaaauuuaggacugaagaaaagggcaguauaaacuaauacaguugaauagaaaaauuauuuuaagggcauggaaugacucagauagguuaaauaaauaaaaccuuuguccugcuuuuaguaguacaaggaugugucauucacaaagugcuuaaaaauaguaagugcucaaguaauuucagucuccccccaucccuuccuuuugugaacacuucuaauuagcagcaccuagaucaaaaaggguguuuggcagaguuugacuucagccagcccugucuaaagugcuacuuuacuaauuaguugaaccuuaaauaguaaggcuuugcuagaauuuaacagugguaaugugaauuuaaaguuggagaaaacuuucugauuuuuaagaguagcauauuuuuuucuuguaaaauucugaguaaguuuuuugauagcagcuauuuuuucccgaaguaaauuauuauaguugaucccucaagagagaauuucuaaguauuuuaagcagcuauuuuuaaaguuaacuaacuuuuuuuacuauugauuaugagaauaaucagguuuuuaaaaguuauucucuuauguaguaaacuguaacacuucguugcugcuuuaaaaauacaauucacauaacauaaaauucaucauuuuaaaguggcuauuaguauauucacuauguugugcaaccaucaccacuaagucuagaacauuuccaucacugcccccccaaaacccuguaucuauuagcacucagucccaauuuccccuucucuuuacccccuaauagccacuacauaauacuugugucuaaauuagaaauauuaauauauaagugaggguguucacauagguagacuugaauaaauccaauuuuuauuggaagguaaaagaaguauuuucuucacuauuuuccacuucagguuaacuuuaguaaucaacauagaaaguuuuccauuaaaagggauaguugaugucucaaaugauuuuuuucuccugguaguaguauaauuagcauuuuucuucuucuuuccaacuuuuacuuaagcucaaggguuuuucagcuuuguuacauggguaaauugcaugucauggggguuugguguacagauaauuuugucacccaggcaaucagcauaauacccaauaggcaguuuuucaguccucucccuccucccaucuucaaauaggcuccagugucuaauaaucaggcuuuuuuuuuuuuuuuaacuuauucuuucuaaguauaaaagguucaggagagcuuagucauuagaaaagagaaaaagaaauauuuaagccuuguuauuuuaugccuuuaaauuuaugauauagucaacauauauaguugcucaguuuuaagauuauucucaugagggaaaaaaaccauuugaucaugcuuuugaauauuuuaaauauuuauaguucauuuggcacuuuaucugcauuaagauacuucagaaucuuauucagcaauuugugucguuauuguuuacagcagaacuauucacuggcugaacuugaugagaaaauuagugcccucaaacaagcccuccucagaaaaucaagagaagcagaauccauggcaacccaccaccuuccaugaaaaacuccucucauccuugucauuuuacuuuuuuguauacauauguguaacuuacacuguuauuaauucaacggauauauauuuaucaauguagacuucucugugaagucaagguuuauuuucacaugaguccagcuugcagcaaguaaucuucaaauauuccaguaaguuuugaaauaaugaaugcauugaaaauagcauuguuggaauuuauucccuucuguuuuaaaggagguauuuuggaaauugaaaaacuuaauuuacaagugcugguacaucuuuuuucuuuuguggaccacaggaaggaagauuuauuuugauauugauacuuuaaaaggacuuuauauuuguaacauugauguuaaccaguuuauuaguuuaaaucaguacuuugcauauaauaagcauucaacaaaaauuuauugacugaaaugaauuuuaaaugcaugugua

SEQ ID NO: 17040 - RNA, 5386 nt, Homo sapiens
guuuuaaucagaaaaagaaucuuuuuaauuuguauaauuuauuagaagcuucuuaggaacuauauuuaagccaaauaucuacauaaguuacaacagaaaaagacugacgccgcaaauaccaaacugccaaauaauauacacagauuugucaaugcccauaaaaaaugugaagggcuggggacugggagugguuuuucuuuuuacaacaaaauguacagauuacuaaaaacuaggcauuuaguccaacuuuugacagcguuuuacagcuacaaguucacauuaaacaaacuauuuucgcggagggcggucgccgcugagccuaggcggccagagggugccggggagggggcacuuccuuugugucagugacaaguggguuauguugaagacucuuuccucuccccagcucccguccucccuucaaaaaaaaaaaaaaauccugguauuuacaagcgaguccucuuugcuggcagagugugcccagagugaaguuuggucuuuagaguccagagccaugucagcacagagcccucuccaaucugugccccgcccuagcguggaaaacccauuugaaucaccaaaaaaagacaccccaaagcuguuuuaugcccuucucugcuuaaagauuccuugagauuggaugcgcuugguuguuuuucauuuucuuuuuuuaaaaaaaaaaacccacaaauuuuagggggggaaaaaaagaaagacguccagcaguuuggccuuugugguuuuuuuguuccuuggucuaaacgcggccagguuguuaagaaaagucgaagcgcguggagcagcgguggaugguggucuguguggcgggcaggagggaagcggugaggcagagcgcugggcuagggccggcccggcguccucucaccagguccgaccguauagcaagguggagcaggacauggugccguaguccgagcccgaggaguucaggugggacaggcuggauaccuggcccugcagcgccgcggggcuggcggcguggugcgccagguccggagacuggccugcgcugccuggcugguggcccgggugugcgccaaggccggcgccaccgcugcccacggagauggccgcugccgccgccugcgcggccugcgccuggugcugcgccugcugcugcgcguggccuuguaggcuggcggcgcccggcgcgggggcacccgccuggcacgguuugccgucuuucaccaggaccggcaccgccacgcgucgcggcgacugcugcugagccuguugcugcugcgggcacccggugcccccgccgcccccgccgccgccgcuguccugcugcaguugcugcugcgccgccuuguccuuggccuggcgcuucauuuuguagcggugguucuggaaccagaucuugaccugcgugggcgucagguggaucaugcuggccaggugcucgcgcuccggcgccgacagguacuucuguugcuugaagcgucgcuccagcucguacaccugcgccugcgagaagagcacccggcgcuuccugcgcggcgcgcuuggcagcggggccauguucuugcucacgucccccagcgagcccaggccgcccaugccgcucauguucaugccgcucgccgggcccaugaagcgggagacuguaagcgacaaacgcacagcgucggccggggccaggccgagccaggccaccccuguuuuccgcgccauuggcccgcccggcccgccccaaccgacggcgcccuccugacccaggcagccuagcgcuggggcccaagaggcccauccgcggggaacugccagcgccugccccaggccguaccgucgagggggcuguacuggagcgcucacagccccaacccuggcugcccucccucagucucaguucccucuuucgaaccaaaagacgcagugggggaaaggccgcuucugcuccuuucgugcccagcccgggucagagcauuaggauuagcuggccacaggcggcgaacugggcucaggccgggagcugggguccuacgguagaccccaguuuggagagguuaggagaggggguguugacuuccaaaagcuggagcccccagacgcuuugccucuuggcuucucuccugucaggccccagugagggcaccugcucggacccuuagaguccccucuggaacugcgaguccucccaccugcccagacuccgcuggagagagggccgggccgggcgcucgagugccucccaacagggcagccucccuccuggcccggucuagccucuccgcgcucugcucgccccugcuccuugagcucggggucgcuucccuuggcuccccgaggucuucugcgccgagcagagcugccaguccaccgcgccuaggagacgccgaguacccgcaucugaccgcaggaccccagcgcuaccaagugccuguucuuggacccccagccgagcagggggaagcauccccagcucccgcacccaagucccuggcgccgcugccgggccgcccucccugaugcccagcgcgcagccugccggcgccgcgccuucuggacggcucucgccgcaccuccugagcucagcccgcggccccgcaguggggcggccucacuuacuggcggggaagcgcgggucuggguuggcgccguaccauccggggccagaggcgcuguuccucaugguguccugguacggcggcagcucgcucauguugcccagguugccguugcaguagccccccacggcggagugcgagagcuggggcacccccgccgccgucaugugguaggcggcggugacggcgccguggugccccacggcgugcugcugcauggccgcuguuggcggugccgccuggcccugccuguacgccgccagcggagccccgaggccgccgcccuccaugcccacuuucuuguagcuuuccuccaggggacucaagaugucagacacugagaacggagucgugugcuuuggacucaucgacaugauucggcggcggcuggaggaggaaggaagaggaggaaaaaaaagggagagggggaaggcgaagccucgcugcuuuuuuuuucucccuuugccaaauauucugguguuaccuuaacgccgaucuuguuggauguacacguaacggaguggaccgaguccuccuuaauuggcuugaguggaggcucgggggcugccucgcguuuguuuuagcccggcgccagguuuuaggcagccaccagaggcggggcguaagcgcuaaagcaacaagacaauagaagccuacaucuugcccgagauaauuagcuuacaugcugaugacaagguaaacaccuuuaaguuucacuugucaggauuuuuaggucucaaagagagagagagagaggcagagacgagacccaaagcauuuccccccucccuuggacacccccacccccauuuuuugugggguaccagcggagcgcggggaggagguggaggggaggggaaggaggagggaaccgagagcggggagggcaggagguggggugggggaguaacagaggaggagagaugguugagaggaaggaaggugaaugcugcuuugcaaccaacuugcggaguuacaaaguggaaccacuuuccaauucggucgggguuccccgggcacggacaggucuuuaggaggagggggcugagggacaggguggggguuucaccugagccugccggggcugcuccucccucccgccgcggccucccagccccgcgccuucccacugccuccggaccacaucgggcuucgcugcgcugagccccagucgccaacaaaugagcgagcgagucuggggacgaacccuggggccgcacuguuggucuacgugucugucagucugucugccucucuucugccgccgucagagggacaccucugcuccccgcccccuuucccccuaccggagagaauccgagcgggcggagggggcgcugaguaggggaucgacugccucccggaggcugucccggauccccgagccacaacccgcccccgcagcucagggguuuuucagugggccacccccgcuaacacgccucccccaaggucuuccccccccccccccacccccggccgagcaaacacagcacuggcccccagagcugggaggaugggaaggggucucacgggaggguccgucacugaaguugccccaccucgaacaaaccuggugucccugacccucgcccaucucccagacacgcggggaucuggggcuggagcugacuuuccgaggacaucacagccccagcacccgagcccagagccacgcuguuuuccccucugaugcuucagggagcgcgcgagcagggagcggcgugagugcccgucugucuguugccgggcggaacugagccugaaccccggcggcuggagcgcuggccaggagggggcgaaugccgaggugcgggcagcucagcgggcgggaggcugggccgaggcucgccuccgcccgcagcucagccaugcaaaagugcucuugcuucccgggaauaaccaaauaucuuuguuuaaagugguggcguaaauggccagucgcuuuguggccacgcuggauauuaguagaugaggaucauucugcuucaauugggcgccucucauccgacgagcaagaaacugcuuaggaggaagaggguuuccugucugcgcguucccaggcuucaagugugggccccgcgccuugaggguccuugggcgccuggcgagggggagcugugggcugcgcuccccagcggaaucgggggugucccccgcguugcuccggccaggccggggccugcagccgagucgacuaccgaguggagcacugaacggcgcggauuuugagaccgacuccgguuuuuguccuuggauuuuaaacguuuuuaucauuguuuuuguuuugcuuucuccuuagcuguuuuagucuccucugcgcgccaggggcugggagggcggagcgcuccccggccggccccggcaggugccuccaagacacccgcgcuggucaaggagcuucuugaauuuaguuuuuguuuucacauuuucuuuccccuccuuguagagaaggagcuccugaucaugacgaacaggcaguuuugagcuacuuaauucauccgggcucccuuuuuuuauuaauagcaauuacaguagagaaaguuuuauuuauuuuuaaagauuucagcccucuccuugaagagagcucuuacucccucaauacaaagccaacuucuauaauaacauucgcuuuucucaccgccuaccuucuuuaccaggguaaagaaagcucaggacacccuccgcccucccaccugcgcccgcguuuuugugcgguccccacggcagagcuggggaggccacccuacguuugcgcagggagacgcgcucgccgcugguguugcgaaagaccagag

SEQ ID NO: 17041 - RNA, 3262 nt, Homo sapiens
cuggcuccuauagguggcgcugugacaaggugcgguggccgggagaggcggcugggggacucgaagacugcgggaaauuuucugcgacuccgacgcuaacccgcugcucccagccuccgcuuccuguuuucgagggauuagcuaggacugugcaacaccagucuccgcucucggagucggcacgggggcugguggguggcgggaugaacucggggaaggcgacaggcuggaaacgcagcuccucgacuuugcagcgcaccaacccccuaucgccccguccgcugcucaggugcgaggauucgccagacgccacaggacugggggcgacucgcaagggcaucaugccaccuagaggaaacgcgcagugagugagcccugggucacugaaaaugggagaacguucgagucggucaagaugacuccggccugcgaguugauucagacuccucggaagccagaaauugggucuagaguggguuggucccuccgucagcaguucgggcccagccgaagcuuggggccuagagggcagacguccggcucugaucagaguacagcgggcugggccuggcagccugcaggcaaccuggaccuugcaauaaagcugcauucaacauaacucagaccacagugggagcccccgaagggcuucaugugagucccgaaaccagaguuuagaggcgcggccugguucucguuuaucuuuuccagacagcauuuaggccaauaaggucuuugaaaggaggcagccccaaagcccucaggccgacaccugagggcagggucucaaacagcugugcuugaagaaccggcaaucuugcuuuucccacacgcagcugcaccucuccugagcgcugcagcugauggcuguauagugaccacggacugcguccuccucacgaagcugcgcaacuucugcuaaugcugcaacccuggcaagacgaaaucccccucccucuggcuagaucagcccagccuccccucagggaccuuccugccccucccuaccccucccuaccccuaggccgcuccccccuuccucuguugggauccgauccuuguucgcucuugcaaucccgcagcccggaguuuugccccgugcauuaaaacauguucucuuucauuugcagauuuaauaaacaaacguaaccauaucacauggagcuccacacuguccuucugaaagcaauuccgcuguugaaaacugaaaaauggguguaauuugcuuucagaaaguaauguuagggucacggcaauuucucgggccguuauuuauuuuuacuuuaaagucuuuaggaaagauuugcuuauaugcucggaaaacuuccaaaugcgcgaauaccagcaaucccgcucgccuucaacgcgugggguaaggggggguggggaacaauuacugagugacgcuaauauggggaaacugaaaagaaaugucgauuguuuuuauuguaauagaaggagugagcaaacagaaaaaccaaccccgggugaucggaaacaggcaggcggagaauuaaaagcggguuucagacagcaacaggccccuccccugcucucgcaaggagaaagcgggcgacgagcgcucgcagcccguggggcugaucccaccucccgcagggcuccggucgugucgcugucggaccgcagaacgccgggacgcauuuccgagcucgggcccgacccaacccgcugccauucuagcuaccuaguggagccgcggagagacucuugaaccgugaggcuccuugaugagaagguggagaggcugccgggcuauucuccgagcaucuuccggccgagcucugcuccucuccgugcgcuugcggcuucuccuugggcuagcgcguccgcagucccuccaaguccaggccgcaggucagugugcgggcgccuccuguccuccucucccaccagaggaccccugagggcugucuccauccccaauccccgcgacugcuccuuuuagccgccauccccucccgcagcgcagauccugcaggggccagcgguccagggcggacccucccucgcccugggcgcggggcgagcuucuggcugucacuugccgcugcaguuucagggaaacucagcuggccgcuuacccugcaagacggggacauagcagagggccgaguucuggagaagcugggcuuguuuuucucucugcaccgcgcgcaaugccccaacugacccugaagggucuugccuuuacugcauuugcccccagacggcuagaagucaaugcacuaugaaaaucccagucccggaccucggacucuggcugucuuacaaucccugcaacuccuccgaguggacaagaggcgggcaccgucgccugggccucgcuugggggggggggguccuguccccagcagggggcaaguuggaggaaucagcuccuuaauauuuucugcuagcucugcuugucauaacugcaacucggaauagaacaaccucucucccgugcauacgcacccccaacucucgcccuauccucccauccacagucaucacugaccuguagacccggaggagcaggcuuccgggggucgguccagguuggggauacagggagggguccucgcguuccgcacaaccuguagugcuugggucugacuucggcagcccucggguacagucugccgggcuagauucccguugcuucuccgcgucucuccgcgggccgcucuagcgccgggaagggggcgccgcaggugacugcccgcggcacugggacggcugacagauuuauggagacuucacagcaucuggcugggguccgcgagggcagggcggaguccggucgauccgaugcuggggucuaaagcuuccccagccacacgccugggccgagucgcccccagaguccccggccccugcuccccuugggcggguguacacaaggauccggccagcgccgaguguacugguuccucccacccaguguagcccccuccuucacacucucggcccggcuuccagucucccacugaguaaauauuuauccagagagcgagucgccccucggaggaggccucgacgcggcuagggaaaggcuuuuuggcuucucccuggccugagccagcugcaggccuuacugguguuuugguuuuggucuuaaauuucuccuuuuagucgaaauucuuccgaucucuuugagaucuucugaguccagagugagcaguguaaccaggcggcagacuccagcugacccuuguucuuguucuagguccugcauccuuacauucaucgggacugacca

SEQ ID NO: 17042 - RNA, 2619 nt, Homo sapiens
uaggaauuucgcccgagaugggggagggguccccggggaggggagggagggggcgaagaggggcgaggagggaaagccuuccuccugacccaaguguacagcuccgguggcgcucggacccaccaacgcuaccgagcaaacauuuuuacaaaaaagaaaaaaacaaauguuuugggagugagcauaggacaggggaggggagcugcaauuguuacucucaccuugcauuuaggaagggcagguaugaaacauuuuuaaggugacaaaaacagaaccaaagauagggaagaagaaaagcucaccaguucuauucagcaaaaacuaaacaacucacagguguucggaaguagaaggcaguuccguccauuuucuacaugauggcuaauacaguguuuacaucaaaggcaaaauuuaauuuccauugucccuuugugaucccccucauacaggauaaacugaugagaauuauuagggaaggagggauuaaaacaaacaagauccuaguaaagcucccaaccucuguuuucauuuucugaaggcuagauaccuaauugauuucacugaaagcauaaaaacauuauauuucuuagaagucuaacagauuugaacgagccauaacagaaaagaaguccugaagugauaaaaauguaagcccuuguuuuggcauuuuaaaaaauuggucucaauuccacaaacaugcuuaaguuucuuugcaaaaaacugccgagaucaauacaaauuccuuccaaugcuggccaaaguagaagaccugucacccaaauuaauuaaccuuuccucaagaucaauugguuuucuguugauuuagcaguaauauuguagaacauuuagcuauaauguauuuuaaugugaucccucaaugucaacaggaaaaaauucguugaaaaauaaaauagcuuaaauaaguuaguagacauuuuauaccuuuguaggaaauauuuugccuucaaaaauuaaauaccaauuguuuauuugaauuguaauaaaguguguuuugcaacuaaauggaguuaagagcaugccuaauuacuccaagauaguuauaugcaaaaagaugauuguuuuaaagauaucuagaacuaaauagguaaucaaauuaugcugaaauuuaaaaacaaaauuuucucaaacugaaagaaucguuagaaucaauagauucucaugagaguaagaauguaagaaaaugaaaugaaaaaaacaugaauauuucacaaucuuccuguuuauaaauagaauugauuuggaaagguaaagcguuucuuaaaguagccacuuacacaaguuuuauuuucaugcacgauguuaguguauccaaauaacauuuaacaacagauuaccuuaaaucuuguguuuuuucuuccaaauagcuaaguuugggggcauaauaauuccauugguuuuucuuuuagccccagcccagcaugguucuuugaacuuuggccagcuaggacugcagcccucaccuuuuuguucuccaccaucauuuuaccaagcaaucuggggcuggaaaauacccaugccauucaauuuuaacuuguaaaaugcaugaauuuuccuguuauaaacauuuuaaaacaccugacaagggggaaauccucacuugccaccuuucuuuuucuauuuaacuuccuuauuucuccaauuauguuagcugugacuacaguguaagagcaaagcacauggugagagugagcacuccucccccuugcagucccgggaaauaaggagcccuccuuuuucugggugccacuccgugaucuuuugggguucucuauguuccagucaaccuaaaggacagaggcaagauauucucccucaaaauccaggaaggaaagggcuuaaguagaaucgugcucgaauacaucagaauccagguggaaugcgggucaagucacuggcgaaaucaagaaccaggccagugacaccaacggcaggccugacucagaauuuaagugugagguugccuugguuuaacuuuuuacgucucucaacuccccuucaagauuacacaucaggggcuuuuucuuuucucuuuauuuaauuucugaaaccaaggaaaaaaacaaccuggaaauuccccccaaagcauugcuauugccugcaaauugggaacaaugaauuaaauuggaaaccuccuuagccaauccccccgcccccccccccaacacacacacacuuuuaaaaaggaguacauuuguuauucuuuugcuugccugcucauaucccgggucaguuuucugguuucucucucuuacgccaaagauuguuuuaaaacacaaacaauuuaaugaaaagacuuuaaggagcucugcggcgguuuguauccuuuguauauuuaauuuuaagggcccauuaugcaccagggaggaaguaggcgcccuccuagucccgugcuccuggaaagcggaauuucuuugcaugauucaggugacuaggauauuauuggaacguuccccuagcucugggucccacuugggggcuuugugcuucacuaccgcaguccagcuauacacccguaacccaacagcggcucaacccugggcgccaacuaccgcugcguccuccgccgcuuuucgcagguggaggccgauucaugagcuc

SEQ ID NO: 17043 - RNA, 6281 nt, Homo sapiens
uauaacaacagacaaaacaauuuuauuuucauuuuugucauuuauauucaguucuagaauuugaaaaauaucguauucagaaauauucacuucggauuuaguuaagugaaaaaaaauaacagaaaugcucuuuuguuaacauuugauuuauuuaaaguccuuaacugcaaaugaucaagaacauuuuccacggcuuaaaaucugguauuauuuuuguuauuuaaaucaaaauauuuuuaauuacaaucacauugauaaaaauuaacaauuuaauuuguaauuuuaaccaucauuuaaagcaauuucagcuguaaagaaaaagaauaaaccaugcaauaaauuaacauugagaaagcaaagagaaauaauaaugaaacccgucuggcuauacuaacaccauguccaacuguggaaagugcauaacacuggaugaaacaagcacacgauggcaaugauuaaaauggccacuaucaauaggauuuuugaaucuuggaccacguuuugaaauccagcucccuauaacuuaucucuccuccaacauuguaauauucccuuuuacugaaaaaaaaauucuuuaaaugguauacacucauagaaacuaauuuuauguguuaugugaccucagaaugacaugaccauggcacucugcaaagcaagaagcagaguucuugagggcaauuccugaggaauugauucccagggccaucuguggguagagaggacaaagggguugggguccuuguaacuuucggucaagcaacucuugagaauguaucauguauaucaccuaucuauuaccucuauauguuauguaaauauacggaggaugucuacacaucugagcaugugcauaauuaaguccauacacaauauacauguauuucauuuaaagacaucugcuaucugcauguaucagaaauguaaacugagaagcaaauggcucugauguuuauaaucuguuuaugucuugcuauauaacagcaguauugucuuucaauacuuuuaagagccucuaguguauacuuguuucuucaccauuucaauucuuaugguuaagaguauugccacagaccuguaaacucguagggggucagguaaggagggggaaaaagcacaaacaaauauuuuacaaacuugaccaucuuccuuuuuuguuuuuuuaaauaacccuccacaaacuagaaugucuggaggggaaagagggaagaaagagaggggggcaaggaaggaggagaauuucauauauacacuuguggaucauuaaacuucgcaggaaaaaaauugguuugggguugucuuuguaguaauauacacaaugaauuuugaauacaauaauaaaguaacagucuuuugcacugggggaaagguugugcaugaaaaaugaaauaaaaauaguuguugggauuuuauuaugcuguugacgguuugguuugugugguuuuguuugcuguugauuuuuucucucuugcuaccagcauggcuaugccagacaaaccccccagucccgggagcuaggaaguguuuaggacgggucuggaauacacaccuugguaguacgccggcuccagggcugagggcucgauggggcuccugguggucaccgaggcgcugccuagaggcaggcuggcgggcaacguagagccguaaggcgaguauugcagugccuguucguaugccuugaaguccagcuuaugcugcugcuccgaggaggacaugagguuguugauggagaacgggugguugaaggaguaguggggguccccuuucaggugcagcugggacucguggggugccaagccgugugccgggugagaggcgggcacagaggccagcgccccgggcccggagcuuauggggggcgcaguugaggaggcuggagucuucaacuccgaggcgcccccugucgccgucgccccacugugguccagagucugggggcuggcggcgggcccgggggccggcgcgcccucuagcuggccggucuucccgugcacaccccgauggaggggcgagucggcgcugggguuagaggcgccagagggguccuugcggcucucagggccgcccuuggcgccgcugcccccgcuuccgcucccgcccccgccgccggcccccggcugcuucucgcacuugaagcgcuucuggcggcgcaaguagcagccguucucgaacauguugccggaguccgggugcagcguccaguaggagcccuugcccggcuuguccggggagcgugccaccuugacgaagcagucauugaaggacagcgaguggcggauggaguucugccagcgcugcugguucugccgguaauaggggaagagguccaugauccacugguagaucucgcucagcgugagcaucuugcugggcgccugcuggauggccauggugaugagcgagauguacgaguagggcggcuuggcgugcggguagcugcgcuugaacgucuuggcgucgccgccgccgcccgcgcggcugcggcccagguuggacggcgcguacgccauggggcucaugcacggguucauggcggccgcguaggggcccaggccauucauggaggccgccugcugcgcacccauggcgcccaugccgcucgggcucagcgccguacccauggccgucacgccggccgcagucaugcuguucauggcgcccgccgagccccccggcaugccggcuacugcgccgggacucaggccggccccuaggcccggguuggcauaggacauguugaaggacgccggggucauguugccgcucguagucaugguguucauggucauguagguguucauggaguucauggagcccaggccugaguucauguugcugaccgggacggaggaguaggccuggaguggagacagcgagugaagaagccccggagggcgggguuaguggugggcacuggagggcggccguccgggaccuaacccgggggcaagugcagagcacuuugcagaacacgggacgcccccacccggggcaaauggcuaagcgcccuccccagaccgagcaaagaugucuugcacggcagggggaaaauccuagcgcggcaggcaugaaagauaaacgcucacagaaaauaugaccccaggaagauguguaaucgccuuacacgccaggcucaggggcuggcuuccagggcccccucaucgccuccuccauccacgccaggcgguaucccaagucuccaccccaaccagccucggcaaagcgcccuuuggggggaaaucguugauagagcaaaucaccuauggacaugggacccccugaaucaucuguuucccaacaaguggcuuuauuguccuagggguuuuugccuauggugacuuuuuguuguuuauuguauuuagaaguaguguuuucuaccugcuuguagcaacuguaauguuaaaagggaagcaaacucagaguuaaauaaguuuuggaaaaauaaaacuaaaaguagauccauaacagaaagggcugggagggggugcuauaauaaucucaaagugcuauaugcauuuuauuuuaacaugacuuuacauguacaccuuugcaagcuauuuagaaacucgcauuaauuuugucaccacuuuacaguccccuguuugaaaaauuuggugacacaguuugucaaaauaaaucuuuuuuuuuuuucacaugcugauguugcugccgaugauuucaacgccuggcuuugagauuccgugaguagucuugaauaauuuaaaauucgaaaaucaaauucuacuuauuuucucuuaaugcuauuguauuuccuaauucucagcuuuaacauguaagaaaguacuuucgcuaggggucuuaauugaaugguggggucgagaugacugcgucagaauuaaaucucuggaagaccucugagcuccuuuuaaaaucaucaacaagcgaaaauccuuaucaauagcgaugugggaaugcauuagguacaguauuuuaaacauacaaaaccuaggcauauuaaaaagcacuccucugguaauuuaauaaggaauaaugauguccuuaaguuuauuuuaaucagcaaguaugacucaauuugaaaauaugagaacaaauagauuuaaauaggaacacccaguaaacuaugguaugcaaauaaacucagagguaaacuugugaauacauaaaucuaaauaagucaguuaccaucaaaauauuacgugauccuauauuuuucuguccacgucuuaaaaguauuuuuuaccuuggggcuuuauuuucuuucccucuucccaagauuauccaaggcaguuccaauacgcguuuucaauaaugguaauuaaacuuuuggaggguaaucgccagcuguuuccagaaaaauacuuuuaauaggugguaguccucccuguaacugguuuucccuguaauccuuuugugcacauuguaaaaauaacccccaugaacgugccaccaaggggacaaugaagagaaacagguucucggcccagaguugugaagaagauuuuggucgcacuagcgccacccagcgguuuuagagaaggagcacacuucuccccaaauagggcuuuugaagaacaaguuuuacaaaauuuagaaaucguuucauuauugagacacccaacuuggcggcagagcgcuuuaaucagaagacgucugcgaauuaaacggugggacgaagaggucgccuuguggguaugcuccggcuuucucagaguugcuuccaacucgcaccggcgcucgcccgcccgcugcaccccgggcccggcuccugcucccgcucgcugcugggaagaggcaagcgcuuccuagagccgcuguuuucaaagcccggaguuuccuaaaacucccucuccggcugcgagagucgggacagagcagggcagcaggucccgcuuccaggcccggccaaggcccggccggggccacaccggcgggcgggcagcgguggcaccgagaaggcgcccccggcccgccugccugccuugccuggcgcccaccgcuccccggccucccccggcacgggcuccagcggcgccccaccggccgcccgccucgccuugccucucaccuccugcgugucugcguaguagcuguuccagucgcugguuucaugcccuuccaucuucacaguuccuaacauccuggagccacccugcccaauacaaccauccagcccugugcgaagcgacgggcggccgcgcggcgcggggcgggggaggggagcugagcagcugcagucacccgagcgcccgcgcgggcccaacgccacccgggcgaagaggaagcccagagcugcggggcgcggcgugcgcggcggcggcggcggcgcggcgggcgggggcagcgccgggggcaggcggcugccgcggagcgcggcgccggggagcgccuccgcgggaagugagcgggcugccucugcgaggcaagugcaguugagcugauguggaucuuacgucgcuugagugcccaccuccucguccucuccccauuuguccgccgcacaaagacgcucgcaccuacaaagcccgaggugcaccugcaaggcggccgcccgccaguccggccgccgcgccucccgccccgccgcuucaccgcugcgcgcgaccccucccccgcgaccccucccccaagcggggcccucacuuuguuugcaaagcaguguaauugguuuaggcccggaggcuagggaaagagggaaauggggagggaggggguguaacccccuuuggaaaaagaaaaaauaggcggggccaggcgggcgggcgggcuagggcucuggaucggaaccucgcagccggagaaggccgggggcgguggcgucggagacugggcuuagagaccuugugggauaacugaccccggggucccuccccagagguacacgccaccuuccgagcgcgggcugcggcccagucucgcgccccuccugcucuuugcuuccucccuccugauuccugacccaaaguucaaccccgggagacuggagaauacagacuuuuuuuuuucuuuccuccugagagcuucagacuagaaaagggaaaaagccccacuuuugcuucgucacuagaaaccgggucaucugagucagccgagccaagugacguuaggccgacccgggccccgggcuagcagagcggaggcgcugccacgaaacucguaccugcggcuaagagcaggugagucacagcaccgguuuauaucuuuaugacauaacuuuuuuuuuuuguuccgccucgguccgcuccucuccccuugucaucuguagcgaccacaaagaggaagaaacugagagcagaugucug

SEQ ID NO: 17044 - RNA, 488 nt, Homo sapiens
uuuuuuucuuuguuucaaguuuuaaucgaagcuuguauauaagauuacuuuauuccugcaucuucucaauuguuucuuccuuguauuugcccuuuuccuuuccuacuuggcaagauuuggcuuuccguucaaggaucuuuucacagucuuuguccaguuuuagccuagugauaaccaccuugcuggggugaaugccuacguggacaguugugccauuagccuuuucccgcugcacccguucaauguagauaacauauuucuuccuguaaaccuggacuacuuugccaauuugcugaccuuuauaguguccacguacaaccugaacuucaucauccuuucggaugggcauggaucacacguuguacuucugucucagcucuuuggaaagaggggaagacauagucuuccuucgaaugugggaaggugcauugaaaugccuuuugcgauucuugcuucggucggaagucacaaagggauuaaacuucauu

SEQ ID NO: 17045 - RNA, 433 nt, Homo sapiens
cauggcaggacaagcauuuagaaaguuucuuccacucuuugaccgaguauugguugaaaggagcgccgcugaaacuguaaccaaaggaggcauuauggguccagaaaaaucucaaggaaaaguauugcagcaacaguaguugcuguuggaucggauucuaaaggaaaggguggagggauucaaccaguuagcgugaaaguuggagauaaaguucuucuuccagaauauggaggcaccaaaguaguucuagaugacaaggauuaucuccuauuuagggauggugacauucuuggaaaguacguagacugaaauaagucacuauuggaauggcaucaacgugaagcugcccauuccacugaaguucugaaaccuuucaucauguaaauaauuuccauauuucucucuuauaauaaacuaaugauaacuaaugacc

SEQ ID NO: 17046 - RNA, 433 nt, Homo sapiens
ggucauuaguuaucauuaguuuauuauaagagagaaauauggaaauuauuuacaugaugaaagguuucagaacuucaguggaaugggcagcuucacguugaugccauuccaauagugacuuauuucagucuacguacuuuccaagaaugucaccaucccuaaauaggagauaauccuugucaucuagaacuacuuuggugccuccauauucuggaagaagaacuuuaucuccaacuuucacgcuaacugguugaaucccuccacccuuuccuuuagaauccgauccaacagcaacuacuguugcugcaauacuuuuccuugagauuuuucuggacccauaaugccuccuuugguuacaguuucagcggcgcuccuuucaaccaauacucggucaaagaguggaagaaacuuucuaaaugcuuguccugccaug

SEQ ID NO: 17047 - RNA, 686 nt, Homo sapiens
uacugcaagguuaaagccggaguggaccuguuuuuugaaacugcugcucuuucacuucucaggcaucaccgagagcucagcacccaggcugaacucuguaccauucagaagaauggaagcugaugcaucuguugacauguuuuccaaaguccuggagaaucagcugcuucagacuaccaaacugguggaagaacauuuggauucugaaauucaaaaacuggaucagauggaugaggaugaauuggaacacauuaaagaaaagagacucgaggcacuaaggaaagcucaacagcagaaacaagaauggcuuuccaaaggacauggggaauacagagaaaucccuagugaaagagacuuuuuucaagaagucaaggagaguaaaaaagugguuugccauuucuacagagacuccacauucagguguaaaauacuagacagauuucuggcgauauuguccgagaaacaccucgagaccaaauuuuugaagcugaauguggaaaaagcaccuuuccuuugugagagacugcauaucaaagucauucccauacuagcacugguaaaagaugggaaaacacaagauuauguuguuggguuuacugaccuaggaaauacagaugacuucaccacagaaacuuuagaaugggggcucaguuguucugacauucuuaauuacagguaacuuuuaa

SEQ ID NO: 17048 - RNA, 1996 nt, Homo sapiens
aaaaguuugcguaagaauaucacuguauuuauuuucccucggguaacuuuucuauggcuucaccauuuucucuucaaaauugaagaaaaauaucccaaaguuuagaacuggaucacuuggcccuuucucuucuuaucuccucccaguucaaaaugcuugcaucucuuaauggccagcauccucuuggaucugcaguuaggcucaacacauuccagccuuagcacaaucuucuuuguggucuuagccuucuuccggaaaauuggcuuugucugcccaccauagccacucugcuuccgaucauagcgccuccuucccugggcauacaaagaauccuugcccuucuuauacugugucacuuugugaggcugaugcuugccacacuucuuacagaagguucuucggguuuuagguacguugaccaucuuugcagcagggcuguuuugucuauaugaugaaaacuguaguaaaauauuuaaaauaagauagcagacguuaaacauuccgaaaagugaaagugcuauacaaguauauacaggaaaaccguacacauaaaugaguaauauauaaauccaccacguacucuuuuuccauaugaauaaacgcacauacaaguacauaccuuuuugaaacacuucguuuaaauuacuggaggacuaauuugucgaccuaaagaacugaggcaaggccgagcacgguggcucaugcuuguaaucccagcacuuugggaggccgagaagggcggaucaccugagguccggaguucgagaccagccugaccaacauggagaaaccccgucucuacuaaaaauacaaaauuagccuggcguggugguggugcauaccuguaaggagaaucgcuugggcgggguggggaggggcggagguugccgugagccgagaucgcaccauugcacuccagccugggcaacaacagcggaauuacgucucaaaaaaaaaaaagaacugaggcacaauucauauaaguagaauguuuauuuggggcaaguuugaggauugcaacccagagcacagauucaaaaugcccugaguagcagcaguugcaaguggguuuuuagaggaaaaaauggcaguuccuaaauugucuaccaagaauuuacauuaaaauaacacaagcgauugauuggcuauacaucauucuuuucaugacaaauuccaggaacgcggacauaaugggugaagcagcuagucaggaauaaaaugccaggcauuaaguggggaggugucugaagucccauacugcugucucucugggcccggcaaauuuugcacaucucaaauaauuaacaaugcuccgagccauucuucuuuucucauauagaacaagacucacgaaaaccgacagcagcagcuuuaggaggcccaauacaguccguuuuccguacgaaaugaguuuaauuuauugugacugcuccaaaagaaaagugcgguucaucuaauuuucuuccgaaaaggaaguuaaggaccagaguuucuuugacccccuuccccccacccaccuccuccauuuuccagcucuagagaauggcuggggcagcgcgcgacguuguagcuacgguuacgacccgccccguuccuucuacgagaaccacaucagcguaguaucacuuuuccccuccgaagcacagucacccgucagcagccucgagggcugacguguccuuaucaagccggcgcgccccgcgauucuauagccgccaugccugagaccuuuuuccugaagggagaagccugcucucgaacuaaggccggcgagggccauaggucucgccuucccuuuccuaagaaggccuaguccuacccaggauucugagcaagggaggcuccuauuggagccgcuacagccucguucuuagcuuaccgagaaacagcgcccgacaccuggcccuucgcagcucucgccuuucgcagcucucgccuaacaggaaagggaagaaacaggcggaagugggaacugcaccugagcgacaguacugca

SEQ ID NO: 17049 - RNA, 2644 nt, Homo sapiens
cuaacucaaaacuuguagaaugccuucacugaauuuugguauaaagaguaaacaaaacuuauucugcaaaaggauuaggaaccuuuuuaugcaaaaaugaguauuuuauuuugucagcacuaaaagaaaaaaaaaaacaaaaccacuguauuucuacauugaggugaaaacaauguuuaaacuuucuuaucaaucaaauacauuccaaaagaaaguguguucuaugaagguuccaaaacacacucaaaacacaauaguacaggaaucuaauacugaaaaugacuguucugacaggguguuuaacaaacauaacuuuuaaauuauuaaaccagugaagcaaucccuuccuaauaagugugucaagagagugaaacuggguuuguuccauuaauacccuaacaauuucaucguaauacuuuuuacugcuaugacaguuuuaaauaaauuuugcuguacuuaaaauagguuuugaaaguggaaaaguguacaaaguuucagauaaaaagauuaauaaaugcaauuuaaauaaaauuuccccucuucucucauaucaacaauaaucaauuuuagcagauaacagauugagcuuuaaaacccuacucccaaaaugaaaccuucaguuuuaaaucuuaaucagacauaacuggaaaagauuacuauguauuuggacaccuuuuacaagauuuuguuuuuguauuaaagcagaaaccaguuccuaaacucuuuuauucaauuguauguccuguuuggacaaauaucaaaaauagaagacugucgcuuuuguaacugugauuuucacugcagucuucuauaacuuuuacagaguucauggucccuaauaucuccccacccuccauuuuuucuagguggggaaauggcuaccacaguaaacuuuucacugauaguuagaguuucuggaaacauguauuguuuguuauuauuuaagagugacucaauuugggcacucugaguggauggucuacagguuuucuugugaugcauaccacagucuccagcaugaaagauccuaggaauuugaggaaccagcacuuuccagaauuuuggaagacaagauacagucaaguauugaagaguccagucccaguuauaaucaucauaaguacagaaagugucugugcacucgaucagcuucugauaggcauuccgggucaaggcuagacccauauugugcucuguggauuuccaaguuuucacaucuaccuugucagccaugccauagaaacugcgacuggcacuauagguccccagggagagaacaucacauucagggcacucuugcugcuucaguuuccacaucuuuuugaagacaugguaaaagucuggggcuaaguagugauccucuucuaggaaaaguauaaggccagcauaaucucgaagaauuuucacucuuucccacacaaaaugcagcuuccaccaccagugauguuuggucugggagaauuuggccucucuauaauggccgaaggagucgggauacucagcauugaugcaccccaauuucaaagcggcauucuucggcaggucucugggacaaucucuagggucacuaccuggaaacucguuaggguacaacugaaugcugaaaggaaagaacaccugcagaaccggacagaaauucaccccggcgaucagcugauugaucucggucgaccagaagucauggcuaaagaugacgaggacguugucaauucccugggcuuuucgaagugaguccagcagcagucugagguauucgggccgguuaugcaccuggaccaccagcaccagcucccggggggcccaggugccagccuuaucuacauuccucagggucugaucaaaguucagcugguacaccagggaccgguaccgcagcgucagguuguccgccucgggcugggggaccgccgggaccagggaagccgccgacacguuggagacccugcggaugcccacagccacagaggggugguccccaccgcggccgccggcaccccgcgcggguucggcguccagcaacgguggggcgagggccucguucuuccuuugucgcccauugcugcuccagaggacgaagccgcaggcggccaccacgagcgucaggauuagcaccuuccguuuguagaugcggaaccucauggucuccagggccgggagcgcaggcgggcgggcgcggaaaggagcagcugcuucugcacggaaggggcgggcgggcggcggccgucgccuuggccugucacggucggaacuggcccccgcggcugcccucgcuaacucaucccgggccccggggguccuggggcccgagaccucucauuuaccccgcgccgccugcgcuccacacauccucgccuggcagcuacagcucgagcaucggcgccgccgcuaggagccgcggcucggcuucgucuccguccucuccauucagcaccacgggucccggaaaaagcucagccgcggucccaaccgcacccuagcuucguuaccugcgccuccagcggcccugcguccucugcgcucucauccuuacaggggcccuagacggccagaacugagcgacgcggccucgccucacuccggcggggaccguuaugacaacccgcaacugccccgcggcacaccgcggcccuccggcccacacccc

SEQ ID NO: 17050 - RNA, 3793 nt, Homo sapiens
gggaccccggaagcuuaucggcgcgguugcggccgcggcucccuguguuuugaucagaacaccacguuccugcuuaacagaaauuggucaguaugcgcuuaaugcucauaguguggcguccggacacgcagcgagagaaaaacgcaauaaccugguccgucagcguugcuugcuucagcaggccuuaaauaugugcugcaucuuuugggggacguuacuuaagaggcaaacaucuggcucgaagucuuccauuauuuucagcaagcauuuaggaggugacugcacuauaaggagaauaacccacaguagcacagguugggagucugcacagugccgaggccagcucagucuucacuauucgaacgaaggaagccuggggcaacuguuuguuuucucugcccugcguguuaguugcccguuguuuuuggagaaaaaacuaguaucgggguauauugguggaaaaauuuggauuuggcagcuugaagccuuuuuugcgacaagcuuagguuaggaagggauagaggggaggaaagaaaaaauaauuuucgaccauaguagaucugcgaaagcagaccuucuguuuguccucuuaucuauagucuuucccucaccccccaccccuugucuccuaaaaaccaguccagacuuuccccgccaccuccguccuuguagcagauaacguugcuccuuccuucauggauaaauugaaggccaacagacaaaaacuuuucaacucuuugcugcucuguccgcucuaaauuuaucuuuacaccuucagagaagagcacccuucuguuuuccccuccuaccucaaacccaguaggucaaaauucuuccaucaaucauuuuuacccauucuaucucucucuuucauuuauacagauuccaagcugccuuucuucuaaaaaaaaaaaaaaaaaaaaaguaaaaaaacuccuuugaccuugccuuucuaaaugaaaucugucuguuguuuucauggcugcacuucuugaaaccauguucuacaauugcuacauuugcuucuuaaccuucugucuucaguccauagcccaccaauccacugaaacuauucuagcuaaggcuacgauacccaagccuccuaauuggcaggucuaagggacccuuucugacauaggugauguaauuuaccaccaaucucugucacuugugacugcuguuuccucccugaacguuucuucucccugguucuuguucacagccccugauauuuccucccaggcucucucuucugcccacccagcaaauguuuuuguuccuuacaguucccuccuaaauguucucuguucucucaccguguucuucaugagugauguaauaaauucucaaggcucucaaaucuguaguuccaaucugaugcuguuuccagagcuucagauucacauuuuuaguugccuucuggaugucaccuugaaaucauucaaaacuucaaauucaguauuugcaaacaaaacugaucaucuucucuucuuccuccaagcuuacccauuuuuucuuuuuaucaauauguuuauuuauuuauuuuuugagacagagucuugcuccguugcccaggcuggagugcaguggcacgaucucggcucacugcaaccuccgcuuccuggguucaagugauucuccugccucagccuccucaguagcugggauuacaggugcccaccaccgcacccagcuaauuuuuguauuuucaguaaagaugggguuucacaauguuggccaggcuggucuugaacuccugaccucaugauccaccugccucggccucccaaagugcugggauuacaggcgugagccacugugccuggcucaucaguauguuuaguugcucacuucagaacucucagagucauccuugacuacuauuucauccauucaauaccaaauacuuacuuuuuacuuauccagugacaggcacuguacuaggugguagagaugugguggugaagaaaagagacagaguggaagagacagacaaaaacuuagcaaaaaaaauuauaauuucaaacugugauaaguaccggugaaggaagcacaguacugagauaugaacaauggugguaggaagcagguggggcaccugcuuuugagaauguagucagguaagccucuuuuaggagguaucauuuaaauuagggccugaagaaugaggcaucgguuaagguacauugaagcaaacaaggacugucuguaaacugaaguaaacgaaccucucuuuaggaaauucagaagaaagaaaauuaucucgaggaaguuggucagaagaaaaugggcagaucaugaaauguuaguugucccccaaagucgguucuccccuuuuacagugcuaauacauugcuacuugggcacaugaaucccagcuagagaccacauugccugaauuuccuuacaaccaaguguggucaaguucucacuaauggaauaugaaugaaaguuguauguguccucugcaucacuugcuuaaaaagaaaucgguugcccucuacuuuggcccucuuggccuuuccagcgcuagguggcgccagugcagauccacugcagugccccaccuuuaaccaugcaaauuaggaaaaauaccuagggucgaggaaagaaaccagugaaugcagaaggggcaggauuggaaaacaaaacaaaacaaaacaaaacaaaaaaaaaaaaacaaccaaaccaaaccaaaauaaaaccaaaacagcagaguccauggaugaauuaaugaagcugauccacccuauagccuccaccacuccuaccucuggacuguuagaugagaaauaagcuuccaucuuaauucaaucacuauauuuuggggucucuuuauuauuacagcauacucuguacucuaacuaauagagggagguucccagaagaaaauccuggauaagcagaacucagagcaggaaccaaaagagcuccagguaucuacagggcaccccaaugggaugaaccauccucaguauccucuaagaagagucugauuuucuaguuugaguucuguauucuucuacaaucuguauuuauaugcauaccuauuuuuauuuuuguuauuuauuuauuuuuugagacgaaguuucgcuccgcuugcccaagccagagugcaauggugugaucucagcucauugcaaccuccgccuccuggguucaagugauucuccugccucagccuccagagcagcugggauuacaggcacgugccaccaugcccagcuaauuuuuuguauuuuuaguagaaacgggguuucaccauguuagccaggcuggucucgaacuccugaucuuaggugauccacccgccucagccucccaaagugcugggcuuacaggcaugagccaccacgcccggccaugcauaccuauuuuuauuauaauuauguuguaaauaaaacaucugugucuugcuuuucuuucccacauguuacuauguuuuugguggcaguauaaucuuuuauuauuauuauuauuugagacagagucuugcucugucucccaggguggagugcaguagcgcgucucagcucacugcaaccaccaccuucccaguucaaaugauucuccugcuuuagccuccugaguagcugggacuacaggcaggcuucaccacacccagcuaauuuuuguauuuuuaguagagauggggguuucaccauguuggccaggcuggucucgaacuccuggccucaggugaucugcccgccucccaaagugccgggauuacaggugugagccacugcucccggccagguggcccuauaaucuuuugauuuggugcaucaua

SEQ ID NO: 17051 - RNA, 4097 nt, Homo sapiens
gacacaccacacgucccacuuaucuaguucaagcgaguaacauaacgugagaaacugcacuguguaauuccuuuauuuucugcauauuagugcuuuaccaacacuacaaccauaaagaacacaauuccaaguacuguacuuuuuaguuuggggagaucacagucuacagacucauuuacuuauauuaaacaagauuaaccucauucaaaacuuacugcaguuuauaaauucacauaaauacagaaauggaugcaauuaaacaacuucaggaucuuauuuuuaaaauucuuagauaauuuuuucugcaggcuauaauuaccugcuccagucaccaaugguuauuguucaauuuaacuacaucaauuauaaaccucuuauauccuuaaagaaaauuuuaagugaaaauuacaauuucuuaccaaaagguuuaggguuuuccaaauuucaaauauuugcuucccccuccccccuuuccagucaaacauuucaaauaaacuaaaaauaaccacaucucaccugcaacauucaauaauagcaaucacuugauguauaaaauuuuaacuaugcccccaguuauuuuaagacacaaaaaaauggcugccuaccaaucugucuucacaaguuagaaauacuacauuuaagauuuaacaugaggguuucaaguuuccuccaguuuaggcauuuauaccuuugugcuuguuuuguuucaggauguuacuauagcauugauauuggauaacccauauuuauauacuuuaaaaugcaaucauuugaaacacuaaaaauuacauuuaugguggagcuuuggaaauuuuagaaagcaaccaguguucuuagauguguuuaucagccucauuucuagagcucuuucuacuaaagugaaacugagaacuucguacuuuaguuguauccugaaaucaaaaaaaucccucugcaccaacaggagccuacaugagaauacccuuuugcaucugcuuuaaguaaaauguuuguuaagaguuuuacuuugaauaguucauuuuuuuauagucuuacacuucucauacaucuuugguaaaagcuccauuauacaauauggccaaagugugaaggaccaauacuguccaacuauaccaugauaucccgcucaauuuuaguuuucagacacccucauaaacaaaacccacuccaccuuuuccuguauacugccuuugcagucuacauuucugaaauucccuauuuaauuccuugaggaucacuaaaauuaauccuuaaggcuauauaggaaccagaugcugcuuuacaauucugcaucaagcauuaacauuugguucaaaauauuaucauaguggucgcaauccaguuacugguccuaaccagcuaaccaaguaaucuuguuaggaucuggauaucaccagcgagcacacugcuuacacaugaagaaaaauaaguuuacauucauugucaucuguagguucuuucucuucauccuacguccccuuuaauagucaucccucaagucuacacaucauucauucaucacgcuuccuuccuuaaaggagacaguguacuauugaaccaacaggauaucuuuuuuauuauuugcaugaguuaauccuacaaacaaaauuaaauaccucuuuuauaaaacaucuuuuccaguguucuaauugauggagaugcggaucacucaucuauaaaaaaugacuuacagcuucagcuuaaucaguugcuauaaugugaaaacaggaauguguauuuuuuucaacuagguaaaaggugcauauaauuugaauuguuaaauguuuuauuaaugaacaaaguaaaccuuuuaguaauuuuuaaauuacuggucuuagguguuugaaacaagguaaaaguauacauuccaguuuugcccaaaagucacuuaaaauaucuacaaauuauuuaaucugugugugguaacaccauuauugcuccaauuucuggaaagagucuauuuucaaaguuuaaaaaagaggaaaaacagcaaaguggcuaacuuugcaguggaaagaaaaaguguccuucauggguuacacuuucauauuuuuaugcagcauuaaguuaucuacguuauggggaacuuggguuuuauuccuacucaugcaugauguguuucagaacuuacuugcugacauuucagagaacuucuuacauuaccuguuuaacauacugaggugcaacuggaacauauuacaauauuacucauuauuugccacugugggcuaaguuuacuauacuggucuuagauauaaaaggucacauuugaaauuacuaaguuagaacucauaaggaaggggggggaaggccuuaaauauaaaagacaaacggcaguuugauuaagcaauaauuuucaguuuacuagaugaaacagacuugcaacauagucugcaugaaugcaaaauaagccaucuacagcaagugauaaggaaacugggcaaaaaaggaaaaaagcauacauaggaaaaugaaagauucucucgaaauaaaaaaaucaaacuauuauuacaaaggacuuuaccaagaacugcuguguuucccccaucccaucugcuggaagucaacaagagcaucuagcaacuuuguguucaugucaaaugucagaucagagcauccuaacgcaaagccaacaaaaaaaaaaaaaaaaaaaaaaggaaaaagaaagggaaacaaacaaaagagaaaacccccaagccccguccccgccaaacuguagaacaguaacuccagaguucaaauucaaaagaagagaaaguggcaauugaaagaggugaugguggcgauaauccuaugaauggguuuuugauuucucuccuuccaggggauggguggagaaugcucauuaagauuuguaguuagagguuaaccaugugagccccucauagaguccguccccugagguggcacaggagggcugcacauaccaguuccugucccgaauccgggucaggcccaguuucuccuggaucucgugggguuucauggcaucgggcagguccugcuuguuggcgaagaugaggauuauggcgucccucaucucccggucauugauaaugcggugcagcuccuggcgagccucaucgaugcggucgcggucggcgcaguccacuacgaagaugagaccuugggucccaguguaguaaugccgccagagcggccggaucuuguccuggccgcccacaucccauacguugaacuugacauuuuuguaagucaccgucuccacguugaaacccacagugggaaugguggucaccgacuggcccagcuucaacuuguacaggauuguugucuugccggccgcguccaggcccaacaugaggauccgcauuuccuuguucccgaagauuuuggauagcaccuuccccaucgcgucggaggagccggggccgggggcauucaggugucccggguccccucagccaacaacgccgccgccgccgcgaaaccgaaacgaagccucucggccgcgagagcgccuuugcggccugcgugggaguugccuccuaagggcagaggcccaggccccccgcucacucgggcaucaccgaccgcacaacuugauuucuccagucgccgccgccacccgggcccugagacugcgcugggagccgccgcccugcugaggcgcggcccggcccggaacugcccuuccccccgcaggcgccgcgcgagcgccgccgcgguucccgcuccuccgccuuccucucaccgcgagggagacugcagcccuccggcccgcccgccggccugcgagcacugggcuccccaccgacccaggacacccgagaggcagcgcggcuccggggccccgucaggucauggauccucgcgggaacucggugcgcugccugcagagaaacagagagggaggggaguuacugccagagcuccacaaaggagcgaagaccgagguggcccgccuuuccagcucggcccaagggguuaccuccagccgccgccccgagcgcgggcucccuccggccuccaacuccuccucccaguucugccgccgccgcugccggaaaaggcgccgaggaaaccgccucacuuccccucccgaccacgcaggcgcagcagaggccgaccguucg

SEQ ID NO: 17052 - RNA, 7345 nt, Homo sapiens
aaaacauuauuauauaauagcagauaguucucuucagaaauuuaucucuagcuuccuguaaaagguccagucaaaucauguuggcuguuuuuggcagauuucagccucgccucaauaccaauuuuuauuugaauaacugauucccaacauuuaagaagaacuugaugcugaacuaaguaaccuaagcuggauucagggccauuggcaggcaggcaggcaagcaggaauuuuucguauugcagacagccccugguggucaucaucuauacaucggaucucuaaggacgugccggaaaaaaaaaucugugaacacaaucuucccaugcuguauucacaugcucuauucacaucuuuaguuuacccagguuguuagagccuuggguaagaugauuaaaggcuucacgauggaaauuucuauaacaaaaaaaaaggaaacuuaaaagauugauuuaccacaaacuauuuacuggguauuuaauaaugccuaauaugccucauaaugccuaguaugccuaguauaacaguggcuacaugcaauucaagugaacaaccaugcauguuuauagaugguucuuugcugacaccuaacaagcaacugaagaaagaacagaugcauuggacauuaucaaaauuaaaauauaugugcuucaaaagacacaacauaggccgggugugguggcucacaccuguaaucccagcacuuugggaggcugagguggcagagcacuugaggccaggaguucgacacaagccuggccaaccuagugaaacccaaucucuacuaaaaauacaaaaaaauuagcugggcgucguggcacaugccuuuaguccuagcuacuugggaggcucacacaggagaaucacuugaaccugggaggcagagguugcacugagccaagaucaugccacugcacuccagacugggugacagugcgagacucugucucaaaagaaaaauaagaaaauaauaaauuaagaaaauacaagacacacuauugagaaaaugaaaagacaacccacagaaugggagaaaauauucacaaauaaugcaucuguaaguguuuaguauucagaauguauaaggaacucucacaacucaaaguaaaaagacaaauaagucaaucugaaaaugggccaagcauuucuucuaaauacagaaaagauacccaacaucauuagucauuagagaaaugaaaaccacaguuuagagacuaucucauacccagugagauggguauaauuaacaaauguugguaaaaauguggagaaaacuggaacccuuauacacugcuagugagaacguauaaugguaugguagauuaggaacacaguuuggcaagucuucaaaaaguuaaacagaguucccauauaaccuugcaguucuccucuagguauauacucaagaggucugaaaacauguucacacaaaaauuuguagaugaacguccauagcagcauuauucaucucaucaauggauggauaaggugugguacagccacauaaaggaauauuauucagccacaaaaaggaguuaagugcuaaugugugcuacaauguagauaaggcucgagaauacugugcugagugaaagaagacagucacaagaggccacacaguaugugacuuguuacauaugacaugugcagaauaggcaaauccauagagauuaguggcugccagcagcuggggacggggguaacagggagugacugcuaauggguaagaggcuucucuggggggugaaaucauuaaaaauuagaaagugguaauuuacacaacuaugugaauauacuaaaaaccaccaaauuguacaccuuaaaagcgugaauuuuaugguaugugaguuacaucaacuaaaaaauaagaguuuuuuuuuuuggccgaaaaaaaaaaaaaagccucuauauuuaggaaacacaaaaucuuucugccuccaaaaaauucuacuuuuaaaacugcacaacagcuucaguuaacacuagaucccuuaaagcacaaaacaguuuuuuuuguaucuguggcaccaugccacauaaauguuaaucugaauaaucccgcugcugccuuuuuacuuagauuuaguccuaacaccuacuucuguucccuaaguuuuauuugcuuuugacuagaauucauauaaucagaaaacuuuaccacaaacauaaucaaagcaaagaugauagaaaaagugugggcuuauugaaucuagcauccuuaauucauaaaacuaaucaucucccugccuuacacuagucacauauaccaaaggugcuggaaauacaaaaauagaugaaaggccaggcgcagcagcucacaccuguaaucccaacaauuugggaggccgaggugggcaggucacuggaguccaggagugcaaaaucagccuggacaacauggcaaaacccugucucaacaacaacaaaaaaaauacaaaaauuagcugggcaugguggugcaugccuauggucccagguacucaggaggcugaggugggaggaucacuucuugagccugcaaggcagaggcugcagcaagccgagauugcaccacuguacuccagccuggaugacagagugagacccuauuucaaaaaaaaaaaaggaugaaguacaauucuucccucuuucuacaggcucaaacccuaggugucacugaggcaaccugcauaaaaugugauuguuauacaggguaaaacaugcaccaagaagcgggaaaauacauaaauucuacuuaauugagugcauuuaucuuuuauggacucaucugccuuguuguauuucauuuccuguaaacaauuuuuaauaaggaaaaguucacaaagguaagagcaggcauuuuaaaaucucacagagauaaaagaaacuuauaaauagcuaauaacuugucugagguaauacccaauuauagagcuauacaauuuacgccuauggagaagcuggaaaaggccuuuaaaagcgaagccuggccagguaugguggcugaugccuguaaucucagaacuuugggaggccgaagugggcggaucacuugagcccaggaguucgacaccagucuaggcaacacggugaaacgugucucuacuuaaaaaauacgagaaaaaaaaaaaaaaaaaaaaaaaaagccuggcuuuagagcaaaaacccaaggcaagauagauuaaauuaucuugacaaugaaguuacugccugaguccagugaaucauuagagcuguuucuccacaucaaaaucaacgcccauaccacacauaugcccugaaauaguguccagcugaugaaaccuccuuggagaaugaagaacugagaauguuauuuaccgauuuuuucuuucugauguauauaauaugaauaucuucacuucgauacucuucaucauguuuuuccaaaggaauuuuuucaaagucaaaaucuagcugaaggagcuauaaauuuaaaagagacauacuucaaauucaauaauaugaacugaccugugggugacagaagucagaaugcugguuacuuuuuuuuugagagucucacucugucacccaggcuggagugcaguggugcgaucuuggcucacugcaaccuccaccucccuggguucaagugauucuccugccucagccuccugaguagcugggauuacaggcaaacgacaccacacccagcuaauuuuuguauuuuuaguaaagaaaggguuucaccauguugaccaggcuggucucgaacuccugaccucaugaucugcccaucucggccucccaaagugcugggauuacaggcgugagccaccgcgccuggucagugguuaccuuuugaguauugccugggaaagggcagugugcaaaccuuccaagauccugaaaauguccucuaucuuuauguugguaaguaguuacuuggguguauacauaugaaaaauuaagcucagcacuugacugauacauaugcauuuuacauaugcuuuaccccaauaaaagcuguuuaacaguacgaaauuuucauuaugcaucauuucaaaaguucaugaacauuuuucauauucaagaaaaacaugaaaauaaacaaacauuuuaguauuuguuaccugaggcagucauauaccugcuuucucauuaaaccaaaguaguccuuccagcagacaaaacugcaggccuauauagauguacccucaaaaggagucacucacaaugugauagauuugugcccauauaaggguuugggugaucacuaggggaagaagagugacagauacauaaaacccuauauacuauauuuugcaacuuccuguaagucuuuucuaacuauuucagacaaaaaguuuaaaaaacaaaaaaaaagacccuaaaaauagacagguaucuagguuggagguuucauaaauauguagagaaaaacacagaaguaaaaacuuaucacuuggcaacaugggaaaaccccaucucuacaaaaaaauacaaaaaguuagccggguguggugguacaugccuauagucccacuuacuugggggcgggggggggggggggugacacugaggcaggaggaucacuugagcccaggagguugaggaugcagugagcccugacugugccacugcacuccggcaugggcuacagggugaaacccugucucaaaacaaaaacaacuuaucaccugcacauuucuaucacguauucuccaaagguaauacauacaucauugagauguuccccaaaggcagcaucauguuuaauaaacacugaaaacuguucuuaaaaaggaguggcacccguauuaacauucuucuguagccauagaucaacuaauuagaaaugaaauaaaguaucagaaaagaugaaaaaggggagcuucguagaaucaugggcugugaagauccuuuccucagcuucacacaaacagcauguuuuccccacccaaaauuaccauaauauacuugaagagucacauacagccccccugaagggaaaucacuacaaagauaauagaguacuuaauacuuaccucaaaauauuuuuucucaauuucuggauuuuuccccauuguucguuguucauaacaacauauaauacaaguuucaaauccgcugauaucuuuuagaguuuucagcaauggcuccaaagacuauuuaaaaaagaauauauuuuuuguuuuugauuuaaaaauuuuucuacucuaaaaguagguugaggagguacagggguauuuauagcuccccuacaauuuauccaucuuugaaucaauccaacaaagcacauguaauuaaagcucuaggcuaggugcaguggcucacaccuguaauaucaacacuuuggaaggcagagguggaaagaucgcuugaaagcaggaguugaagaccagccuggagaauacagcgagagacaaaccaccccccgcaacaccuuacaaaaaauuuaaaaauuagccagcaugcuggugcacaccuauagucccagcuauugaggaggcugaaugggaggauuacuugagccucaggagcucgagguuacagugagcuaugaucacuccacugcacuacaacaugugugacagagcaagaccccuaucuuaaaacaaaaacaaacaaacaaaaaccccucuguaacuaaugauuggguaagcuccuguuaacuaaaccauguacugauuuugguuuccagaaaaaggauucagaugacugcauuuuggaguucucaugggaaacaaauggaaucaaccuuacucuuaaaaguuuaauuuuauuuaaucuaauuugggauuuaaauaaucaacgauuucccuacaaaaguuaaaucugacccuaacuugguucaaugcuaauuauuuuuaaaauaaucgaugcccacaacacuauacaaacugauguuuuuuuuuuuuuuuuuuuuuuuugagacagaguuuugcucuuguugcccaggcuggaaugcaauggcaugauuucggcucacugcaaccuccgccucccagguucaagcgauucuccugccucagacucccaaauagcuaggauuacagacaugcaccaccacgccuggcuaauuuuguauuuuuaguagagacaggguuuugccauguaggucaggcuggucucgaacucccgaccucaggugagccaccugccuugaccucccaaguguugggauuacaggcgugagccaccgcgcccggcccaaacugguauuuaaagaaaagaacaaugaauuauuuauaacuuaauucucaaugucaugguuaacauguuccgugggaacaaccaagggaaaaagagaggauuuuggcuuuucauaacauccaauuggcaaaauccuuuaaaauuuuuacagaagccucuaguaaaaugcauauaacacuuuucucaacaugcuucaccaggucgguaugauaaugaugagcguauauacauauggucccuggugacuuuuaucuucucuuuacugcaucaacuauaaggcaaaucccggauucaaagauguuaaaaugugaagaaacgugugcuuuagaauucauggaauaagguucaucuucuaagugaagagacuucgcucacuggauacuuaccucuucauaguauaugcagucggccaucaguaugaagucggguggagaaggaaagccuucuauuucuuccccccuuaaaaaugccaaacaaauauuucaauuguuuuaauaauucaaaauacucuuguuuuauaaagaaccggaaaguccccuuccauccuuuuaaugaaacgcaauucaaaacaaacuacaaaucaauaucuuaaaacaagcugaaaggccauacaaaccauuucaguaccuuggcuugaacagaaccagugacaagaugcuuguucauauuaauauucaucuucagcaagucuugcaauuccucaagaucggugacuacaacaucagcccuauaaaauaacgucgacugagguguaggcacaggggggaaagccuguaauccggauuuccccagcaagaaggcgcccccacaucccgcccgcccgccagcucuuacccgaggguagcagccaugagccccacggccccggugcccgaacccagcuccagcaccgaccgccggcucagcgcgugggccccgucgccagaaaacucgggcguuuccagguauuuagaaaggacaauggcagcgucccacacaacgcaacccacgccaccggagcuauacugcuguagucguagcacuguaccaucccgcuucuccaaaacucgcacaaagcuccgcaguggguccuccagcgaggacuccagcguauccgccauugcgcccggcaacagaaagcggcgcgcgcagggacgucacaucaacgcgcaccgccccgcccugcggcuccgcccccugcccgccgcugagu

SEQ ID NO: 17053 - RNA, 7345 nt, Homo sapiens
acucagcggcgggcagggggcggagccgcagggcggggcggugcgcguugaugugacgucccugcgcgcgccgcuuucuguugccgggcgcaauggcggauacgcuggaguccucgcuggaggacccacugcggagcuuugugcgaguuuuggagaagcgggaugguacagugcuacgacuacagcaguauagcuccgguggcguggguugcguugugugggacgcugccauuguccuuucuaaauaccuggaaacgcccgaguuuucuggcgacggggcccacgcgcugagccggcggucggugcuggagcuggguucgggcaccggggccguggggcucauggcugcuacccucggguaagagcuggcgggcgggcgggaugugggggcgccuucuugcuggggaaauccggauuacaggcuuuccccccugugccuacaccucagucgacguuauuuuauagggcugauguuguagucaccgaucuugaggaauugcaagacuugcugaagaugaauauuaauaugaacaagcaucuugucacugguucuguucaagccaagguacugaaaugguuuguauggccuuucagcuuguuuuaagauauugauuuguaguuuguuuugaauugcguuucauuaaaaggauggaaggggacuuuccgguucuuuauaaaacaagaguauuuugaauuauuaaaacaauugaaauauuuguuuggcauuuuuaaggggggaagaaauagaaggcuuuccuucuccacccgacuucauacugauggccgacugcauauacuaugaagagguaaguauccagugagcgaagucucuucacuuagaagaugaaccuuauuccaugaauucuaaagcacacguuucuucacauuuuaacaucuuugaauccgggauuugccuuauaguugaugcaguaaagagaagauaaaagucaccagggaccauauguauauacgcucaucauuaucauaccgaccuggugaagcauguugagaaaaguguuauaugcauuuuacuagaggcuucuguaaaaauuuuaaaggauuuugccaauuggauguuaugaaaagccaaaauccucucuuuuucccuugguuguucccacggaacauguuaaccaugacauugagaauuaaguuauaaauaauucauuguucuuuucuuuaaauaccaguuugggccgggcgcgguggcucacgccuguaaucccaacacuugggaggucaaggcagguggcucaccugaggucgggaguucgagaccagccugaccuacauggcaaaacccugucucuacuaaaaauacaaaauuagccaggcgugguggugcaugucuguaauccuagcuauuugggagucugaggcaggagaaucgcuugaaccugggaggcggagguugcagugagccgaaaucaugccauugcauuccagccugggcaacaagagcaaaacucugucucaaaaaaaaaaaaaaaaaaaaaaaacaucaguuuguauaguguugugggcaucgauuauuuuaaaaauaauuagcauugaaccaaguuagggucagauuuaacuuuuguagggaaaucguugauuauuuaaaucccaaauuagauuaaauaaaauuaaacuuuuaagaguaagguugauuccauuuguuucccaugagaacuccaaaaugcagucaucugaauccuuuuucuggaaaccaaaaucaguacaugguuuaguuaacaggagcuuacccaaucauuaguuacagagggguuuuuguuuguuuguuuuuguuuuaagauaggggucuugcucugucacacauguuguagugcaguggagugaucauagcucacuguaaccucgagcuccugaggcucaaguaauccucccauucagccuccucaauagcugggacuauaggugugcaccagcaugcuggcuaauuuuuaaauuuuuuguaagguguugcggggggugguuugucucucgcuguauucuccaggcuggucuucaacuccugcuuucaagcgaucuuuccaccucugccuuccaaaguguugauauuacaggugugagccacugcaccuagccuagagcuuuaauuacaugugcuuuguuggauugauucaaagauggauaaauuguaggggagcuauaaauaccccuguaccuccucaaccuacuuuuagaguagaaaaauuuuuaaaucaaaaacaaaaaauauauucuuuuuuaaauagucuuuggagccauugcugaaaacucuaaaagauaucagcggauuugaaacuuguauuauauguuguuaugaacaacgaacaauggggaaaaauccagaaauugagaaaaaauauuuugagguaaguauuaaguacucuauuaucuuuguagugauuucccuucaggggggcuguaugugacucuucaaguauauuaugguaauuuuggguggggaaaacaugcuguuugugugaagcugaggaaaggaucuucacagcccaugauucuacgaagcuccccuuuuucaucuuuucugauacuuuauuucauuucuaauuaguugaucuauggcuacagaagaauguuaauacgggugccacuccuuuuuaagaacaguuuucaguguuuauuaaacaugaugcugccuuuggggaacaucucaaugauguauguauuaccuuuggagaauacgugauagaaaugugcaggugauaaguuguuuuuguuuugagacaggguuucacccuguagcccaugccggagugcaguggcacagucagggcucacugcauccucaaccuccugggcucaagugauccuccugccucagugucacccccccccccccccgcccccaaguaagugggacuauaggcauguaccaccacacccggcuaacuuuuuguauuuuuuuguagagaugggguuuucccauguugccaagugauaaguuuuuacuucuguguuuuucucuacauauuuaugaaaccuccaaccuagauaccugucuauuuuuagggucuuuuuuuuuguuuuuuaaacuuuuugucugaaauaguuagaaaagacuuacaggaaguugcaaaauauaguauauaggguuuuauguaucugucacucuucuuccccuagugaucacccaaacccuuauaugggcacaaaucuaucacauugugagugacuccuuuugaggguacaucuauauaggccugcaguuuugucugcuggaaggacuacuuugguuuaaugagaaagcagguauaugacugccucagguaacaaauacuaaaauguuuguuuauuuucauguuuuucuugaauaugaaaaauguucaugaacuuuugaaaugaugcauaaugaaaauuucguacuguuaaacagcuuuuauugggguaaagcauauguaaaaugcauauguaucagucaagugcugagcuuaauuuuucauauguauacacccaaguaacuacuuaccaacauaaagauagaggacauuuucaggaucuuggaagguuugcacacugcccuuucccaggcaauacucaaaagguaaccacugaccaggcgcgguggcucacgccuguaaucccagcacuuugggaggccgagaugggcagaucaugaggucaggaguucgagaccagccuggucaacauggugaaacccuuucuuuacuaaaaauacaaaaauuagcuggguguggugucguuugccuguaaucccagcuacucaggaggcugaggcaggagaaucacuugaacccagggagguggagguugcagugagccaagaucgcaccacugcacuccagccugggugacagagugagacucucaaaaaaaaaguaaccagcauucugacuucugucacccacaggucaguucauauuauugaauuugaaguaugucucuuuuaaauuuauagcuccuucagcuagauuuugacuuugaaaaaauuccuuuggaaaaacaugaugaagaguaucgaagugaagauauucauauuauauacaucagaaagaaaaaaucgguaaauaacauucucaguucuucauucuccaaggagguuucaucagcuggacacuauuucagggcauaugugugguaugggcguugauuuugauguggagaaacagcucuaaugauucacuggacucaggcaguaacuucauugucaagauaauuuaaucuaucuugccuuggguuuuugcucuaaagccaggcuuuuuuuuuuuuuuuuuuuuuuuuucucguauuuuuuaaguagagacacguuucaccguguugccuagacuggugucgaacuccugggcucaagugauccgcccacuucggccucccaaaguucugagauuacaggcaucagccaccauaccuggccaggcuucgcuuuuaaaggccuuuuccagcuucuccauaggcguaaauuguauagcucuauaauuggguauuaccucagacaaguuauuagcuauuuauaaguuucuuuuaucucugugagauuuuaaaaugccugcucuuaccuuugugaacuuuuccuuauuaaaaauuguuuacaggaaaugaaauacaacaaggcagaugaguccauaaaagauaaaugcacucaauuaaguagaauuuauguauuuucccgcuucuuggugcauguuuuacccuguauaacaaucacauuuuaugcagguugccucagugacaccuaggguuugagccuguagaaagagggaagaauuguacuucauccuuuuuuuuuuuugaaauagggucucacucugucauccaggcuggaguacaguggugcaaucucggcuugcugcagccucugccuugcaggcucaagaagugauccucccaccucagccuccugaguaccugggaccauaggcaugcaccaccaugcccagcuaauuuuuguauuuuuuuuguuguuguugagacaggguuuugccauguuguccaggcugauuuugcacuccuggacuccagugaccugcccaccucggccucccaaauuguugggauuacaggugugagcugcugcgccuggccuuucaucuauuuuuguauuuccagcaccuuugguauaugugacuaguguaaggcagggagaugauuaguuuuaugaauuaaggaugcuagauucaauaagcccacacuuuuucuaucaucuuugcuuugauuauguuugugguaaaguuuucugauuauaugaauucuagucaaaagcaaauaaaacuuagggaacagaaguagguguuaggacuaaaucuaaguaaaaaggcagcagcgggauuauucagauuaacauuuauguggcauggugccacagauacaaaaaaaacuguuuugugcuuuaagggaucuaguguuaacugaagcuguugugcaguuuuaaaaguagaauuuuuuggaggcagaaagauuuuguguuuccuaaauauagaggcuuuuuuuuuuuuuucggccaaaaaaaaaaacucuuauuuuuuaguugauguaacucacauaccauaaaauucacgcuuuuaagguguacaauuuggugguuuuuaguauauucacauaguuguguaaauuaccacuuucuaauuuuuaaugauuucaccccccagagaagccucuuacccauuagcagucacucccuguuacccccguccccagcugcuggcagccacuaaucucuauggauuugccuauucugcacaugucauauguaacaagucacauacuguguggccucuugugacugucuucuuucacucagcacaguauucucgagccuuaucuacauuguagcacacauuagcacuuaacuccuuuuuguggcugaauaauauuccuuuauguggcuguaccacaccuuauccauccauugaugagaugaauaaugcugcuauggacguucaucuacaaauuuuugugugaacauguuuucagaccucuugaguauauaccuagaggagaacugcaagguuauaugggaacucuguuuaacuuuuugaagacuugccaaacuguguuccuaaucuaccauaccauuauacguucucacuagcaguguauaaggguuccaguuuucuccacauuuuuaccaacauuuguuaauuauacccaucucacuggguaugagauagucucuaaacugugguuuucauuucucuaaugacuaaugauguuggguaucuuuucuguauuuagaagaaaugcuuggcccauuuucagauugacuuauuugucuuuuuacuuugaguugugagaguuccuuauacauucugaauacuaaacacuuacagaugcauuauuugugaauauuuucucccauucuguggguugucuuuucauuuucucaauagugugucuuguauuuucuuaauuuauuauuuucuuauuuuucuuuugagacagagucucgcacugucacccagucuggagugcaguggcaugaucuuggcucagugcaaccucugccucccagguucaagugauucuccugugugagccucccaaguagcuaggacuaaaggcaugugccacgacgcccagcuaauuuuuuuguauuuuuaguagagauuggguuucacuagguuggccaggcuugugucgaacuccuggccucaagugcucugccaccucagccucccaaagugcugggauuacaggugugagccaccacacccggccuauguugugucuuuugaagcacauauauuuuaauuuugauaauguccaaugcaucuguucuuucuucaguugcuuguuaggugucagcaaagaaccaucuauaaacaugcaugguuguucacuugaauugcauguagccacuguuauacuaggcauacuaggcauuaugaggcauauuaggcauuauuaaauacccaguaaauaguuugugguaaaucaaucuuuuaaguuuccuuuuuuuuuguuauagaaauuuccaucgugaagccuuuaaucaucuuacccaaggcucuaacaaccuggguaaacuaaagaugugaauagagcaugugaauacagcaugggaagauuguguucacagauuuuuuuuuccggcacguccuuagagauccgauguauagaugaugaccaccaggggcugucugcaauacgaaaaauuccugcuugccugccugccugccaauggcccugaauccagcuuagguuacuuaguucagcaucaaguucuucuuaaauguugggaaucaguuauucaaauaaaaauugguauugaggcgaggcugaaaucugccaaaaacagccaacaugauuugacuggaccuuuuacaggaagcuagagauaaauuucugaagagaacuaucugcuauuauauaauaauguuuu

SEQ ID NO: 17054 - RNA, 114245 nt, Homo sapiens
ccggcuaggggggcgcgguggcgcggucgggaggguguuguguucucagcaggccucagggcggcacucugguucugcggccggagugcucgggcgggccgcugggcgccgacccaugcuggcugggaacgugucucccggugacgcagccccggguggggaacguggugcggcggcggcggcggcggcgacuguacgcgccuccgccgcccccgagaggacgcgccgugcagcggcugaguggcggcggcggcgacggcaaacccggagcugccggccggcgcgcgggaggaggacgcgggugcggucuaggaaguaggucccgggcuccgcgcucaacaaagacggggccgcccccauuagguacggagccggcccugggccccggcuggcggggaggccucgucgggcaguucgcgggcggccggggagggggaagggccgcagaccgaacggggauacggggcgccgggggcccuuccaggccccuuucucuuccacggccccuggcgggacggaagggaaggggccgggccgcgagggcgcgggccgcugggggucguagccugcgacgccaaccagccuuugcucgucccucgugcagacggagcugcgggcggaggcuccauguugggaagcggcgccguucgugcuuguuagcgggaauccgggagccgcggggugagcuggcgggggccgggcccuaagugaagauggaggccccgcugcggccugccgcggacauccugaggcggaacccgcagcaggacuacgaacucguccagagggucggcagcggcaccuacggggacgucuauaagguaagugaggcuggccgugcuuuuuuccugcggucgacugggucccgggaauggggccacuuuccugcgaaguauuggggcgagaggaggaugcuuuuauuguugccucuuggggagaaagcggccggggucccuuuuacucgguucugagcacccucgacucauggcuuguucuaaucgcuaccaacaggcagaacuaaccacacaguugcaaaccgcuguugcacuuuuuuugugguuuaaaggcuuuuuaauagggcuuauuuaugguauugaagggaauuugaaucugcuuguggaauuacaccgaaggaugcucuaguguuagcauggaaaaaugcuucauggaagauagacaggaaagaauauugacauucagacauuugcauuuuuuuaaaaaaauuuguuucaauggaugaguuugacuaaaaaagccauaugaaacccugucucugagcuuuaacuguaagcaaacuaauauuggugacauuuaugcaagcauuaucccauauaaaaagaugcuuuuccugguggaaguuugaucguuuguuuuugguuggcgauaaaaaugugauauuaacuugcuggguuuuguuuuacuuuagcgguuccuuucagggauuuauaacauccuauaaccaagaguggauaugagccgcugucuuuguauugugcuguuuuguauuacuuaagacaaacgaugagaguaaguuacaccuaauuuaggauuuuaaaaaacauuguagagaagcaaacccaauuccccaaauccgcugaguucuugaaugguucagaggaaagagauugagauugccuuaugcuuuuuguuguguguuccaaaaagggagcauuagugcagccuaugaauauuaagggcaaauuccuuugcuuuuugcaacggcguuguuuauuggauuugaucaugauauauaucgcauugugccaaacaacacuucugcauaucgcugaagugguuuugugucauuuggguaauuaaccaguagauuccucugggguuagguuguuguuuugcacaggugguuccccucuuucuacuuacuuuuaauuuccuccuaauuaauauuagcauuucaagguagugguauuaucaaacagcccuagcacuguuugauucuacugagauaaacuguaauggauaggcuuuuuauugcuuaaacaagcauuugagucuucuguaccaggcacugguagagguacugaggugaugaauugugagcaagguucuggcucuuaccuugugaauaccuuugaacucaaaguguauguuuguaacaauccucuucuucuuuauguaaaauuagagguaguuaacuuaguuguuuauccagggauuagccauuuuguggaaugcucuucagaaaauugaaauuccuauuuccuuucucagucucauuuuuuagucaucuuugucuuaugauucacuguguguuagacgaguucaauuuaguucauguuaauuuacaauaguauaaauucuacuuguauauauucucuucucccuacuacaauaaaguuuuaggaguguuuuucccauaaagaucuuaagaccuccacccuuuuucuucauagauguaguaacuaaagcaacucuggagcaggauuuuauucaugccugagaaaaagcaaagauuauauuuaaggggcagcuaaugccugccuuuuacccuggugccuuccugcccuagucucucuucugcaguucccaaacagaaucaaaaaccgaauauucaucauacucuaccuucaccccuuaacacaugguccccuacccucacaauguugcuuccucuacccucacaauguugcuuccucacacuuacauguauauucauugcacacuaggccagccucugauucuaaacauccuuaaggcguucuuagcuccuugucuuuuguuuuccuuuguucuaauuacuuggaaucaccuuccaccccuccauuuccaccuguugcuguaauaccuguccaugaaagccuuacccaaaugcuccugggcaagacagcccuucccucuuauuucucagccucaucuaccacucuccuuagucauucugcucuagucacacuggccugcuugcugcuccuuaaacaugauaagcaucuccccaucuuuggguccuuguucuugcuauuuccucucuucguaaugucuccccuucaccaccgccccccacuauauggcuugcucccuuccuccuuuuuuucacauccucccgaucuuuuuuuccuacucuauuuuuugcuuuguacuuaucaccaacauaauguuuuacuuauuuuuuucuuguuuauuaucuaucuugauucacuaaaauacuccaugauggcagggauuuuaaucucuucacugcucugucucugauuaugccugccacagaguaaguacuuccuaaaaauuugaugaaugaaugaaugaaugaauaucagacucugucacuuaguucucugagcacaugcuuuugacaucauagcacuaaguuagcauuuaauacucuauguauuccuguaaugccuucuguuugucuguuuguuuggauacaggaugucgcucugucccccaggcuagagggcaguggugugaucuugguucauugaagccucaaccucccgggcugaagugauccucccaccucagccccccaaguagcuggcacuacaggugugugccaccaugucuggcuaauuuuuguauuuuuuuuuaguagagaggaggucuugccauguuucccagucuggucucgaacuccugagcuuaaaugaucugccugccucggccucccaaaguauugaaauuacaggcaugagccaccacauccggcccugugaugcugucuaaugauacccugcguguguauuuuuauuacaaauuucaucuauuugaguucucuggggaaauauuucugaaaaacuauuuuauaguauauccacuaucagugaucuaaguccuauagaauuuugucaguuuaaauuuacuccuuaguaugccuaaaaacacauaaccugaaacuguagugcugaauuuuuuaagcucugggcaauuagaguaauuuugcuauuuaucacuguguuucugaugagcugaacauccuaggacguuuuagaaguauuuucaauguaggauauaaacuagugaaauaccugcaguaaagaauaaugaagguaaauuagccacuguucuacucagauaauaucccccuguguuuuugagagauggucuugugcuuuaggcuggaguccaguggcacgaucagcucacugcagccuugaacuccugggcuuaagggauucucucuccucagccuccucaguagcugggacuacaaguguguguggcaacaugccuggcuaauuuuuuuuuuuuuuaauguaaagacagggucuuccuguguugcccaagcuagucucaaauucuugaccccaugugaugcuucugccucagucucccaaagggcugggauuaauaggugugagccaccaagccuggauuuuucccugccuuuuuuuuuuuuuuuuuuuuuacaccuuagguaucuuuugaagcagaagcuuuaaaggacucuggcuuugagauucuucguaauuuacuuuuauguucaucaauaccacagauccccucugaagcuuccaucuuuccugagaauccccaagagggagaguucaaucuuauauuggcuguucuuugguugaaagaagaggaggaacauaaagauucuuuuagauaaauggagugaaucauugagggcaagagcaggaaaugguagagggaaaagaaacacagaagagaaaaggaauuugguggaugguggaugaaggauuaaaugucaacugagcagcuuuuauuuguaauuacuguaaaaauguagaucugccagcaggaaggauaaaucuggagauuuagauucucaacuaccucugaccacaaggaucuauaacaacuacagcaucaugauacaguucauaaucaguaguacaagccauuugggcagcccuuauccaaauauuuguaucaaaauugcuuccagccuagauuucagagaaguucuggcaaucuggcuuuuuauuuuuauuuuuauuuauuuauuuauuauuauuauuauuauuauuuuaccuuucauagaauauaaauuuagacugggcaauccuaugaauuuuuuucuaagcuuuauugcuuuaucugauugauuauagaagaauaacauguuuaguucccaggggacagaaacagaugucucuugcacaucuuuguaauguaacaaacaaaugcucaauaaauauuuguugaacaaauuaguuguagaaaauuacucagagauagguacugcuaauaauuuaauacaguuuauuucaggcuuauuuccuaaauguuuuuaaaucaguauuuccaaaauggcuuuuauauuuaauuuaugauugggaauaugauacaggucuuuuuucuguuugauugaaaugaccagcauuuucccuagucguuaaauauucuacaaaaguacauuuuuuuuuuuuuuuggaugacagggucuugcucuuuugcccaggcuagagugcagugguguaaucauacaaaaguacuuuuuuuuuugagacggagucuugcagugucgccaggcuggagugcgguggcgcaaucucagcuuacugcaaccuccugacucccugguucaggugauucuccugccucagccuccugaguagcugggauuacaggcaugugccaccacacucagcuaauuuuuguauuucuaguagagacgggguuucaccagguugacuaggauggucucaaucuccugaccucgugaucugcccaccuuggccucccaaagugcuggaauuacagggugagccaccacacccagucaaaaguacuauuuuuaaaggauccguugaaugagccuucauuuaguuaaucauucuaaguugcauauuuguuauuucuaguuuuuaaacuuuuuuuuuugcaauuauaaaugauguuauaauuugcguagaagucuuugucauguagucuuaucacuaacguggguuccucuggaugcuagaugaauuaggucugcuauggggaaucuccuuuauguaugccuuuacuuucuuuuccuccagccaagagucaccauucuggaauggcuuuaggcacuuugaaacauaucccaagaucccauuuuauagagacaaagcuuaauguaucaucacacuucuagaagcauucauucauuaaagaaguauuuguugagugcugacaauguguuaggauauggggaugcaaacaugagaugaaguacacugucaauaaggaacauaugguuuagucaagaaaacagacguggccaggcgcaguggcucacgccuguaauccuagcacuuugggaggccaaggcugguggaucaccugaggucagcaguuugagaccagccuggccaacauggcaaaaccccaucucuauuaaaaauacaaaaauuagccgggcaugguggcaggugccuauaaucccagcuacuugggagaggcaagagaauugguugaacccgggggucggagguugcagugagcugagauugcgccacuucacuccagccugggcaacaaaagcaaaacuccaucucaaaaaagaaaaaagaaagcagacauguaagcagucauaauuugguagaaaauuaugugccauagaggagaaguggaagaaaugccaaacucugccuuuauuggggaugaaggaagggagagagaggagugugaaccaaggaagauuaacagaggaaggaacauuaacuggauuuuuaaaagaagaccagugguuucuagguagagaagauaggaaaagauauuccaggcuuuggguauaguaugugcaaacaccuggaggcuugagaagccgugaugaguuuugagagaucugcaucuguauucauuccagguucagugugacaucuggcagagaugucauuucaauuauuuauuuuuauuauuuuauagauggagaauagaggcuauuuucuggcaggaaacaccagcuaauggacuccaugugucauaucaaagaauuuggaccuuuucaauuauuuauuuuuauuuuuuugagacagggucuuacuuuuucacuuaggcugcaguguaguggcaugaucucagcucacuagacccuccgccucccaggcucaagugauccucccacuucagccuccugaguagcugggacuggcacacacugccaugcccaguuaauuucuguauuuuauuuuauuuuuuuguaaaggugggguuucgccauguugcccaggcuggucuugaacucggaggcucaagcaauccauccaccucugccucccaaagugcugggauuuuagggugugaguacacugugcccggacuagagaaacacuuuuuaggaggaaauaucuuacaguguaguguaaggauuuuacaaaguggcuagaaauguagagaccaguucccgaauaauccggaugagaguuuaugcaagacuaaauuuaggcccugguauagaagaugaaaggaagggauggauuugagucauauuuagaagaugaucaaaaacaccugguaaucggugaggggcaggaggagaaggguaauugauggcauuuagaauuucuggcuugagugacuacauugaugcuaucaacagaguuaggaaauaccaaauauguggagucuggauuuuguguuugguuuugaacauaaggcauugcauaggugaaugugucugguaggugguaggaaaugcaccucuggccuugagaguucuggacuggggauacagguuugggagucaucaucacuuuauggggugguaccugugaaauauaggugaggucacccaggagaguuuguaggagagcugaggaaaggcuguagccuuagagggguggcagagaaaaauaauauauugaaggugucugagaagaaacaaagcgguaugaggaaguucuuuucauaggaacgaaaaguuucaagagaugaucucuaucaucagcugccuccauucuuguuccuguuugcucuaacugcaaugaggaagaugaauucauucuccaaaaaauauaaaucugaaguuuugugucauuucuccuuuauuuccuuugucuguagaauaaagucuuagaauaauauuccuguuaaggcccugcuuaucccaauaccguauccauacugaacuuucaguucuuuauaugcacucuacucucugucuuucagauuuuugcagguauuccuuuagaacacucuuucucuuccaucuuaucgccuacucuuuggguuucuguuuaaacauuacauuucucggugggggggcuuuucugucccuuagaguaggucacaccuagcagcuguauguuuucaaagcuccauguacauuuuuuaucaugauacucaucauuuaucacuucucauuuuugcuugucuuccugguagacuaaaacugcaugagaacagagaucuuauguuuacuguugaaacaccuguacuaguauauugccuaguauauaguauguggucaauaaauaugccuugaaggaguaagcagcauaguggucauguaagcaaggaguuggaaggguucauuaagaguagaguugagguaugauugguaagugaggaaguagagggaauguagccugcucucugaagcagcuuagcuaugacaggaaagagaaaugaggcacacaaauguuucuucuuguuucaggguuuuacuuucaucaagacugagugauuacagcauucaguuaccauucuuuaaguuugucguaucacccaagugucuaagacgauugcugaguuuagagauggaauucuacagagaaggaaaucaagacaaagaauuugggaggaauugagaauucagaaagcagauaaaaggaaaaaacauaggauggauuuuuagggacuagaguaggggauaaauguaaaaaccucccucccuuucugaucuggagccuuguuuguuuauuuccaguccuaguuguuccacugcgagcaugguuagagugaggcauguuaaugaaugggagcugggauggagaacugggaggacaggaugcaaaggaguauuuaacauucaacaaauacuuauagaaggccuccuauggggcagacacuguuguggugccuugugauacaucuagugaacaaagcggacaaagauuccuccccucauggaacucaaauuuuaguggggggagagagacaacaaacauaauaaacacauuguauaauacguuacaaggagauuaaagguauagaaagaagaaaagguugaaugguuaaggaggaucaggaaugccugaauggagugaagaaggcagguuggggaauuauauaaggauggucaggguaggccucauugaaaagguuagauuugaacagacuugaagggcauuagggaguuaaccaaguggauaacuggguaaucaaaggaagucuuaaaucucuuucuuauugagucaccggaaccugugucuguagcugaauucuaagcuuaggggcaggcauauuaucuaagacacaagcauggccaucaccaugccuuauugacuggugcaggaccacaggucauugugauuuuuauuuauuuaugauuuuuuuuuuugagacagaguuucgcucuuguugcccaggcuggagugcaauggugugaucucagcucaccgcaaccuccaccucccagguucaagcgauucuccugccucagccucccuaguagcugggauuacaggcaugggccaccacgcccggcuaauuuuguauuuuuaguagagaugggaugucuccauguuggucaggcuggucucgaacucccgaccucaggugauccacccgccucagccucccaaagugcugggauuacaggugugagccacugcgcccagcccauugugauuuuuaauuaaguucagcaguugguuguagguuaccaagucuuauguuauuuuuuuaagcaugaauuuguaagcaaagaaaauguagcuguuucuuaugucuucucuccaccaguauacuuugaucuuuaaauauuaagagucuaguccaaugccuaaaaaucugaagguaauaaaaaauagauguaugugauguuauuucucugacauuugauaucaaaacaucaccuacuuucuuauuuuuugauaguaacacagcugaacuauaugaauauacuguccuuuuuguguccugugucugacauuaugagagacucuugguuuucauauuugagugagagagugaauaacuuggaaaaauagcuuaacaguagaaaauaagagaggaaggauuguccuucaaaaacuuuaaauuauauuucuuauuaaauaaauguuauguuaaauguuguauaaggucacugcgaaaauaaaacauguuuuauugggaugaugugcuacuguuguggauauuuacuauuuuaaaagucaucuggguaaaaucuuauuauuuauuuuucuuacuguucagagguaggcuuauuuugugacugccuaaagagaaaauaugguucuaaugaugaaugugaagcucugaaccauaccugggagcaaaauacauguuaugaaaacuguaaaagaaguaaaaaguacuuucaacuuggugaagauagacauaaaacagugccgucacuagugcaaguauagcaaugcaucacuaguguaguccccagauugacuuguggauacagcugcaaccuugggcuuauucaucuaguauucuaguucuuuguuuacauagguuuagcauuuucacuuugaucuucauuuccaguguauuuuaugaagacaaaugggauagaauacagauugacuuagauuucuuuuuuuaguuuugcuuucaaaauuuaaaaggguuucacuuguaaacuaacauugugguuucagaccaagaacacagaaagaaaaacaugaacucuauuaacaagcaauacuuguguuuuuggggcuuuguugucaguuugagaacuuugacuaagauaaaugaauucacuuggugguauuggacuauuuugaguauuuguauauggagaguuuuauuagaaggcuauugcuuuccagugacgugaaguacuagucaaguuugagaggguagaugacucucugagaaggacaagaugaauuuaggccuaauauaauuuuauuucuguuaaauauaaucucucauggagauuuugagaugaugaugugggaagcccagcugauagucagaucuguccuuggagguguuugggcuagugagucauacuggcccccgccuuccaacauauuuaugaaaaugaaauuggauuaaaaugacuaagaaugacuaauguuuguauaacacucucaugaucagugugugauuuguuucacacgauaaucuagugaaguagguggaacagaugugcuaucaucccuauuuuacccaagaagaaacuuacuguuacccucaaucuuacuguuaguagauggcacuguaaggacuugaaucuagaucuucugauuccagucucugcucuuuccauuauuccaagccaccuuaggacugcaucuuuaaauucacuacucuacacauaguccuuaacacauugucugccaugcuguaggcacuauacauauuauggucagaugaggcuuagaagccuuaccccucuacugagaaaugagggauuuauggacugauuucaauacguaaaacuuuaggucucagcaccaguuuucagaugcacuucuuccugguuaucacuuggucauuacucugacccucauguuuccauucagagcccaggcuugauuuaccuuuacuaucaaaaugacuuugcccgggugugguggcucacaccuauaaucccagcacuuuggaaggccaagguggguggaucaccugaggucaggaguuugagaccagccuggccaacauguugaaacccugucuacgaaaaauacaaaaauuagcuggguguggugguggaagccuguauucccaacuacuugggaggcuggaagugggagaaucacuugaacugggagguggagguugcggugggcaaagaucgcgccacugcacuccagccugggcaacaagagugaaacuccaucucaaaaaaaaaaaaaaaaaaagaugacuuugccgauagccaccuuacaauacaaauaacuaaaaccagaaacggucccguuuuugguugcugcauauucuuccugcugugccuucucuuguccucauuuuguuggaacuuuauauuuauguuuauuguuaauuaacugaguccuauaaacuaggcucuguaaugcuguuauaaauuauaaaaugugaaugauuucaggcagauagaauaaccugccuuaaguagcauuagcuaguuuuguuugcuucuuucugauuuaggauaauuaggacugccugagaaggauugugacuuccagcuuugucuuuuuuugagacagagucuugcucugucgcccaggcuggaaugcagugccaugaucucggcucacuacuaccuucgccucccggguucaagcaauucuucugccacagccuccugaguagaugggacuacaggcgcacgcugccaugcccgacuaauuucuuuuuuauuuuaguagagaugggguuucaccauguugcccaggcuggucuugaacuaccgaccucaggugauguguccaccuuggccuccuaaagugcuaggauuacaggcgugagccaccacgcccggccaaauuuuuguauuuuuaauagagacaggguuucacuauguuggccaagcuggucuugagcuccugaccucgugauccacccgccucggccucccaaaguccuaggauuacaggugugagccaccacgcccagccccagcuuugucuuaugaaauaauguguuauuucucacaugcaugcaucccuuuguuggugccccgugccuucuugacccccuuauuaacucuucauguauccaaaucagaaagaaucagguguaacuuaauauauuuuuaaagacaucuuuuaaggaacuaguuuugcauuuucagcuuugguucuucauuguaauacaugcuagagauguuuggguccuuuaccaguuuuuuccaggaauuguuuccuguuauucuuaauguaguaguaaagaucuacagguaggacucaccuuccuauauguuugucucucucuucuugccuuggcauagauagccuucuuuuaccuaccuuuuuauuuucaaaauacauuuuaagugauacauguucauuuuuuauuuuuauuuuuauuuauuuuauuuauuuuuugagauggagucucacuuugucgcccaggcuggaguacaguggcacaaucucgacucauuacaaccuccgccucccagguucaagcaauucuccugcuucagucucccgaguagcugggacuacaggugcgugccaccacacuugacuaauuuuuguauuuuuauagagacaggguuucaccguguuggccaggcuugucucaaacuccugaccucaggugaucugcccuucuugaccucccgaagugcugggauuacaggcaugagccacuguaccuggugauacauguucauuuuuaaaacuauauaggaaugaaaaauuacuugugucuccuuuaccaagagauaaacauucccaacuuuuaaaaauucauauuaaggacauacguauaaaucauagaauagauauguauaauaauauacaguauauauuauauagauguauauuugauaacgugcuuuuaaauuuaacaauauauaacaacuuuuugucaguaaauauacauauuuaauacuuguguauuauuuucuuguauaguuauauaauuuuuaguucauuauauacaaacauacaagcaauugucuccaauauuucuuuauuguaaauaaugcugggaucaguauccuugaacagauuuuuuucacacaaucuuaauuauuucuuuaaauaaauuucuagagcuaaauuuccuaaauugucuuaaagguuuuggugaauuuuaaccaauuauucuccaaaaaaauuugcacccaucaacaaugacugagaguucacaucuucccuacccugaaacucaagcccuuuccucccuuuccuuugccauuaagaccuccagauaauuaguucaauuuaaguaauccucuguaaguaauucuucuuuuaauaaaaucagucuguguuagaaaagaguugggagaaaccuuuucagagacagaugaguauccuaauagauugggcggaagaccugagauugaagucaugugaacagauuuugggucauucuaagggaaggcuuuaggcucugaaucugucugccugggaguggggaaauugugcaguauagccuccuuccaugggauaggaagcaccuguccagaccuguauaauuguguggaagccagccuggaaguaacuugcuccacaaaaauuaaggaguuuugcaccgcauguucucgcuuauaagugggaguugaacagugagaacacagggacacagggaggggaauaauacacacuagggcuuguuggugguggggggugaggagaaguaacuuagaggacaggucgauaggugcagcaaaccaccauggcacacauauaccuauguaacaaaccugcacauucuucugcacauguauccuguaacuuaaaguaaaaauaaaaaaaaaauuaaugaguuuaggagcuagcagggaaccuguggcuggcacauagugcauauaaccccuaccuuguccuuuacaaauggucauuuauaacuucuuauuuaaauaauaaggauauacuguguuuggaaguaguuggucuuuuuuuuggacguuuuaauugcuagagaaaacuuucuuauauggaucuaaaaucugccccauugaaacucagggcagguacagauauuuuuauucaucuuaguaauuccuugcuguuacucuacuaauauuauccuuguaucugagguaccugaugcuucagaggugcucagugaauaaauguuaaauugauguaugacuaauauauguagugauuaaagccuuucuuuuucccaaaaugauuuauaauaaaaguaaaaugaagcacuuucuuuacucuugucagaggauaaaauauugcauucuguuuuggaucgaacacuuucaacguuuauuuuuuguuuuauuuuuugagacggaguuucacugucgcccaggcuggagugcaguggcgguaucuuggcuuacugcaaccacugcaaccuccgccucccggguugaagcaauucuccugccacagccuccugcguagcuggaacuacaggugcccacccaucaugcccugcuaauuuuuguauuuuuaguagagacaggauuucaccauguugaccaggauggucuugaacucccgaccucaaguuauccacccaccucggccucccaaagugcugagauuacaaguguaagccaccaugcccagccucaacauuuauuuuuaaaacuuaaaaauauuguaggcugggcgcgguggcucauuccuguaaucccagcacuuugggaggccgaggugagcgaaucaccugaggucaggaguucgagaccagccuggccaacauggugaaaccccgucuccacuaaaaauacaaaaauuagcugggcgugguggcacgugccuguacucccagcuacucuagggccugaggcaggagaauugcuucaacccaggaggcagaaguugcagugggcggagaucacgccacugcacuccagccugggugacagagugagacucugucuuaaaaaaaaaaaaaaaaaguauuguaauuuuguagaaaccugaaaaaaagaaauguugccuuuguugucaugaaucuaauguuauaacuacuaucauuuuuguuggacaucaaacuuugagcacauaaucaaaguaaauaauaacuagacuggugggaagggucuagaauuuauauggcauggcauauugaaaaauuuguguuuugucuguagguagaagcaaacuuauauuuuuaucugagcagaguuagaauuagagcuuaggccuccugacuuucauagggacucaauacuuauugaauaaauuaaugaauuuagagaucugaauuugucauauaguagaaggaguagguuaagucaguguuaucuuacaaaccaaaacugggaccacugaagagaaauuauuggagaauauauuugcuuaucgcagaaaagccuuuauacaacuacaguuauacuaaaaaugaauguauuagaccaccauagauuaaguagaagagaugugcucuuuaaaagagagauuggauuggaugacuuuaaaaaaauuccugcaaacugagauuccagagaauagugucucuguaauaguuucauuuuaacuuugucuauuuucacuauuccauaaguguggcuaauuuuuuaggauucuguucuugauccucuuuucuucugacuacuuauucuaaguaaucucauccaccugccugcguucaguaauguuggugaugcccaacucuguuuucaguccagguuagcucuuguuaagcagcuuauaggauaucacuagauugguuuuccauagcaaguuaaaauuuuaaguauguccaaaacugagcccccaucuguaucccucuccccgccacagaaugugugcuuccuccuauguuugucaucucaguaaaugggaccacugucuacccaauugugcaauccagaacaggaauuauucuugacuugcuauuucuuuauguuucacagauaguuuaccaguuccuaauggagacaagcuuggauuacaguauggcacuggaaauagaagaaaguguguggauuuggcuuauaaguuuaagcugucaggauuugcugauaugucagaugugaagagugugaaggaaagaaauaaagaaugaccuggauuuugggcuuaagugagugugguggauacgguaaauuugauuuagauuaggaagaugugggaaugaaaaaguuugugggagagggauaaucgaguguucuguguuagacacauuaauguuaaggugccugucagguuuccauggauguaggagucuggagcaaagugaggagagagaugugcccuagaaauagaugguuggcugcauaggugaauguuagauaaagaaaagaugcaguuccaugaucaguuaggauaggugagagaagagggguuaacaaagaggcugagggaucauugaaaguuugaagcaagaggaguggaauaguucuuauaaaaaguggaaaauaaaaccuauacaagaaguuguaguuugggauuuguguugauuugaaaguaagaccaguuagcaugauuuugucauuuuuuuucuaguaacuguuagcuauuugaugccagugugggauuaguggauaauuggaauuaaucaagauuaggauuuugccaggcuaguacaauagagggaagaggaaguuuaauccugauagguaagggaggauguauggaguugagagaaauaauugguggucauggagaaaugcauuggcaaauugaugaggugggagaauggcuggaaugggaggacuagaauaagugagcugaaaggauaggagauagugauuagaaaggaaguauaauguuaauuaggucagagaaugaaaagucagaguaguuccggauauugaagucacuaagagugguggaggcaagagaaaggauagagaggaaacugugaaccaggggucauaaaaucuuaaaagaauaaggaugacuggcuaggcacaauggcucacgccuguaaucccagcacuuugggaggccaaggcgggcagaucacaaggucaggagaucgagaccauccuggccaacauggugaaaccucgucuguacuaaaaauacaaaaauuagccuagcguggcggcgagugccuguagucccagcuacucgggaggcugaagcgagagaauuacuugaaccugggaggcagaggcugcagugagccaagauuacgccacuguacuccagccugggcgacagagcgagacuccaucucaaaaaaaaaaaaaagaauaaggaugaccaagaaguuaguauaugauagcuacaggaagauaggcggugauacauucuguccugagcaucaaaggaaucuuaacuuucaccauucccucuuuauaucuuuauauucccuuaaugcaagguaguuuugcucuuuuagacugcccauguuuucucuugucuuuacaccuuugccuggaauuuugcuauccauaaucucuuacccaccacuccucccaggaaagucuucuauuaggucucaguuuaaauuuacuuucuccuggaagcuuuuucuucaaucuaguuugacugggcucagaauccuccaauguugacuugugucaucuaugagagcauuuuucacacucuguaguauuuacucuucccuuuucugucuuucuaacugauaaaaguuuucggaagacaggaacuguuuuuguuucauuacauuccuaguauuaacaccguaccuggcacauaguaaguauuaaguaauguuuguugaauaaaugaaccaguuaaaaacaguguuucagccgggacuaguggcucacgccuguaaucccagcacuuugggaggaugagguggguagauuacuugagguaaggaauuugagaccauccuggccaauguggugauacccucucucuacuaaaaauacaaaaaaaaaaauuagccaggccugguggugccugccuuagucccggcuacucaggaggcugaggcacgagaauugcuugagccugggagguggaggcugcagugagcugagaucacaccacugugcuccagccugggugacagagcaagacucggccucaaaaaaacaaaaacaaaacaaaacaauaacagagaaagcaauguuccauaaaguauugaguauagagguuuuacagccuaugacauaguugacuuuucacuuuuauuguggauuaaucagcuacuuuguauuuuucaaaccuuaugggugcugcguugcuucuuuuguauuguagaucauguucuuaaaucuggaauacauaauuaugacucugagaagcagucacuggccacuggagauagcuuguuaaaaauauugagaugucuggauuuucugauguuauguuauagaauaaaggggcauauuuaaaacugaaguccacaguuggcuuaauggaaaaguuuugugacccuaagaaugugcugggagaaaguugucugggguaggaugagagacccaaugugaagaacagagaaauacaggagcuuuuucauuuuucuucauggugauggucuugguugccauagcuuuuagauggcuguccuuacuugcugguuuuuuuuuuuuuagccccaguuuauaaaaaauuaucuuucaacuucaugaauacuaggauguauuacuauguauugauucgugucuuccaauucuguguugaaaccuuguagguaaaauguuuagacuuuucuucauuaacuuuuaguuuucauuaaaaauuuuacaguauguagaagaguucauaguuuacaaaacuggcaauugcauaauauuacugaaguagaaauggcuuaauuaacaucuuucaauuuuuuuuguuuguuuaaguggaaauccauagguaacuuuuuacuauuaguaagauugaagacuggagggcuugaguugaaauacuuccuuaguaguaaauugacuuggaaauaugaauuaagagaugaaaaggaauugcauuagcaaugcgaauagaaaauuaauuuaauuggaaugauucuauuguggauuuuauagugauauugauuccauucauuaugaguuuaucuuuuccacauaauaauuucaguuccugauuaauaagaguuaaauaagaccuguaacuguacuguuuuauuagauuucuagguguuuaguauaucuuaagucugaguauuaguguauaccaaaacccuacuaacaugaauaggaaucagaaauauaguuagaucuuuuuuguguaguugccguuguacuccaguuaguuccuuuuauaaacauaaugcaggaucuuucaauucuuguguauuaaaguuaaaaacaaaaagaauugagaguaucacauuuaacuuguuggaaagaaaugguggauuucaaaaacugguacuccaaaacucuuuuggauuauagcgcgaauuuguauaguuaaauuucugaaagaucucuuuaguaaauugaaucuguaaggucucuguuuagaagaucucuuuuucugaaagccucuuugccuuucauuauaaaagagccugguacugcucucuguuuuaaaaauccagcuggaaaauuacagagcacaaacauuugcccaucgguucuucauuuggagaaaacagaaauaugucuucaaaauggaggcugacauuuaaguauuuauuccuaucagcgggagcuguaguuuguauuuuuugcauuuuacuucuguaaccacauauaauauaucuuggcuucugcgugguguaacuguaaaacaccaucuuuauuuuaugucauuuugugauuguuguucaaauccuccaaugaucuguuucugagccccucagaaucucuaaaaaaaucaagguauccuuccuuuucuuuuuggcucuauuaaauugaaacauaaaugguugauucuaauaauaaaaauuggcucauaaaugugucugaaaauguguauucuuuucaaaaauaauuuaucuuuaaauuaauagacaauuuuuuagugcaguuuuagauuuacagaguaauaaagcacauaguacauagaauuacauuuagccaaccccugaauuccuguauaguuuugucuuuuauuaacaucuugcguuagugugguacauuuguuauaauuauugaaccaauauugauauauuauuaacuauaguucauaguuuaccuaaagauucacauuuuguguuguauaguucuauggguuuugacaaauauguaaugagaugugucuaucauuaccauuucauacagaauacuuucacucuccuaaaaauccccugugcuucaccuauuugucucuuuccuuccuccccuaaaccccagacaaccauugcuuuuuacugucucuguaguuuugccuuuuucggaaugucauagaguuggaaucauacacuuuguaagccuucuuagacuggcuucuuucacuuaacaauaugcauuuaggauucuuccguaucuuuuugugguuuccauuucuucuauuauuaaauuuaauuuaaaaaaauugacaguuguacauauggguaagauucauagugacucauagugauguuucgauacauaaaauuuguagugaucaggaaaauuagcaaaucuauaaucuuaaacauuauccuuucuuuguguugggaacauuugguauuuuccuggcuauuugaaacuauguaauauauuauuguuaacuauagcuauccuguaguaguaguauagaacacuaaaauuuauucuuccuaucuagcuaucguuuuguauacuuuaacaaauuucucccuauuccucccuucccccuacccuucucagccucuaguauucucuguucuacuuuuuacuuuuaugagauuaacuuuuuuuagcuuccacaugugagugagaacaugugaugguuaacuuucuguuccuggccaauuucacuuaacagaauauccuccauuccauccaaguuuccucaaauggcagcauuucauucuuuuuuguggcuaaauaguauuccauuuugagcauauauaaucagauuuucuuuauuuaucauuguuggacacccagguucauucugugucuuggcugucgugaauagugcugcaauaaacauuccacuguauggauuuaccacaguuuguuuauguauucaccuauuggaggacaucuugauuacuuccaguuuugggugacugugaauaaagacugcuuuaaacacuuauguauagguuuuuauguggacauaacuuuuuagcucaguuggguacaugccaaggagugggguugcuggcuggcucauaagguaagacuauguuuagcuuugugagaaacugccaaaguaucaagguuuguguucuguccauauguguucuuaggacucaaccuaauuaaaaguuuggaaggauauacucuaaaccauuaacaauaguuauuuuggaagaugagauugggauggagagggacugucaucuuucacugauuuauauuauuuuaauuuuucuaccacaaaaucuuacuuuuguaguaauuuuuuucaaauaauuuucuucaaaauacuuuaauucaucauaauaugacucaacauaagugaaaaaaguaagacuauuuaaaauaauguauugucaguuucauagcauuuucuaguuguggaagauuuuaauuuuuuuaagagagcaauaaccuuccuacaaccaugauugucuauucaacaaauuuguagagcaucuaccauguggcacagccuuucaaaggaucaugcguagagcuaagaugacaacacacuuaauccagccuuaggauaccagggagacuuccuggaggaggugauaacuaaacugaauucugaaggacgagucugaguuaaccaggccaaacggggagggaggcggggaaaggagaacguaccagaaugaggacaguuuucagaucagagaccgagcuauucacuucugauuaaucugacuaaaaucagaauuaauuguuccaaacucucagagaagcauauuagaucuuuucauguuguugacucuuguuuaauaauugguaaccgagaagaauggagucauuuucuuuugguuccucaaaguaaguggcagugaauggcagaaugcauugcccaaaugccuguuuuugcuuggcauaaugaauugccugaagauauuuuguuguugaaaauguguuagcaucagucauugucauaugaguugaacauuguauucuuuaccugaaauguauaaucuugaauuuuucaaccgucacaauuugugaguguacuuuuguaacuuucuugugccuuuauggcacuuauacuuaaaucuuucuucucaauuuguaaacuuauacuguauguucaaagauguuuuucuguuuucuauaggaguccagugaaaauuuuaaaugaaaaaacaauuuaaaugaucucuuagguggauagggaaagagggaaaaccaggguacugacauuuaggcauagaaguggcuauuauguuugcuagauuaugacguaagugaguuaaaauaagaguucauugaaucuguuuuuuuuuuuuuaauuccaguucuuuagauggauuuuaaacauauuagaaggcuacuaacuuuuauucgauaauuuuuuucaaaauguuuaaaauacuacuguuuucuuuggaucaaauucaacucuaagauuauuucuuuaagacauuaaauguguaauaguucaccuucuguuacauugaaaauuaucacggagaaauuuaaugugaaagaggauuaguauauugcuuuguuagcuguuuucaguagauuauuuuguuaaucuguuucaacaaaaguuaccacuguugcugaucuguuaaauaauacacaauuaauacuuuucucuaguaucuguugcauuuaaaaaagaaaaagagaauucucgaauucugaaaaggggcagugaaauauugucaucagaauacauuagguauuucuccuaaugcuaucccucccccugccccccaccccaugacaggccccugugugugauguucccugcccuguguccaaguguucuuguuguucaauucccaccuaugagugagaauaugugguguuugguuuucuguccuugugauaguuugcucagaaugaugguuuccagcuucaucugugucccugcaaaggacaugaacucuuccuuuuuuuauggcugcauaguauucgaugguauauaugugucacauuuucuuaauccagucuaucauugauggacauuuggguugguuccaagucuuuacuauugugaauagugccacaauaaacauacaugugcaugugucuuuauaguagcauaacuuauaauccuuuggguauauacccaguaaugggaucacugggucaaaugguauuucuaguucuagauccuugaggaaucaccacacugucuuccacaaugguugaacuaguuuacacucccaccaacagugucaaaguguuucuauuucuccacauccucaccagcaucuguuguugccuuuuuuuuuuuauacuuuaaguucuaggguacaugugcacaacaugcagauuuguuacauauguauacaugucccauguugguguacugcacccauuaacucuucauuuacguuagguguaucuccuaaugcuaucccuccccucuccccccaccccacgacaggccccagugugugauguucuccacccuguguccaaguguucucauuguucaauucccaccuaugagugagaacaugugguguuugguuuucuguccuugggauaguuugcucagaaugaugguuuccagcuucauccaugucccuacaaaggacaugaagucauccuuuuuauggcugcaugguauuccauuguguguaagugccacauuuucuuaguccagucuaucauugauggacauuuggguugguuccaagucuuugcuauugugaauagugccacaauaaacauaugugugcaugugucuuuauggcagcaugauuuauaauccuuuggaauggagggauggaggaaaaucuaccaaggaaauggaaaacaaaaaaaagcagggguugcaauccuagucucugauaaaacagacuuucaaccaacaaaaaucagaagagacaaagaagggcauuacauaaugguaaagggaucaauucaacaagaagagcuaacuauccuaaauauauaugcacccaauacagaacacccagauucaugaagcaaguccuuagagaccuacaaagagacuucaacucccgcacaauaauaaugggagacuuuaacacccuacugucaacauuagacagaucaacgagacagaaaguuaacaaggauauccaggacuugaacucagcucugcaccaagcagacccaauagacaucuacagaacucuccaccccaaaucaacagaauauacauucuucugagcaccacaucgcacuuauuccaaaacugaccacauaguuggaaauaaagcacuccucagcaaaugcaaaaguacagaaauuauaacaaacugucucucagaccacagugcaaucaaacuagaacucaggauuaagaaacucacucaaaacugcucaacugcauggaaacugaacaaccugcuccucaaugacuacuggguacauaacgaaaugaaggcagaaauaaagauguucuuugaaaccaaugagaacaaagacacaacauaccagaaucucugggacacauuuaaagcaguguauagaaggaaauuuauagcacuaaaugcccacaaaagaaagcaggaaagaucuaaaguugacacccuaacaucacaaaagagcuagagaagcaagagcaaacacauucaaaagcuagcagaaggcaagaaauaacuaagaucagagcagaacugaaggagauagagacacaaaaaacccuucaaaaaaucagugaauccaggagcugguuuuuugaaaagaucagcaaaauuggauucuaacucuugacucaccccuggcagcaggauggccuugggcaggucugcuuuacuaaacuaagucuuuuuguguuuaaauaaauagaauuaaguaauguauaugaaaguuccugcaaacuguaaagcauuacaaacauaauugccaucauuauuacggaauucaucuucuaacacauuuuaugauuuacugaacaauaugcccaggaagucaauuaucacugcuuguucuggccauauuuuuuauaccugagucucacuggcaugugaauuggcugagagguggacaggcuaaaucuacgugcacauagccuuuuaugacccaagggaaauuuuaggaauuagaagaagacgugaggcuaacagacaguucuuauguccaauggcagaaagaggagaggguaggaauggugugaggcaucuggcugaccacugcuccccuuuuuguaaauguguucguaguuaggagagaaguaacuauaacuaugaaagagaggaguuaaaaggccugcucuucuuuccugagacaccuucuuacccuauucaguagauuuagugaggaaaaugugaacuuaucacaaaguaguugcaacuucugcuguugaaaauuauuuucuugccaggccuggugguucacuguaaucccagcacuucaggaggccaagaugggcaaauuacuugaacccaggaguuugagaccggccugggcaacauggcgaaacccgucucuacaaaaaguacaacaguuagcugaguguaguggcaggugucuguagucucagccacuugggaggcugaggugggaggaucacuugagcccaggaggcagaggcugcagugagccgagauccuguugcugcacuccauccugggugacagaagugagacccugucucaaaacaacaaaaaccaaacaaacaaaagacaaauuauuuuucuuucuguuugugucuuuuccucuguauaucucucccccauucuauucuuuuucucacccucuguaugucauuuuuaaaaggaucucuuugaaggcacucuucccuacuuuaucauucuucuauuccuuucccuuuuucucuucuuuccucagaaaauuugauuuauuuaauuuggcagauuaguauaacuauacuuuucuauuuuaucaugucuuuuucuuguuuuuuucugccauuugaaaguugauauucaaaucuaauauaguaaaugaaaaaggucauaaauuaguaaauuccauuuccacauaugauguaccacgggguacgaugaaaaugagcacucacauuaacaaagagaguauagugguaaaauguuuuuagacuauuugaugguauguguucauauucacaaccuuugaccuaguaauaccguaucuuagaauccauuuaaaacaaauaugucuuaaauaaugaaaagacuauauguaacauccuuuauguccaacaauaaagaggauuauuauauggacuauguuauaaucauuuaauuuucaccaacaauaaguuuuggcagacaugguuuuaacauccaagguuuuaacauccaaggucgaugacaguaaaaauucgcacaguguuuuagagcaauauggcaacauacccauuauaaguccacauaccuuuuggucucacaauuguaugucuagguugccuuccuuauaagcugaucuaugguaaaauauugguaaugauauucauugcagugcuaauuauaguaaguuuguugauauuguguuaaauaguaaauaguuucucuucuagacauuuaacugaaggaaauaaggcuguggauagauacaaagcuaagauauauguaucccuauuuuuauaacuugaaaauaauauuaaaauuguaaaugcccaacaauagaggguuggguaaauuauauauccugucaguggaaaaucaggcagcauuuguaaucaugucuuagaagacuaugauggggucaucuucuuccauaaugcacaugcauauacauauguguaccaggaaagagaugcauguacacugaaauguucacuguuuuucucuagguaguuagauacagaugaugaaaauuuuuaaugaccuaugauuauguuuucugauauaaauaaaacccaugagauuuuuaaaauuaaaaauauuaacuaacccgaggcugaagaaaagccuuggaggaaguagaccaaauuuuaaacaggagcuguuuuugaguggugggacuauugguaauuuuuuaaacacuuuugugucuuaucuauauuuuucuuuaaugggaaaaugaguuugcucagcauuuuauuggaaauauuuuguuuuuuaguuuugauaaaaguaugguugauaagcaauuaacauaguaccaaguaauuuuaauguaauuaacaagcuuuuaauuaacaagauuuuuguuuuuauuuuauuuuuaggccagaaauguacacacaggagagcuggcugcaguaaaaaucauuaaauuggagccugguauguguuaaaacccucaagacaauuuuugaggguuuuccauauuucuuuccuuguuucccuucuucccagaagaagucuuuauauguucuaucaggucaguagaauaucuucaauuaaauuacccugaaggugguuaguuaaagguaaguuugaugugacaguuuuguugccaaauaaaauuugacauguacacauucagaauuggaagacacauugacacuguuaaaguaauuuucuuuuaagaugauagugaaguauuugaacuucagguuuagcuuuuaugagaauuugauuaggaaaguauucaaugauuuuuuggggugaauauuugggauaaugacauuuguuugucagcuauucccuuugauugauuuagguuuguuaauucuggucuuagcuuaaugcuuauuuuauuaacacuucugugugucagaagacugcuuguuucaaaacacauugaauaguuugcuuugcaaauaaaacuauaguccuggaacgguuuuaugauuuugauauccuaaaaguuucuaaugagugcaguaguaguuuuugaccagguaagcgaauauuuggugguauguucauuugcugguucauaagcuuaggcacguaggauaaguuugugaccauaauuaugccaguuuccuaguuugagcgguuaaaaugacuuugcauuucaaacacaguauuugaaucauuauacaugugauucauuagagagauaauaguacugagguagcauaugcuggaacacuuuaaaaauaagcuuucagauaugucccaguaucuuuuuuguccuggcaaauagaaauuguuauaauaauacucuuucaggauccucuuauuaagugccaccuaauaaguuuaaaaugaucuccaaaaugucacuaacacaaauagggaauauaacagaacuauacaagccuuugccuguccuggaaaagucacuagagcaaauauucaaauuauguucaaggaugguuauucaaguuauguccagguacuggcgugugcucucagagaaaacaaagauauuuaucccuuuucugucuuaagcgagugcagugggcuuguuacaacacgguuucacuuacuugacuugaggguauggcuuauuuuucauuagguugaugcauaaauaauugcaguuuuugccaaccuaauauuauagcaguuuuugccaaccuaauauuauaguucauuauaaugaauuaaugaguguauuuuuuaaauccugcaauucugaauucucaauaagccauauauuagaacuaacauaagaaggcaauucaguaaaaaagaaaaauauguguaugauuacuuaaaauauaaggauuaaaugcaaggaucauaagacucuuuugaaaggcuggaauuucucacugccuuguuuuguaaaagcuacugauuauuuuauguuagaugugacccauguauuaagauugaguaauauuucaaccugucccccaaaaaagaauaacauggaaguucaguaaauauugaugaugugaucuuaguauuuggccauuuaaaaauuuuuuugguugccuauucuuaugccuugccccaguccuaucagguuauuuguauuuuauuauugauuuuuagaugcuguuugcauuuuggggauagugacucuucaucauguauuuuacacuucccacaauuugucuucugucuuugcacucugcuuauacuuuuuuuuuuccauguggaaguguucuuuuuucucuccgacaaauuugucaguccuccuuucucuauuccccauuuccuuguacuuaggccuuuucuccuagauaauuauaacaauuuugaacuguaauuucuuccaguuuuuccuuuuuuuccuuccaaaauuuaaauauuugcucaaucaggagcaaguuuguucuaagggaugaaagagaacucucucuauguauuuuuucaaauggcuaguuucccaaagccauuacuauagauucagucucuuauccacagauuugaagugccuugguugucauaaacuaaauuuccauguaaacauagauuuuguguucuguuccagugacuuucuuuuuucuauuccuacuucaacacuauccugguuuugauuaccaaaacuuuuguugcguauuauaaucuucacucuuuuuauuuuucagguauuuccuguuuguaaaauuuuuuucuucagaacuuuaaaaucauuuuuaucaagaagaaaaaaggcacauagauuaauguaggauauuuggcauuuugacaauaguaaagguuuuuucuuauucaggucuuuaggaaaguuuuugccacgucuucauauuuaugguauuucucgcuauugggaauggcuuccuuuuucccucuuacacugucuaauugguuauuauagauauuuacuucgccauugauuuuauugguuauauuuugucucuggcagucuuacagaauucauauuuuucuggcaguuuucaaauguuuuucgugguuuuugcaacuauacggacauacauagaauguuauuuuggcccagacuuucacauuguaggauagugcuuccaguguuauuaacccauuuaugcuggaguuugcaguuuuuugaauugcagacgugugaaaaaucagaccuuggugaugaccuugagccauaggcuauaaauaacucccacgugcuuagcguucccauaauggaacaguaggcauaaaugaguucugacagaaguguugaucaucuuccacuagagugauuuuguccauuucuccuuccauuuguggcacaucugcuuaauguauuauaugugugucaguugacccauaaaauucauguuauauuuucauuucuuaauaaauauuuauugaauaccuaauauacgccaagcucuguucuagaggauaggaauguagaagagaacaaaaaggcaaagaccuuguucucacggaacuugaauuccagugggggaguuagaauaauggaauaaauguauaaugcauuagucacucauauuggucaguggcuucagucuuucccuuacuauugugacuugcauccuccauguuuaaucauucacucccuuaaugaucuuugauacccuuuuuaccuugaauauaacuuuaucugacauugauauugccaacccuccuuucuuuuuguuuauauuuauguggcauacaacaaauggauagaacugguauacuugggccuaucauuauccuuucuagguuguugauguuucucuuguaaaaaauuauauuugacuuuuguuuuauaacccaaucugaauuuuucuuuuuuuaauaugugaaucuguccacuauuauauuguuuggagagauguuuaauuuuaauucuguuguuguuuuuguuuuuaauauuuucuuaaauuuuaaaaaaaauuauagcuggggguuucuuuuauuuuuacugcugauaauuuguaagauacaauucuguaguuuugucagagaauggcuuguaagaccuugaauaauauacuuaaauuuguggguguuuuaguuuaucaguuuaagaaauaaaacagucaucuguugaauucuugguuuacagauuuugaaauuugcauauuuauacucuuccugccucaucauccccccaauuuucaacuguucauugguuuauuuggggauuuuagcccagaaacuuucugauugcacugggguaugaguauguauuacuauguguaccuucuuuuaagaaauauaauauuuauaauuuauaaaugccaugaccaauuauuuagacuuaguuuuauauuuaguagauuuacuacccaccauuggucuuuuuaugccauuuccuuuccauucucaccuacuuaguaucaacuaucaauaggcuaagucauauuaucaaaaagauuuucccguauuaggaauauuauaauuuaaauccauaaauugauuauucuucucaaaccugcuuuucuucugcauuuugcuaagcaguuaacccauccacaaauguaggcauuaaccucgauuucucucuuuuauuugugcucaagaaucagucugucagcaaguucccucagcucuaccuccagaacacauccugaauccaucuacuugucuuuguuacccaucuccacccuucuagugccuguugccuugcccacaccucccauuccccaccaucuauuuuccagaaagccucuggagugaacuuuuaaaaacauaaaucauaucaucacuucugcuuaacacuucccugaagcuuucauaucaacuuagaaaaauacucagauuuuuagccuuguuuauaaaacccuacaugaucuguucuauccaccucucugagcucaucgcauauguuucugccuacucuacuaugccucuguuuucuuuuuauuuaaacaguccaagauuaaagcaauucuucccuuuugccugagguaacuguuuuucaagaucuuugcucugaaggcuccuggucauucagaccucagcuuaaauaaauaucauauccucggagaggccaaugcccuuguuauuuuaguucgcugcauaggacacgugagugccugauacuuuucuuguuuguuuauauguauacguguauauauuguguuugucucucuccuagaauguaagaucaaugagaauagcgauuaucuauccucacugcuauauuucaccacuugggacaguguaagcauguaacggacacugcaauaaauauuccuccuauaaaagaauauuacagaugucuuucuguugccuuugaaugagaaugacgauuugacuagguauaaaaugauugcaucacacguucuucucccucuacccucaaaaaacucuauagacauuuuuuucccuugaauauuguuggaaagaaauguaaggccuaacugauauuuuuccccugguagauaacuugcuguuacuaccugauuguagcaaaagcuggcauuucuuucuuugucuucaaaauuaguaaucucaacagaauauaacuuggucucaauaauuuucuacagauuuuucucccugagacacaaugagcugcuuuuuucaucugcaguuuugauuuuuucuuuauuucaagaaacuuuguuuuaagauucuugaauuuauuucauuacuuuggaaaguaaugaauuuuuaaagucuuccauaucagugacuuuuuuuuuuuuuuaaacagggucucuuucuguugcccaggcuggagugcaguggcacaaucugggcucacugcaaccuuugccaaccggguucaagugauucucgugccucagccuccugaguagcuggaauuacaggcaugugccaccacacccagcuaauuuuuguauuuuuaguagagacagaguuucgccauguuguccagguuggucuuggacuccuggccucaagugaucugcccgucuaggccucccaaagugcugggauuacagaugugaaccaccaugccuggcccccaauacugcuucuauuccuuguugguuccaauguuuuuauuaguucuauauaaguauuauuuuuacacagcuuuccccccuuaacucuaccagcauucuuucuguuucauuuuguugccuuaauuuuccuguacucuuuuuucccccuuucauaucccugagaguuugaagcacuguugucuuaaauuuucuuucaaaacaaauucuucguaucuucagcauccuguauuugucuuuuuuuuuuugcuguggaauuuuuguggaaaaucaguggacuuuuagcauugucaguaaagccaaaguagaugguauuuuucacauuuuuggaacagacuuaaggguaucuuuagguuaaaaauaugaugguaugcuaaugaauuuucccaacauucaguucagauacuucaaauaauuuuggagacugcuguauuucaaaaaugaauucucaacuguauuuagcagcuuucaaaaacuugcacuaaagccagcauaauacaaaagugcuuucuuguauugauuuaacagaugaacugguuuaaaauuguauuuagacaugaaaagauaauuauuugccagugugacuuagaaaaaaacuuaugucugguaauacauaaacaaaaauuuuuuuaaguaaaugaaauuccagcuguaaacuuaacaugcuuuucuccauggugaaaaauaggauauuaaaguuuauaguaauuuuagaguccuaaauuguauuuacugacuugccccuggcaauuuaauuuuauaaugcuauauucaaaauuuugcugaaacagauugcuuuugaaggucuuccuaauagucaaaaaaaugcuacaguaagccuuagaguugaaaauagguuagcacagaaaaucgcguuuauuaauuagccacaaaaauauuuguaaaagaaaaugaagucagcauuccuuccuauguuuguauguucuuguugcucuuuguauauauaggcaaaaugauuauuuucaggaaugauuuaaccauuucuaucucauuuuuauaguagauacuuacuaaagucaccaccuuacaaaugguaacauuaaauagaguuugacuuaccagugauuagcauugaaaauaauaccaccagugauaccauugugaguuuuaguugcauuuuucaucucuuugauuagacauccagagugcccuauaagcccaggcagauacugugaugguucaugccaccauguuuuccugucuucugucugaauuucagccuaccaucuaacucauuuuacagaugcucaguuugcccaacaagucuguagcuauugguggccaacagccagagcaggaacaaaguuugugggaaaacuuaccaucagaauccuacuuucccuucccucucuccuccuuccauuaccccucuuuuauggcaaaacuacaaaauaauauuuuaagcuuaugaaaauuacaguuuauuuaaauauuuucggccuugcuuacagggauguaauuuaauacaucacuacccaggaugauuaaugcaauacccuuuugguuuguucccuugcuugucuuuuaaaacgguaaaucggaaauacuuauaaaauaguuuaguauuuuuuaauaaaauaaguuaaauguguuucuuuagacaguuuuugaaauaaauaggaaucuuuaaauaucuuugaauagauguuuaaagcuuuccuuggacuugcagggaauacuuuaacuuguuuccugaaaguauaagcagagaagguaguguaaguguuaaaaagucaggaacuauacggagguuuaaaccagccauuaguuugccuuguucuugaaagaacuuggcaaaguucuugaaagaaaucccaggguaggcuguuuggccaaauaggacaagugucaucuauucagguuacgugguauguucuuuucagacuuucuauucaaaaaccuaacaaucuugauuuuuaaaaauauucuguaaaguaaaauauuuguauccugucuucacuguuuggacaguucaagucugaauuaauggaaaauguuaauuugaaggcacaaauacaugccccaaaugucauuuuauugguuuuaaauaauagauacagaaaaugaauaaagguuaguguuguuuacuaaugucuucuguuuaacauuguacauucauuaugcucaauggaaaaaaaccauauuuacuuauuaugaaccaaaacaaccauauucacaagauugccaccauugugucacuguauuuuucauaguuauuuaaaaauuagcugauugaauauuuagcauuggauugauuuucugaaaaaguacugcuaauuuauucacuguauaaugaacuaccgcuaaaauuaguuuucguuuugauaacuaucuuuaacauuauuucauaaacuucagaaauguaucuaguacuuacuaauacagaaaacuuuugccauugcaaauauuaauuaagagaucuaauuuuuacauuguaauuuugcucuaaaugauauacaaauuuuuagguuacugcauauuuauuuuaaauacuuguuuuaaaaguuuuuauuuuuauuuuuauuuuuauuuuuauuuuuuuggucugggagcggugguucacaccuguuguagucucagcacuuugggaggcugaggugggaggaucuuuugagcccaggaguucaagaccagccugggcaacaugauaagacccagucuuuacaaaaauuuuuaaaaauuagcagagcacggcagccugcuucuguagucccagcuacucaggacacugaggcaggaggaucacuugagcccaggagguugaggcuucaaugaaccauguucacaucacugcguugcaccaugggcaacagaaugaaauccugucccaaaaaagaaagaaagaaauauauauauaauaauauauguguguguguauauauauauucauuuaaacauccagcuguagugaaaugauuaaauuaggcuaugcucacaucauuuuaauauuuuuaaaauuucaguaaaaaacacauaaacuuuaccaucuuaaccauuuuuguuuuuuugcuuuuuguuuuguuuuuguugaguuggagucuugcucuuggcaccccggguggagugcaauggcacaaucuuggcucacugcaaccuccaccucccgggaucaagccauucuccugccucagccucccgaguaccugggauuacaggcucccaccacgacacccgacuaauuuuuuauguuuuugguagagacaggguuucaccauguuggccaggcuggucuugaacuccugaccucagaugauccaccugccucggccuccaaaagugcugggauuacagaugugagccaccaugcccagcugucuuuaccauuuuuaagugcaucuuuuaguaguuuuaacuauauuugcguuguugugaaauaguugucuagaauuuuucaucuugcaaaacuaaaacucuauauucauuaaacaacaacaacucuuugcugccuccccacagccacuaguaaccaccauucuacuguugguaucuaugaauuuggcuccuuuagauacuuuauauaaguggaaucauacaguauuuguccuuuucugacuaggcuguuucacuuagcauaauguucucaagguucaucuauguuauagcauaugacaggauuuccuuccuuuuuaagucugcaugguuuucauauacuacaguuuuauucauucaucugucaauagacauucugucaaacuggguugccucuaccucuuggcuauuguaaauagugcugcuaugaacauggguguacaaaucucucuuugagauccuauuuucaguucuuuuggauauaaaccuaaaagcaugaauuggucauaugauaguuccaccuuuaauuuguugagaaauacuguuuucuguugcagucucaccaguuugcaaugucaguaacaguauacaaggguucuagcuucuccacaucaccucuaaccaguuuuauuuucugcuuuuuuuaauuguagccauccuaauggaugugaagugauaucucauugugguuuuauuugaguuucucugauuaaugauguugagcauguuuuuaugugcuuauuggcuguuugcaggucaucuuuggauaaaugucuauucaaguccuuucccauuuuuaaaaucaggucauuugauuuuuucuugugagucguaggaguucuuuauauauucuggguauuaaacccuucuuagauacaggauuugaaaauauuuucuccuguucuauagguugccuuuucaacucuguugauuuuguccuuuggugaacaaaauuuuuuaaauuucauuuguagucucgucuguuuuuuguugccugugcuuuugguaucauauaccagaaauaacugccaaaucugaugucaugaagcuuuucuucugugauuucuucuaggaguuugauaauuuggggucuuacauuuauaucuuuaaaucauuuuaaguuuuguguaugguuuaaggcagggguccaacuuuauucuuuugcaugugaauauccaguuuccccaaaccauuuguugaagagacugcccucuccccaucaaguaguucugauacccuuguugaagaucauuugaccauauauacuacaugaggguuuguuucugggcugucgguucuauuccauuggucuuuaauauaucugucuuuaugucaguacccuacuguuuugauuaugguagcuuuuaguaaguuuugagaucaggaagcaugagucuuccaacuuuguucuucuuuuucaaaauuguuuuggcuauggagagucucuuaaaauuuuauacaaauuuuagaaugauucuuuuuuauuucugcaaaaaaaaauguuaccagaauuuuucauagggauuguguagcuauuuauaucacuuuggguaguauugacaucuuaguaauauuaaguuggguugggcacgguggcucacgcuuguaaucccagcacuuugggaggcugaagugggcggaucacgaggucaggaguucgagaccagccuggccaauauggugaaacccgucucuacuaaaaauacaaaaauuagcccagugugguggcaugugccuauagucccagcuacucgggaggcugaggcagaagaaucacuugaaccccgggaggcggagguugcagugaguugagauugugccacugcacuccagccugggugacaggcgagacucugucucaaaaaaaauaaauaaauaaaauaauaauaauaauauuaaauuuuucaauccaugagcaugggaugucuuuccacuuauuugugucaucuuuaauaucuuucagcaauguuuuauaguuuuuagugcacgagucuuucaguuccuuaguucaguuuauuucuaauuguucuuuuuuuuguuuuuguuuuuguuuuuuuuugcgauggauucucacucugucgcccaggcuggagugcgguggcaugaucucagcucacugcaaccuccaccucccggauucaagugauucucguucuucagccucccaagcagcugggaguacaggcgcccaccaccacgcccagcuaauuuuuguauuuuuaguagagacaggguuucaccguguuggccaggcuggucucuaacuccugaccucaggcgaucugcccgugcuggaauuacaggcgugacccacugcacccggccuaauuguuauuuuugaugcuauuguaaauaaauuguuuucuuaauuuccuugucugauuguucacuguguauagaaacacaacugauuuuucuguuuugauuuuguaucuuacaauuuugcuaaauuuguuuauuuguucuaauagauuuuuuuaauggacuuuaggauuuucuauacauaugaucgugucaucugugaacagagauuuuuuaacuuauuucuuuccaguuuggguaacuuuuaugugauuuuuaaugacaugagaaaugcuuacacaauauugauuagugaaaauagucugugaaacucuggaguaugguccaaauuguguaugugauaugcagaacuucauaaguauaguacuuacaggacuggaaaaaaaaucaaaaugcucauggugucagccugagcaacguaauggagaucaugucucuacuaaaaauuuuugaaaauauuagccggauauggcagcauauaccuguagucccagcuaccugggaggcugaggcagaaggacugcuugagcccaggaguuugaggcugcagugagcaaugaucgugucccugcauuccagccugggugacagcaagaccuugucucuugaacaaacagaaagcuaacagugggugucucugguacauuuaugggugauuuuuauuucauucucuuuuuuuuuuuccuuuuuuuuucuuuuuuuugagacagagucucaggcuggagggcaguggugcagucauagcucagugcagccucaaacucaugggcucaagcaguccucccaccccagccuccugaauaguggggauuucaggcaugagccaccguacguggcuuacauucuuuauauuuuucuacauuggcuuacuuuucuaagauaaguauauuaauguggauacaauaauauggaauaaaacaauuauuuuuaguuuaagaaaugguaguuuccauuauugauaccuauauaggauaggcaugagucugauaguuuucuuuacauauucuggauauuaacuucucaaccagauauaucuuaccagauacaggauuugcaaauaguuucuccuauagguugcuuuuucacuuuguugguuguguccuuucgugagcaaauuuuuuuuuuuuuuuuuugagauggggucuugcuguguuacccaggcuggagugcaguggugaucauagcucacugcagccuugaacuccugggcucaaguaauccucccagcucagccuccugaguagguggggcuacaggcacacgccagcacaucuggcuaauuuuuguguuuuuuuuguggagacagagucuugcuauguugcccaggcuggucuugaacuccugggcucauaugaucuucccacuuuggccuucuaaaguguugggauuaugcgugagccucugcacccagccaaaauuuugaaauuugaggcagucucaucucucuguuuuugcuuuuguuaccugugcuuuugguguuguaucuuggaaaucacuaccaaauccagugucauggauuuauuaauaauucugugagauuaguuaaaaauuagaggauuaaaauaggaaauacaacucgaagcaucacguuaauaauuucaacaugaacaaugaaguagaaauacaguagacauaaaaagcauaaaccaguugauauuugaugaaauaacaaauggaaaauacucacuaauauacuuuuuguagaauuauuauaaugugcuaacuuucugaaagcucaggccaggugugguggcucacaccuguaauccuagcacuuuggaaggcugagucaggcagaucgccugagcucagaaguucgagaccagccugggcaacauggcaaaacucaggcucuacaaagaauacaaaaaauuagcuaggugucaugacaugugccuguaaucccagcuacuuaggaggcugaggugggagaauugcuugagcccaggagguugaggcugcagugagccaagaucgugccacuguacucuagccugggcaauacagugaaacccugucucgaaaaaaaaaaaaaaagaaaguucaguauguaauguuagaggauaguuuuugguauuaguucaugcuuauagcuuggaacacaguuuuaggaguuuaagagauaauaagcugcgugcuguggcucaugccuguaauaccagugguuugggagaccaaggcugguggaucaccugaagucgggaguuugagaccauccuggccaacauggugaaaccccgucucuauuaaaaauacaaaaaguaaucccagcuacucuggaagcuggggcaggagaaucacuugaacccaggagguagagguugcagugagcugagaucacaccacugcacuuuagccugggugacagagcgagacuccaucucaaaaaaaaaaaaaaaagagagauaauagacuuugugcucaggaaacauagcuauccacauaauuauagacauugguugaauuaauuaccucaguauuaaaucugugaucuacugucauauuuuuggaaggaggggugugaugaaucuuacugccuuuuaucuuggcacaaccagguuuuaaugccuaguaccuuuuuuugaaaaaaaaucugagggucugcugcuuuuaaucccuucccagguacuauuuguuaggacucauuugauugcaagaaaguuuuaagaggguauugaauccaaauguaaugcagaggacccuuauacacgaggggugcaaccgacuuacuccaguucauccccagaguaugaaggcuuaacugcuuuaugucaaccugcagauaguauuaggaaacucuaaaauucuagucuuuugcuucccaagauuucuacuuuuuucuuacuauguuuuuacaaguguuuugaguguggcauuaauaaugucuaacuugauccuauuuugaugcacugaugguagcagaagcaagugguagcuaacacuggcauuggcuaauuguauucagagcugugaaacugggagcaaagaccagccccucaaggugaccccagauacuaaggcuguaucuuuguaguguaacuuguuuuaggggguuggcugcccacuccaguuaaaaauuguaguuuagaguugcagugugccugcuaggcagaagguggcuuagaaacaaggggcagaaaacuuggccuucaggaucuuguacuuguacacuuuuuagcaaaucugucucuuaaugucagccuugaaacacuauguuggaggcugugaucauugcucuagugguuacugaacaugcuuaauuuaaacaguaauacagugguuuuucaaaaaacuuuaaaacacaaacccccaauguuaacaucauuuagaacccagcaugcuauaacaaauaucuacauuucuuaguuaauuuuuauagcuaccucccagggcucaagccaguuuuaggagcuuuuaauaauuuaucauuuuaauuaggacuaguuccagugucuacugucucagauacagaacuaccaucccuuuuggcucuacauauuuccccuuucuggcugaagggggucauuuuuuuuuuuuucuaagaguaucaggcugaguucccuuacacacacacacacacacacacacacacacucucacucgcucucugucucucucugucugucucucucucucacacacacacacacacccaugcauacuugaggagcccaaggaaauaagcaucugucuucagugguucccaucucugucugcgguuugguagaaccugcaacugcccuuacagaaaggaggagaaaaaaaacaaccuguacuuucggucucuaguauuucucccuuuccuguguaaggauguacucagcagccagguuuccaguaggacaucucuaggaaucuuagccauagucauucauggccucuuguucuaauauuucacuuuuauuaugauucugcugguaacugacaacugaccgagucuccaugguucacauuuucaagagaucaaaugugauuagcucuugccaggcuauggauuaguucuuuucaagucaguuguucacccugguuccuuuggcuaguacaaggucacaugacacaaacagugccauggauggagguagauuuuguuaggagggcuaugaucagacugguagugauuaauccuuuagaauaaagugucauuaacacaaacuguaaagucaggaagaaaaauugguuuuuaagagaagauauugguacuucagggcauguauuaaauguaagguacuagcaagacauucaaauagaaauaauagguauauagucaaaacugaagauaagauaaggggcucugugguucucaacuagucucauccuuacauugucagggugugaagaauaaaauuucucuucuuuaagcaaguaccuuuuucuuuggagacagacucucacucuguuccccagucugaagugcaguggcgugauuauagcucacugcaaccucaaacucuugggcucaagcaguccucccaccucagccuccugaguagcugggacuacaggugcaugccaccaugccuagcuuauuauuuuggaaagacgagaucucucuauguugcccaggcuggugagcaacagggcuggaaccuacaagccuaaguucucugaaccuaguggauuuuaugccacaucucaguggaaaguaauauuaauuuggcguaucacccaguuaaaagaauaaaaucaacuauccgaauuucagauuauuuuuaugaggcugauguaggccaucaaagaauagcuacaucugugauaaccauauuuagcuuacuuaccucucaggauaaacuacaaaaauaguagcuuuauguaagucucuuccaugauacaauuucaguucacagaagauuuuacucucuuugcauuaaaguuucaaauaauauaauagugaagcagauauacgaagaauauaucugaagguggaguucaaacaucugacuuauuaauaaccugugcuugggaauucuugcuuccagcuacagcuguaaaaaguugucacucacucucaccaagaccucaccuugccugauagaaaccucacauagcugcugcuggaaacacaguugcaggguggaacccagaacucaaacuacuaccaagaguuaguaguuuguuacuaguaauauuaauucagccauauuauugacuuuuaugggucaguuuaagaauuuacacacaauugagaaguuaggcaccauauuaugugaagcuacucuugugagaaaaucuguucuaaaucccagacuuaacugaagaauuucucagcauagcucagauauaaggcuucugugcacauuuaaaagugaguaggugggaauccaaagaauaacauauugauaugguuaggcuuuguguccccacccaaaucucaucuugaauuguaauucucaggcaucaaaggagaggccuggugggaggugauuggaucauggaggugguuucccccaugcuguucucaugauagugaguucucaugauagugaguucucaugagaucugaugguuuuauaagugucugacaguuccuguaacacacacacucucucaccugccacagugucagacuugccugcuuccccuucugccaugauuguaaguuuccugaggccucccaagccaugcggagguguaagucaauuaaaccucuuuucuuuauaaauuacccagucuugggcaguucuguauagcagugugagaauggacuauauauauauguguuaauauauauacacauauauuaacaaaauuaugugcugcuuuacucuucuuuguaauucauguuuuuucaaacaugaaagaugggcuagaauuuagccaguuugagggaaauuagcaugcguaaaggagaaguuuuaaugcuaugauggaaaaggcucagauggaggagugauauaaaagaagaaaguauucuggugcccgcgagugaacacagaaagcagggccuuuccucugcaccuagguaggcagacuuucuacugucaccuucagggcuuacucacagcuggcuaaacugauaaugaggaacaggagaucaucuucuauuuuggauuaucuccuuugauccucuuuuauuguaaaaccauuaagaagcacauuuucaauuguaacaaguagccauucguacacuuauguuuaagguauacguaaccauuuauguaauacauguuuucccagguuacaaauaaaagguagauuaucuuuaaagguuuucucucagacguucauucaguuagaagauuguacccucauuuggcuucccuaacccuuuaaaauugcuaacaugaaauucuguaacugaacuaucaguuaauguuuacgugaauugacuguuaaaaaaaguuccaaugauuauaaauaaaugugucauauuaauaguuaaacuaaauguauguauggguuuuuguuuuguuuuguuuuugagguggagucucgcucugucgccaggcuggagugcaguggcaugcucucagcucacugcgaccuccgccucccagguucaagcgauucuccugccuuagccucccgaguagcugggaccacaggcaccugccacuaugcucagcuaauuuuuguaugaaacuaaauagauguuuaaaccacaucaguagugauagguucuuuaaaagcuuuuaauggcaugacaagaauauuuaaagcucuguuuugguuuugaacugaaaaaguugaaaguauaaagggaaaaaauaucucugacuugugugaagauuuuguuuauuuaucuaagaccuaauugcugaguuuuuccuucuuggccuuguauguuuuucuaagaugacuuugaguuagagccagagucugucuggacaccacugaacuuuuuuuuaguugggagagggaggcucacuauguugcccacugauuuuaaacuugaaguuccauuucaaguuuaaagauuacaggugccaccaccacacccaucuaauuuuuguguuuuuaguagaaacggggucucaccauguuggccaggcuggucuugaacuccugaccucaagugauccgcccaccucggccucccaaggugcuggaauuacaggcgugagccacccugccuggccuaauguagcuuuuucuaauuaacucauaaggguuugauuguaaaauacagaccaaaaaggaagaaagcaaaauuacuuuugcaauacuuuuucuauauacuuaaauaauauauaaucuuuuucacauaauauaaaccuauuuucaugucacagcacacuguacuguaauuuauuuaaccauccuugcauuauuaaaccauacugugguaaacaucugucuuuguacauaucuccuuaagaaaaaaaaaauuuguaaguaaaauuguggguucaaagauucuguauauuuuaaagacuucugacuuuauagaaagauucuaccaguuuacauuuucauugaaguauuaagaaugccucauuccucaucucuaauauuuauuguaaaguuuuccuuccuucuuuucauauguagagauuuugaguaacaugauaaacaacuuauuuuguuuuccaggagaugauuuuucuuugauucaacaagaaauauuuaugguuaaagaauguaaacauuguaacaucguugccuacuuugggaguuaucuuagguaagagaaaaaaaagcaucaucucucucuguauuuuauauauucuuugcuacuacacucucucccuuguauguaagugcuacuauauuuguauguuuuuaaacacugcaaaguucuaaauuuuuuaagguuuuccuauuucuacgguuuuccccuauuacauauuaauaaugguacucccauuuuuauaguuguaccucaucuggcaauuuuaaugaaacauaagugauuacaaguaaguguuuuaacuuacaaaacugaucauauucuaaaccacugaagaugggaacaaagcugaaauuaaugugcuuuucuguauauuguagcaagauuacauagcaguuuccuguugcacuucacaguccauucugaacccuggugugcuaaagagugagagccuuagaguauuucagugauugaaaauuacuagcuaauauaauuuucuuuuuuuuuuguauuagucgggaaaaacuauggauuuguauggaauacugugguggcggaucacuucaagauauuuaccaugguacuguuaauuugacuuuacauuuuaaacagacuuugguuuuaaugauuguuguucgauauuuccaguuaaccacggaaauuaacagguagacuuacuauuuugcauucuucuguucccggagcacugcauaacagaaaucuguauuuauuuuuuauugguuagucaauuaaacuugccugagccugaagugacaaaugcaaaaguauuuauauaauccaaauuuuacucuuuagauaucucuaggaaaguguuuuaucuacaaaugaaacuuccuaaauuuccuuguaaaaaaaaauugaaaugcaagggguaacucacagaagggaaguuacgugucugucuuaguaacuuaaccugcuaaccagaaaagcaauuugcuuguuacuguaauauuuuuguauuaauauguauguuuuaaaguuucgaguauuuuauuuaguauucauauuaauuuaggcaguuuccugaguugaauuugacauuacagucuaauacuguuuagaaaguuuuguuuuggcucuacuguuuagcuuuuaauuuguuuuguugcugcuggcaauuucuugaauuucuagaauuuaugagacuaaacauagauccuuauaauuuuucuucuccuuguuuaacauggauaugggauaguaaaacucccauugcagcuacuuauuuuauaauuuguuuuaaagaauuacgugaaauauuuuuaaacguuucuaugcugaaaucuuuauauuggaaaccuuaccaaauuucagucaugcaguuuacaaaugcagccacaguagauauaaaaacagaagugcuauuucacuucaaauaauagguuguaacuacagagcucaguuuuaaaaugucaaucaauagagcagugguuaaauaaacuacucuucaaccuguaauauggaauacugugcggcacuuaaaaagaugaaguuacuucauaauuauugaccuggguauauaucccuaaggcuuguuuuuaaauggaaaaagugaauugugaaagaauauguauaacauacugggucauacuuaggcuuuuaaaaauuacauuuuuauaaguauaaauauagaauguaaauguauagcaaaaugaaagaauaccuaccaguugacuaagucauuaccagaggagagggaaagcaaagcucagaaguaaacuuuuaaauuacaaaaaaacuuaucaauauaguacuuaauuaucaauuuuaaaaugucauaauuaucuaauuuugucacaacaaauaauccauaacaacaaaaauucugacugaugucuaaacacugaucacuaccucuuuauuaacaaaaauguuuuaacaucacauaaauguuacaaauacacaaauuacuaugauuuaggcuauuucuuaggcauguggauuuaaaauucucugugccacuggauuuaauuuuuuucuaugauuuuauaaagaauugcuaucuucucaugccuguaauuccagcacuuugggaggccaaggucgggaguuugagaccagccuagccaacaugguaaaaccccaucucuacuaaaaauacaaaaauuagccaagugugguggcaggcaccuguaaucccagcuacuugggagacugaggcaggagaaucacuugcacccaggaggcggugguugcagugaaccaagaucacgccagugcacuccagccugggcgagagagcaagacugucucaauaaauaaauaaauaaauaaauaaauaaauaaauaaauaaauggaauugcugucuuuucugugaaaaguuuuuauucgguaauuguaauuuuuguccauucacauuuuuauaaaaugagagcacucaagauagcuggcuuuuuuuuuuuuuuuugcaacuuuuaaguuuaaagaauagcuuugaaacauuaauuuuauuuuuucaugaaauucugacuuucucuuauuaaaccugauauuuguugaauuaaauugaaccuaagaaguacccaucccgguaguuaguauacuagauagcauaauaaucaauaaaaucuacacuuauaauuagauguuguuaauaaagugacuuuuuuucuuuuacuacuauuuaucauguuacuaagaaucaaaaauuuauguuccugaauggguagagagagccagugauuaaaauacgcgguagaaauuucucuaggugaagaauacacaugacuaccugauuugguuucgcugucagcagauaccaccccagaguuacucucaugguacugaaaggcauagucccgaagccucugguugaguucuugaaauaaguagaauuuuauauuucauauuagggagagaucugguugccaaaagugacacgguuauuuuuuaaauucuuagauaagguacuggaucaagccucucuuuugauaggugugguaaagaauuauacuaaagaaauagcaucuugaucuauaaaaaaguauaugaugccuuuuaauauauuggauagucaaucucuuuaugauucucuauuucucuguauaauuaguuauauguauuucuuuauuuuugaaaaauuguucaggauugcauucuauagaccuuccuauaaugcauaccacuaugcuuugcacaugagugcuuaauauuuucaaggaccacaguuguuacggaguuaaaucuuuuaaaguacauuugaaaaaauucucaguguuaccuuuuguuuuugauucuuguugacagaaauaauauaugcucacaaucagaagagaaaucacucaacuguauaaauagaaauuguuuuauaauaguucgucuguuuuuuuguuuuguuuuguuuuuuuguuuuuuuccgagaccgagucucguucugccgccaggcuggagugcgguggugugaucucagcucacugcaaccccugccucccggguucaagcaauucuccugccucagccuuccgaguagcugggacuacaggugcgcaccaccaugcccagccaauuuuuguauuuuuaguagagacgggguuucaccauguuggccaggauagucucgagcucuugaccucgugauccgccugccuuggccucccaaagugcugggauuacaggcgugagccacugcgcuuggccuaguuugccauuuuuuuuaaguagacuguuucuaauguuagguuuaaauguauaacaauguggucucuuuuucuuucuaguuacuggaccauuaucagaauugcaaauagccuauguaugcagagaaaccuuacagguacuauauuuucuuaauauaguuagaaaggcaauucuaggcaauauuuucuuaauguaguuagaaaggcaauugccugacaauugauaacuauaaaaugauagucuaccuuaaagagaaaggguaaaacaaaaugauuuuucuguuaaucucuuauaauucuguaaaacuaguuauuuuucuuucaugaaugaaucacaugaauucauuuaagcugaugccgacauauacagugaucauauguggaauuccacuuugaugcugaugcacaccauggucaugugagguauucuccuuuauagcacuuggcccucaguuguguaaauugguuuucaagaaugaauuaccaaaccucucaauuguaacauguugucuaagcguucccuucaaguuuauggcaguaaaaggaaucucuuccaugagacauaggggcuuuuacuauuucucuugaaauaaaauaaauuagcacagcauuaacucaagguguuaucugaaaacccuaguucuaugugguauuaaauguuauugauagcagaaucucuuuuuguaaguuugguuaacauugcauuaaacagguuucuuuacuucagggccugugagaacuuuuaguaugcuaaaauggguuaugaauauucaauaaagauauagaguaugugguauuucucccaauuuauuuauuuuuuucagugcccugaaagacuacucacugagaaaauuaggaauuaacaauuuuguucauauaauuuaaggcauuuaaauuugcaggagggaauaaguaguagugauugugguuuguauuuuuguaauuuacaacugauaauuguuaauuaaugcuucuaucccuaaauuuccuauauuguguaguuucaauuuagaaagaaauugauacucuauguguuguucucuaauauuuuccaaaaugggagauuuggcugaucaggaaaaaguucuagucaauuuugaagaguugguucccacaugcuuuaaaagacauaaacacugccaaaucuuacugagagauaaaucagauuaauuuaucuaacauauauauauuuauauauauauauagagauguguaauauauauguauguacguauguguguguauauuccuauaacguuuacauaacauagaaaccuacuucauuguaucuacauaaaauacaaacuuaauuauacacucauagcagagaauuauugacaaauucauuuucuuuguauuuuaauuucuaaaguucauuguuucccuaaguauuaaacaaaguacugaguagaggugaaaaaauaaaaaaaaaaaacaaagucgaauuugcacucuggcgcugguaugugaccguaaucuuuuauauaguucuaguucccaaaauacaauccuguacugcauaacauuucagucaacaaugggcuacauauacaacaguggucccauaagguuauaauacuauauuuuuacuguaccuuuucuaugcuuagauauguuuagauacacaguaauugucauuguguuacaguuccuacaauaucaguacacuaaugugcugugcagguuuguagcuuaagaacaauagggcuauacauauacccuagguguuuaguaggcuauguguauauaccauccauguuuaugcaaguacccucugugauacuugcacaacaaaauugccuaacaaugcauuucucagaauguaugcaucccuauuguuaugugagcaugaguuuauaaaaugaggcuuauuuucaagaacaaggauggagcuggagauccuuauguuaugugaaauaagccggggacagaaagacaaacaucacauguucuuacuuauuugugggaucuaaaaaucaaaacaauuaacucacagacauaggaaguagaaggaugguuacccgaggcugagaagggauuugauauggucggaggggaguggggaugguuaauggguaccaaaaaaaaaaaaaagaaagaaugaguaaguucuaguauuugauaacacaacagggugacuauagucaguaauaacugaauuuuauauuuuaauauaacagagugucauugaauugcuuguaacucaaaggauaaaugcuugaggggauggauaccgcuuucuccaugauguguuuauuucacauugccgccuguaccaaauaaauuccccauaaauauauaccuacuauguacccacaaaaauuaaaauaaaaaaaaaaccaauaugaagcuuaggaagggaauaccuccaagauuauuuccaauuuuaaaauucuauuaugcagauaaacuuccacaucuggucaaaaucagguaacaagaaguagauuuaccaugcuacccaaaacaaucaaauaaaguaggcaaaauauaugaaacagugauuuucaagaaacugaacaucagguaaugaaggacaaugaggccugaaaaauaggaaacaaaccaaggaagccauauaauugccccagcuuauggcguugggaaaguuuucaggccacaguacagggagaaggaacccagguggggucccaagccaguuagaguauuuaagguagaguauuggagagugcuucagaguauuggaguauuuuugaaaauucaaaaauauacagcacccaacaaaguaaaauucacaauguugggcaucuacucaaagauuaccagacaagcaaagaagcaaaauaagaugaaaaucaguaaaaccaacccacacugacagaugccagaauuagcagacaaaaacauuaaaacaguuauaacuguuuaagaugcuuaacaaguugagauauggaagguauaaaaaaggcccaagucaaacuucuagagaugaaaaccacagugucugauggaauuaacaaaggaugaaauuagcagaugauuaaauacugagugagcuuuggauggaauuaacaaaggaauuaacaaaggauguuaauuaacaugugucugauggaauuaacaaaggaugaaauuagcagaugauuaaauauugcaaaaaacguauauuugaauuugagggcauagagguggaaaauauucaaaaugaaacauggaaagaaaaaguaauuuuuuauaagugaagaguaucauuaagcuguaggacaauuucaaguggccuaauauggauauaauugguguccuugaagggacaacagaagaaaaagggacaaaaaugagaaaaaaaaaaagagagagaaugaagagacaaagagaaaaaagggaaacgaaagagaaaagggagacaaacugaaaaggggagauggcugaaaauuguccauacuugaugauaacuauuaauaugggcccacagauccaaagugcucaacaaacccugagcacaaaaaacaacaacaacaaaaaaaaaaaaaacgaaaaaaacuacacuaagacacaugaaucaaauugcuuauuugauuagaacaucuuagaagcauucagaacaggacucaugauauacaaaagaacaaagacaaggaauauuuauuguuagaaauaagugagaagacaguggaaaaucuuuaaaguacugaaaaaaaauugucaaccuaaaauucuauuccuagagaaaaucucuuucaaaaacaaaggcaaaauagaguuuuucagacuuacaaacacugaaagaacaagucaccagcagaccuauccuacaagaaauguuuaagaaaguccaacauuaugcucaaagaaaaugcucauuggagcauuuuguauuuucuguuuucugauuagggauguuuaaccaguauauauucugcaaguacuaaaaaaucugaaaucugaaauaugucuggucccaagcauuuuagauagggauauucagccuguacuuauagggaaauuuauagcacuaaacagaagcucucaaaaucaguauccucagcuuccaccuaagaagcuagaaaaagaugagcaaauauaaugcaaaguaagcagagaaaggaaauaaagaucagaauaaaaauaaacgaaauggaaaggaaaaaaaauaguaauagagaaugucagugaaauaaaaaucugauucuuugagaugagcaauaaaaaugauaaacaucuagacagauugaucaggaaaaaaaguaaaaagagaagaaacaagugauaagcaucagaaaugaaugaugggauaucaagacagaauuuacaaauauuagauaacaagacaguauuaugaacaguauuaugccaauaaaaugggcaguuucaacaagagauacaaacuaccaaagcucacucaauuauaaauaaccugaauaauccuauauguauucucacaaagaaaacuccgggccagaugaugccauacaguaaauucuaccagacauauaagaaagaaauaaugccaauccuauauauaccuaucuagaaaauugaagaaugagaaauaacucccgaaucauuuugagucagcauuuuucugacaccaaaauuagacaacaaucuuacaagagaacaaaacuacaggcuaauguucuucauaaaccuaggugcaaacauuaaaaauaaaagguuuagcaaagguaauccaguaauauauuuuaaaaguuaauacaucauaaguggaguuuauucuagaaugcaguguugguuuaauauccaaaaaucauuucaucuuaacaacuaaaaaagaaaaaccacauuaucaucuaaauacacacagggcauuuagcaaaauccaacauucauuccugauaaaaaaaaguucugaacaugguaggaauagaaaggaacuuggucaaccugauaaagcguaccugugaaaaaccuaugacuaacucauacuuaaugguaaaagacgggauguuuuuuccuccaggcucacccaaacagggugaugaagucugccuuuacuacuacuuuucaacauuguccuagagguuucagccagugcaaaaagagaaaauaaugaaauaaaaggcaucuggauuagaaaguaggaaguacaacucucuuuauucacagaccacaucaucaucuguguagaaaauggaauaaaaucuacaaaguagcuacuagaacuaauaaauuaggcuagaaagauuguaauauucacuaucaauguacaaaaaucaaucagauuuauauauacuagcaacggacaaucugaaguuaaaauaauacaacauauaauaacauaaagaauaugacauucuuagggauaaauaugacaaaagaugcauaaacaccugcauacagaaaacuacaaaacuccugaaagaaauuaaaaacccaaauaaauggagaacuauaccauguucacaaaccagaagacucaauacuguugagaugauaauucuucacaaauuguucuguagauucagugcaaccccaaucacaauuugaggaggcuuuuuauuaaagaaguugacaugcugauucuaaaauugcuguggaaauguaaaacaccuagaauagucagacaacuuugaaaaccugaacuauagugccagaaagcacaucaguguuugugaggguuguggggaagaaugggaaaauuauaaaggagcaccacauaaggaaacuuuuaggaguaauuaauauauuugauaucuugauuguguuuagugaaauauuucugauuuuuaucagaaaauaaauuagaaaucuucaggccgggugugguggcucacgccuguaaucccaccacuuugggaggcugaggcggguggaucacuugaggucaggaguucaagaccagucuggccaacauggugaaaccccgucucuacuaaaaaauacaaaaauuagcugggcauaguggcgcaugccuguaaucccggcuacuugggaggcggaggcaagugaaucacuugaacccaggagauggcagcugcagugagccaaaaucacugccacugcacuccagccugggcagugagacucugucucaaaaacaaaaacaaaucuuuaaaauauaguaaacauugauuuacuuaucuagguuuuuuucuccccaaaaaagacauucuaguuuuucuuauucaauaagaauuuaaguagaaaauuuaggagucacauuuacaguuuugcugauacauucuuuuuuuuuuuuuuuaaacuuuuagggucuugccuauuugcauacuaaaggcaaaaugcauagagauaucaaaguaaguucauuuaauacauuuaaauugccaauucuauuggaagaaauuuuaugaugcuaauuuaauuguauuuguauuuuuguucuagggugcuaauauuuuauugacagaccauggcgauguaaaauuagguauguuauuucaaauuccuaaaauuuuuuccaaaaauuuaaugacauuuuaauaaaauuuuuauaaaauuuuaaaugagaauuaacauuaugcagauuucauuuucauaucaagagucgcaguaauguuuaacuuuugauccaguaauuuuacucccaaaacucauuuuaaggaaauuaaaccuaaagauggaaaauccauauucacuaaagcauuaaccauaauauuacuugugguagaaaaaaugcaaauguaagucuagcaauagaaaaacuguuaaacugugauaaaucuauucaaucauugauaucuaugaauguguaagaguaacaucugguguguuaaaugacaaaaauggacuguauauuuauuuaguauuuuacaaccacguguuucuguguguuauuuuguuuguuuugaaggagauggucucacucugucauucaggcuggagugcagugauucagucauagcucacuguguacuuggacuccuggccucaggcuaugcucccaccuaauccucccaaguagcagggauuacaauacaaucauguuuaacuacaacacuuaaaaaguucauacauagaaaaaaaugacuguaaaaaaaauaguaccagaaugcuauccuuguuauauuaggauaaaaggaauacagguguguguuucucccauguguuuuauuuuuugugcuuuuuuuuuucucuuuuucccaaauuaacuucauuguguauauaauaaaaauauuuuuuguuaacuuuguucuuaauaaaguauuuucauucuaguaaagugccaguaaauuuuuuuaauaaguauguugugaacuaagcaagaagagauuuagguauucaauuuaugcgcauuuuucuaacauuaauauuugaauuauuaauacugccaugccuaagggcgaaaguaaaaauguuguuugguguauuguaaagaacuaaaauuuucuguuuuuuuccucacuagcugacuuugguguggcugcaaaaauaacagcuaccauugcaaaacgaaaaucuuucauuggcaccccuuacugguaagacauuacugugauugaauuugauccauuuucauuucuucaugguuuugugaucaaccucgauacuugguaauagaaguaauaauuaaaaguagggagauuugcgugcucuuugacaguaucauaaguucuguuuggguuagggaacuuugaugcucauauucaugguucagccuucccucuguagaagugcuaauaauuuuuacuaucccugugauuuuauauugagagggcucuuagguaugaaauuuucaaaagauuugccuccuguaauuuucuuacccuuucuucuggcauucucuuuuaaucuaggacuuuuccacuuuauuuuauuuuaaguugcaggguacaugugcaggaugucuagguuuguuacauagguaaacgugugccaugguggguuugcugcaccuauugacccaucaccuaaguuuaaucuaggauucuucuuccugguuguuaaaacuccuucauccuaccuaccauuacucucaccagccaccccacucuuagugcauuccacugauuacugacaaaauaaucuuucuaaaacacugcuuucauuauugauagaugauagaaauaaaaagccucauaacaaaaccuuaauauuuaaaauugugaauguuauaaaaggugacauuugcaguuugugugaaagguuagauucuuuuuuuuuuuuucugagacaggguuucauucugucacguggcuggagugcgguggcacaaucacagcucacugcaucauugaccucccagagccagaugauccucccauuucagcccccgaaauagcugagacuacaggcaugcaacaucacagccagcuaauuuuuuguaauuuuuuuuguagagacaggguuucagcuaaaacuccugggcuggucuaaaacucaagugaucuaccucccaaagugcugagauuacagacuugagccacugugcuuagccaauuuggauucuuuaaugugcaguguuuggauaauuuguuauuugaaaagaaauuuaaguagcuccguaccucauaccugaugucaaaaaaucguauguggaaauagucaaguucacaccuguaaucccagcacuuugagaggcugaggcgggcggaucaagaggucaggagaucgagaccauccuggcuaacacggugaaaccccgucucuacuaaaaauacaaaaaaauuagccgggcgucguggcaggugccuguagucccagcuccucgggaggcugaggcaggagaagggcgugaacccaggagucagagcuuacagcgagcugagugcgcaccacugcacuccagccugggcgacagagcgagacuccgucucaaaaaaaaaaaaaaaaaaaaaaaaagugaaaccaaaagagccaucaguaacuaucugcuuuaagagcugaggaaggcuuucugaacauaaagaauaaaaccuuaaaaggaaaugcugauagauuuaacugcaugaaaauuuaaaacuuguuuauguccaccagcuuaaacaaaauuaaaaggcaaguaaaaaaacaggaaauauugucuaaaauaugccaaacuagguuuaauauuuuucauauguaaguucuuaugucguuaaaaagaaugucucauuagaagcaguuaguaaaauaauacauauuaaguaucguaacauaugauaauagaucacaagaaguuacggauuucuuuuuuuuucuaauaccaacucuauuagcaaaaacaauggcauagacuuauuugugccaaaagagaauacuuuuuccauaaaaaagaaagguagaauauaucuaauaggugagggguaaccaaaacuuuuuaccugagaccaguaagaaaagccccaaaauuaacaaagacucaguuuucaaugacacauucaucacagaccaauuaaaaaacuacauaaaaaucuuaccuacauauuagaaauacauuuuuaauucauucauaaauccaacaaccuuuuagacauauaaagaaaaauuauuaacugacaaaaaaacacuacguaucgaauucauuuacuaucacuuaaagggugucuacagaauucucaccucaauauuuucauggaaaauaaguggaaaucaauaguccagagauccucauuaagaaugagccacugauaaacacaauauauuuauaaguuguauaauauucaugugcauguuuugagcauuagucaauguuuaauuugcaucaggcuuuucaaauuaaauuuauaagauuucuuuucaauaggcauucucagaugacuuuugaaauaauuauuaaaauggaaacuuaccuguuuugccaaguacuaggauuuagauacagaauacauucuuauaagauucaucuccaaugugcacaugucaugugucuuugaauguaccugagagaaacaaaggcauccccacauuccauauguuuacagggauuuucagaaaugacuucuuucaugucuucaacuagaacuggaaacacugaggacauuaccacauuguuuacaugcauauuuuccccccaguaugaguuuuauauuuuaaaagggaaguggcaaaauuacaugccuucccauauuccuuacauucauagguuuuucuucaguaugaguuuuuuuaauguguucaaagggaacuggaacauacaaagacuuuacaacauuucucauauacauaugguuauucuccaguauaauuuuuuucauguuuucaaagauaacucagauaauugaauguuuucccacauuccuuacauuccuaggauuucuaugaaguauguuauuucauguuuaccuacagaacuggaauaucugaaggcuuuaucgcaugucuuacaaucauaagguuucucuccaguaugaauucugucauguguuucaagguaauugaaacgacuaaaggcuuuaccacuuuuuuuuuuuuuuuuuuaccuucauagaguuucucuccaguaugaguuuuuucauguguucgaagggaacugaaaugucugaagguuuuaccacauuuuucacauucauaaaguuuaucaccaguaugaguucucucauguguuuaaagguaacugaaaugacuggaggauuuaccacauuuuugacguucguaggguuucucuccaguaugagcuuucaugucuucuaagggaacuguauugauugaaggcuuuaccacauuuuuuauagucacaggauuucucucuauguguucuuucaugucuucacauggagcagaaaugacggaagacuuuaccacauuucuuacauuuauaggguuucugucuaguauuauuucuuucauguuucugaaggaaacuagaaagaauaacucccuuaccauauuucuuacauguaaaagauuuuucaccaguaugagcccuuugaaaguaacuaagacaacuuaauucuuucgcauauucccuacauucauagcguuucucuccagugugagcaccuuugugguuaugaagguaacuggaauauccaagggcuuuaucacauuucuuacauuuaugagguuuuucuccacuguuaguuauguuuuugaaaagaacugcagagucucaaggauuuaccagauuucuucuguucucgggguuuuucuccaaugugaauuacuuuaugucuuugaaguaaauaggaaaauuuaaauguuuucucauguuucuuacaucauguaguggccugcaggucauggcuaggggcaugcaaccccuacagauuucuuuguuccuucuuuacucucacugcuucacuugacuaaccuaaaaaauauauauauucugaauaaugugucccuugaugaacaaauuaaaugacuuuuuucuaucaaauuggaaaauauuuggaauuaugggcauccuuacuaucacuaaauauuuggcagugagaguagaaauugguacaacagggguuagggagggagagcaucaggaagaauagcuaauggaugcugggcuuaauauuaauaccaaggugauggguugaucugugcagcaaaccaccauggcacacauuuaccuguguaaaaaaccuguacauccugcacauauacccuggaacuuaaaauaaaaguugaaggaaaaaaagaaaagaaauugguagaacgauuuugaagcauaauuugaugguaauguuuaucaaaaacuuuaagcaauauuuaucuucuuuauucucaguaauuccauaucugguaauuuauuagagaggcauacagauuuguauaugauaagcuuuaucacacuauuuuaaugauaaaaauugagggaaaauaauacacaacaggaagggaauuacauuuauucaauucaguggaauaauaugcuacggcucaugauauguuguuaauuuuagaaagcaagauuccaaguaguauaugcaauaugauaccauuuuauaaaagguguguguguguguguguguguguguguguguguguaaaaauggaugaaaauaugugaaacaggaacucucuuugagugggaucaugcuuagcuuguuuucuuccauauuuuuucauauauuccaaauuguuuucagucaacacaaaucacuuuaacagaaaaaaagccucaauaaguaucaguuaaauaaaaguuaaaugaagauauaggugaguuagauaaccuauaggauugccuuugucacaucagagucccucacuuucuaugacuguccuuuuugugaauacucuucuagucuaaauugucuauuuuuuguauccugacuauaucaggugaaauacuacuacuuuagcuuucuuuacucuucccuaagauacccuuuuucuguguuuaucuuaagcccuccccauucuuaagagggccacacucucuaccuuucuauaccuauggccaacugauugaauacaguuucccacugagccaggaagugcaacagucauagucaacuugacauuccaguuagccaccacuagcugauuccaguggguagaggagaugaauccuguuugcuuucucugggcuccaccucagccucuuuccucugugaaacuugccuucaauuaucuugcuccguggugauuguuuacuucuccuuacuccuauauccauuguuauguauguagcacuugcauauaguacacaucuacauguucacauuuuuaguauacauacuuuauaugcuaaccacacuugagagacaggguguuaauauaacuuuuuguagccuaaguacauauaaaagcaacuuguaccuuguggauauucaauucaaauuaauugaaguuaaguuaguaaacauuugaaaagauaaaagaauauuuccccugaacaguaucaucuauacuuuauaacuucagaggccuucuacagugcugauucccaaacuuguaacuccaacuucagucuuuuguauauucaacaguuguuuaauaauagcucuauuucaauauccacaagcauuuccuccucagaucuauaucuuaaguuaaccccuuucauucuguucccucugcuacggccuuugaaaaguucucuaacauaucugccugacugauuucaccugauuucacacuauccuucaucuugccaugcaguuuuagauuguuugaccucauaauuaaaucuuucauuggguccccaucauuuucaugauaaagucuaaccuuuuuuguauaaacaguagaucauuuauaaucuagccucuacuucugagguugauuucccaaacacuuuugagacuuucucuaaccauguguuauuuccuguccauuacagacuuauuuguaaaauaagauaaaaaugaauuuaugcauuuggacaagcauaaaugcuuacucuccauuucuguauuuaucacagacugguagccagcaauguauggccccuuaucaguuugcaggugauacauugagcacuguccugucagcuuugcuggucucccugaauuuguacucguuuccugucacugaaauguccaggcuccccacccuacuuagaagucucaccuccuuuaggaacuuuucuuugaccuucacagggauuuagguauucuuuuucuuuuugccuauuacauaacaagauucacaaaaauagaaaccaaacuaaaacaagauuuuuccuuagagcauaaacauucagaggagggcauucaagauucuuaauuaauuuuaaaaguguguaugugugugaaauagagauuuaagccuuuacuuaguaauguuucuucuuuccuaguaaacaccucucagcuuccuucccuccaacaagucuggugauuauaacaggaaguaacagauucagaucaauauuuaacaacaaaaauguuguauucauugauuccuucuaggauggccccagaaguugcagcaguagagaagaaugguggcuacaaccaacucugugauaucugggcaguaggaauaacagcaauugaacuuggagaacuucagccaccuauguuugaucuccacccaaugagguguucucauuauuuauaauuauccaguuauugaucaagucuauggggaaagugaaaugcugauaacucagcaucaagcucauuuuuaagaaugaaaaauaguaaagguauuguaagggauuuaggaguaaucucauccaaaaccuauugugggcuaguccgaagguaguuaccucaauucauuuuucacaauuacagaucaagcuccuuguucugcuuuucuccuucucacuacuguacuugacuagucuuuaaauaaauaaaaccugucuuguauugcugcuccuaaaacaacauaagaguaaauugucuguacuguuugaagcuuuuccauaaaacaaauuucucuucauaaucacacuaggauaugagaguuaacauuauuuuaagacuuuuugagucuucauguucauucuuuuaucaauugaucuuuuuuuuuguccuauguggaauuauaaguaaaugauagaaugcagaugaaacuuuucuaguuauauuugauuuuguuucuuuuuauuuuauccaggaauaaugaagagguaucuaugcugaauauaauuaucauuuacauucuaggauguauuaucucagaaaaaaauauuugagggcaucugaaaaguuuuuugauacuuugaaggaaaagauagauuaggcuuaaauugacacuuuaaaugguaugaagcuaaaaagaaaauuaacagaauggugaaaguguuuugcuaacgugauuggcaacagauugauauauacuauauaaggaaaucauucaaagacuacaagcaaaaaauagauuaagguuuaugagcaaguaccagauacgggaaucuauuugagcucauaagcagcuaaagauaauauauauuaaaagauaccuacuuuuagcuagaaugcugauaaguacagaccuuuuggaaaaauacuuugauguuauuuguuaugggcaauacaaauguuucagugcuuccaccguuuaggggauuauaauucagaaauaaucuaaggaaagaaaaugcuaagaauuaugcauuucaggauaacaagggaaaaaaucuaaauauguaguaguuggugaauucuuaagccaauuauuuaacaguuaagggcagccauuacauauguaugaaccaaagcaaaauggaaaauugauuauuagugaaaaaaauuauaaauacuaaugugaauauaauguaauugguaagcauuuagauaaagacuaaaaagauuagaaaaauguuuuaaagagauuagaaaauuuuaaauaauagaauggugggaauauaguuuuuuuuauuuuuccuuugaaucauuuaauuuuuagaaaggaaaaauguauuuguuaugcuaaaaaagaaacaggaauuugcuuagaaaccugggauuuuuguaggaaaugcugaaauagagcauuuuagaacuuccuucuuaaauccucuaucauacuacccccauagcccacaagaaaaugggucacacgugaguuuauagacaaaguucucuuguagauugguuuauguauuuaauauacugagagaauaugggaaaucauuguccaaaaaaggaaaacaaucaggaaauggauauaauuugccuauacacccacccaaaauaaauauggaggccagucuuugguuaaauaugcaaccuaauguuagaguaacaugucaucucuauguauuagagaauuauauacaauuauauagacaugugcuuaagauauaauacuaguuacauauguaacaguauaguaagaaaacucuuuuccaauauuugguggguuugcuuugugaauaaggacuuguuggaaauuuaaaaaucuucucuguagucaagagaaauuuuuugaaagcuaucuaaaauauuaaaaauuuaauuucuauaucccauaguaguuuucaucauuguccacuuaugugguagucuuguauaaauucauuacagaauauucuuucuaauuguuagauguaguaauuuugauauuguucuuuaacuauaauuuuuauuucagggcucucuucuuaaugucaaaaaguaauuuucagccuccaaaacuaaaggacaaaacaaaauggugaguuaaagaauauauaguuuuauagaauuuuacaaucgaaaggaguauagauucaguucccauauuuugcagaugauuaaacagaaguccauagacauuaagcaguuuucucaaaguuacacagcugauuugcuugcagaccuauggcaaggaucuagauuuauuuucugguaguuuuuuuuuuuuuuuuuuuuuuuugagacaggauuuugcuguguuauccaggcuggagugcagugucaugaucauaacucacugcaaccucaaacuccugggcucaagagauccucccuccucagccucuuguguagcugggacuauaggaugugccaccacaacuggcuaaguuuuguuuguuuguuuguuauagagacagggucucacuauguugcccaggcuggucucaaacuccuggccucaagggauccucccacuucagccuuccaaaguacugggauuacagguguaagcuacugugcccagcccaguguuucuuucuuuuuuguggagacggagucucacucuguugccaggcuguaguacaguggcgcaaucucggcucaaugcauccuccgccuccuggguucgagugauucuccugucucggccucccgaguagcugggacuacaggcacaugccaccacgccaagcuaauuuuuguauuuuuaguagagaugguuucaccauguuggccaggauggucucauucucuugaccccguaaucugcccacuucggccucccaaagugcugagauuacaggcaugagccaccucacccggcccaguguucuuuauaauccaguguucucauaaaacucaauaauuuucuuaggucuucggcagauuggguaagaaguguggugaggaaagaauuagaagugauuacaugaagauuuugaagaaucaucuauuuuugcucuaucuuccuuuacuuccauuaauuacacauugacuuucauggaaggugauaugaaaaggguuuccagauaacaugacacuuaaaaucaaucucuguugguuuuucccucucuuccuuacguaauacucaaaaagauuauuacuuauuuucaucuugaucccuucuuucucuuacaaaguaaagcaguuuaccuaucuuuauaguccaaaaagaugucaucaauugguuaauaaaaauuaaagauuauuuuucugguaaugucuuccccauacauuuaauaaaagaagcugugcaaauaaguuucugaguucuuaaauucuagaauuccuuaucuagauuacauagaucuuugaggaucugugagcccccaaaauucuguauguauauccauuuuucugagaagacaguccauugcuuauuucagguucuaagaggccccuccccacaaacagguucucaaccacugcuuuauguuucaguagucugucuuagcauaguuuuauuuaggacucaagccauucuggggaugaugacaggaaagaauggcaaaucacaccguggaaagaaaggaguuuauauugugcugcuaauuauauuccuuuguauugacacuggguccuuccuuuucccuguugcucuaaguuccuagacaucuggaacugaacgguuuuacggcaggaaugacugauauucauucaggaaugaaugacuguuagcuauaaaugcuaaauucacagucagauuucagagcaguuauuaccauuggagaaccuuugccagucccgauacugucugacuccauguuaucuuuaucgcaagccaccaaaugugaugcagugaugugauuucucugcagagaacugcuguguggugguugucauugcugauaaauacgguuauuucauaccuuuaguucuuguccauucucuccaguggaaucuuggcaaugguagaaauaccuuuuugugucauuucuuaauaaucaaaaugugauaccuuuaauuuaugucuucuuccuuuccccacuucaucagugaagguggcagaaaacccuucuaguugcuaaaauugcucccuccucuuugccuuuuuuucuaagaaauucaucagccucuuugggauuuaaauagucucuuauauuaccccaugccuaccuuucgugccguccaacucuuuugguauagcacaauauuuacauacuagguaaauuaugcaaugagaaaaggacauuuugacuccuaaguaguaccuagaaaagaaggucauauauaaaugacacagccuaucuauuucugauuguuaguguaauuuuugugguuguauauuacuguucuguuacuuaauuguauuuuauaugaaagacaaaacugacacagauguuuccacggaauauauuguacuuuaacuaaguggcccaauaaaaaaucaugguguuuuagacuaacuguuccuaaguuaauguuauuuacuaacaccgaaacguaauaguagugaaauauuuuuguacgucucuuuuuauuuuaaggucaucaacauuccauaauuuugucaaaauagcacuaaccaaaaacccaaaaaaaagaccaacugcugaaagacuucugacuguaagucauugaaauuacgaggggucuuccuauagucauaaauuagacauaucaguagaacaaaaguauuuauguuuuuaagauaaaaauguuagugaucucuuacagcaggggucagcaaacuuuuuuuuuuuuuuuuuuuuuuuuuuuuuuuuuuuuuggaaacagggucucacucugucacccagacuggagugcaguggcaugaucucagcucacugcagccuccacccccacccccugggaucaagccauucuucugccuuagccucccauguagcugggauuacaggcgcgugccacuaccaccuggcuaauuuuuguauuuuuaguagagacaggguuucaccguguuggccaagcuggucuugaacuccugaccucaaaugauccacccgccucagccucccaaagugcugggauuacaggcaugagccaccaugccugaccagcaaauuuucuauaggcgggucacauaguaaauauuuuaaacuuugugggccauacagccucugccacaacuacugaguucugccauuauagcccagaagcagccauaaacaguguauauauguggguauaguuuuaauacucaauaaauauuuacaaaaagaggcaggcagugcacuagauuuuccccaugggcuguaguuugcugaccccugccuuagagaaaacuuuaaaauguugcugucagcuaaaacaaauugcuuuucuugucuucuaauguaaauuuauagaauacucugcauauguguguguauaaaacacuuuuauguuagaaauagucagugauuacaacaaccuaagaagcuuuacugacaugccaauauuuaauuauauaugucuuuguaaauuaacauaauuuuacagaauuaaauguaugcagauauaugauauacaugcuuuuuucuuauugugauuauguaccauaccacaguauucauuugcaucaguauagugauaugaguaaugaaugucauugguauagccauaucuaaucuauauuaauuuuagaacuuaauauggauuagauaacuucacaaaaagaaauugcuuucuaaauuuacccuacaaaggcucuucaguuuuauauaauguguaauuauggauucucugauuaauauuuuuacuaacacaguuuauuuguguuaguagacucccauauacuugucucugcuaguuacugaaugaaaaaaugaagauagcauuuucuuuaagccauagauguaaaggcauacucaugaaauuucauuuuguugucuuuuagcacacuuuuguugcacagccaggucucucuagagcccuagcaguugaacuguuagacaaagugaacaauccagauaaccacgcacauuacacugaagcagaugacgaugacuuugagguaaggaaguguuugcagucucauaguugaaaauaaauguuuuauaaggccuuaaaguuugcuuuuuuuucuuuguuuucugagucuaucuuuuaacuuaguuaaaacagguuuagcuacagagauuaauaauguaaacuacacuuuuccugcacauaauuaucaguugauacuuuuuuauugugguauaaccaguugauacuuuuuuuauccuaguucuccuuagaacuaggauuaguucuuaacacugucucuuuuuauguucuuaguuugguuagccugaaguuuugguagcugagauugaaaucaggggucccucugcagaaaugcagaggugcuuucccuuuuagugauugcccuuaucucuagaccucagcuucuguagugaguuugaucauucugugggauauauauaaagaacaucuguuuccaaggaaauaaagguuuuaagagccuugcuuucaaccaagaaaacaaaaguguagccacaacacauaugcauauuauuuuucaugaaaaggacuucuucgaaauccagcugcgcauuuuuguaguugaauuuguauuaacaaaauacaaauaauuuuaaagaaugaagcugaaguuccuguuggaaaauguuauccuuuucaguauuucaaaacuauuauuucuuauauaauuaguuguagggcuauucauaacugugcuugccuucucugaaaacauuauagaauuauuuuuaauguauuuucuuuuuuuuuuuuugagauggagucucgcucugucgccagguuggagugcaguaacacaaucuuggcucacugcaaccuccacuuccuggguucaagugauucuccugccucagccuccugaguagcugggacugcagguaccugcuaccacgcucggcuaauuuuuguauuuuuaguagagacaggguuucacuaaguuggccaggauugucuugaucucuugacaucaugauccaccugccucagccucccaaaguguugggauuacaggcgugagccaccaugcuuggccuguaauguauuuucuauaacaacacaauuugucaggaaaucaggaaugagagacuuccucuucauugacagguaucuauuuaugacuauagcacagcuauauuuuuucaccagucucuuucucuccuuauguuccuucuucuccuuuuaugauuccauuuuauuucuaaguuuuucugaauuugucucuucauguccuuuauuuauuuauuuauuuauuuuauuucccuuuuaucucuaccuucacuaaagggaauuuucuauuuccuguuuuucagcuuuaaauuauuuccuauaaauaucauacugugugccagacacgguggcucacaccuguaaucccagcacuuugggaggccaagaugggcaggucacuugaguucaggaguucaagaccagcuggccaacauggugauacccugucucuacuugaaaaaaauacaaaaauuagcuggaugugauggcaggcgccuguagucccagcuacuugggaggcugaggcaggaggaucucuugaacccaggaggcagagguugcagugagcugagauugugccacugcacuccaaccccagcaacagagugagacuuugucuuuaaauaaauaaauaaauauuauaguaacuacuagcacucauuggguacucaauguaugccaaguauuaggccaaauaauuucuauguuaacucaucuaauaucaaaacaguccuuuauacuguuuuauaaaugaggaaacgagggacaaaaaaugaaaguaauuugcccagcaucauauggccaauaggaaauggaaccaggauuuagauccaggcaaacuccagagccuacucucuuaguuaauacaccaucauaucuauguauguauuuaauagaaauagucauugaacaaucuuuaaacuccagucuuuauuuccccauugccugguauauagcauaauccugucaugucaugaguacccagugaauauuuaguugaacguuaaaugaacuugaaguggaaauauuaaauaaaccagccaaacaaaauuguuuucuacuugaaccacuguuugcaacuugggauuaguaaauauuuuaauuguuuaaagauccaaaacuuaguaaaguuauucuugcauaaauguagaauuagauauuacucuauucuccaauuugccuuucacuaguuauguaaauaaccagacaccucuuauuuuuuaucucguuuugcugggcuucccaaauccacucuacuuucugaauucucuauuucuguuuaaugaugucaccauacuuuucaguucucgaaaugcaaaaccacgugccaggcaguugggggggcacaaugguauaugagacuaacauuaucccugcuuuuauaacgcucauaguauagucucaaaggaaauucagaaguaccaacgaauaauuuacacaugugauggaaugggagguaaaaggugcuauggagggauaucauagggacuggaaaaaacucacuacuguagaagugacauuuaagcugaaaaccugaaggauaaaucagaauuagaggaagagaauaaauguaaguggccugagcagagguguuaauaacauguuugaaagccuagugauaagggaaaaggcaguguacauaaggaacuaaagaaaagucagucuggguuggacacaguggcugucuguaaucucagcacugugggaggcugaggcggcuggaucacuuugaauucaggaguucaagaccacccugggcaacguagcgaaaccccauuucuacagaaaauaccaaaaaauuagcugggcaugguggcacacgccuguagucccagcuacucaggaggcugagucuggaaaaucgcuugagucugggaagcaaagguuacagugagccaagaucgcgccacugcacuccaaccugggugacagaaugagacccugucucaggaaaaaaaaaaaaagagaaagaaagaaaagucagucugacuagggcagaaaacaaggaagaaggaagugguagaagauaacgauacagagcuagauacugucuaucaaacuguauuuaaaauguugggcuuuagucuaaggguaguagaaagccauuaaaggguaagggagugacauaaucaaaaugugcauuuuuuaaagaucucagugacuucagaauggugaguucauuacugaaaaccuguuaaaagacuguugaaauuauacaagauaaaaauaaugguaaacuaggaugguagagcaaggauggagaaaaguguauuaauuuaagaauuagagaguuaaugauuggaugaagacaugaagguaaggaauaagaagagaauuacuaccagauuuugacuugagcaguuggauggauauauuuacuauuuacuaagauaggaacacuaugguaaaaucagguuuggaaagaaagaugaguuaaguuuuauacugaagaagauguugcauagaacuuccaaauggaaaagucuaguaaggagcuagauaugucauuguagcuuggagagaaaaguuuggacuaaaaauacagguuugaggcuagguaugauggcuaaugccuguaaucccaguaguuuaggaugggccaaggugggaggaucacuucagccaaggaguuggagaccaaccugggcaacacagugagacccugccucuacaaaaaauguuuuaaaauuagcaaggcuuggugguggguuccuguagucccaacuaccugggagaccaaggugggaagaucacuuuaaugcaagaggucaaggcugcagugagccaugauugugccacugcacuccagccugggugacagagcaagacccugucucaaaaaaauaaauaaaaguaaauaaaauaauaaaaauauaaauuugagagugauuagauacacauguaguugaugccuuaggaguaaaugugaucgaucacccaagggaagcauguagaaugagaagagagccuagcacaaaaccugacauuucucccaaaauuuaaggaucaaguaggcaaagagcaauagcaaaggagauugauaaggaacauugaaagaagaaaggagaguuucaaugagaacauagaaauuaaguuaaacuaguuuuggcuuuaggugguuaguguuugaugaguuuaacagagauaauuuucuaauagaggagggggagcuagauugagugauuugaaagauauguauugcaauucauuuaugaaauugaguugugaagggagggauaggauagagcaguagcuggaagagaauaagcuggagaaggauuuuuuugugugugugguggggggcauugcuugaacaguauuaaaugcucaugaauacuguccaaaauagauagaagagucaagggaagcaagauggaaaggcagaguccaugagaaggaagcagggagaagcaacacugcucuuccauuagagaaagggaugguugauaaugcaguguagcuggugauuucuauuuucucugugaaguaaguggugaggucaucuguacggaugaaggaaaauggguagguuugaagaaugugaagaagguacagaauaguaauugaggggaauggaggguuagaugacuagagaaguguuugugggcaaagucggagcucagauuagaugaauuuucaguguguucugcuguguaauuuuccuccagcaugauugauaccccagauguguaaacgcaaagguaaccaguugaguuuauccaggauuggcauuuugcugucccaguguacuaaaagacaguggggcaaagggaauuuagaauuuuugcaagaaauuacuugaaauuaugugcuaccagacauaaacuggauaaggagagauguugauggagagugagaaaauaaugaaucaauggacuugauauuccaaugggaacauugaacaaguguuaugggagugagagaguaagcucaaaagaucagagauuuguaauauagaggaaauucauguguuagaguugaugacaggguccaagaugugauuuuuaggaguugagaguacauugaaauauaugagagugucuuuaaagauggggucagaaaauaagucuagaacaauggauccuccuggggcuuugaauuuauuugguguuuugguggguauugaaguaaggggcgaacaaaugagccacuuugagagucaucagugaaugacagugagucaucagaaauuugguaaauagggguugagcugaaggccuaaggggcaggagguucugcgugguggguagaaguauuaugcuucucacuuggcuuacuacaauauucuuacucaaucucccuguauccaauauuucuccccuccauagucucauacauauuuaauagauaacucuuaaagcugacauuggcaaugccacuuccuugcuguaaagucuccaaaaaauuccuuuugccaagaaacugaggugaagagccccaggcugacauucagagccuuugucgauugggcucacccucauggucugucuuuccaucuuugucaucucaucaccuaaucuucacugcaaacaaauaauaaucaacccccacugccuacaaacacuccacaauuuccuguuauuucuuacaucacuuuguucuuauucuuucugcugucuaaaaugcuuuucccacauugcugcauauucaguacauacugguacuucagagccccagaugagauuacagcuuucaugaagaacuauaccccuucaggucaaagucauuucucccuucacugggcuuuaauaguaguccauuuauccuguuaaugaaaggcacuugccauuuucuuaucuguauuugugugucuuaucuuccuagacuguaagcucuuugaggacaggauuugugucugucuuugaaucucuucaguauuuuauacaguauaaacauggaacaagugaaaaaacuuccgaaguauuguagcguucauuguauuuguuuuauguuuauccuauaauuuacuaguagauauucauauuuaucaauaaaugauaagaaaguuugaccuuuuaacuuucucauugaaauuuguuaaaguauauauauuaugcuuauauucacagccccaugcaaucauucgucauaccauuagaucuacaaacaggaaugccagagcugaacggacagcuucagaaauaaauuguauguguuugguuuacauuuuccauuggugguuuuggaggguugugcugcguguucuuguauguuuuguagaauaauaaaauuucagacuaaggcuacauacuucaacauaucagaauacuuuuaaaauagggguugcuuuucugguuucgauggaauucccuugguuuguaauuucugaauaauuuuuauuuuccaguuauggacaaaaucaugcccauugcugaaaaucugcaagaaaaaaaagagaaaauuaacauugcaugcaaucacaucacccagagccaacccauaguuaauauuuugccacauuucuuucauuuuccauguguauuuuuacauggcugaauuuaugcuaugcauaaaauuucacuuaacaauagaauuaauuuccauauauuaguauagacuuuauaaccauucuguuuagcgauugcauucuguuucauuaauugauauauuguaguuagccaguuuacucucacuguacauuuggguugguuucagguuuuaaaaaucagauuagcacuaagaugaaucuuucuaaaggaaauauuucaaaagcgagauuaguuuuuaauuuaauaaucauugacagaugaaaauuuucuaucaauauuugucaccuuagcuaaauuaauuuagaacuacagauucguaaagacguuuuaguucucugguuuauugccuuaaaugaauacuuguucugagagauuuaaaguaguuuauauuaaaauaagguuuaugacuaacaaaaucaaauaaaauuguaaaccauacuagaggaaaauaauucauuaaauauuugagcuaauuagaaugauugccagugugcauuuuguuuaagucugaguuuucauaaacccaaacauuucuagcuuucuggacauagcuuuaaaacucuuagucacuagagaguuagaguaucuuucccuucucaguuguuucaaucaggccuuuucauaauuaagccaguaauucaagauuuagugucuuuguuagugccuagauugaugauaucuucuuaugcuguucucuccuuuuauaaucugaggugaagucugugggccuccaauacuaaagagaaaaguaacaaaguugauauuccauuguaacaucauauucuuuauuuuaugcaguucuguaguauuccauuaauguagucuauuuuaucuaucuuuucucguauaguuuuggguuuugugucauauuuagaaggcuuucucgauuccagaguuaucaaauaauuuuccuauuguuucuucuuguguuuuuaguuucuuuuuuuaauauuuaaaaaccugauauacauuauuugguagaagguaagaaguauggauucaacuugaguuucuuucuagaugacuacucauuuguuucauuauuuauugaaaaugcaaucuuucuacucauggauuugauaugccaucuuuauuauauaccgaauuggcauagauauuuuaggguuguuucuggaaauucuauucuauucuggaaauucuauucuguugcaugucuguuuuugugccaguagcauacuuuugauuauuauaucuugauaauaucuguuagaacuaauccuacuccuacucucugccccuccccacaacacacacauauguaccuugucacacuucuuuuucauuaugacauuuggcuauugugccuucuuccccacauaaacuuaagaaucagcuuaugugguuaaaaaaaaacagaaaaauucauuguuuuuacacagaucuuauuacuuugggagaguugacauauuuaugauauucagucuucuuaaucaaaauaggcuucuucagagauaagauuuaguucuuuuauauuccauaauauuagcccaaaauacuaauauccucauagaguaaguucugguugcuuaaagcaccagacaaagcgguagaguagaaggucacuuuauuaaugacuugucuuuaaauuuuugugaaacuucuuuuguauuuaucaggaauguuuuaccacuuugcuuuuguugguuugauagauuuuauacuauuuauuucuacucuguuuuuuguuucaguguuuuaaauugaagugguagcuuacauacaguaaaaugcucaaaucuuacgaauacuccaggguaaauuuuuaaauauauacacucauauaacuaccacccagcuaaaaauaugaguuagaacaugaucagaaucucagaagguucccucacgagagccuucacaaucaguuuucuuaaauucuauacucgccugcccucucuccgcccaggcgaauuacuauucugaucucugucacauaaacuggcuuuuaccugaucuugaccuucagguaaauggaauuauacaaaaagcaacuuuuguuccuggcuucuuuuacucaacuuuaugucuguuagagucauguguaguaauaguucaguuuucacuacacuguaguauuccauuguaugaccauaccacaauuuauccauucuucuguugaugagcauuugauuuauuucugguuuugggcuauuaugacuacuguaagcauuuuuacaguguauuuuuaguggacauaaaugauuauuaugaaucacacccaaucagucuaagaccaccaggggcaaauguguaguccaacaaagucagguuuacugacucccugcagugagagagaacacacaccagaggaaccaaaccauucaagauuucaucaaacaagggaaaagaaauacaggauuuuggaaagaguagaguucaggugaauuuuaaaugaugacuuaaugcaaaguagggauguaucugaaagggugaacaucaggucuccgcuguuaaaguaaacccgggaguauguuuccuuggaaacuuuuugaaguguuguguucagaaaugccuuuauuugaagcucugcaucuggacuggaaauugagucuguuucucugugucagugauuuaguccaggcaagaauaggaugauucauucuaaaugugauuucauguagcaauguuucuggcagucagugauuuuagagagagagacauuucucaguuagaaagcagaauaacucagagggggucauuauaugaaacuuuacauguacaaaguauccuugggagaaacauuguuucuuguugacuuugcauuuggauuugugucuguccuuucagcuuuaugaauggcaagacagauuuccuacuuucucagucugauucagauaugacuguauuagcuaaauuaccuaauuuuuuuucuuuuuuuuuuuuugguuugucaucugaagaguguauuggugguugagucguuaccuaggaaaccagcugauuacaaggaauuggcaccaagggaagguaggagguauucacgaagaguauaagccuaacaguuaguuuaauuguauaguuuuagcugacucacaaguaaauuucagccagguguuagacucauucuccagacugacuaaggcugcaaagggcaauaguaagaauagggacucuacagguaucaucauaaagaaguaacaagcaucugucaacaguccaaaaccuccagcuagcaaaaaguggggggaaaugugacuaagaaauaaaguacuguuguugcagguuaaaguaaaacaaccaguggcuccaguuaucuuuccaugggucuugggcagacuuuucauguaguuaucaguuugguccaacugacuuggguggaagcccucuucuuuuuguagucaucugcuucagaaggauuccuugucaccucuuuuugagguguccugcugggacagucuuccagcaauuuaagauuggcguaugucucuauguuugagagacaugaauacagggaucaacacccuauuuuacuguugcauuaguuauuaacagcaccuggcaaaauucuauuuauugaguuuagagggcaguuuuccagaagacagucucugaauuuuaauauaaagguuguuucagaggaaaugcuuccuggaccuguuugaauggaaaacuguguguacucugaguuacaguuaauaacuggaaauguaauaaacauaguaacuugagaugauggcaguauucccagauguauaggaugcccagauuuugguucauagaguuaaugagcuccaggggaacugccgucacuugucauucaggcaaaagagaaaaacaacaacaaaaaacccuuuaggcuaaggaagucucaggauuucugaaaguuuaaccaacuucaguuugagauuucuauuuguccuuuuuaucuuaccugaaggcuaagagugauaaaggcaauagagauuuugagugagagguacagaugcuccccgauuuaugaugggguuacauccuaauaaacccauuuaaguugaaaauaucauaagucaaaaaaacauuuaauauaccuaaccuaccaaacaucauaacuuagcccagccagcuuaaacacgcucagaauacuuaauguuaggguagcugacugggagcugcggcuugcugucgcuguccagcaucucaagagaguaucauaccguauaucccuagacugggaaaagaucaaaauucaaaguacaguuucuacugaaugcauaucacuuuuguaccacgagaaagucagaaaacuuguaagucaagccuuugucaguuaggaagcaucuauauugucuuacaaaucucuuuaguaacaguucuagggagguaaguguuucugucuccagagaaguaaucacagauuucccaaguaggaagcgcaaacucaagacacguuuuguuuuuuuuuaaccauugguauaguugaggcuuuucgacaagcuauauucauccuaaaaauagacuauaauuaccaaauaaaagccuauauugacagaauaacuauuuuugaaaaaaaaaaccuguaacauaucuguaaguucuucuacaugaguauuuuuuaaagcugccaauuauaacccaauucaugacaucaacucaguuuuuaaaaaaagauaugagguacugcaguaugaaacuuuuguggguuuuguuuuguuuuuaagcaauuugugaugugucugcauuuuuucuuuguauucuaucuugggcugauugagccucuuagaucuguagguuaauauuuuucaucaaauuuggaaaaugcuuggccacuauuuauucaaaauuucugccccagucucucuccucugcuucugggacuccaguuauauacguaagaacacugaauguugucuacaggucguggaggcuuuguacucccacuacacucuucuucauguauccacacguaaguuuuuuuuuuucuucacuguacuucaguuuuguuucuguugccgugacuugaagcuuauugaucuuuuuuacaguauugagucuacuguucagugaauuucauuucaggcaagcauuuuuuggaucuagacuuucagucauauauguacuauaccuguauauacacacacauccauauauauaauuucuguuuuucuacugagcuauuccaucugcucacuuacugugucuaucuuuucucuuaaauccuugaacauauuuauagcuguuuugaaauucuugucugcugauuuuaacaucugugucaccucugggucugguuuuacuaauuuguuuucaacugguuaugguuccuauuuucuagcuucuuugguugucuuuuuuauuguaucuuggacaauguaauacaauguugagcaucuggauuuuauccucuuucuuuaaagaguuaauuaccugguaugucuacuuaauccuuucaaggcuugugucagguuuuaguagaguauucagcaaggucuuuccucagguagaaagccaaauuuuuccugguacugugggauuuccagaagcucacagcgcucuguuagcuguuuucugagauaacuugcauacucuugcuuugcccuuaguauucagccaaagacuuaagaaaacuucuuugcauauuuuuggaguucauccuucauacagcuuauuuuugggacugugcccucuaccuaagcagcgcuaaauucaaauccuuguuccguucaccuguugagacuguuacuuucucugugggcuccauuuucuuguguccuaguuuggaaagugcccccaggcagaaagucaggguaaauauggcucuuaccaccauguauuuuccuucuuuuaagaaucacagacuuacggugucuguggugcauugccuccaaacaguugcuuuaguuuguacacacacaaacaugcagacauauauauguuuacauguagauagcuguuuauacagaaggguaaguccaauuucuguuauuuaaaaauggccaggugugguggcucacaccuguaaucccagcaccuugggaggcuuaggugggcagaucaccuggggucaggaacuccugaugucaggaaaccucaugagauggugaaaccccaucucuacugaaaauggaagaauuagccaggcgugguggcgggcaccuguagucccagcuacucgggaggcugaggcaagagaauagcuugaacucuggaggcggagguuauagugagcugagauugcgccacugcacuccagccugggcgacagagugugagacuccaucucaacaacaacaacaacaacaaaaaaguaauauauuauuuucacauuuuauguaaugugaaaugcagcucuagaccugcuugccaguguuucugguugucacaaaaacaaacuuuagcucaucucuguuucaaaagacuaaagagguucuuuaugaauaguaguaguucuugaauucagauguuuuuuaauuacguuaagucauuaaugucccaggacuuuuuauuuuagauuauuuuuuaaaguagauacuguauuuuauggaaugucuucuaaacuuuuauugaaaaauuuaugacauacuguuuuuguuuaaugugaugaauuaugucaguacuuuguguuugcuuuuuacaaaucuuguuuuuaggaauaaggacaacuggauccuauuugaaagcgcuuuuuaaaaauauuuuguuuccuaagauuguauuuaggaauuuugcaucucuaugaugcaaguaugaguguuuaaaaaaauuuggggggcuuuuaaucacauuagauuuuagaauuuuuaaauuuuaaauacuuuaugaggaaguaauaaacccuccuuuucuauguuuuagaauauuuuauagaaaagaaguuacucuuugaauauuuugaauaacucugaagucaguaugacuaggccaaauaaaauacauauuuagcaaaauauaucagauuccugaaugccauugugacauuuaauugaacagaagucauuuguucuuuuuagauaauuuuuagguaguuuuucuuaguucaucucugccaugaagcuguagcuuaaaccgucucaaaacagagucuacagcauagagaaaauucuuaaaguuuuuacuuagucauuuauuuuugaugaauuuuuaaaaaucucuuuuauacaaaaagaacuguuuaauuuccugauuccaaacaagaauuaaguagagauguuaggaagaucccacuuuguuauuuacuuuugguaagcauaacaaagggguacucuuguagucaaaaaauaacauauuuuuugucuucuuuccccucuucuuucucccucccccaccccauauacaaacuugucauuacauuucugagaucaacccuuugagaugcugaguuuguacauaccuguuauauauuuugcaguugacaaauuacaauuugaaccuccucugagaaaagaaacagaagcacgagaugaaaugguaagaauucauuuuuaaagcauuauuuucacauuaagauuugagaaaacuuuuuuuuuguuaguuguacuuugauuagaaaacaaaguaauauacucuuuuaagcauuaauuuugacaauuuuucccguauuaaaguuuuuaaaaguuuauaguuaguuuuauuuuuacuagaguacgauguaauacacuauuucaaucauucauuuuaaccuccuuagucuuuugaagguuuuacaugauguuauuaaauacgcagaauuugauucucagcuuuaagcucuuaggaccuuuuuuuuuuuaacugauucuguuuguuuuauaguaaauucuacauucuguauugccuuacuauuuuuuaaauauauuuuauuuguuaauauaguuucuuuuuuaaccauugcugcuauuuugaauuuacuaucuaguuaccucuuuccuuaucuaaaaugaaaaaaguggccgggcccaguggccaacuccuguaaucucaguacuaugggaggcugaggcagacagaucaccugaggucaggaguuccagaccagccuggccaacauggcagaacccugucuuuacuaaaaauacaaaaaucagccaggcgugguggcaugugccuauaaacccagcuccucaggaggcugaggcagggagaauugcuugaacccaggagguggagguugcagugagccaagaucaagcuacugcacuccauccagccugggcgacagagugugagacuccauuucaaaaauaaauaaauaaauaaaaagaaaaaaguaaugaagcaagauauuauuagaguuagccuaaccuagccuauugaguucauccuuaauguuuggaaguagugcucuucuuacuguaaauauguugcuguaugauaaaaccccaguuuccaugcuaagagggaaaaguaguagcaccaguaaauucaugacaguuuaguaauaugauauuuaguuuuccaugcuaauggagugaugauguagauaauucaguuguuuucuuuuauuguuugcuuuggaauaugcucacauacugauaaagaagguuugucacauuugaagcuaccuuuaguauguuuauggaauuucuuaaguucaggucgacugauaaugagucauugaccuaaauaugucaaaugacaaagcaaaucuagcuagagauuaaaaaauugauugaaugccaagaugauuaauaaucaugacacuggaauguuuucuugaaucaaauaaaaugguuaauaccuguuacaaaguaacauuuuaaacuauauuuuuaucuuuacagggauugucaucagacccaaauuucauguuacaguggaauccuuuuguugauggugcaaauacuggcaaguaaguuguuuucuaauuuaauaacuauauuuuauuugauuacauaagaacaguauggggcaugugauuuauucuaauaagcuuuaauuugcauucuugaaaaaguuaugccauuaaugaagguaaagcuuuugaguuuuaccaaaaagcaucauguauugaucauuaagguuuuuuauuuguuuuuguuuuuaaucagaauaugcuauguaaugauaauauacugaaaggugagucacaugaugucaugggaaaaaauacuguaacagaguuaaaaagccccaguucaucucuccaauauaguuaccucuacaauuaagugagggggcuggccuucaugaguuguuccuaaccugucuguguacugcaauugccuacagagcucuuuagaaaugcagauuccuagguucccacauuaggccuauacauuuggaguuaacaaacuauggcagcccacaaacuaagaauaguaaauacauuuuuaaugguugaaaagaaaucaaaagaauaauuauauuuuauuacacaugaaaauuacaugaaauucaaauuucagugucauaaauaaguuuguuagaauauaacuaugcuuauuaguuuauguaucguacauggcugcuuucacacuauaacagcagaguuccauaguuacaaccacuguaugccuugcaaaaccugcaguauuuacucucuggcccuucauagaaaaaguuugccaaccucugguauagaauacagucuuugggacuggaucuaagaauccugaaagccgccuaauugauugcaaugacuguggauaagugugugggaccaguggacuagauaagugcuucucaaacuuauugaccuggagagcuuauuaaaaggaagauucugugcauuuagaaaaguucccagaugaugccaauucugcugguuugaggaucuacuuugaguaacaaaagguuugaugauauacccacuugaaucuaugggucccaacucuaaaauucugaaucaguuuuuuaaccaagaaguuaacuuaguuuuuauuacauaagaaauauagcaaagcauaaccauaaaaguaaaauaagacuuuguguccacuuuuuaaaaucuuuauuuuauagacauacaauuugacaauaugagugaggucuuaggucuuccuaaagauuuuauacucugcaucgugaucugucuuuuacauccucuguauagaaacugauuuuaauacauauuuaauaguaucuguguuuucgguuacggucauuuaucaucaucuaaauugcauuucuucuuuguauuagaucaaccucaaaacgugcaauaccaccuccccuaccuccuaaggugagcuacuuaaugauuuugaacacuaaauccuuauuuaaauaauauaguuaaauuuuuaaaauaauuuugaguuuuuucaaaauuuucuuaaauguauuuuagaugaauagaguuuucuucaaaagaaguguaugaugguguaaaauauauaguaaagaagauuucaugaggaauacaauauuuuuaauagcuauuagaaaaaggcggccaggcgugguugguggcucacgcauauaaucccagcacuucgggagacaaaggcaaguggaucacuucagaucaggaguuugagaccagccuggccaaguggugaaacccucucuacuaaaaauacaaaaauuagcugggcaugguggcguaugcuuguaaucccagcuacuugggaagcugaggcaugagaaucgcuugaacccaggagguggagguugcagugagcugagaucgugccacugcacuccagccugggugacagagcgagacuccaucucaguaaaaaaagaaagaaagaaaaaggcaaaaacagguuauugcuuauugaagaaaauauuugacuacauggaggggaaacaguucaucauuuaucauucuuaugacuacaauuugacauauuaguggagucauuuuucuugauuguuucuaguuguuuuguggauuuuuauauaauuauauuaguuauaaaaauuuuaucaguuuuaaggcugauuaaaaaucacauggcaaguugauaguuguguugggcaguaacucaccucuuacuuugcucacuuagcccagugaauugaacuguauagaagaaugaaaaaaggugcauuucccuuucccuaaagacucugaugccuaaugauaacuguuaaaguacuuuuuugucuuuguaccacuagccaaggauaagcaguuacccugaagacaacuuuccggaugaagaaaaagcaucaaccauaaaacauuguccugauucagaaagcagagcuccccaaauucucagaagacagaguagcccaaguugugggccuguggcagagacuucuucuauugguauggcuagcauuauuagcagccaugggguacauauggcuagauauuguuaucugggugaauaaaucaaagugaaaacugaaaugagagucauuuguuccuauuucaaaaaauaucuuuuuuauuuagucaauccuauuauagcuuaaagcuuuguaaaggcucuuuaauucugcauggaugggcuauaaauagauuucaguucacuucaauccuaauuugaauccuuacuaaauauuuauuauaggaucuagaagggugaaugcauguuucugcccccagaacuucagggucuacagcagaagguauacccacauacacauaacauuaggaaagacaguuuauguaugugucuucugaaauaauuaccuggauguaacagaagaccagagauuucugagggagauaaagauggggaauaaggaaacuaagcucuugcaggauuuuuuuuuucuguagagaugggguuucgccguguugcccaggcuaaucucagaccccugggcucaagugauccgccugccccagccucccaaagugcuggaauuacaggcaugagugaccguaccugguccuucuugcaggauguuaaagggcuuggugagccuucaguagguagaugaaaugcacugaagcugggaaaucugaauuaugcagucuauuauaauagaaaugugagcuuuuaaaggguauauacuggaagauacaacugaaaagguggauugaaguucaauuauaaaaagccuugcauaucagagucaguaggucagauuuuuuuucuucaugauacggaaaaacauggauuaagaccacugcuaaagaugcaaugcuaccucuauagaaucuagagaaagacaccaaagauaacuuaccugagaguagagaauauuccccaauaaaggaucacccaagugaaagacaaauagugggagaaaggggaaauaauuuuucaaggaaagugcuuauuuguguggucauucaacuuuuaacaugauucucuuuaggaaauggugaugguauuucaaaacugaugagugaaaauacagaaggaucagcacaagcaccacaguuaccacgaaaaaaggacaaacgagacuucccuguagguauaacaggcauuuagcaauuaguuguaaauaauacuauauuuaucaugcaaggggcauagucuguuuaauucaguaauucaaguaacagaaguucuaaaugucucaaguuucuuuuuaagacuuaggaggucuuacacuaguaaauuuuauuuuucccauagaaaccagccaucaauggccuuccacccaccccaaaaguucugguaaggaauauuuuuaugugaacuauuugccguuuuuucucucuuuagaagcagcaauauauuggcuaucaauauacuugagccuuugaaaguuaagauaucauaaaauacaaagauauugaaugcauuuggauaucucaucauguauucuaauuugagugugugaauuggaauugacaguguuucacuuuuuguaaauacuggcaguugagucaucagauuagccuacaaaggccuauuuaauuuuaaugcgaugauauuaauaguacuguguccucuucuugauguggauuaaauaucuuucuaccucuaaagugauuuucacauuggacuauauacaauuaaaaggaaccagggaagcuuauauuaaugcauuuuccuggccagucaguggaacuuaucugugaaugggaaccccaugaucccaugaaugggaugggaaccaaucguaugaaugggaugcuuuauacauuguccuuuuuuauucagugaaagucuaauguauaauauaaauaucaaccuuuuugucucuuaugacuauuaaagaguuauacugcaauuguaaucacuauaauguuacugaauaaaauuauccauuguuucacauuaauaauugucaguccuaaaaaauaguaguaacuuaaaauuccuagacuauguuauugauguauguagaucuuuugguaaauuugauauuugugccauaaaauaguggauuacaaaaggaaagaauaugagacugucuugguaguagggguuuaaugaugugaaaauaugaauuuuguuuuggaaugaaacaacaagcauacgcaaauaagaguuaauuugguauuucaaugauguuaguuauuuuccaagaauauauaaaauuuucuaaucaaauaaguuaacauuucuuucuuuauaaauaagaugggagcaugcuuuucaaaaguuuuugauggcuguccuuugaaaauuaauugugcaacauccuggauacauccugauacaaaagguaaaauguuugaauuuuauauacaucuccaauaaaauauuuauuaugggaaagaucuuuaugaucagugacuugaaguuguuuauuuuaaaaauacgacuuuagagaccuaaugguauaggaaccugcaacaaccuaaauaggucaauaggguuuugguuuaaaggcguuaaaauuuaggaguguauaggagcuauucuugauuaaaggacuaaagagaaaucacaacugauugcauccuuaauuuagaauuuucuuuuaccguaaaaggacguuauugggacaauuuauaaucucaauuaguaagaauuauagauaaccuuguuuauuguuuaaguauuaaugucuugugguuauaugacuuuuuuuccuuaauguacacaaauauuucaaaguaaagaggcaucaugcucauaaguuaucuuaaacagcucagaaaacaaacauuuacauaaggaagagagaaggaucaagcagaaguaguaaauguucaacauuuguggaauuuguguuacagguauuuaggaauuauuuguacuauuacaacuuuucuguacaucugaaaugauguuaaaauaacuuuuuuaaaauguagacuauguuucugaagugaggaaacauuuucagaggcaaaaauuuggaaucaaauaaaucuggguuuggauucccacucugucauuaccaugugacuuugaaaacaaacauaacaccucugcuuuucagugugauuguuugaaacaugaaucacucccgauauuuacuuuauuucaaggaaggaacaagccuaccccagugucuagcaauuagcaaacagaagcuauuaggcaguagaggauuucaggaaauguguguuucuacuuaauaauaaagacagguuauaaugauuggcuuuaaaugccacuauuaaaaaguaugacagaggggguauauauauguguguguguguguguguguguguguguguguguguguguguguguguguguguauaaaauaauuuuuuuuuagagacagagucuuguucuguugcccaggcuggacuucaguagugcagucauaguucagugcagcucaaacuccugggcuugggcaauccucgugccucagccucccaaauagcugugaccacagguguguaucaccucucccagcugauuuuuuauuauuuagucucuuuuaguguaaaacaauuccucaacuucugaugucaacuuuuuugaggccacuuauuuuguagaaugucccuuaauugggguuuguauaaugaguccucaugcuugaaucagguuaugcauuuuugaugggaauaacacagaaauguuacugugcaucuucucaguacaucauaucaggagauacaugguaucagcuuguccaaauacuagugauguuaauaucgaucuguugguuaaagcaguguucacuagccuucuccauucucagguuacuauuuuuuccuuucugauuuauagguaauuaauauggagaugcacugagauuauguuuauaauuauacuauugccauucagaauuucacucacucaguuuagcauccauugacaaucuguugauagccauugacaguuuaucuucuuucccacuuauucauucguuuauuuauaucaguuuaaacuuauuaauucuuauuuuauuccaugcgauaugaucuaucucuauuauuuauuuucacacuuaaauugucccagaauuuuugagcagugggaaugccuguguucuuuuguuugaaauguccucaucauuuuuuagcacuucuuuacuuucuggcacagcaagauuucuaggcucagcaucuacuuuuauugccccagaauuggaagcagucuuucucuaagaagcccugguucuuuuuaguggaaaguaauauuuagaaaccaagaucuggauacuaggugugcucauuauuucuagugugucgugauuuauaauuuauauuaacuuuuuguuuccuuggucaaaagaguguuugaggugucuugcaaaaauguguaacuauaaaaaucuuaaaauacaaaaauuauguugaaaggcaggguuauauaguaagauaaagucagagugaguuagucuaacauagaauauaucugcuuuuaaaaaauaagaaaggaauuggggaaagagguaaagaaggugauacaaauuuaagaaaauaauuuuauuuuagauggauagguggcuaauucuugaugccauuacaauguaaagucauuauuuuagugaaugauuucagaagaugaugguaaauucuggugauuuaucucaacuauuuuagaucaguacauuauuuuuggaacugaagaugguauuuacacacugaaucucaaugagcuacaugaggcaacgauggaacagguaauuaggcauuuuaauucaagaaauuaauuuaaacaaauugaauaaagaagugucuuaauuuuaaaucaaucuguguaggccccaauuuuaauuuuuaugauuuaaauauuuaaagggauaaaauuguacucuuugcauguucauguugaaagauuuuuuuucuuaaggguuugauaauuaccugaaaguuagaaaauaguuauuuuuauaugauuucagaauguuggaauuuaaaagauuaaaauaaugacaaugagagaaucuuaauuaucuucuuuuucuuaguuauuuccacggaaguguacuuggcuguauguuaucaauaauacuuuaaugucauuaucagguauguaugugaugaugaaaaauaaaccauagauaagcagagaaauguaauuuuaauauacaccauuuuuaaauguuauuuguaauucuggaugacuauaaucuaauauaguaacucugggacuuguggauauuugcuacccaccuagaaugggaagaaacuuugggaagggauccugucuucaguuagggcugcacuuuccaaacccacccagcaucuaaacaccugaaggguaucacagugcuuaucacuagaggccguucccuuccacucagccuccuccacuaucacugucaccacuccuggccuccuuugggaauuaacaggaaagaagcagaggaucacacuauuuucuuucucugcgauccugaacaagucacugucucucagccucauuuaucuuaauuauaaaaugaggaugaugggguaacaguacagccuuaugagguugugagaguuaaaugagauaauauccagagugcuuaguaaacuguagagucuuauacagauguuugcuggugaaauucauguuguucuggacacacauuaacuaucuuggacugauucuuuaaggucuucugaacaagauuccaggguaaccucauuuuauucuuucuugguuauuauuaggggugaacggguggguaggugguguuuuaggcuuuuuuuuuuuuuuuuuaauucuuaccuaugaaaaaaauauuuucuuauauuuuagauuuaaaugacuaccaagaaguuugcugauugcuuucauuuugguaguagaguacaagauaguuaauuauuauuucucucuaguagagauuuuuuaagaaucuguauauuugagcuaauaacacuguuuauggagagcauauuauuugauuguguguuaaauggcuucuaaaaagcuggaguccucaaaagaauauuuaauauauuuuaauuaugcuuccccaaaaucuuuuuuacuuuuguuugguaaaauauuaauauguuaauauuuuauauuacuguuaugaaaauaaagccaauucuguuugaguugacaauuaugaauuguaucauauaaacuuuucucuaacucucuuacugcuuaucccuacucauacuugucuuuggaaauaagcuuaaaaauuacacaggguacaucuuagauagcaacgcccaauaggaggcauguacauguguguuuagcugccuggcuagcuggguagcaaacuauguagauuggggaaauggagaaaggaaggguguuuaauguuuaggcagaauauuucuguucugagaacauacagauaauuuuguugaggauaaaacuguguauauguguguguauauauguauguuuucuaauaauaaaaagauaaauauuguuuuguauuguuauauuaucauaccauauauagugagaaaucagaugauguuuaccauauccaucccucuuacuuaauacagccauauuuuuuauuauauggaauuguagcccuguuauccuuguaucauggcuuauaauauugguugguuuuacuuuuuuaaguauuuccaucuguuauauuuaagacuucauucacaaugauuuuuaauccaagguaauuuguuaaguuauugauaaauaggucugucccagagaaauaauaauauagcuuuauagaauuuuccaucuuguauuaaaauaaucacauguacaucauuguaacucaguccauaacauaagauuuuguacaacaauuucuuuuugugugcuggcaucauuaagguuuagucugcccagaucaccuauuaguaccuaauuuauauauucugaauuaaaauuaucuguuaauuuaaaaacauuuuaucuauugucuuucaaaauaguauuaacugaggguuuuuuuguguguguuuuucuauuuugcuuggcuuuuugaacauuacuggacucucguuuuagaagguaauuacguuuucuuuuucucgaaaauuguauuucucugcuguaaaugauucucaaaaagguaacauguuuuucuuuuauaggaaaaaccuuucagcucuacucucacaaucuuauagcuuuguuugaacaugccaaaaaaccaggauuagcugcccauauucaaacucacagguuuccagaccgaauacuaccaagguacaaaauaucauuuugauucuacugaaugaggggaauuaguguuuauuuuaaaaauagcccguauuucuugcccaguaaaaaacuaugucuuaauuuucaaagguaguuuaaacuaaaguguauuauaucuggaaaagcugaacguuuucugaacuugaccaugagaaucaacuguggaaguuuuauaauacagacugucaggcccuuccucaguccuauaagaugagauaguguggaguuaggauccaagacaguuuuuuaagcuccuuucugucugauucugaugcaacugauuuacaaaucauuguguuguaaccacuacuguagagugcauuuauaucgucuuacguuuucagaaaauucgcuuuaacaacaaagauuccugauacaaaaggcugccacaaauguugcauaggugaguaaaugguauuucucaaacugaaugguuagaacuuuuaacaucuuuauaauuaucugaagagucguauggaaucaaauaggaaggaggguagguuuuuaaaauuuguguuuaguaagaaguuaagcugccauugaaguacaagaauauagacagacauggcauagaaaugcuuagagauaauaaccuuagcguuuucucagagcauaguguuccuagaguuuuuuaaccauagucccugaggcuguaucuuugcuaauauucuaacuuucauuuauuuaauauuugccaucuaccaguuaccacccauguuuuaugaacauguuuacaggaguugagccaacuaugcaguuagagggaacaguucacacaagaacacccucacuuaugauaccaauugcaaguuaggggauucccaaaacuacccccagaauaaaaaaauucacuagaagguaucacggaacuggaagcaguuauacucauaguuacgauuacaauuuagaacagggaaaaaauauagauuuaaaucauuaccguuuagaacagggaaagaauauagauuaaaaucauuaccguuuagaacagggacagaauauagauuaaaaucagccaagggaagaaguacauagggcagaguccaggaaaaauaccaaacauggagcuucuguuguccucucccuaugguuaauggauggcguuacuuuuccagcauugguauguggcagaacacacaaccauugccaaccacugccaaccacaagcuuauucgagccucgauguccagaguuuuuauuggggcuucaucacaaaggcaugauugauugaccaccuugcugaucucaguaugcagccccacuaaaggucaucugauguuacaugacccaaagcccccacccaaaaucacauuuuuuguauuucuggcaugauugauugaccaccuugcugaucucaguaugcagccccacuaaaggucaucugauguuacaugacccaaagcccccacccaaaaucacauuuuuuguauuucuggcaugaccagcccucacauuaagacuaucuagugcagccaguccccacccugaaucauuauuguuauauuauccagugaccagagucccccagacaaagacaguccugucaagcaugacauuccaaaggcuuagcaauuaccucccagaagcaggacagagaccagaccucuuuuuugggugagguuaaguucuuuacuacauaauuaucucauuuaacccuuaaacaacuccauaauacugauugugucacuaguaaguaacagagcuuaggaaucagauucagguucaaugacuucagaucuuaaguuccuaacuuccuauuuauucuuuuguuugaucaaugaauuuacacauugaucuuugugccacauaauaguuucacagcauaguccauacuguaaaacaaaaauguuuaaccacaaaugugcuauaaauauuauuuuucuagggagaaucaugucaauaucuauuaucagauucccaagaucugugaugcacaaaaggccuagaaacuuggaaucuaagauaaaaacucauaaauaauacuuuagaguuuaaugcaaauaacuauucuuauaaucaaugauuauaauuauuaauggaaaucaaauuugggagaaggaaagagcaauaugaauuuuuauagauuugagucaagauuacaucaugauaaauuaauacauacaagaugaauuauuuucaucuuaaguagacaucuguacacugcuauaccaaaacgaggugcauuuuaguugccuccuagaccuugucagaacucauucuuugaguuuacuaagaaacaacuuuuuggggaggccaagaugggaagaucgguugaguccaggaguucaagaccagccugggaaacauagugagaccccaucucuuaaaaaaaaaaaaaauugaaaaauuagcugggcaugguggcauacaccuauagucucugcuacucaggaggcugaugugggaggauugcuugagccugggagauugaggcugcaguuagcuauuacugugccacugcauucuagccugaaugacagagcaagacccugucucuuuaaaaagaaagaaggaggacgggagggagugaggaagggaaaaaaacaccuuuuuagguugcauguuagguuguuauugugcuugucaaaaguucuuauguuuaacaaccuaguauaugcaaguuguuuagaaguaaacauauauaauuuaaaauugagauaagaaaguaaaacggaaaaggcaaugaagccaaaagaaaagacacagucuuuuuuuauuuucugcccacucuugucauccugguuaacagauacaaugaaaguauucaguauuuugagugugucuggguuuuuuguuuguuuauuucuuuccagucagaaacccuuacacgggacauaaauaccucuguggagcuuuacagucuggaauuguuuuacuucagugguaugagccaaugcagaaauucauguugauaaagguauauauuauuuuguucacauuuuuuuccuuuagaaaacacuaguguauaacugaagcuaaaauuagcagaucccaauacuacuaucuagggucagaacauuuauaguuauuuguaguuguuuauuugauuuagagguuuuuguguucuuaggauuuacucuuuaacugauaauaaacuuccagaaccaucagucauaaagauuaauauggcuaauuaucuaaaacacauuuuuauagaacauucauccuucuuaucaucuuagagguaauccuuuuuagaacuagauaaaugaagaagauaggagucuuucuguugacuuuauucaacagugguaugaauggggagauuguuucugaauuauggcucuauuguuuauuuuuuuugcagcacuuugauuuuccuuugccaaguccuuugaauguuuuugaaaugcuggugauaccugaacaggaauacccuauggucuguguagcuauuagcaaaggcacugaaucgaaucagguaguucaguuugagacaaucaauuugaacucugcaucuucaugguuuacagaaauuggugcagguaaguauuuuuuaccuuauguuagaauauugauauuuuugccuauaaaagaagcaaaacaccaccuauaaaagaagcaaaacaccagugugggcucuuuuaaauauucaaaacauaguuucccaaguaagcccauagaaccguguacguauauuuaugaucucuauuugccagagguaguuugauacaaauuauuuaaacaaaggaaauuuuuaaugauuccugacagugaaaagucuuaguucuuaccagugaaucuuuggacuugcuaaguaaauacacuuucuaagcaguucuuaaaauuuuaucaacuucucaagccucaagcaaagagcuucacuuauccuguuuuauccugucuuccccgcucacuucuuagaaucagugaauguggcuuucagaccugaauagaagcuucuuagguguugcuuccgagccuuuccauuuaaaucagacauaucucagugaaagaucugaaaaaaaugggaaguuuauuccuagacuuuaaaauuagaacaaaucauucaauaaaucauuuuuuaaaucugcauaauaugugaagugggugagguggggccuccauuuugcuaguuuccuguuuguugugcugguguauuuggucauuuauaauccagguuuauuaggccauuuuuacauaugccaagcaagcuuuaguuauggcuauuucauuacucaccacuguuguauucuuuacugccuuuugaagaagucuguuacauauauuauaaguuugaugcuuaaugcuucuuauuaaauaaccuuuggcuuuugaucauuuauaggcuaaguuacaagaacucauuauaauauagaaccuacgcuaaauucacuuucaacauaagaaucaguaugaaccagugauacccugguaaaugucuaacaacaggcucuugaggugcaaccauuuguuagaguugccuauuuuugugguacaaauacuccacccauggccaauuucaaacuaccaaccugaugucauuuggcuuacaaaauuccugaaaguuuaacucaguacaagccagcuccagcaugcacuggucuauaaaacauacucuuuauggaagaggucacauuauguacccuucuaccuccaccugcacucugccuuuuaagucuauugaucaaugcuuuaaguugaguuggauguaugccugcuguuacagcuaacagaaaagguacaaaugcauugcuuuauuaucgugagauauaaacugcccaaauagaaauauuuccccaggcugggcacaguggcucacaccuauaaucccagcacuuugggaggccaaaguggguggaucaccugaggucaggaguucgagaccggccugaccaacaugguaaaaccccaucuguacuaaaaauacaaacuuagccgggcgugguggugcaugucuguaaucccagcuacuagggaggcugaggcaggagaaucgcaugaaccuggaaggcagagguugcagugagccaagaucgcaccauugcacuccagccugggcaacaagaacgaaacucugucucaaaaaaaaagaaagaaagaaauauuucccuguucuuauugcucaaaggaaagguuauggaucaguuuauuuaaagacaaguuuuggcugacagcccaacuuuuuuuuuuugcucaucagcaugguauaaagcaugucauuuaauacaacuauuuaauguauauuugcgaccacuuucuucuggauuauauauuagaagguuauauuguucaaggcaagaguucagugaguccuguuuuugaguuccuuuugggguauguuugaguuugcguuuuuuuguuuuuuuuuuuuuuuuuuuugagaguuuuguuguuugcuuuguuuuuuaaugcgugagguaugcuauucuaccuacuuuuaacauugucuuggcuaaaauuaaagcagacccccaacuacugucugaccuggggucaaggcuguuuaaagacccagauuacuuccugagggaguaaagacccaaauuacugccugaggguaaucauugaggucaccuucaggcagaggugaggcaaucuuucuaguccagcacuuuguccucauuagguuuccccauuuuuacaagugauuuguuaauccaacuccuagcuguguucauuguugaacaaacaggcuauaccuugaacuggcaaguuauaacauuaaaauaaacuccuauucaagacucuuuuaggcucagucugauuuauuauugcuauauccuuaucuccaaggauggugcuuagcauauggucagcacucaguaaauaucuguugaaugagugccugaacauagaguagcuaagaaaaacuauuuuugaaguguuaccugagggacaguuuaucgauucuguagauauggauucuucaccauguauaagcuuuagaagguccacaaacaccccaaaauauuauauaaaauucuguguuuauguuugaaugugcaguuuucaagggagacaaugcauaggcuucccaaagagguauaguuaagaaggacugcucuguuggugggacuguaaacuaguucaaccauuguggaagucaguguggcgauuccucagggaucuagaacuacaaauaccauuugacccagccaucccauuacuggguauauacccaaaggacuauaaaucaugcugcuauaaagacacaugcacauguauguuuauugcagcauuauucacaauagcaaagacuuggaaccaacccaaauguccaacaacgauagacuggauuaagaaaauguggcacauauacaccauggaauacugugcagccauaaaaaaugaugaguucauauccuuuguagggacauggaugaaauuggaaaucaucauucucaguaaacuaucgcaagaacaaaaaaccaaacaccacauauucucacucauaggugggaauugaacaaugagaacacauggacacaggaaggggaacaucacacucuggggacuguuguggggugggggaaggggagagggauagcauugggagauauaccuaaugcuagaugacgaguuagugggugcagcgcaccagauggcacauguauacauauguaacuaaccugcacauugugcacauguacccuaaaacuuaaaguauaauaauaauaaauaaauaaauaaaaaagauaaaacccauagaaaaauaagcaaaguacuuaaaaacaguauguuuguguugaaucucauuuauaaacaugaaaguaugugaaagaaaacuuguauaaaucagugcaaugaaauauuuacccaaagaacauuuuaaguuauauugauuuccacuauuuccuaauuaggugaaaguuaccgccuucaauugcauguuugcccguggccuuggggaaacauguacuuuuuacaaggaaaugggggaagcaggcucugacucuuaggcuucuaaguaggaauucuguucaaggaauaagaagagaaaggaauauguuauuaugaaugcccucacuccggcaaacagcucugcucuuuaccacccacuuucaguuucccucacacagucaugaaugaugcuaucaaaauuuuuaccaggcccuaauucuacuuuuccuaauuuuggucacagcuugccuggauuuaggacauaaagagcuuagaaacucuuaauuuuaauauuagaaauguagcucaguccuauaucagaaaguuuauaaaacccuuuuagauaauaaugaucaguuauaauuuauuuucauagaaaaacauauucuaagaugcucuauacaauuguuuuuacacugaauuguuuuacugaauggugccuguauugaaggcacuaucagaaagggcacauugaaguugagguaacuucaaaagguagugaauaccugcuauuuggcaauccucuuuucugccugcccccaauccgccauuugaaggaaaagucauacaaugaaugcgucuguguuaggaaaaguacuuuuaagaauguggcccugucucagugcccuaagcuugugaccucagugucucuagagaguucuguauuagaaaucacaguggccaauuagcaauuuuucuuuaaaauuaguggucaccaaguucuuuguaaauauacagcuaaaugaauguaguugggcauguuuaacucuuaaaaguucuaagagaaugaaagguaaccuagaugacauuuuguaaucagaaagaaguacuucuaauggagcaacucagguuaaggacucuucuguauuugucuuaguauauauguguucauauauauauaugugugugugugaauauguucagaaguaugaaaugucuguguaguacauuuauuaucacuauauuccuuaaaucagguugauuggugauguuuuuaaaauucuucaauaaaagcacauacauuuaaaaaaaaaaggacugcucuaaauaaucuaaaaucuuuucuuagauucagcuagaccauugaaacaaucugagugcuuaaaaugcauuguuuuaucaaaaaaauuuuuaauguuauuacaucuaucagcagauguuagaagcagcccuuuaaauaucagcaaaacgaugagaguuguauccugcaaagauguucuugacaauauuguucauuauguuacucaguguccucuuuguaaaagaacucccacccaccuguaaacacauaccuauaccaggaaaauuucugucuuacuauagauuucauugauccugugcccuuuugaaucacuggcuaauuuuuaauuuagguuugcugugauucacccaauucaucuuguuucuaucucccauuggcuauauaaaaugcagagcaaaaucgagccauuguguauagcaugcauguuacuuuuccuccucauauuuuaccuuugcuucauuuuauuuuugugauucaccuuuguagaucuagcugaggcuuuaauuaaaggcaauacugagguuuuuuucagcugaguuagccaugcuuaggacauauuuguccucuuaaauugauuuacaugcauuuuuugaaagauaacaucacaaaauauaaauucuguguuaaauuucaaagaucaauuuuaagucacagcaaaagucagaauuuauguuuauuuucuaggcucuagguuuuaaaaguauaauuguaaccuuguuuuuuacuuccuaaggcagccagcaguuagauuccauucauguaacacaguuggagagagauaccguuuuaguguguuuagacaguaaguacuauuuuuaauuuuauuuugaguauacuacuugauaaagcaauuuuuuuauucuguuaaaccauaauucaagauuuuuacuguuuuuacuaaaaauguuacuuaucauguguaauuuguaagcgaaaaaaaucaccucuuauggcuaaauaguugagcaccgagguagccauuuuuaaagaagcauacauuuuuaaaaaugagaguguaaauauucaguauauacuauauaaaaaauaauagcagaauugccauuugccgauggaggcacucuuacaguauuuuuugccauuuggcauaccugacucaagauaaauaguugaacuuuauuaagaauauuauuugauauccauguaaaauccacauauaucaaguuacauuuauuuuagcagauuugcauguccagucuugacuuguuuuuuuuuuuuaagaauuugugaaaauuguaaaucuacaaggaaaauuaaaaucaaguaagaaacuggccucugaguuaaguuuugauuuucgcauugaaucuguagguaaguuuccuuuuuuucauaaaucaguuugcgauacuuaaugauuauuaaaauucauucuguacuuaggguugucuagaccagcacugucucacagaaauuucuguaaagauagaaauguucuacgccuguaaucccagcacuuugggaggccaaggugggcagaucacaaggucaggaguucaagaccagccuggccaacauggagagaaaccccgucucuacuaaaaauacuaaaauuagcugggcaugcuggcgggugccuguaaucccaacuacuugggaggcugaggcaggagaaucgcuugaacccgcgaggcggagguugcagugagcugagaucaugccauugcauuccagccugggcaacaagagcaagaaaaaaaaaaaagauagaaauguucucuaucugugcucuuaaauacaguagugauuaaacauauauggcuguuaagcaccugaaacaugauuagugcuacauuuucauuuuuuagauuuuaauucaaauuuuaauguaaauaacaacauguggcuucuugcucucauauugcacagugcagguucagaccaucauaaaucuuuuauuguuuccugaauauuuaaaacuuguaaucacuuuuaacauuucuguucauuauucccuuugcugcauuaagugaauuauacuucccccaauucuuucccagucaggaagguauuugugugaugcgauaacaguguuagauaugccauaauucuuugccauguaagauucugggugguguguguugauauuacugcuuuuggaacuauuuuuauauaaauagcuaguucucacaggacuuguaaacuuuuaugccauuuaauuugcuuccuugucaacgaauguuuuacucucuaauacucauugguuuuaugaugaaaauuauuacaguuuauuauuguuugcaugcucauugaucauaugucaguaucuuccccaggagugacagaacuugugaaaaaaaugaugaauggaaacauuuuuaaacauuucaugauaugauucuaccauaaaucaaaggcacuaaaaugaaguugguaauuuuuauuugggccauaaaaaauaacauguacuuuauaauuacauauuuuuaaaaacacgauuuucauuacuuaguuuuuuauuuuuaagaaacauuuuaauauguauuucucaauuggaguuuuauccacaaaauguuugugccucugugugacauuuuacaugaaaauaguuugcuuaugauugggaaauuuaauuuauuaaagcagaaaaccuaaacuuucuguaaaugucaggacaaaagaaauuuuggaaacuaguuucuucuuuuacuccuuauauuacaugccaauuuggauuuaacauuuuugagagagauucugacauaggaauccuuaauuccucuucacuuucauugaaacacacugauaccucaacuuuuucagaugugccaaauuaucuucguaauuuuaauuguuacacaaaaguuuguuccuccuaggcuaccaucuuuucuugccaguaaaccuuggaauaauuacaggaauccuccuggggaaaaaaaaaugccuuuacaacaccucuuaaaaauaaaaucaguaacuagguuuuuuauuugucacaguuagugaaacacaugugauuugucauugucaaauacuuuuauuuuuauugagcuuaauuauguucccagaacauucuuacauuaacuuuuuacaaaaaguuaauagucuaauaaaacaguuaauuuucaguuacuuuccuccaucacuuuuaauuaugcuuuucuaacucuaauacuuacuuguaaugguuaaauacuaagaauuuuauguaagaauugacucacagauccuaaauauucaaugugugguuaaauguuggauuguggggcagguuuauuuuauuuuauuuuuuauuuauuuauuuuguuugagacggagucucgcucugucgcccaagcuggagugaagugacgugaucucggcucacugcagccuccaccugugggguucaagcaauucucccguuucagcguccugaguagcuggggcuacaggcacaggccaccacaccuggcuaauuuuuguauuuuuguagagacaggguuucaccauacuggucaggcuggucuccaucuccugaccucaggugauccacccaccucggccucccaaagugcugagguuacagggaugagccacugcgcccggccagguuuauuuuuuaaaauuucuuuuguuacagggaaaauaugaacauaaaaaaugcuuguuuaaagcuacuucugaauauguaacaguauuuaaacaacaaugcuuuuaaugcaaaaacccaguuauauauguuuuuaugauuuuauucauuuaagacaaaagauacacuguaucuuuuguaugaaagaaaugaauaugccaacauccaccuuaucagaaguuaguucauguuuaaaugaauggcuuuuauauguaucuuugaagacuugcauaacccuaccucaguaaauuacuugaacuuaggcaugucuuagccacaaaaauguugagaaaucguggucuagacaguggaauuuugcacuagacacuugaauaggcuuauauuauuuauuaaaaguagagaaaauuuauagugaaaugcucugugcuuuauauuaguuucacuucucccuuaucauuuuuaguaugccuucaagacaguguguuggcuuucuggaaacaugggaugcaggguaaaagcuucaagucagaugagguaagccuucucagauuaccuccacugacucccacuaacaauuuuaaaugucgaagcacucguuuuaugcauuuccucucugaaccuacauuacuguguuuagugcuuuuaauacuaugaacugguagaacaaaaaagccaguauuuucccuucaacuauguucacuucuguaucauaguucaaaauucucaguggccaccaggaauugcaaaauauaaguucaugcaauuucauuuaucuaauuuguaauuuguaaauaugguugcuaagcuuguaaaacuuuucuaaauuuauuaaguguuuuccauaaucuauaaauaucuggcuucuuuuuaaauauauuuuaaaaucuaaauuaauacauaauggagcauaagaauaagggaaucuaagaaaauugacucauuuaguaacuauugaguaccaacuauguucaagacacuauuauuguaaauaauaucaaacuuuaaauaauaccuacuguguuccaggcacuuuacaaauauuugcuuauuucaggcucaaaauaauccaguagaaguagauacuauucauauugccauuuuuacagcuacagagugguuaaguaacuugcccagaguuacauaacuagugaaguggaagagucuggauuugaagggucucuuuaaaucacuucuagcugagauaauuacgucucaugcaggagaugggauuugggccuccaauuugaggaaugaguccuacuagcuaagauaauacuaacagagacauuucacauuuacgugaauacuugugugauucuucuaacuauggccuaacaaguuugugaacuuacuuaaagcucaaaaacuucuucuguuugcauuuaccuuuaguuuuauccacacucuuacuuauauauaaaugaauauuccuaccucuuauaugaaugcagaauuagaaugcuuccaggaggaaaugacauaaaucagcugucuuugaauauauaaguuuaucuaguuacugauacgugucacuaaaugucaccaagucccugcacuugaugaaaccuacaguccuacuuauuaucauaugguuaauuauucuuaaaugcuauuuucauuaugucacuccuaugguuagaaaucuacagaagguccuuguuucuuacuguaucaaauauugauuccauuuccgaaauaucuauuuuuaacucuuuuuuuuuuuuuuuuuuugagauggagucucacacugucgcccaggcuggagugcagcggcacaaucucagcucacugcaaccuccaccuccuggguucaagcgauucuccugccucggccuccugaguagcugggauuacaggcaugcaccaacacacccagcuaauuuuuguauuuuuaguagagaugggauuucaccguguuggccaggcuggucucgaacuucugaccucacgugauccaccugccuuggccucccaaagugccgggauuacagaugugagccccacacccggccuauuuuuaauucgucuugauuaccuuuuuuucaguuuauguucucauccuucaacuugggccuagcuaaagucuugaccucuuucauaaaguaauacucagucauuccaggcacaaugauuagaacaucucugaacuuaauacucugaaaaaucagcuccaacuaguauaacaccuaauuuauuuucugauucaagcuuauuaauucuauuuucccagguagacugcaaacuccuugauaccagacuuuuuuuuuuuuuuaacuuacuuuauaucuacaauaucuuaguguggguuccucuaaaaguagacccuaagacaaggacucaaauacagauaguguauuugggaauagauuccagaagacaagugauggaaugaggaauggagaauaaagaggggcaaaaagccaauaaagaacacauuaauaagcuaguucccacuaagagcaacuggggcuuaauccaguagggaccacugaggaaugggguaaaauacaccucagaauugacucauuuguagaugacgaggcuugagcauuuaugcagcaacugcuaucccauguugguuaaggccugcccccagguauacaaacugcgggcacuuuggcauaguaccugcacauggcugagcacccucugcagcuuuguagaaaacagaguauacagggucuugcucuguugcccaagcuggaaugcaguggugcaaucauaguucacuguauccuugaacuccugggcucaagcgauccuccuacuucagccuucugagcagcuaggacuacaggcaugcaccacugugcccagguaaaauuuuuaaauacuucuguagauacagggucucacuuuguugcccaggcuggucucaacuccugaccucaagccuuggcccccaaaggagcucugcaguccaacaaaccuguauucaagucuugagucuacccauucuaugagauugaacaacuuauuuaaccucuuggagucuuaguuucuucuucaaugauaugagaauuauaaugcauaucacaaagaguucuucuaaguagaguaccugacccauacuagauguuccauaaauguggguucauuucuaauaauaugcaaucaaaaaacuuacuaaaauuucuuuuauuugaggaauuaagucuaccaaaaaauauuuauuguguuaauaauugcucuaaauuaauuuuaaauuguuauuaaggcaauauggggaguaagauguuacugauagguauuuuucuuuccuagguuacccaggagauuucagaugaaacaagaguuuuccgcuuauuaggaucagacagguaauaguuugguuguauuaauuuaauuaccaaaggaguucaaagaucauacucuuaauuauacugucagucuguaauuguuucaaacaaaacucuuagaagcucauugacuuagauacauuucucugugucuuuacugagagaauuaguaauauuuuaauaaguuaacuaagcaaccuuuugucagugugaggauuguuauucuagagacaguuauauucaacugagacaaaauguguugauauagauguugaugucccuaguacuaugagagcuauuucgggcccguuugucuucauuucuucauggugugcugccuuccauuaacuauuaggaauauguaccucuugaugauauuugcuuuuauauuagaaaaugccugguucaguuucuaaaguuaaucuaaguuaaaaagaauuauauggucucuuuuuaccccaaauaaaagacaaguugcaaaacugucaucuuaugaaaaaaauguaguagcuguagcuuuugauuuccaaaaucuacugccuacuucuuuuuuucuuuuuuuuuuuaagacggucucacucugucgcucaacugucuacuucuauagcuaauaaaauacccauuccuuccucuuuucccaccaaaaguuguuacuaaagcaaaauuggcuauagugguaugcauuaguccugagacaaggauugggaaccucuggucuucagguucacauugcuuaaguuuuagauacuugaggaaggagggggaaauggaguuauaacuccauaaaaauuuugaagagaguuuuauaggagaacaggaauuuucaaaaagugaugacuaccuuagugaauagaaaagguaagcccacaaagcauggcaacuuaguaagucguccaaccaacaaaaagagaauuugaggaucaucugguaaaugacucuagaacuaaaaugagaggcucuuugcuucuccaggaagggcugagaaaagaacugugggccgggcacaguggcugaugccuguaauuccagcacuuugggaggccgaggcaggugaaucagcugucucuacuaaaaauagaaaaaguagccagguaugguggcgugucccuguaaucccagcuacucggaagguugaagcaggagaauugcuugaacccaggaggcggagguugcagugagccaagaucgcaccacugcacuucagccugggcgacagagcaagacucugucuaaaaaaaaaaaaaaaagaauuguggaucauccauugauccugguguagauaauccuuuaaugaaaccaagugugagagaauucagcuugguagaggguuggcaucagaggccguuucucuggguugcuuguuuccuucuaccuacucugcucagagcuuugugcaucacuuuucccuucccuguucguauucucuguccacucuaucacuauuugcucugaaaaacuacuuccuucagacuguugccuugcucugcuugucucuuacaugggcaucuccuuguuuuuaagauacauaucuaaacagaguuuuuguuuuaucuuuacaagugguuaaaaauuuauuuuguugccgggcgcggugacucaugccuguaaucccagaacuucaggaggccgacgcagguggaucaccugaggccaggaguucgaaaccagccugaccaacaugcagaaacccugucccugcuaaaaauacaaaaaaaauaagcugggcuugauggugcaugccuuuaaucccagcuacucgggaggcugaggcaggagaaucacuugaacccagguugcggagguugcagugugccgagaucacgccauugcacuccagccugggcgacaagagcaaaacuccaucuaaaaaaauaaaaauaaaaauaaaaaaauuauuuuguugcuuaaguauagauacuugugucuaggaaaaaaaaacuaagcaugucaaaauuuuaauaacaguuaacucugggcaguuggauuauaaguaauuauauuuuccuuuucuacuuuucuguaaugccuaauauaaaguaucuaugauuuuuaaaaaauguuuucauuauuaaaguaauaacaugcuaauuauagaaaauucauacacuagaaaaauaaguguuaugugcaguuuuuuuucucccauuccuccucuagaaacuuuuuucucugcauggguauauuauuuuuuauuuuguucucaaacucucuuccccacaacuaaaauguuuggaauaguacuucuuuuuuuuuuuccuaucaguccuuugauugaacucuuucuccauuuuuguuccagcaacuagggagaggggccccauuucauacuauuuuuaaaaagcuauuucaaauaccuugaagaacaguuuggacgagugucucuuagaguccuauuuuauucucuuggcucuuccuccauccucuuccuguuagugaaaucccuaaaguauuauauuauaccuuuuguuggcauaaaugaguaagcaaauuuuguuuguuguuuuuuauuugagaaggggucucacucucucacccaggcugaagugcaguggcacaaucacaguuuccugcauccucaaacucccgggcucaagggauccuccugccucagcguccugaguagcugggacuacaggugcaggcuuccacacccagcuaauuauuauuuuuuuuuguagaguuggggucuugccaucuugcucaggcuggucucaaacuccugggcucaagcgaucccccugccucagacucccaaaguucugggauuacaggugugagccaccacaccuagcccagauuuuuuaguuggaauaagauaaugagucuaucccaaaaugucuucaauauuuuauauucaucaauucuuauuguguuuuaaagcuguaaaauguaaagcugaauuugauugugcgucugugauccuuacguaaucuuacugaaaugugaacaaugauauucuuuccuaguuugauguuaguauuugauguaugaaaucuguaguuacucuuaagcccuuuguuuugguuuaauuacaggguugucguuuuggaaaguaggccaacagaaaauccuacugcacacagcaaucucuacaucuuggcuggacaugaaaauaguuacuaagcaacagaaacugaucucaaaugacaggaaaaugaauauacuccauugaaaggaaaaauaaggaaauucaauacaaacugcacuaugauuugcuuuaacuauuauggguuauauugcaaaugaucuguacuuuaggguagaauucaauauuuucugcagcuggaaacagcuagucuaucucuugccacuguguggugguuauaucaaguuugcuuaauaaaagcuaugagacaaauaguccucuaguuccaggaaacacagucuuuuuuuaaaaaaaacaauguuuguaacaagggugccaugguauuuuuagauaacucgugauuaucuuaagagagguaaauuuagugaucauuuuauaucaugucuuauuccuucuuaaugaacauaauuuguuaaauucucaagcaagguuuucacuuuuauauuggccauucuguauguuuuuguaaaacagaauauuuaauccuuauuuauuaaucucuugcuggagugguguaauguaucuaacuuuuagcaaaggaggguugcagagcagcuuaaauuuuuuuuauaauguauaagaauuuuguuuaucuuuuaagaguaguaaaguacuuugaguguuuggggguucaacacacacaugcaauuuugcuuaacaaaaguauuuuauaauacaguuucauacagaauuaccuuaaaagggagucuuauguuuucaacuacagauaguuguaagggaucauacagaagauauugaugauaguugaaauauucuuagaagggguguguaugucuagcugugucuaccauguguauguauucuugacaagcaguauaaaauaccugugauuuuucuuuacauuagggauaaugcauaaggaauuaaucuucauauauauuaucaucccuaauguagcagggggaaguauuuaauugcccaugauauguauuuuacuuauacuaugccagagaggaaacuauaaaguaauuacacauguaaucuuggguuuuucacauauguagguauucauuuugaguagguugaagaagaaaaaaaauauuuaaaugaauugaauuccugaugggauaguaucaauaaguauuuaaaagccaguauucuaaaaauaauaaaggguagggucauuuuugaguuuguuuuucuuuugcuauuguuaauauucaaaauuaaaguguuacauugguaccuguugucuuaaugcauuuauugagaacagcauugagaugaugaacaagggguuagcaauagcaaacucuauaauuauuuugacuaauuacuuaagaggaaaacaguauaaguaucucauucaguauuuagcaauucuguaaaauaaguauuaucucuauuuuucagaugaggaaguaaggguuuagcaagguuaagagaucuauccaauuuacacagcaaguuaguaguugagccugaccaugagucuucugacucuguucuuuucacuaugcaauacgcaaacaauaaaauguuauacaaauggaauau

SEQ ID NO: 17055 - RNA, 1243 nt, Homo sapiens
ugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaag

SEQ ID NO: 17056 - RNA, 11875 nt, Homo sapiens
agaacaaaauccagucucauagcagaggagaauauaauguuuacagcaccuuccagagccaugaaccagaguuugacuacuugaaaaguuuagaaauagaagaaaagaucaacaaaauuaggugguuaccccagaaaaaugcugcucaguuuuuauugucuaccaaugguaaguauacauauuuucuuuccaugugcccacuguguguaccuguugcacauauccuguagccuaggagaggaaucauuuaacagagauacuuguaaaaaggacuuuuguuuuucuauacagaauguaaacucuacuuuuuuacugucacuugcaguuuuuagauucucugaaagauucucugauagcaauuuuuuguuuacuacaccuccaauuuguagugaaaagaaugggcugcuauaccauuggauuuaggucagguaauauuucugucauuucucagucucguaaucuugggcagguuacuaacacugaauugaauuuuccucagcagcaaacuagagauagcaauuuuuuauuauaguauuauuaugaauauuaaauaacuucacauacaucaugagugcaagugcucaauaaauguuaauuuauuccuccuuuuuaaguguuuguaaacuacacagaguaucucaaacugcagauacaaaauacucaaaggauggucuccauuccaggauacgcuauaggagagcacuuucuuacuugaucaccauuagcauauugccuucuucccagcaauccacauggcuggaaggagauuccucuccuacuguuuacuugccaagggaacauuuuuuguuguuuuuugagacaaugucugucgcccaggcugaagugcauugguguaaucacagcucacugcagccucgaccucccuaccucagucuccugaguagcugggaccacaggugagugccaccacacccggcuaauuuuuuaaaaacauuuuuguagagacugggucucccuauguugcucaggcuggucuugaauuccugggcucaagcagucugccccgcucagucucccaaagugcugggauuacacgugugagccacuaugccuggcccaggaaaaguugagugaggauuaaaaguuaguaaugacaggccgggcgugguggcucacgccuguaaucccagcacuuuaggaggcugaggcggguggaucacgaggucaggagauugagaccauccuggcuaacauggugaaaccgugucucuacuaaaaauacaaaaaaauuauccgggugugguggcgggugccuguaguuccagcuacuggggcgggggugcugaggcaggagaauggggugaaccugggaggcagagcuugcagugagccgagaucgcgccauugcacuccagccugggcaacagagcgagacucgucucaaaaaaaaaaaaaaaaaguuaguaaugacucuaccagaauuugaaauccuuuaugaugaguugggugcuuucucuuuguucuuaugaaaaacuuuuuccugugaauuguuuggacuuuguuggggucuugagucuaaagggaaucauuagagugacugaggagauacuuuaguuucuggguagccguagucuauaaaaauuugugauuaaaacuuuuuugagguuggugcuagggugaggggaaccucuuauuuucucauccccucacuauuaauuuaaaaagcaaauucuaacaccuagaccauaaacauuugcagaauauauacuuaaaugacuucaggaugaaaugggggaagaaauucagcacuuccuccaucuaauugaugccccucguccacaguauuaguucuuagaaaugcuguucacaaaugccugauggccaucagcguuggccgccuccugggugcccguuuuucugaucaugaaagcuuuccccagccaguccauugagaugcguacccucugccuucucuguuuucacaauagacugcauuccccucucuuguccuuauuagaagaaaaauaaagagaaguaacuauuuaaagccuguaaaucacagcacuauggguggagggaacaguuuauuccugucauaugcuagcuucuagucuugggucaguuuuaauuuauaugguaaacuaaguuauuucaaauagcuucaaauauuuuagacacuguucuuuggcaucagaugauacauaauuaaaccauuuauauaauuucuacuuuuagaaguaaauguuccuagggaaauguguuguuaacauuuuauauauuggaauauuuuuaugucaguuuauuucuuauagggcuacaucagcuuucuuauaaagagaacuuuuuaaauguaggcugaguucaagagaauaguauagugaagcccugcaugcucaucauccacuucugacacuccucaguucauggcuaauuugugucucggauccuuccccuuccccuccuccucaguguuauuucgaagcaaauccgauuacaacgucuauggauuaaaucuuguuuaaagacauuagagaaugcauuguagauuuuugucuuuuguuucuuaauacuaaguaaaauacagcuaacugggggcugcauuuuuuaaugcuaaaauaagugcuuaauaauagaguccaauguggaaggauaaagcagauuaugagaaucauaugaacuguugugucuggguagaugggaaaaggaugggaggaguaggacuugaacuauaucugaaaaacuauuuggaaagaaggagacuuagagaaaaaugucaacaucuguugauucugagugauaucuuuuauauuauuuuguguauuuuucucugugaguuuuuucugugagcauaguaacaccccccccccccaauauaaugggucuauauaaaaacuauaucugugggagaaugauggaaaauaguaccaaacuuuccagguuugauuaaccaaaauuaaucuuauaaaaauauuugcauuggcuuuccaugaucauuauaugaacuggguuucccagaucauuuuuacuuaaaggacgucauagucaccuuauaacuugaguuaauuuaauguuccuucaagcauuuuaauucucuuucucuuuaaucuucuuuugcuccucugaauucucauuaauuccucuacauugcagaaaacaugaaacugaccugucaaccaugaguguuacauauaugaauaauguaaaguucacucauaaauagggugugucuuaacaacuucuugauaaguuuuuuagggucuuacauaaagcugcauucccacaaaggaaacggcagcgugguuuucccugcucauaccucucauaccuucugcuuguggugagaggaacucuguucuucugcaguuucuccaaugcuuuaguuauuaguguugauaauucaggggaacaccacaguguggucguuuuggaaggaacagaucuugagaaucuaauaacgucuccacugaaaacuguguuuuuacauaaucucacauacaguuuuauggaguuugauuauucucacauacuuugucuuaugggccaaaaacuccagguaauaaaauaucacugcuguagaacauaaggauucugauuuuuuaaaaauuuaugucauauuuauuaacauacugauuuauuuccugccugccuuguccccaccuuacugaaaaauguauccuaauucauauguguccuguguuuguguuaaggaaaaaacauuuuuuaaagagcuuucuuccuguaaacacuauuaggcaccacaaacuaauuuuaucucaucugaaaguuucauaaauacauugugguuucuuuauuuggaucuuuaauaaggaggauggauuuaaacaggccacaagacaacuggaccagggggcggggguguugucauccucaucacaaauacuuugcaaguauuuagaacaaauacuucucagaauacagauuuaggcuaggcucauaucuaucuauaaaucauauacauauauaaacuaaauaacacauagaaaaucuguaugacugaacuacaagaaaauuauaagcaaggucacauagggcuuagaagaaauaauagauuacagaugauuaaaguuagcaguuuuucucuguuuacacuucaucauugggaagggcauccuuaggggcaacuaucauucuucuguacgauacagagacugccaggcuagagucacuggcaucucucugaguuguuucuguuuuuauaaaauggcuuuauauacuguuauaaacaauuuuguuacaccauuuugcuuaugaaagaucguuaggaauguaugcuuuucuauaagaaaaacuguuauacaauuguaacaguuuuaaaucaacaugcaugagccuauagugauacaaauaaacaauugaauggauacauggagagcagggaugcuuccugcaggagaauucuaaauaagacguggauacauacucuucccuacagggaguauaacuuauuucucccuuuaaguacaggcuggauuuagugacucacuuccaaagaacagaauauggcaagggugaaagagucauuguauaguggagaagccuggcaaacauugucuuaaccaaaugacccaaguuaacgccaccagcuguaagucauguugauaccauguaucccuuugaacaaugcugugagaagucacuucaucucucuguucuguuccuaaaaacccauggucccagucugaucaugaggaaagagcaagcaaauccaguugagggauauucuacaaaguaccucaccaccacuacucaaaacugucaagaucaagaaaaauaaggagagccugagaaacuuaaaggcagagagacuaaggaaacuugaugacuaaaugcaguguuguuugaauucuggagcagaaaaggaauguuaguggaaaaccugguuaaaucuccaaaugcagucuguaguuaauaguaauauacaaagucgacgucuuaguuuugacacacguaccaugguugcguaagauguugacagaagaaacuggguaaaggauauauggaacacugcaauucuuguaacuuucuguaaaucuaaacuuaauuguaaaacaaaaguuuguuuuuaaacagaugccauuuuauauauccuugauaccuaggaauuugguuucuucuugaaggacuuggggauguaugcuuuuaaucaguuuucuucaggcccuguuuccuacuugugaacccugauacaagaaggggaaagguuuuaaaaaggaggcauccaguccuauggaggccucuguggaaucuuugauaggcucugcuaagaagugggagcaagggagagcagcuuuacuauuuugauucuacauaauaggcagucuuaaucaacuucauuguucccuuuaaauuuuuuaaaauucaguacugaacauguauauguuuacauguagguacagacauauauguguuugcauacaccacacaugcauaucaaguuuuucccucuagcuuuaauuacuuuuaagggacagggauagagaccugucugugacuugauuugacuaucacauggaauuuaugagugccaccaaucuuugcacuuuauuuccauguguguauguuauucagcugauaauaggaaauuuuuuaguaaguucagauuaggguuuuuuuuuuuuucguggaauccuuuuacgugaaaugugaaauagcauauuuuaaaugccuuaaaauguuuuucuucuucaguauuuuaaggacuuuucuuuauuuucuucccagauaaaacaauaaaauuauggaaaaucagugaaagggacaaaagaccagaaggguauaacuugaaagaggaggauggaagguauagagauccuacuacaguuacuacacuacgaguaaguacauaagaaaaaaaugucacagauagugcuuguauucauauuauauagcccaaauccugagcagagcuugaauaggaauaauuacagucuaucuccccuuucccaguaauucuguaaucagguaggacauugaguaacucauuuaaacauagaaacugaccuacauagaggucucacuuuggccagggacagaagcaggacucaagcacaagacaguauuucacgccaucagacuucaucucugguuugucauguuagcuaucacaaggucaaguuucaagauaaauuuucuuuggaaaucaaaaaaguagauacagaucaaaucuucuaguuguagcuaaaaaauaccaagaauuagauguuauggguuaauuuucuuuuuagccucuuuaaucugaaccauaaacauuuauuagcuuggcaugucuuucaagcaaaauauugaaacuaagaacugcaaauucuaauaguauugcaaccaguaaaagaagauauauuauccacauuguucauuuuuucuucagcacucgaaaggaucaacaucaguugcuuuuuaaaacuaaaucuauguaauauuguucuauuuuauguucucaaaaacugaaauaaugaaguuuucugaaucuuaauugcuauuugaaacugagccuuuuguaauuucuguuuuucaugugucuuauugacaggugccagucuuuaggccuauggaucuaaugguugaggccaguccacgaagaauauuugccaaugcucauacauaucacaucaacucaauuucuauuaauagugauuaugaaacauauuuaucugcagaugauuugcggauuaaucuuuggcaucuggaaauuacagacaggaguuuuaguauccauuugguuuucuuugguguuuggugaagaaggcauguugugcccauauuagauuuauuucaucucuccuaaugaauuugguugcuuuuuauagucuguguacauauauguauggcaccuuauuuuuuucuuuguagaugaguaaugaaauacuggaaaaaguuauuugcuaaacauaaagggcauaauguauugauuuaaaauuggauucauggaauuuuaaggaauuugucuauuguaucuauguaaauaggauuauuuuuuauaauuuagguuuuuguuuuaaaaaucacauuugugaggucuguguaugguagcuuaugccuguaaucccagcgguuugggaggcugaggugggaagaucacuugaggccaggaguucaagguuuacagugagcuugauugugccucugcacuccagcuuggaugacagagcaacacccugucucuaaaaaaauuuuuuuucuucuaaucaaauguaugaacuacuguauuugaauuuuuuauuguaaaaauagucucaccuggcugcggugacucagccuguaaucccagcacuuugggaggucaagguggguggaucaccuaaggucaguaguucaaaaccagccuggccaacauagugaaaccccgucucuccuaaaaauacaaaacauuagccgggcaugguggcgcaugccuguaaucuaagcuacaugggaggcugaguuaggagaauugcuugaaccugggagauagagguugcagugagcugagauugugccauugcacuccagccugggcaacaagagugaaacucugucucaaaaaauauauauauauagauuuauauauauuauauuaauugauauuaagauuagauuaagauuagauuaagauuaaucuuaagauuagauuaagauuaauuuuaagauuagaaaaagauuaauaauuagauuagauuagaaaaagauuagaaaaagaaagauuaaagauuacgauuagauuaagauuagaaaaagaaauucacgcaagucaugaugcaugauuggguaaauaaaaauauucuauugaggccgggcacagugacucaugccuguaaucccagcacuuugggaggcugaggcgaggcggauggaucaugaggucaggaggucgagaccagccuggccaacauagugaaaccccgucucuacuaaaaauacaaaaaaaaaaaaaaauuagucaguuguaguggugugcgccuguaaucccagcuuuucuggagacugaugcaguagaaucgcuugaaccugggagucggaggcugcagugagccgagauugcgccacugcacuccagccugggugacagagugaaacuccgucuaaauaaaaauuaaaaaaaaaaguuuuaaucccuuuggaauuuauacucauaaaaacaguggagugcaauucagaauuaauauuuuugcuuagguccaugaauggguuuuagguuugagaaauguagaauuauauuugcccuuuuuucuaaguggaaauuccuuaauaaaauguuaucuagacauuguggauaucaagccugccaauauggaagagcuaacagaggugauuacagcagcagaauuucauccaaacagcuguaacacauuuguauacagcagcaguaaaggaacuauucggcuaugugacaugagggcaucugcccucugugauagacauucuaaauguaaguuuauuguaucuuuccuuaaaaugauuacauauucuguuugucugaaauaagccucagacaugauaaguacaauuacagagguucaaagucuuaaacccguguguccagagccacuuguacccuugguaaucugccuaccuccucaugaggcauuccagguuauuccuggaagcucucuuggggggcaugucuauugauugccaaggaauauaucucucauggaaugcuguuguucuuugguaacuugcgguugggcucuguaaccuuguauugaaguagagcuguuccuuucuuucccauccucccuuccuacuuugagcuuccuaggaagauuucuucugagguuuccuuggcuuaaaaaaaaaaaaaaaaaaacaacuuugguuuaaaaacuucaggauacaauauucuugucuuguugaauauuaacucaugaaaauugauacaugccuguuaccaaaauaauuuuaccuggcuacuagaaaauaagauccugguaugaauuugggaugggcgaggaugguguguuucucauggugaugauacaggcagucagugaggcauauugcaggaauaauaccaauaaaccuggugcacugaagucagaagucccaggugagucugguucuaaauuagucauaugacuggaaguauacugcauacuuaugcaucuucaacuucaauauucaauuaaacuaagaagcuuucaggagaauucuagccagagagauguuuuucaguucuuuauuagccuggcauuuuaccucacuuguagggaguuugugaaugguuguuuaggaaaugcuuuguccaagccagaauauuguacaccuugcccuuuuuguguuguuuuguuuuguuuuuaguguuugaagaaccugaagaucccaguaacaggucauuuuuuuccgaaaucaucuccucuauuucggauguaaaauucagccauaguggucgauauaugaugacuagagacuauuugucagucaaaauuugggacuuaaauauggaaaacaggccuguggaaacauaccagguauuugaguuuuuucuuucaaugagcauauacccuguuuacuuugaaguguuuauagagaaggauuuuguuacuagguuuuaaucccuguaugguguuuguucaccauuaggccuuuucccucagagaucuaugaguauguugcucuuccuuauguuaaauguauauauacuuacauagguuguguugucucuugaguuuugcaguuaaagugugauuuugcuacccauuugguucaguauugacauuguuuuuuuuucugccacuauguacauuuaaagugaggauggaagagcacccuucauugaggucugggcaggaagaggauuggagaaaguggccaguccuuaguagaggugcaccugcucagguugugggaguaguugaacuagagauuaaauuuggugugccaagucaaauggacugguguucugccuuuuggcagauaacuguugucuucagcuaaaagaaagggcuugaaagccuuagcagauggcuuuaggaguugccuauccguuguuggaugucaguucuugauucucuuaucagccagccacuacuguuuauccguguccacuacaucaaacagaagagaaugaaguacacagccuggaacagggugagggacagcacaaaccugugcuaggcccuagacugcaguguugaaaucacuuaacucuaauuuauacauauacuuucuuuauguuauauauucucaauagacugggaaguauguuucucaaacuuuaaauccucugacaaacauaaacgaagauuguuuuugauacgugaaauuucaaaauaaauacugcacugaaacaaaagacaaaauacugcuuugcuuuucaaaguauaguucacuauugagcaacauggauuugaacugcauggguucacucauacacagauuuuuuguuuuguuuuguucaaccaaugcacauuugaaaauacaauauuugagggaugcaaaccccucaaauauauggagggccaaaacuucacguguggguuccgcagggcuaacugcagauuuggguauaccugggguucuuggaacccaucccucguguauacugaaaaaagacuucuauuuguguaacugccaagauugauauaucuccuaguuacccucaccaucauuucauucccauugagaagaauugauuugaagcuuagcuucauacugauguauagugagaaacucuauaaugugcauucuaaaauguugcuaaauuaugauaaucuaccuaauuuuaccugauuugcuacuuuucuacuuauaaacaguuggaguagugauuaaaaguagucacauuauaggcaaauguaucauauauagauaaaacuauuuuuauugaauuuguaccagcaucuugccaaguuuugugugauugaaggguauuuuuuucuuacugauuuuuuuguguuacaugcucacuuuugauccuaaccccacaugaguugcuauuccucuguauuacagauuuucacuuaaugucacagagacauggccugaaucauuccacuauauuuaaaguuaaaauagacacugaaaauaaguuuagauuguuucauauagaauagagaauucuaagcauuuagaagguaccuucucauuucugucauuucuccuuaaguagcuccuuaaaaagagauggugaaauauagacacuuccuuuuuuccuuugaguuacaacaaauacuuuggaacuuuuguuuguaauuaauauuaauguugaaauaugucauauuucucagacuuuuuaaauaugagauuucuaguuuauccuuuuuugacauauuaguaaauacagaauuauauaauucaaaaaacaggcacagcuuuguuagcuuuugacauuguauaauaugauacuaucaaauuuuuaauaauauaugcccagaauaaccauauaauuuaucaccaaaccaaggcaugguuacgcuaugcauacaugugcauuuauaauggaaaauauaggcuucaguuaaauuuaugcccagaaaaugguauuuaagaaagaaauaggcacaguuucaguguuguuaucaguaguuaauggacugaaagccaagaauagugauauucagauauugcuauaauguucuuuuauuagucucuuaacugugccauuuucaaguguuuuuggccugaauguuuuauucaggcuuauaaaggcuaugugugccaugcccagaauggaguuuuccuuugucauaccaguaggaaaauguaccucccugaagggcuuguguguuuuguaaaaggacaaaaugccuuuauuguuacugagaagauugagauuaauagguuuaaaagguguguguaugugucuguauaugcccuuuuuuucuuuuuaaagauauggacuuguuaaaucauuuuccuaauuucagugcaguauauuuguauuuuucccccaggugcaugaauaccucagaaguaaacu
